United States Patent 11,926,839 (PLATFORM FOR T LYMPHOCYTE GENOME ENGINEERING AND IN VIVO HIGH-THROUGHPUT SCREENING THEREOF) - sequence listing, part 5

SEQ ID NO: 105465 - RNA, 20 nt, Artificial Sequence
  MKO10105465_B_Olfr689
  gRNA
acuuggaauugacaugauuc

SEQ ID NO: 105466 - RNA, 20 nt, Artificial Sequence
  MKO10105466_B_Olfr68
  gRNA
agagagucacuaauguuucu

SEQ ID NO: 105467 - RNA, 20 nt, Artificial Sequence
  MKO10105467_B_Olfr68
  gRNA
cauuugaugaguaguaugga

SEQ ID NO: 105468 - RNA, 20 nt, Artificial Sequence
  MKO10105468_B_Olfr68
  gRNA
ugguaguuugaaaguacuua

SEQ ID NO: 105469 - RNA, 20 nt, Artificial Sequence
  MKO10105469_B_Olfr690
  gRNA
uauguacauugcugcagucu

SEQ ID NO: 105470 - RNA, 20 nt, Artificial Sequence
  MKO10105470_B_Olfr690
  gRNA
gaaaaaugacccuggccauc

SEQ ID NO: 105471 - RNA, 20 nt, Artificial Sequence
  MKO10105471_B_Olfr690
  gRNA
ggugccaauggcuucaguuu

SEQ ID NO: 105472 - RNA, 20 nt, Artificial Sequence
  MKO10105472_B_Olfr691
  gRNA
aaugggggacgauguugguu

SEQ ID NO: 105473 - RNA, 20 nt, Artificial Sequence
  MKO10105473_B_Olfr691
  gRNA
aguguuucgcuugcccuccc

SEQ ID NO: 105474 - RNA, 20 nt, Artificial Sequence
  MKO10105474_B_Olfr691
  gRNA
agggcaagcgaaacacugcu

SEQ ID NO: 105475 - RNA, 20 nt, Artificial Sequence
  MKO10105475_B_Olfr692
  gRNA
uacccaggaggcccgaguaa

SEQ ID NO: 105476 - RNA, 20 nt, Artificial Sequence
  MKO10105476_B_Olfr692
  gRNA
cuauagauguggcuaagccc

SEQ ID NO: 105477 - RNA, 20 nt, Artificial Sequence
  MKO10105477_B_Olfr692
  gRNA
uuuacucgggccuccugggu

SEQ ID NO: 105478 - RNA, 20 nt, Artificial Sequence
  MKO10105478_B_Olfr693
  gRNA
caccuccagauaucaacuca

SEQ ID NO: 105479 - RNA, 20 nt, Artificial Sequence
  MKO10105479_B_Olfr693
  gRNA
gggguacugcauaguguaga

SEQ ID NO: 105480 - RNA, 20 nt, Artificial Sequence
  MKO10105480_B_Olfr693
  gRNA
uaucagucccaaagcuguca

SEQ ID NO: 105481 - RNA, 20 nt, Artificial Sequence
  MKO10105481_B_Olfr694
  gRNA
uuaccauguaucuucugcua

SEQ ID NO: 105482 - RNA, 20 nt, Artificial Sequence
  MKO10105482_B_Olfr694
  gRNA
gcugcacaugcccucaaaug

SEQ ID NO: 105483 - RNA, 20 nt, Artificial Sequence
  MKO10105483_B_Olfr694
  gRNA
cuagagcacugagagaugca

SEQ ID NO: 105484 - RNA, 20 nt, Artificial Sequence
  MKO10105484_B_Olfr695
  gRNA
ggaagucuucaacuccaccu

SEQ ID NO: 105485 - RNA, 20 nt, Artificial Sequence
  MKO10105485_B_Olfr695
  gRNA
ugggaaugauaacugauggu

SEQ ID NO: 105486 - RNA, 20 nt, Artificial Sequence
  MKO10105486_B_Olfr695
  gRNA
aaaguauagugcuaugauaa

SEQ ID NO: 105487 - RNA, 20 nt, Artificial Sequence
  MKO10105487_B_Olfr697
  gRNA
gccaccaccccauacauuua

SEQ ID NO: 105488 - RNA, 20 nt, Artificial Sequence
  MKO10105488_B_Olfr697
  gRNA
uggucagugccaguguguac

SEQ ID NO: 105489 - RNA, 20 nt, Artificial Sequence
  MKO10105489_B_Olfr697
  gRNA
auuauucuuucugcaaaucg

SEQ ID NO: 105490 - RNA, 20 nt, Artificial Sequence
  MKO10105490_B_Olfr698
  gRNA
uuucuacacgauugucacuc

SEQ ID NO: 105491 - RNA, 20 nt, Artificial Sequence
  MKO10105491_B_Olfr698
  gRNA
gacaacacagaauggagcuc

SEQ ID NO: 105492 - RNA, 20 nt, Artificial Sequence
  MKO10105492_B_Olfr698
  gRNA
cuguccaaguagaagauaca

SEQ ID NO: 105493 - RNA, 20 nt, Artificial Sequence
  MKO10105493_B_Olfr699
  gRNA
guaccuauguaccuucugcu

SEQ ID NO: 105494 - RNA, 20 nt, Artificial Sequence
  MKO10105494_B_Olfr699
  gRNA
cccuaaaaaguagacugugu

SEQ ID NO: 105495 - RNA, 20 nt, Artificial Sequence
  MKO10105495_B_Olfr699
  gRNA
agaagggauauugcauugua

SEQ ID NO: 105496 - RNA, 20 nt, Artificial Sequence
  MKO10105496_B_Olfr69
  gRNA
cccacuaguguuaaaacaga

SEQ ID NO: 105497 - RNA, 20 nt, Artificial Sequence
  MKO10105497_B_Olfr69
  gRNA
cgugaugaagauucgcacau

SEQ ID NO: 105498 - RNA, 20 nt, Artificial Sequence
  MKO10105498_B_Olfr69
  gRNA
uugagcugccaauuucacaa

SEQ ID NO: 105499 - RNA, 20 nt, Artificial Sequence
  MKO10105499_B_Olfr6
  gRNA
gaaggccuuccgcugcccag

SEQ ID NO: 105500 - RNA, 20 nt, Artificial Sequence
  MKO10105500_B_Olfr6
  gRNA
agcuuguaugaacuuaucua

SEQ ID NO: 105501 - RNA, 20 nt, Artificial Sequence
  MKO10105501_B_Olfr6
  gRNA
uaaaaguacacauucaguac

SEQ ID NO: 105502 - RNA, 20 nt, Artificial Sequence
  MKO10105502_B_Olfr700
  gRNA
gagcaggauuaguguauaag

SEQ ID NO: 105503 - RNA, 20 nt, Artificial Sequence
  MKO10105503_B_Olfr700
  gRNA
acuuagaauguagaguguuc

SEQ ID NO: 105504 - RNA, 20 nt, Artificial Sequence
  MKO10105504_B_Olfr700
  gRNA
cccaaccacaguuagaugug

SEQ ID NO: 105505 - RNA, 20 nt, Artificial Sequence
  MKO10105505_B_Olfr701
  gRNA
gguacauggguacgugaagc

SEQ ID NO: 105506 - RNA, 20 nt, Artificial Sequence
  MKO10105506_B_Olfr701
  gRNA
agaugcuaggauccaugaua

SEQ ID NO: 105507 - RNA, 20 nt, Artificial Sequence
  MKO10105507_B_Olfr701
  gRNA
accaugagccugcaggccuu

SEQ ID NO: 105508 - RNA, 20 nt, Artificial Sequence
  MKO10105508_B_Olfr702
  gRNA
gccaguuggcuauaguuucc

SEQ ID NO: 105509 - RNA, 20 nt, Artificial Sequence
  MKO10105509_B_Olfr702
  gRNA
ugacaccuauaaugcugaaa

SEQ ID NO: 105510 - RNA, 20 nt, Artificial Sequence
  MKO10105510_B_Olfr702
  gRNA
uggggcauuugcauguucag

SEQ ID NO: 105511 - RNA, 20 nt, Artificial Sequence
  MKO10105511_B_Olfr703
  gRNA
aguaaacagaauucguacau

SEQ ID NO: 105512 - RNA, 20 nt, Artificial Sequence
  MKO10105512_B_Olfr703
  gRNA
cuagggcuaucacugaugcc

SEQ ID NO: 105513 - RNA, 20 nt, Artificial Sequence
  MKO10105513_B_Olfr703
  gRNA
cuggcaucagugauagcccu

SEQ ID NO: 105514 - RNA, 20 nt, Artificial Sequence
  MKO10105514_B_Olfr704
  gRNA
caguaccaagugucaaagcc

SEQ ID NO: 105515 - RNA, 20 nt, Artificial Sequence
  MKO10105515_B_Olfr704
  gRNA
uuugacacuugguacugcag

SEQ ID NO: 105516 - RNA, 20 nt, Artificial Sequence
  MKO10105516_B_Olfr704
  gRNA
gcugcacaugcccucuaaug

SEQ ID NO: 105517 - RNA, 20 nt, Artificial Sequence
  MKO10105517_B_Olfr705
  gRNA
auggguccuagcaucucuga

SEQ ID NO: 105518 - RNA, 20 nt, Artificial Sequence
  MKO10105518_B_Olfr705
  gRNA
uuugcaauaggaauacugca

SEQ ID NO: 105519 - RNA, 20 nt, Artificial Sequence
  MKO10105519_B_Olfr705
  gRNA
gccagcacacccuacucucu

SEQ ID NO: 105520 - RNA, 20 nt, Artificial Sequence
  MKO10105520_B_Olfr706
  gRNA
auggcucuagcauugaugcu

SEQ ID NO: 105521 - RNA, 20 nt, Artificial Sequence
  MKO10105521_B_Olfr706
  gRNA
agugucuacaucauggaucc

SEQ ID NO: 105522 - RNA, 20 nt, Artificial Sequence
  MKO10105522_B_Olfr706
  gRNA
ccagcacaccuuacucuuua

SEQ ID NO: 105523 - RNA, 20 nt, Artificial Sequence
  MKO10105523_B_Olfr707
  gRNA
ugugacagaauucaucuucc

SEQ ID NO: 105524 - RNA, 20 nt, Artificial Sequence
  MKO10105524_B_Olfr707
  gRNA
caguggugcacuuguguccc

SEQ ID NO: 105525 - RNA, 20 nt, Artificial Sequence
  MKO10105525_B_Olfr707
  gRNA
caggagguucacagaaaaag

SEQ ID NO: 105526 - RNA, 20 nt, Artificial Sequence
  MKO10105526_B_Olfr70
  gRNA
ccguuaauaucagcgcguug

SEQ ID NO: 105527 - RNA, 20 nt, Artificial Sequence
  MKO10105527_B_Olfr70
  gRNA
acuccguuguaccuagggcc

SEQ ID NO: 105528 - RNA, 20 nt, Artificial Sequence
  MKO10105528_B_Olfr70
  gRNA
agcggcccauucacgagcuc

SEQ ID NO: 105529 - RNA, 20 nt, Artificial Sequence
  MKO10105529_B_Olfr710
  gRNA
uucugcuaguuguaggaucc

SEQ ID NO: 105530 - RNA, 20 nt, Artificial Sequence
  MKO10105530_B_Olfr710
  gRNA
ugaacuccgucagauaagug

SEQ ID NO: 105531 - RNA, 20 nt, Artificial Sequence
  MKO10105531_B_Olfr710
  gRNA
acugugguucaaauacaauc

SEQ ID NO: 105532 - RNA, 20 nt, Artificial Sequence
  MKO10105532_B_Olfr711
  gRNA
ugagcuaguagacuuugcuu

SEQ ID NO: 105533 - RNA, 20 nt, Artificial Sequence
  MKO10105533_B_Olfr711
  gRNA
augaugacuggauaucgaag

SEQ ID NO: 105534 - RNA, 20 nt, Artificial Sequence
  MKO10105534_B_Olfr711
  gRNA
uuguaauuauauucacuguc

SEQ ID NO: 105535 - RNA, 20 nt, Artificial Sequence
  MKO10105535_B_Olfr713
  gRNA
aacuuauccuucuuagagau

SEQ ID NO: 105536 - RNA, 20 nt, Artificial Sequence
  MKO10105536_B_Olfr713
  gRNA
aaucagaguccccaacauuu

SEQ ID NO: 105537 - RNA, 20 nt, Artificial Sequence
  MKO10105537_B_Olfr713
  gRNA
cuucaagccucacuuacuuu

SEQ ID NO: 105538 - RNA, 20 nt, Artificial Sequence
  MKO10105538_B_Olfr714
  gRNA
aauagcugaauuuauccuca

SEQ ID NO: 105539 - RNA, 20 nt, Artificial Sequence
  MKO10105539_B_Olfr714
  gRNA
aaucagaguccucaacauuu

SEQ ID NO: 105540 - RNA, 20 nt, Artificial Sequence
  MKO10105540_B_Olfr714
  gRNA
gucccuugguucaugaugau

SEQ ID NO: 105541 - RNA, 20 nt, Artificial Sequence
  MKO10105541_B_Olfr715
  gRNA
ccugcuugagaaguucuuca

SEQ ID NO: 105542 - RNA, 20 nt, Artificial Sequence
  MKO10105542_B_Olfr715
  gRNA
ccaugaagaacuucucaagc

SEQ ID NO: 105543 - RNA, 20 nt, Artificial Sequence
  MKO10105543_B_Olfr715
  gRNA
uacuucucauguuccuuguu

SEQ ID NO: 105544 - RNA, 20 nt, Artificial Sequence
  MKO10105544_B_Olfr716
  gRNA
guuccgaagacuauaaauua

SEQ ID NO: 105545 - RNA, 20 nt, Artificial Sequence
  MKO10105545_B_Olfr716
  gRNA
cccuaggguccugggccagu

SEQ ID NO: 105546 - RNA, 20 nt, Artificial Sequence
  MKO10105546_B_Olfr716
  gRNA
gcuuuccaucuucccuaucg

SEQ ID NO: 105547 - RNA, 20 nt, Artificial Sequence
  MKO10105547_B_Olfr71
  gRNA
cagagacggucaucgccaug

SEQ ID NO: 105548 - RNA, 20 nt, Artificial Sequence
  MKO10105548_B_Olfr71
  gRNA
ccguaaaggagauggucuuc

SEQ ID NO: 105549 - RNA, 20 nt, Artificial Sequence
  MKO10105549_B_Olfr71
  gRNA
ugaagugucugaucacgugg

SEQ ID NO: 105550 - RNA, 20 nt, Artificial Sequence
  MKO10105550_B_Olfr720
  gRNA
cauaugugccacguucuuca

SEQ ID NO: 105551 - RNA, 20 nt, Artificial Sequence
  MKO10105551_B_Olfr720
  gRNA
cacuauugugccuaagauuu

SEQ ID NO: 105552 - RNA, 20 nt, Artificial Sequence
  MKO10105552_B_Olfr720
  gRNA
auaggcuuggggaagcauau

SEQ ID NO: 105553 - RNA, 20 nt, Artificial Sequence
  MKO10105553_B_Olfr722
  gRNA
uucaccauuagaucagacuc

SEQ ID NO: 105554 - RNA, 20 nt, Artificial Sequence
  MKO10105554_B_Olfr722
  gRNA
gucauucucuaccacguaaa

SEQ ID NO: 105555 - RNA, 20 nt, Artificial Sequence
  MKO10105555_B_Olfr722
  gRNA
cugaaaucagugcgaagacc

SEQ ID NO: 105556 - RNA, 20 nt, Artificial Sequence
  MKO10105556_B_Olfr723
  gRNA
cauacacacaaugagccaga

SEQ ID NO: 105557 - RNA, 20 nt, Artificial Sequence
  MKO10105557_B_Olfr723
  gRNA
guuuccaagaagaaaguaca

SEQ ID NO: 105558 - RNA, 20 nt, Artificial Sequence
  MKO10105558_B_Olfr723
  gRNA
ucucccauguacuuucuucu

SEQ ID NO: 105559 - RNA, 20 nt, Artificial Sequence
  MKO10105559_B_Olfr724
  gRNA
uuucagcaccccccaaaaaa

SEQ ID NO: 105560 - RNA, 20 nt, Artificial Sequence
  MKO10105560_B_Olfr724
  gRNA
cauacacaccaugagccaga

SEQ ID NO: 105561 - RNA, 20 nt, Artificial Sequence
  MKO10105561_B_Olfr724
  gRNA
gaauaaauggauuauaaaaa

SEQ ID NO: 105562 - RNA, 20 nt, Artificial Sequence
  MKO10105562_B_Olfr725
  gRNA
guuuaaaaugggcgugaaga

SEQ ID NO: 105563 - RNA, 20 nt, Artificial Sequence
  MKO10105563_B_Olfr725
  gRNA
aguaauuaaaaccacagugu

SEQ ID NO: 105564 - RNA, 20 nt, Artificial Sequence
  MKO10105564_B_Olfr725
  gRNA
aucaguucagaaaccugccu

SEQ ID NO: 105565 - RNA, 20 nt, Artificial Sequence
  MKO10105565_B_Olfr726
  gRNA
augccaacugacucauugua

SEQ ID NO: 105566 - RNA, 20 nt, Artificial Sequence
  MKO10105566_B_Olfr726
  gRNA
cauccauacaaugagucagu

SEQ ID NO: 105567 - RNA, 20 nt, Artificial Sequence
  MKO10105567_B_Olfr726
  gRNA
auuaauucagaaacuugucc

SEQ ID NO: 105568 - RNA, 20 nt, Artificial Sequence
  MKO10105568_B_Olfr727
  gRNA
gucaacugaauagcugcuaa

SEQ ID NO: 105569 - RNA, 20 nt, Artificial Sequence
  MKO10105569_B_Olfr727
  gRNA
aucaaugcagaaaccugucc

SEQ ID NO: 105570 - RNA, 20 nt, Artificial Sequence
  MKO10105570_B_Olfr727
  gRNA
uugcuaauaguugcagauag

SEQ ID NO: 105571 - RNA, 20 nt, Artificial Sequence
  MKO10105571_B_Olfr728
  gRNA
uaucauaccacuguuagcca

SEQ ID NO: 105572 - RNA, 20 nt, Artificial Sequence
  MKO10105572_B_Olfr728
  gRNA
gugcauggauacguacagaa

SEQ ID NO: 105573 - RNA, 20 nt, Artificial Sequence
  MKO10105573_B_Olfr728
  gRNA
gcacgcaagcuuuaucacca

SEQ ID NO: 105574 - RNA, 20 nt, Artificial Sequence
  MKO10105574_B_Olfr729
  gRNA
aguaauguaugagucaaugc

SEQ ID NO: 105575 - RNA, 20 nt, Artificial Sequence
  MKO10105575_B_Olfr729
  gRNA
cacaagacuauaucauucag

SEQ ID NO: 105576 - RNA, 20 nt, Artificial Sequence
  MKO10105576_B_Olfr729
  gRNA
cauuacugaaauacuuauug

SEQ ID NO: 105577 - RNA, 20 nt, Artificial Sequence
  MKO10105577_B_Olfr730
  gRNA
gaccugacucauugaaugca

SEQ ID NO: 105578 - RNA, 20 nt, Artificial Sequence
  MKO10105578_B_Olfr730
  gRNA
aaccaugcauucaaugaguc

SEQ ID NO: 105579 - RNA, 20 nt, Artificial Sequence
  MKO10105579_B_Olfr730
  gRNA
augaauccagaugaugaaug

SEQ ID NO: 105580 - RNA, 20 nt, Artificial Sequence
  MKO10105580_B_Olfr731
  gRNA
aguccaaguaacacgaauuc

SEQ ID NO: 105581 - RNA, 20 nt, Artificial Sequence
  MKO10105581_B_Olfr731
  gRNA
cuaguugacucauugugugu

SEQ ID NO: 105582 - RNA, 20 nt, Artificial Sequence
  MKO10105582_B_Olfr731
  gRNA
gucuucaugguagcaaccag

SEQ ID NO: 105583 - RNA, 20 nt, Artificial Sequence
  MKO10105583_B_Olfr732
  gRNA
agccaacaacaucacauagc

SEQ ID NO: 105584 - RNA, 20 nt, Artificial Sequence
  MKO10105584_B_Olfr732
  gRNA
guaacccuucacccccucca

SEQ ID NO: 105585 - RNA, 20 nt, Artificial Sequence
  MKO10105585_B_Olfr732
  gRNA
aggaugaucaggauauuucc

SEQ ID NO: 105586 - RNA, 20 nt, Artificial Sequence
  MKO10105586_B_Olfr733
  gRNA
cucaccaucauaucagaccc

SEQ ID NO: 105587 - RNA, 20 nt, Artificial Sequence
  MKO10105587_B_Olfr733
  gRNA
gugaauaaauccuccaagcc

SEQ ID NO: 105588 - RNA, 20 nt, Artificial Sequence
  MKO10105588_B_Olfr733
  gRNA
ugcucuaucagcugacaaag

SEQ ID NO: 105589 - RNA, 20 nt, Artificial Sequence
  MKO10105589_B_Olfr734
  gRNA
uccuuauuaucugcacaauc

SEQ ID NO: 105590 - RNA, 20 nt, Artificial Sequence
  MKO10105590_B_Olfr734
  gRNA
cuucguacauucuauaauac

SEQ ID NO: 105591 - RNA, 20 nt, Artificial Sequence
  MKO10105591_B_Olfr734
  gRNA
uugagcaauacacccaccaa

SEQ ID NO: 105592 - RNA, 20 nt, Artificial Sequence
  MKO10105592_B_Olfr735
  gRNA
caacccuuugcacuaccuga

SEQ ID NO: 105593 - RNA, 20 nt, Artificial Sequence
  MKO10105593_B_Olfr735
  gRNA
gcuaggagauuuccuacaga

SEQ ID NO: 105594 - RNA, 20 nt, Artificial Sequence
  MKO10105594_B_Olfr735
  gRNA
aaccaaguaaguguccaugc

SEQ ID NO: 105595 - RNA, 20 nt, Artificial Sequence
  MKO10105595_B_Olfr736
  gRNA
uacacccauguacauucugc

SEQ ID NO: 105596 - RNA, 20 nt, Artificial Sequence
  MKO10105596_B_Olfr736
  gRNA
guucauauaccuuagugcug

SEQ ID NO: 105597 - RNA, 20 nt, Artificial Sequence
  MKO10105597_B_Olfr736
  gRNA
augauaacauauguaagccc

SEQ ID NO: 105598 - RNA, 20 nt, Artificial Sequence
  MKO10105598_B_Olfr738
  gRNA
caacuuccucucugacacga

SEQ ID NO: 105599 - RNA, 20 nt, Artificial Sequence
  MKO10105599_B_Olfr738
  gRNA
gauuugccccuccuuggggc

SEQ ID NO: 105600 - RNA, 20 nt, Artificial Sequence
  MKO10105600_B_Olfr738
  gRNA
ccagcugcauguucagaugu

SEQ ID NO: 105601 - RNA, 20 nt, Artificial Sequence
  MKO10105601_B_Olfr739
  gRNA
gaucccaugaugcagaaaaa

SEQ ID NO: 105602 - RNA, 20 nt, Artificial Sequence
  MKO10105602_B_Olfr739
  gRNA
caacuuccucucugaaaaca

SEQ ID NO: 105603 - RNA, 20 nt, Artificial Sequence
  MKO10105603_B_Olfr739
  gRNA
gcccagaaaaccuccaucaa

SEQ ID NO: 105604 - RNA, 20 nt, Artificial Sequence
  MKO10105604_B_Olfr73
  gRNA
uacgguaugccuggaguucu

SEQ ID NO: 105605 - RNA, 20 nt, Artificial Sequence
  MKO10105605_B_Olfr73
  gRNA
uagguacacaguauaggaau

SEQ ID NO: 105606 - RNA, 20 nt, Artificial Sequence
  MKO10105606_B_Olfr73
  gRNA
uggggcuguguucacccucu

SEQ ID NO: 105607 - RNA, 20 nt, Artificial Sequence
  MKO10105607_B_Olfr740
  gRNA
cacacccauguaccuacugc

SEQ ID NO: 105608 - RNA, 20 nt, Artificial Sequence
  MKO10105608_B_Olfr740
  gRNA
guccagaaaaccuccauuaa

SEQ ID NO: 105609 - RNA, 20 nt, Artificial Sequence
  MKO10105609_B_Olfr740
  gRNA
cauuccagcuucaugcucag

SEQ ID NO: 105610 - RNA, 20 nt, Artificial Sequence
  MKO10105610_B_Olfr741
  gRNA
uuccagagucccauugauag

SEQ ID NO: 105611 - RNA, 20 nt, Artificial Sequence
  MKO10105611_B_Olfr741
  gRNA
accagaaaaccucuaucaau

SEQ ID NO: 105612 - RNA, 20 nt, Artificial Sequence
  MKO10105612_B_Olfr741
  gRNA
cacccccauguaccuucugc

SEQ ID NO: 105613 - RNA, 20 nt, Artificial Sequence
  MKO10105613_B_Olfr742
  gRNA
aaaaaggccuucuccacuug

SEQ ID NO: 105614 - RNA, 20 nt, Artificial Sequence
  MKO10105614_B_Olfr742
  gRNA
cacccccauguacuuccugc

SEQ ID NO: 105615 - RNA, 20 nt, Artificial Sequence
  MKO10105615_B_Olfr742
  gRNA
guuggccagcaggaaguaca

SEQ ID NO: 105616 - RNA, 20 nt, Artificial Sequence
  MKO10105616_B_Olfr743
  gRNA
aauuauaaugucuauucucc

SEQ ID NO: 105617 - RNA, 20 nt, Artificial Sequence
  MKO10105617_B_Olfr743
  gRNA
aaaugaucuuguugucagag

SEQ ID NO: 105618 - RNA, 20 nt, Artificial Sequence
  MKO10105618_B_Olfr743
  gRNA
ugucuaccuacucauccuca

SEQ ID NO: 105619 - RNA, 20 nt, Artificial Sequence
  MKO10105619_B_Olfr744
  gRNA
ggaccuucaauacagcugcu

SEQ ID NO: 105620 - RNA, 20 nt, Artificial Sequence
  MKO10105620_B_Olfr744
  gRNA
gguccuagcagcuguauuga

SEQ ID NO: 105621 - RNA, 20 nt, Artificial Sequence
  MKO10105621_B_Olfr744
  gRNA
uagagaagaccagcucaauu

SEQ ID NO: 105622 - RNA, 20 nt, Artificial Sequence
  MKO10105622_B_Olfr745
  gRNA
acuaccccucuaucaugacu

SEQ ID NO: 105623 - RNA, 20 nt, Artificial Sequence
  MKO10105623_B_Olfr745
  gRNA
ucacccagcagauacaaauc

SEQ ID NO: 105624 - RNA, 20 nt, Artificial Sequence
  MKO10105624_B_Olfr745
  gRNA
acacaggauagugcaaacaa

SEQ ID NO: 105625 - RNA, 20 nt, Artificial Sequence
  MKO10105625_B_Olfr746
  gRNA
guaccccuacacacaucaua

SEQ ID NO: 105626 - RNA, 20 nt, Artificial Sequence
  MKO10105626_B_Olfr746
  gRNA
auguaugucagccccacauc

SEQ ID NO: 105627 - RNA, 20 nt, Artificial Sequence
  MKO10105627_B_Olfr746
  gRNA
acucuuaucauuauucucac

SEQ ID NO: 105628 - RNA, 20 nt, Artificial Sequence
  MKO10105628_B_Olfr747
  gRNA
auuacccuacuaucaugacu

SEQ ID NO: 105629 - RNA, 20 nt, Artificial Sequence
  MKO10105629_B_Olfr747
  gRNA
gcucugaggaaaguucuguu

SEQ ID NO: 105630 - RNA, 20 nt, Artificial Sequence
  MKO10105630_B_Olfr747
  gRNA
augugcuacugaucuguuca

SEQ ID NO: 105631 - RNA, 20 nt, Artificial Sequence
  MKO10105631_B_Olfr748
  gRNA
ggauccaaggauguacaaac

SEQ ID NO: 105632 - RNA, 20 nt, Artificial Sequence
  MKO10105632_B_Olfr748
  gRNA
guaccccuacacccaucaua

SEQ ID NO: 105633 - RNA, 20 nt, Artificial Sequence
  MKO10105633_B_Olfr748
  gRNA
cucaccuguuuguacauccu

SEQ ID NO: 105634 - RNA, 20 nt, Artificial Sequence
  MKO10105634_B_Olfr749
  gRNA
auuacccuaccaucaugacu

SEQ ID NO: 105635 - RNA, 20 nt, Artificial Sequence
  MKO10105635_B_Olfr749
  gRNA
gcucugagaaauguucuguu

SEQ ID NO: 105636 - RNA, 20 nt, Artificial Sequence
  MKO10105636_B_Olfr749
  gRNA
agagugauaccacaacuaaa

SEQ ID NO: 105637 - RNA, 20 nt, Artificial Sequence
  MKO10105637_B_Olfr74
  gRNA
acaugugaacccccaugcgu

SEQ ID NO: 105638 - RNA, 20 nt, Artificial Sequence
  MKO10105638_B_Olfr74
  gRNA
ccagaaacucuguaucacac

SEQ ID NO: 105639 - RNA, 20 nt, Artificial Sequence
  MKO10105639_B_Olfr74
  gRNA
ccagugugauacagaguuuc

SEQ ID NO: 105640 - RNA, 20 nt, Artificial Sequence
  MKO10105640_B_Olfr750
  gRNA
acuacggaguuuguccuggc

SEQ ID NO: 105641 - RNA, 20 nt, Artificial Sequence
  MKO10105641_B_Olfr750
  gRNA
cuugacuugaucguugcgca

SEQ ID NO: 105642 - RNA, 20 nt, Artificial Sequence
  MKO10105642_B_Olfr750
  gRNA
ggagaaagccuucugccgac

SEQ ID NO: 105643 - RNA, 20 nt, Artificial Sequence
  MKO10105643_B_Olfr761
  gRNA
gagagugcccagcucucccc

SEQ ID NO: 105644 - RNA, 20 nt, Artificial Sequence
  MKO10105644_B_Olfr761
  gRNA
cucugcugaaggcagaucua

SEQ ID NO: 105645 - RNA, 20 nt, Artificial Sequence
  MKO10105645_B_Olfr761
  gRNA
gaaagcaauccccauaaagc

SEQ ID NO: 105646 - RNA, 20 nt, Artificial Sequence
  MKO10105646_B_Olfr763
  gRNA
uguugccuauaugaggccuc

SEQ ID NO: 105647 - RNA, 20 nt, Artificial Sequence
  MKO10105647_B_Olfr763
  gRNA
ucucuucacgagccgccuca

SEQ ID NO: 105648 - RNA, 20 nt, Artificial Sequence
  MKO10105648_B_Olfr763
  gRNA
gggugacaacuguguagaac

SEQ ID NO: 105649 - RNA, 20 nt, Artificial Sequence
  MKO10105649_B_Olfr765
  gRNA
agcucccuucagcccaacaa

SEQ ID NO: 105650 - RNA, 20 nt, Artificial Sequence
  MKO10105650_B_Olfr765
  gRNA
aaaaagccuuuguccuuugu

SEQ ID NO: 105651 - RNA, 20 nt, Artificial Sequence
  MKO10105651_B_Olfr765
  gRNA
cauccucguccucacccugc

SEQ ID NO: 105652 - RNA, 20 nt, Artificial Sequence
  MKO10105652_B_Olfr767
  gRNA
gaacaggagaguucuagaag

SEQ ID NO: 105653 - RNA, 20 nt, Artificial Sequence
  MKO10105653_B_Olfr767
  gRNA
agcucccuucagcccagcaa

SEQ ID NO: 105654 - RNA, 20 nt, Artificial Sequence
  MKO10105654_B_Olfr767
  gRNA
uguucgugaaagaaauuucu

SEQ ID NO: 105655 - RNA, 20 nt, Artificial Sequence
  MKO10105655_B_Olfr768
  gRNA
ccccagacgccauuguguag

SEQ ID NO: 105656 - RNA, 20 nt, Artificial Sequence
  MKO10105656_B_Olfr768
  gRNA
cccuuagcucuuuaugauag

SEQ ID NO: 105657 - RNA, 20 nt, Artificial Sequence
  MKO10105657_B_Olfr768
  gRNA
uccaaugucauagaucacuu

SEQ ID NO: 105658 - RNA, 20 nt, Artificial Sequence
  MKO10105658_B_Olfr769
  gRNA
gagguggaaggaugaucaac

SEQ ID NO: 105659 - RNA, 20 nt, Artificial Sequence
  MKO10105659_B_Olfr769
  gRNA
ggacaagaacugugcauacu

SEQ ID NO: 105660 - RNA, 20 nt, Artificial Sequence
  MKO10105660_B_Olfr769
  gRNA
ucccagauuccuguacauga

SEQ ID NO: 105661 - RNA, 20 nt, Artificial Sequence
  MKO10105661_B_Olfr76
  gRNA
uaacacguuccucagccaag

SEQ ID NO: 105662 - RNA, 20 nt, Artificial Sequence
  MKO10105662_B_Olfr76
  gRNA
ugaguagcaaaugucaacga

SEQ ID NO: 105663 - RNA, 20 nt, Artificial Sequence
  MKO10105663_B_Olfr76
  gRNA
uccaccggccucucacagag

SEQ ID NO: 105664 - RNA, 20 nt, Artificial Sequence
  MKO10105664_B_Olfr770
  gRNA
gaaaaaugcuugacuggcac

SEQ ID NO: 105665 - RNA, 20 nt, Artificial Sequence
  MKO10105665_B_Olfr770
  gRNA
accaguuauauucaacaagu

SEQ ID NO: 105666 - RNA, 20 nt, Artificial Sequence
  MKO10105666_B_Olfr770
  gRNA
uacuuguauaaucuagcaac

SEQ ID NO: 105667 - RNA, 20 nt, Artificial Sequence
  MKO10105667_B_Olfr771
  gRNA
gcuauguuguacaaauaucg

SEQ ID NO: 105668 - RNA, 20 nt, Artificial Sequence
  MKO10105668_B_Olfr771
  gRNA
auaucgaucguaggacauaa

SEQ ID NO: 105669 - RNA, 20 nt, Artificial Sequence
  MKO10105669_B_Olfr771
  gRNA
ggugggagucuaauauagug

SEQ ID NO: 105670 - RNA, 20 nt, Artificial Sequence
  MKO10105670_B_Olfr772
  gRNA
uaauggaaaccacaaucaug

SEQ ID NO: 105671 - RNA, 20 nt, Artificial Sequence
  MKO10105671_B_Olfr772
  gRNA
ugucacaacuuucaucuuac

SEQ ID NO: 105672 - RNA, 20 nt, Artificial Sequence
  MKO10105672_B_Olfr772
  gRNA
aaaucucuuguucagacacu

SEQ ID NO: 105673 - RNA, 20 nt, Artificial Sequence
  MKO10105673_B_Olfr773
  gRNA
uaauggaaaccacaaucaua

SEQ ID NO: 105674 - RNA, 20 nt, Artificial Sequence
  MKO10105674_B_Olfr773
  gRNA
ugucacaacuuucaucuuac

SEQ ID NO: 105675 - RNA, 20 nt, Artificial Sequence
  MKO10105675_B_Olfr773
  gRNA
aaaucucuuguucagacacu

SEQ ID NO: 105676 - RNA, 20 nt, Artificial Sequence
  MKO10105676_B_Olfr774
  gRNA
cagaaacccucccagccaug

SEQ ID NO: 105677 - RNA, 20 nt, Artificial Sequence
  MKO10105677_B_Olfr774
  gRNA
uaugcccaagagcagaaacu

SEQ ID NO: 105678 - RNA, 20 nt, Artificial Sequence
  MKO10105678_B_Olfr774
  gRNA
aaaaucacaaacugaaguuc

SEQ ID NO: 105679 - RNA, 20 nt, Artificial Sequence
  MKO10105679_B_Olfr775
  gRNA
gucacagcagaagugaucaa

SEQ ID NO: 105680 - RNA, 20 nt, Artificial Sequence
  MKO10105680_B_Olfr775
  gRNA
ugagcaagacagcuguaaaa

SEQ ID NO: 105681 - RNA, 20 nt, Artificial Sequence
  MKO10105681_B_Olfr775
  gRNA
auuauugaucccaaaaaucu

SEQ ID NO: 105682 - RNA, 20 nt, Artificial Sequence
  MKO10105682_B_Olfr776
  gRNA
ugagcaagacaguuguaaaa

SEQ ID NO: 105683 - RNA, 20 nt, Artificial Sequence
  MKO10105683_B_Olfr776
  gRNA
aacugucuugcucagauaca

SEQ ID NO: 105684 - RNA, 20 nt, Artificial Sequence
  MKO10105684_B_Olfr776
  gRNA
cagaaauccugccagccaug

SEQ ID NO: 105685 - RNA, 20 nt, Artificial Sequence
  MKO10105685_B_Olfr777
  gRNA
auagcaccaucaugagcagu

SEQ ID NO: 105686 - RNA, 20 nt, Artificial Sequence
  MKO10105686_B_Olfr777
  gRNA
gacuaucaacaaggguguga

SEQ ID NO: 105687 - RNA, 20 nt, Artificial Sequence
  MKO10105687_B_Olfr777
  gRNA
agucacagaauuucagcuug

SEQ ID NO: 105688 - RNA, 20 nt, Artificial Sequence
  MKO10105688_B_Olfr77
  gRNA
gacaaaauuuaacucuucua

SEQ ID NO: 105689 - RNA, 20 nt, Artificial Sequence
  MKO10105689_B_Olfr77
  gRNA
ggcuuuauacuuauucuuaa

SEQ ID NO: 105690 - RNA, 20 nt, Artificial Sequence
  MKO10105690_B_Olfr77
  gRNA
uaucuuggaucauuauguuc

SEQ ID NO: 105691 - RNA, 20 nt, Artificial Sequence
  MKO10105691_B_Olfr780
  gRNA
gguagggauccacuguagug

SEQ ID NO: 105692 - RNA, 20 nt, Artificial Sequence
  MKO10105692_B_Olfr780
  gRNA
cacugaugauccucagcugc

SEQ ID NO: 105693 - RNA, 20 nt, Artificial Sequence
  MKO10105693_B_Olfr780
  gRNA
aaauaucgugcucagacacg

SEQ ID NO: 105694 - RNA, 20 nt, Artificial Sequence
  MKO10105694_B_Olfr781
  gRNA
aucaucauucucccaccaau

SEQ ID NO: 105695 - RNA, 20 nt, Artificial Sequence
  MKO10105695_B_Olfr781
  gRNA
gaucauaagacaugauagcc

SEQ ID NO: 105696 - RNA, 20 nt, Artificial Sequence
  MKO10105696_B_Olfr781
  gRNA
acgauguagcuaucaauaaa

SEQ ID NO: 105697 - RNA, 20 nt, Artificial Sequence
  MKO10105697_B_Olfr782
  gRNA
gagaaugaaaaauaagucaa

SEQ ID NO: 105698 - RNA, 20 nt, Artificial Sequence
  MKO10105698_B_Olfr782
  gRNA
agaagacuucuuucaccugc

SEQ ID NO: 105699 - RNA, 20 nt, Artificial Sequence
  MKO10105699_B_Olfr782
  gRNA
gaaauccagcuucaaaccca

SEQ ID NO: 105700 - RNA, 20 nt, Artificial Sequence
  MKO10105700_B_Olfr784
  gRNA
uucuuaaugaguauucucac

SEQ ID NO: 105701 - RNA, 20 nt, Artificial Sequence
  MKO10105701_B_Olfr784
  gRNA
uaaaucuuaauucacuguuu

SEQ ID NO: 105702 - RNA, 20 nt, Artificial Sequence
  MKO10105702_B_Olfr784
  gRNA
aguuugagucccaagaguaa

SEQ ID NO: 105703 - RNA, 20 nt, Artificial Sequence
  MKO10105703_B_Olfr786
  gRNA
cuaaugccaaagugaacauu

SEQ ID NO: 105704 - RNA, 20 nt, Artificial Sequence
  MKO10105704_B_Olfr786
  gRNA
cuaauguugcaaaauuccua

SEQ ID NO: 105705 - RNA, 20 nt, Artificial Sequence
  MKO10105705_B_Olfr786
  gRNA
cugagcuaugcaguuguuga

SEQ ID NO: 105706 - RNA, 20 nt, Artificial Sequence
  MKO10105706_B_Olfr787
  gRNA
cuuuaacugagagucuagca

SEQ ID NO: 105707 - RNA, 20 nt, Artificial Sequence
  MKO10105707_B_Olfr787
  gRNA
ccucagaauggugcugauga

SEQ ID NO: 105708 - RNA, 20 nt, Artificial Sequence
  MKO10105708_B_Olfr787
  gRNA
caaacucaguaaucacagaa

SEQ ID NO: 105709 - RNA, 20 nt, Artificial Sequence
  MKO10105709_B_Olfr788
  gRNA
gaauuccaucuaccagccag

SEQ ID NO: 105710 - RNA, 20 nt, Artificial Sequence
  MKO10105710_B_Olfr788
  gRNA
gcagaguuuccuguucauga

SEQ ID NO: 105711 - RNA, 20 nt, Artificial Sequence
  MKO10105711_B_Olfr788
  gRNA
gguugcucuucuguucacuu

SEQ ID NO: 105712 - RNA, 20 nt, Artificial Sequence
  MKO10105712_B_Olfr78
  gRNA
aauugaaucuacuauccugc

SEQ ID NO: 105713 - RNA, 20 nt, Artificial Sequence
  MKO10105713_B_Olfr78
  gRNA
cccacuacugaucaagcgac

SEQ ID NO: 105714 - RNA, 20 nt, Artificial Sequence
  MKO10105714_B_Olfr78
  gRNA
uuccaagucugagcgagcua

SEQ ID NO: 105715 - RNA, 20 nt, Artificial Sequence
  MKO10105715_B_Olfr790
  gRNA
cugagccacgcaaccauugu

SEQ ID NO: 105716 - RNA, 20 nt, Artificial Sequence
  MKO10105716_B_Olfr790
  gRNA
gauaaaguggucaauuaugu

SEQ ID NO: 105717 - RNA, 20 nt, Artificial Sequence
  MKO10105717_B_Olfr790
  gRNA
uguacauuaagccuucugca

SEQ ID NO: 105718 - RNA, 20 nt, Artificial Sequence
  MKO10105718_B_Olfr791
  gRNA
gauuaucaucauccuuacgu

SEQ ID NO: 105719 - RNA, 20 nt, Artificial Sequence
  MKO10105719_B_Olfr791
  gRNA
cugagcacgagaucuucaga

SEQ ID NO: 105720 - RNA, 20 nt, Artificial Sequence
  MKO10105720_B_Olfr791
  gRNA
gacuaguaagauacacaccc

SEQ ID NO: 105721 - RNA, 20 nt, Artificial Sequence
  MKO10105721_B_Olfr792
  gRNA
ggaguucuucuucauacucc

SEQ ID NO: 105722 - RNA, 20 nt, Artificial Sequence
  MKO10105722_B_Olfr792
  gRNA
acaccacaauaaugagcagc

SEQ ID NO: 105723 - RNA, 20 nt, Artificial Sequence
  MKO10105723_B_Olfr792
  gRNA
gacccugcugcucauuauug

SEQ ID NO: 105724 - RNA, 20 nt, Artificial Sequence
  MKO10105724_B_Olfr794
  gRNA
uuccuguacaguauaucaac

SEQ ID NO: 105725 - RNA, 20 nt, Artificial Sequence
  MKO10105725_B_Olfr794
  gRNA
uauuaagaugagaguccauc

SEQ ID NO: 105726 - RNA, 20 nt, Artificial Sequence
  MKO10105726_B_Olfr794
  gRNA
aaugcagcugccauacauga

SEQ ID NO: 105727 - RNA, 20 nt, Artificial Sequence
  MKO10105727_B_Olfr796
  gRNA
ugcuggccguuccgaagaag

SEQ ID NO: 105728 - RNA, 20 nt, Artificial Sequence
  MKO10105728_B_Olfr796
  gRNA
ugcaggcccggugguucauu

SEQ ID NO: 105729 - RNA, 20 nt, Artificial Sequence
  MKO10105729_B_Olfr796
  gRNA
uacaugggggagugcagcac

SEQ ID NO: 105730 - RNA, 20 nt, Artificial Sequence
  MKO10105730_B_Olfr798
  gRNA
uuccuugugagcauugugac

SEQ ID NO: 105731 - RNA, 20 nt, Artificial Sequence
  MKO10105731_B_Olfr798
  gRNA
gacucuacuguucauuauug

SEQ ID NO: 105732 - RNA, 20 nt, Artificial Sequence
  MKO10105732_B_Olfr798
  gRNA
gaagaacaccugagccaugc

SEQ ID NO: 105733 - RNA, 20 nt, Artificial Sequence
  MKO10105733_B_Olfr799
  gRNA
auugauagcuacauuauccu

SEQ ID NO: 105734 - RNA, 20 nt, Artificial Sequence
  MKO10105734_B_Olfr799
  gRNA
gagcugcaucacaacaaaaa

SEQ ID NO: 105735 - RNA, 20 nt, Artificial Sequence
  MKO10105735_B_Olfr799
  gRNA
ugaugauauaaccauaagaa

SEQ ID NO: 105736 - RNA, 20 nt, Artificial Sequence
  MKO10105736_B_Olfr800
  gRNA
auagcaccaucaugagcagc

SEQ ID NO: 105737 - RNA, 20 nt, Artificial Sequence
  MKO10105737_B_Olfr800
  gRNA
aauccugccaccacuuagcc

SEQ ID NO: 105738 - RNA, 20 nt, Artificial Sequence
  MKO10105738_B_Olfr800
  gRNA
cauaacaacauucauccuac

SEQ ID NO: 105739 - RNA, 20 nt, Artificial Sequence
  MKO10105739_B_Olfr801
  gRNA
agaaugcucaucaagaaccg

SEQ ID NO: 105740 - RNA, 20 nt, Artificial Sequence
  MKO10105740_B_Olfr801
  gRNA
uaaaagcauccuuuaccugc

SEQ ID NO: 105741 - RNA, 20 nt, Artificial Sequence
  MKO10105741_B_Olfr801
  gRNA
cacuguugugagaauacagu

SEQ ID NO: 105742 - RNA, 20 nt, Artificial Sequence
  MKO10105742_B_Olfr802
  gRNA
caguccauuucauuuacuug

SEQ ID NO: 105743 - RNA, 20 nt, Artificial Sequence
  MKO10105743_B_Olfr802
  gRNA
gcuugacuugcugauuccuc

SEQ ID NO: 105744 - RNA, 20 nt, Artificial Sequence
  MKO10105744_B_Olfr802
  gRNA
gucacuauacccaaguucuu

SEQ ID NO: 105745 - RNA, 20 nt, Artificial Sequence
  MKO10105745_B_Olfr803
  gRNA
cuuggguaauuauugaugcc

SEQ ID NO: 105746 - RNA, 20 nt, Artificial Sequence
  MKO10105746_B_Olfr803
  gRNA
caucuucccaccacuuaugc

SEQ ID NO: 105747 - RNA, 20 nt, Artificial Sequence
  MKO10105747_B_Olfr803
  gRNA
cauuauccuccucacauugu

SEQ ID NO: 105748 - RNA, 20 nt, Artificial Sequence
  MKO10105748_B_Olfr804
  gRNA
ggauauauuacgaaagacuu

SEQ ID NO: 105749 - RNA, 20 nt, Artificial Sequence
  MKO10105749_B_Olfr804
  gRNA
aaaaccacaauuugcaacug

SEQ ID NO: 105750 - RNA, 20 nt, Artificial Sequence
  MKO10105750_B_Olfr804
  gRNA
gaaauccagcuucagaccca

SEQ ID NO: 105751 - RNA, 20 nt, Artificial Sequence
  MKO10105751_B_Olfr805
  gRNA
ugugaaugccauuuccaaga

SEQ ID NO: 105752 - RNA, 20 nt, Artificial Sequence
  MKO10105752_B_Olfr805
  gRNA
aaaacagugaguuaagauuu

SEQ ID NO: 105753 - RNA, 20 nt, Artificial Sequence
  MKO10105753_B_Olfr805
  gRNA
aauuaucuuucucacccugc

SEQ ID NO: 105754 - RNA, 20 nt, Artificial Sequence
  MKO10105754_B_Olfr806
  gRNA
aauuaucuuccucacccugc

SEQ ID NO: 105755 - RNA, 20 nt, Artificial Sequence
  MKO10105755_B_Olfr806
  gRNA
uccucagcuccuggaugaca

SEQ ID NO: 105756 - RNA, 20 nt, Artificial Sequence
  MKO10105756_B_Olfr806
  gRNA
aaaaucagaauuugaagcug

SEQ ID NO: 105757 - RNA, 20 nt, Artificial Sequence
  MKO10105757_B_Olfr807
  gRNA
cugugcuaugccaaagauaa

SEQ ID NO: 105758 - RNA, 20 nt, Artificial Sequence
  MKO10105758_B_Olfr807
  gRNA
uauauaaaaggguuuaguac

SEQ ID NO: 105759 - RNA, 20 nt, Artificial Sequence
  MKO10105759_B_Olfr807
  gRNA
cacugguaauguucucuuau

SEQ ID NO: 105760 - RNA, 20 nt, Artificial Sequence
  MKO10105760_B_Olfr808
  gRNA
acuuagcaccacaccuucuc

SEQ ID NO: 105761 - RNA, 20 nt, Artificial Sequence
  MKO10105761_B_Olfr808
  gRNA
ugaaugccuguuugacuugc

SEQ ID NO: 105762 - RNA, 20 nt, Artificial Sequence
  MKO10105762_B_Olfr808
  gRNA
ugugcaagcgaucugcagca

SEQ ID NO: 105763 - RNA, 20 nt, Artificial Sequence
  MKO10105763_B_Olfr809
  gRNA
ugugaaguggucaauagugu

SEQ ID NO: 105764 - RNA, 20 nt, Artificial Sequence
  MKO10105764_B_Olfr809
  gRNA
auuguugucucuauauccua

SEQ ID NO: 105765 - RNA, 20 nt, Artificial Sequence
  MKO10105765_B_Olfr809
  gRNA
uauaaagcucauaagcucca

SEQ ID NO: 105766 - RNA, 20 nt, Artificial Sequence
  MKO10105766_B_Olfr810
  gRNA
ugaaaacugucacucuugua

SEQ ID NO: 105767 - RNA, 20 nt, Artificial Sequence
  MKO10105767_B_Olfr810
  gRNA
uugagucaaacaauuaccau

SEQ ID NO: 105768 - RNA, 20 nt, Artificial Sequence
  MKO10105768_B_Olfr810
  gRNA
guugagcacagaaauucccu

SEQ ID NO: 105769 - RNA, 20 nt, Artificial Sequence
  MKO10105769_B_Olfr811
  gRNA
gaucaucuuccucacccuac

SEQ ID NO: 105770 - RNA, 20 nt, Artificial Sequence
  MKO10105770_B_Olfr811
  gRNA
uaaacucuaucuucaaugau

SEQ ID NO: 105771 - RNA, 20 nt, Artificial Sequence
  MKO10105771_B_Olfr811
  gRNA
aacuaagaacccaguuaccc

SEQ ID NO: 105772 - RNA, 20 nt, Artificial Sequence
  MKO10105772_B_Olfr812
  gRNA
aaacuggauuucuguacuuc

SEQ ID NO: 105773 - RNA, 20 nt, Artificial Sequence
  MKO10105773_B_Olfr812
  gRNA
cuccugagagaaugcuuauc

SEQ ID NO: 105774 - RNA, 20 nt, Artificial Sequence
  MKO10105774_B_Olfr812
  gRNA
gauuaagaauccaguuaccc

SEQ ID NO: 105775 - RNA, 20 nt, Artificial Sequence
  MKO10105775_B_Olfr813
  gRNA
uuacuucugucuguaacccu

SEQ ID NO: 105776 - RNA, 20 nt, Artificial Sequence
  MKO10105776_B_Olfr813
  gRNA
caucauuacucucacacugc

SEQ ID NO: 105777 - RNA, 20 nt, Artificial Sequence
  MKO10105777_B_Olfr813
  gRNA
aaaaucacaaccucaagcuc

SEQ ID NO: 105778 - RNA, 20 nt, Artificial Sequence
  MKO10105778_B_Olfr814
  gRNA
ugucugagcaagagaguugu

SEQ ID NO: 105779 - RNA, 20 nt, Artificial Sequence
  MKO10105779_B_Olfr814
  gRNA
uuuaaucacuauuguaacac

SEQ ID NO: 105780 - RNA, 20 nt, Artificial Sequence
  MKO10105780_B_Olfr814
  gRNA
uacaauagugauuaaaaauc

SEQ ID NO: 105781 - RNA, 20 nt, Artificial Sequence
  MKO10105781_B_Olfr815
  gRNA
uugacaaacacagccauuau

SEQ ID NO: 105782 - RNA, 20 nt, Artificial Sequence
  MKO10105782_B_Olfr815
  gRNA
uuuaaucucuauuguaacac

SEQ ID NO: 105783 - RNA, 20 nt, Artificial Sequence
  MKO10105783_B_Olfr815
  gRNA
uacaauagagauuaaaaauc

SEQ ID NO: 105784 - RNA, 20 nt, Artificial Sequence
  MKO10105784_B_Olfr816
  gRNA
agacaaaucccaucgucucc

SEQ ID NO: 105785 - RNA, 20 nt, Artificial Sequence
  MKO10105785_B_Olfr816
  gRNA
agauucaagccuaacacgag

SEQ ID NO: 105786 - RNA, 20 nt, Artificial Sequence
  MKO10105786_B_Olfr816
  gRNA
aucuuuccaccacucguguu

SEQ ID NO: 105787 - RNA, 20 nt, Artificial Sequence
  MKO10105787_B_Olfr818
  gRNA
gauaagugucauuauagcua

SEQ ID NO: 105788 - RNA, 20 nt, Artificial Sequence
  MKO10105788_B_Olfr818
  gRNA
agaaaugaagaaccagucuc

SEQ ID NO: 105789 - RNA, 20 nt, Artificial Sequence
  MKO10105789_B_Olfr818
  gRNA
aaggaagugaucaacaguuu

SEQ ID NO: 105790 - RNA, 20 nt, Artificial Sequence
  MKO10105790_B_Olfr819
  gRNA
agugaaggaagccuuucaaa

SEQ ID NO: 105791 - RNA, 20 nt, Artificial Sequence
  MKO10105791_B_Olfr819
  gRNA
aacucugagcucaugaagaa

SEQ ID NO: 105792 - RNA, 20 nt, Artificial Sequence
  MKO10105792_B_Olfr819
  gRNA
gauguauguauucaccaucu

SEQ ID NO: 105793 - RNA, 20 nt, Artificial Sequence
  MKO10105793_B_Olfr820
  gRNA
ucuccaaaaacgcaaaauuu

SEQ ID NO: 105794 - RNA, 20 nt, Artificial Sequence
  MKO10105794_B_Olfr820
  gRNA
caucauucucuugacucugc

SEQ ID NO: 105795 - RNA, 20 nt, Artificial Sequence
  MKO10105795_B_Olfr820
  gRNA
uccaauauugauuagcaucu

SEQ ID NO: 105796 - RNA, 20 nt, Artificial Sequence
  MKO10105796_B_Olfr821
  gRNA
cuaaaaaugagaaguuucgu

SEQ ID NO: 105797 - RNA, 20 nt, Artificial Sequence
  MKO10105797_B_Olfr821
  gRNA
uguaaccaagagugucaaaa

SEQ ID NO: 105798 - RNA, 20 nt, Artificial Sequence
  MKO10105798_B_Olfr821
  gRNA
cagcaaaauuugcaacuugu

SEQ ID NO: 105799 - RNA, 20 nt, Artificial Sequence
  MKO10105799_B_Olfr822
  gRNA
guagaaaugaucaaugaugu

SEQ ID NO: 105800 - RNA, 20 nt, Artificial Sequence
  MKO10105800_B_Olfr822
  gRNA
aacuaauaagccaacaacug

SEQ ID NO: 105801 - RNA, 20 nt, Artificial Sequence
  MKO10105801_B_Olfr822
  gRNA
acagacuuuauugcucauga

SEQ ID NO: 105802 - RNA, 20 nt, Artificial Sequence
  MKO10105802_B_Olfr823
  gRNA
gaaaaaaguagcaagagcuu

SEQ ID NO: 105803 - RNA, 20 nt, Artificial Sequence
  MKO10105803_B_Olfr823
  gRNA
agguuucuuucuggcuguga

SEQ ID NO: 105804 - RNA, 20 nt, Artificial Sequence
  MKO10105804_B_Olfr823
  gRNA
uuaugaaacuggagcagagc

SEQ ID NO: 105805 - RNA, 20 nt, Artificial Sequence
  MKO10105805_B_Olfr824
  gRNA
uuaugaaacuggagcagagc

SEQ ID NO: 105806 - RNA, 20 nt, Artificial Sequence
  MKO10105806_B_Olfr824
  gRNA
uuccuuaagcuauaaaucag

SEQ ID NO: 105807 - RNA, 20 nt, Artificial Sequence
  MKO10105807_B_Olfr824
  gRNA
accuucagcuugcguuucug

SEQ ID NO: 105808 - RNA, 20 nt, Artificial Sequence
  MKO10105808_B_Olfr825
  gRNA
ucaaaacacuacuuguagaa

SEQ ID NO: 105809 - RNA, 20 nt, Artificial Sequence
  MKO10105809_B_Olfr825
  gRNA
acagugcaaagagaaagauc

SEQ ID NO: 105810 - RNA, 20 nt, Artificial Sequence
  MKO10105810_B_Olfr825
  gRNA
agcaagucuaucucauuugc

SEQ ID NO: 105811 - RNA, 20 nt, Artificial Sequence
  MKO10105811_B_Olfr826
  gRNA
agcaaguccaucucauuugc

SEQ ID NO: 105812 - RNA, 20 nt, Artificial Sequence
  MKO10105812_B_Olfr826
  gRNA
acaaugaugacuaugacagu

SEQ ID NO: 105813 - RNA, 20 nt, Artificial Sequence
  MKO10105813_B_Olfr826
  gRNA
aggucucuuccaugggcgac

SEQ ID NO: 105814 - RNA, 20 nt, Artificial Sequence
  MKO10105814_B_Olfr827
  gRNA
acugacccagccgcagagau

SEQ ID NO: 105815 - RNA, 20 nt, Artificial Sequence
  MKO10105815_B_Olfr827
  gRNA
gcaaacuuacaacccccaag

SEQ ID NO: 105816 - RNA, 20 nt, Artificial Sequence
  MKO10105816_B_Olfr827
  gRNA
ggccauggcugcuaguauaa

SEQ ID NO: 105817 - RNA, 20 nt, Artificial Sequence
  MKO10105817_B_Olfr828
  gRNA
aucauaagucuugugaauag

SEQ ID NO: 105818 - RNA, 20 nt, Artificial Sequence
  MKO10105818_B_Olfr828
  gRNA
aucaugaauccucaaaccug

SEQ ID NO: 105819 - RNA, 20 nt, Artificial Sequence
  MKO10105819_B_Olfr828
  gRNA
ugaauguucaccaaugucuu

SEQ ID NO: 105820 - RNA, 20 nt, Artificial Sequence
  MKO10105820_B_Olfr829
  gRNA
auuaugauccuauaccuaag

SEQ ID NO: 105821 - RNA, 20 nt, Artificial Sequence
  MKO10105821_B_Olfr829
  gRNA
gaagauaauaaguugcagcu

SEQ ID NO: 105822 - RNA, 20 nt, Artificial Sequence
  MKO10105822_B_Olfr829
  gRNA
caacaauuacagaaucaucc

SEQ ID NO: 105823 - RNA, 20 nt, Artificial Sequence
  MKO10105823_B_Olfr830
  gRNA
uccuaccaauaacuuucuuc

SEQ ID NO: 105824 - RNA, 20 nt, Artificial Sequence
  MKO10105824_B_Olfr830
  gRNA
guuccucaaacaauagacaa

SEQ ID NO: 105825 - RNA, 20 nt, Artificial Sequence
  MKO10105825_B_Olfr830
  gRNA
gaagccacagcaaucuucuu

SEQ ID NO: 105826 - RNA, 20 nt, Artificial Sequence
  MKO10105826_B_Olfr832
  gRNA
aaccaucaccccacagaguu

SEQ ID NO: 105827 - RNA, 20 nt, Artificial Sequence
  MKO10105827_B_Olfr832
  gRNA
gucaacucaaucaguuauac

SEQ ID NO: 105828 - RNA, 20 nt, Artificial Sequence
  MKO10105828_B_Olfr832
  gRNA
gacgcagugccaucaaagug

SEQ ID NO: 105829 - RNA, 20 nt, Artificial Sequence
  MKO10105829_B_Olfr834
  gRNA
ugcuuuguucuagcguuugc

SEQ ID NO: 105830 - RNA, 20 nt, Artificial Sequence
  MKO10105830_B_Olfr834
  gRNA
aaccaucaccccacagauuu

SEQ ID NO: 105831 - RNA, 20 nt, Artificial Sequence
  MKO10105831_B_Olfr834
  gRNA
aucuaggauacuuaucaaga

SEQ ID NO: 105832 - RNA, 20 nt, Artificial Sequence
  MKO10105832_B_Olfr835
  gRNA
aacccacaauccugaaccau

SEQ ID NO: 105833 - RNA, 20 nt, Artificial Sequence
  MKO10105833_B_Olfr835
  gRNA
cuuucauguccuuauuucga

SEQ ID NO: 105834 - RNA, 20 nt, Artificial Sequence
  MKO10105834_B_Olfr835
  gRNA
gaucagagcaucaguuaugc

SEQ ID NO: 105835 - RNA, 20 nt, Artificial Sequence
  MKO10105835_B_Olfr836
  gRNA
uggugaaucaauuacauuug

SEQ ID NO: 105836 - RNA, 20 nt, Artificial Sequence
  MKO10105836_B_Olfr836
  gRNA
auaucaagauguuguugauu

SEQ ID NO: 105837 - RNA, 20 nt, Artificial Sequence
  MKO10105837_B_Olfr836
  gRNA
gagcuucagcccuuuaucuu

SEQ ID NO: 105838 - RNA, 20 nt, Artificial Sequence
  MKO10105838_B_Olfr837
  gRNA
auucaacauuggaggaacua

SEQ ID NO: 105839 - RNA, 20 nt, Artificial Sequence
  MKO10105839_B_Olfr837
  gRNA
uuuagcuggcugucugagcc

SEQ ID NO: 105840 - RNA, 20 nt, Artificial Sequence
  MKO10105840_B_Olfr837
  gRNA
cacagauuaaucauacauca

SEQ ID NO: 105841 - RNA, 20 nt, Artificial Sequence
  MKO10105841_B_Olfr843
  gRNA
uggccauaguucauccucug

SEQ ID NO: 105842 - RNA, 20 nt, Artificial Sequence
  MKO10105842_B_Olfr843
  gRNA
gcugaagauaaaugauucaa

SEQ ID NO: 105843 - RNA, 20 nt, Artificial Sequence
  MKO10105843_B_Olfr843
  gRNA
acuaugcaguagugcauuaa

SEQ ID NO: 105844 - RNA, 20 nt, Artificial Sequence
  MKO10105844_B_Olfr845
  gRNA
gauaucagccacagauagau

SEQ ID NO: 105845 - RNA, 20 nt, Artificial Sequence
  MKO10105845_B_Olfr845
  gRNA
ggcacucagcacugaugguc

SEQ ID NO: 105846 - RNA, 20 nt, Artificial Sequence
  MKO10105846_B_Olfr845
  gRNA
cugcaguuacugaaucuccc

SEQ ID NO: 105847 - RNA, 20 nt, Artificial Sequence
  MKO10105847_B_Olfr846
  gRNA
aaaaguaauaugcaccuguu

SEQ ID NO: 105848 - RNA, 20 nt, Artificial Sequence
  MKO10105848_B_Olfr846
  gRNA
aggcuuuguacuuuccucua

SEQ ID NO: 105849 - RNA, 20 nt, Artificial Sequence
  MKO10105849_B_Olfr846
  gRNA
uuacacagguugccucauuc

SEQ ID NO: 105850 - RNA, 20 nt, Artificial Sequence
  MKO10105850_B_Olfr847
  gRNA
guugaagaacauccacacac

SEQ ID NO: 105851 - RNA, 20 nt, Artificial Sequence
  MKO10105851_B_Olfr847
  gRNA
uacagugucugaugauacug

SEQ ID NO: 105852 - RNA, 20 nt, Artificial Sequence
  MKO10105852_B_Olfr847
  gRNA
auuaugaauccccaauucug

SEQ ID NO: 105853 - RNA, 20 nt, Artificial Sequence
  MKO10105853_B_Olfr849
  gRNA
cucuccaaaaaagacuguag

SEQ ID NO: 105854 - RNA, 20 nt, Artificial Sequence
  MKO10105854_B_Olfr849
  gRNA
gauuagcaaguuuccuaagg

SEQ ID NO: 105855 - RNA, 20 nt, Artificial Sequence
  MKO10105855_B_Olfr849
  gRNA
ucagauauauggucaggaac

SEQ ID NO: 105856 - RNA, 20 nt, Artificial Sequence
  MKO10105856_B_Olfr850
  gRNA
agauuauaagaagguuuccc

SEQ ID NO: 105857 - RNA, 20 nt, Artificial Sequence
  MKO10105857_B_Olfr850
  gRNA
uacuuugaugcacagccuua

SEQ ID NO: 105858 - RNA, 20 nt, Artificial Sequence
  MKO10105858_B_Olfr850
  gRNA
acuuccccagauccucaagu

SEQ ID NO: 105859 - RNA, 20 nt, Artificial Sequence
  MKO10105859_B_Olfr851
  gRNA
cauuuauagugcugaugauc

SEQ ID NO: 105860 - RNA, 20 nt, Artificial Sequence
  MKO10105860_B_Olfr851
  gRNA
aacauccaugauguacagug

SEQ ID NO: 105861 - RNA, 20 nt, Artificial Sequence
  MKO10105861_B_Olfr851
  gRNA
auucugaagaucccaucagu

SEQ ID NO: 105862 - RNA, 20 nt, Artificial Sequence
  MKO10105862_B_Olfr853
  gRNA
augucauuaagccauguaga

SEQ ID NO: 105863 - RNA, 20 nt, Artificial Sequence
  MKO10105863_B_Olfr853
  gRNA
gucuuuguacauuagcauug

SEQ ID NO: 105864 - RNA, 20 nt, Artificial Sequence
  MKO10105864_B_Olfr853
  gRNA
agcaaauccaucaguuacac

SEQ ID NO: 105865 - RNA, 20 nt, Artificial Sequence
  MKO10105865_B_Olfr854
  gRNA
aauccacaaugcuaauuagc

SEQ ID NO: 105866 - RNA, 20 nt, Artificial Sequence
  MKO10105866_B_Olfr854
  gRNA
cccaaaauugcagccugucu

SEQ ID NO: 105867 - RNA, 20 nt, Artificial Sequence
  MKO10105867_B_Olfr854
  gRNA
aaucaggaggauacagaaac

SEQ ID NO: 105868 - RNA, 20 nt, Artificial Sequence
  MKO10105868_B_Olfr855
  gRNA
uucccugauucacacacuua

SEQ ID NO: 105869 - RNA, 20 nt, Artificial Sequence
  MKO10105869_B_Olfr855
  gRNA
agagcacgauguugucaauu

SEQ ID NO: 105870 - RNA, 20 nt, Artificial Sequence
  MKO10105870_B_Olfr855
  gRNA
gugagucccgcaaguagaga

SEQ ID NO: 105871 - RNA, 20 nt, Artificial Sequence
  MKO10105871_B_Olfr857
  gRNA
aguuaaauuauguuaucuga

SEQ ID NO: 105872 - RNA, 20 nt, Artificial Sequence
  MKO10105872_B_Olfr857
  gRNA
cgcuucaguaauguauacaa

SEQ ID NO: 105873 - RNA, 20 nt, Artificial Sequence
  MKO10105873_B_Olfr857
  gRNA
cccuugccucuguagauguu

SEQ ID NO: 105874 - RNA, 20 nt, Artificial Sequence
  MKO10105874_B_Olfr859
  gRNA
cgaagccaccauacuuuccu

SEQ ID NO: 105875 - RNA, 20 nt, Artificial Sequence
  MKO10105875_B_Olfr859
  gRNA
auggaaccauauaauucaac

SEQ ID NO: 105876 - RNA, 20 nt, Artificial Sequence
  MKO10105876_B_Olfr859
  gRNA
augcaaguuuaucagcaucu

SEQ ID NO: 105877 - RNA, 20 nt, Artificial Sequence
  MKO10105877_B_Olfr860
  gRNA
uccucgucuguguagauauu

SEQ ID NO: 105878 - RNA, 20 nt, Artificial Sequence
  MKO10105878_B_Olfr860
  gRNA
gacuucaguaauguauacca

SEQ ID NO: 105879 - RNA, 20 nt, Artificial Sequence
  MKO10105879_B_Olfr860
  gRNA
uuucuugucaguaucauugu

SEQ ID NO: 105880 - RNA, 20 nt, Artificial Sequence
  MKO10105880_B_Olfr862
  gRNA
caacuauuucuagaucaacc

SEQ ID NO: 105881 - RNA, 20 nt, Artificial Sequence
  MKO10105881_B_Olfr862
  gRNA
gccuuggaauuccuguuacu

SEQ ID NO: 105882 - RNA, 20 nt, Artificial Sequence
  MKO10105882_B_Olfr862
  gRNA
acuaaaauucugcacuaaua

SEQ ID NO: 105883 - RNA, 20 nt, Artificial Sequence
  MKO10105883_B_Olfr866
  gRNA
cggacaggaauaauccaaag

SEQ ID NO: 105884 - RNA, 20 nt, Artificial Sequence
  MKO10105884_B_Olfr866
  gRNA
gauaucaaucaaagauaagu

SEQ ID NO: 105885 - RNA, 20 nt, Artificial Sequence
  MKO10105885_B_Olfr866
  gRNA
uguuaguacaagcaagauua

SEQ ID NO: 105886 - RNA, 20 nt, Artificial Sequence
  MKO10105886_B_Olfr867
  gRNA
guauguagugacuuccuuac

SEQ ID NO: 105887 - RNA, 20 nt, Artificial Sequence
  MKO10105887_B_Olfr867
  gRNA
gaauugcaaccuauucucuu

SEQ ID NO: 105888 - RNA, 20 nt, Artificial Sequence
  MKO10105888_B_Olfr867
  gRNA
uauaacaaaauuucucaucc

SEQ ID NO: 105889 - RNA, 20 nt, Artificial Sequence
  MKO10105889_B_Olfr868
  gRNA
aaaauaagcauaccacugcg

SEQ ID NO: 105890 - RNA, 20 nt, Artificial Sequence
  MKO10105890_B_Olfr868
  gRNA
cagcccacguaggauaugac

SEQ ID NO: 105891 - RNA, 20 nt, Artificial Sequence
  MKO10105891_B_Olfr868
  gRNA
acuaagaugccacagcgaca

SEQ ID NO: 105892 - RNA, 20 nt, Artificial Sequence
  MKO10105892_B_Olfr869
  gRNA
guacuucuacguucucugag

SEQ ID NO: 105893 - RNA, 20 nt, Artificial Sequence
  MKO10105893_B_Olfr869
  gRNA
cuacaauuuacacacuucag

SEQ ID NO: 105894 - RNA, 20 nt, Artificial Sequence
  MKO10105894_B_Olfr869
  gRNA
gggacauuaaaauugcccua

SEQ ID NO: 105895 - RNA, 20 nt, Artificial Sequence
  MKO10105895_B_Olfr870
  gRNA
cccauaucacaauauaaaga

SEQ ID NO: 105896 - RNA, 20 nt, Artificial Sequence
  MKO10105896_B_Olfr870
  gRNA
auugauuaguguaucugagc

SEQ ID NO: 105897 - RNA, 20 nt, Artificial Sequence
  MKO10105897_B_Olfr870
  gRNA
cacacuucuccucaccguga

SEQ ID NO: 105898 - RNA, 20 nt, Artificial Sequence
  MKO10105898_B_Olfr871
  gRNA
uauauucugauauguguccu

SEQ ID NO: 105899 - RNA, 20 nt, Artificial Sequence
  MKO10105899_B_Olfr871
  gRNA
cagaacuaagguacacacca

SEQ ID NO: 105900 - RNA, 20 nt, Artificial Sequence
  MKO10105900_B_Olfr871
  gRNA
auugauuagugugucugagc

SEQ ID NO: 105901 - RNA, 20 nt, Artificial Sequence
  MKO10105901_B_Olfr872
  gRNA
gggacauuaaaacugcucuu

SEQ ID NO: 105902 - RNA, 20 nt, Artificial Sequence
  MKO10105902_B_Olfr872
  gRNA
ugaaccaauguauacuccaa

SEQ ID NO: 105903 - RNA, 20 nt, Artificial Sequence
  MKO10105903_B_Olfr872
  gRNA
uuaugauuaagaaguuguga

SEQ ID NO: 105904 - RNA, 20 nt, Artificial Sequence
  MKO10105904_B_Olfr873
  gRNA
acagccauuggaguauaucu

SEQ ID NO: 105905 - RNA, 20 nt, Artificial Sequence
  MKO10105905_B_Olfr873
  gRNA
caagauuaaggaguugugca

SEQ ID NO: 105906 - RNA, 20 nt, Artificial Sequence
  MKO10105906_B_Olfr873
  gRNA
cagcaaagagauaaucuaug

SEQ ID NO: 105907 - RNA, 20 nt, Artificial Sequence
  MKO10105907_B_Olfr874
  gRNA
uauugcaagagagcucaaga

SEQ ID NO: 105908 - RNA, 20 nt, Artificial Sequence
  MKO10105908_B_Olfr874
  gRNA
ucuggggccauggcccauac

SEQ ID NO: 105909 - RNA, 20 nt, Artificial Sequence
  MKO10105909_B_Olfr874
  gRNA
uuccuuguucuauaugauug

SEQ ID NO: 105910 - RNA, 20 nt, Artificial Sequence
  MKO10105910_B_Olfr875
  gRNA
aacuacaagcucauuuguga

SEQ ID NO: 105911 - RNA, 20 nt, Artificial Sequence
  MKO10105911_B_Olfr875
  gRNA
acauggugaccguguacauc

SEQ ID NO: 105912 - RNA, 20 nt, Artificial Sequence
  MKO10105912_B_Olfr875
  gRNA
gcaaaagaaguaaacauacc

SEQ ID NO: 105913 - RNA, 20 nt, Artificial Sequence
  MKO10105913_B_Olfr876
  gRNA
gugugauauccuuccccuuc

SEQ ID NO: 105914 - RNA, 20 nt, Artificial Sequence
  MKO10105914_B_Olfr876
  gRNA
aacaacugugccaugcaccc

SEQ ID NO: 105915 - RNA, 20 nt, Artificial Sequence
  MKO10105915_B_Olfr876
  gRNA
uacuacaaucguauagaaca

SEQ ID NO: 105916 - RNA, 20 nt, Artificial Sequence
  MKO10105916_B_Olfr877
  gRNA
auugauguaugagcuauugc

SEQ ID NO: 105917 - RNA, 20 nt, Artificial Sequence
  MKO10105917_B_Olfr877
  gRNA
aaugggcacuccaaugccaa

SEQ ID NO: 105918 - RNA, 20 nt, Artificial Sequence
  MKO10105918_B_Olfr877
  gRNA
accaccuucuaguuugccuc

SEQ ID NO: 105919 - RNA, 20 nt, Artificial Sequence
  MKO10105919_B_Olfr878
  gRNA
acuggaauucaacccaauua

SEQ ID NO: 105920 - RNA, 20 nt, Artificial Sequence
  MKO10105920_B_Olfr878
  gRNA
cuucccucuuccauugaacc

SEQ ID NO: 105921 - RNA, 20 nt, Artificial Sequence
  MKO10105921_B_Olfr878
  gRNA
aauaaaaaacacaagcucgu

SEQ ID NO: 105922 - RNA, 20 nt, Artificial Sequence
  MKO10105922_B_Olfr881
  gRNA
gguguauguuaugggguuug

SEQ ID NO: 105923 - RNA, 20 nt, Artificial Sequence
  MKO10105923_B_Olfr881
  gRNA
acaccccaacugucaucaag

SEQ ID NO: 105924 - RNA, 20 nt, Artificial Sequence
  MKO10105924_B_Olfr881
  gRNA
gcugcugugucaagccaagc

SEQ ID NO: 105925 - RNA, 20 nt, Artificial Sequence
  MKO10105925_B_Olfr883
  gRNA
aaucuacauuguauccaugg

SEQ ID NO: 105926 - RNA, 20 nt, Artificial Sequence
  MKO10105926_B_Olfr883
  gRNA
uuggaagccauugcacacac

SEQ ID NO: 105927 - RNA, 20 nt, Artificial Sequence
  MKO10105927_B_Olfr883
  gRNA
ccugaugagacaugguaacu

SEQ ID NO: 105928 - RNA, 20 nt, Artificial Sequence
  MKO10105928_B_Olfr884
  gRNA
aaguaccuccaucaaugaga

SEQ ID NO: 105929 - RNA, 20 nt, Artificial Sequence
  MKO10105929_B_Olfr884
  gRNA
aaucuauguggucuccaugu

SEQ ID NO: 105930 - RNA, 20 nt, Artificial Sequence
  MKO10105930_B_Olfr884
  gRNA
gaaaaacauugaugaaacug

SEQ ID NO: 105931 - RNA, 20 nt, Artificial Sequence
  MKO10105931_B_Olfr885
  gRNA
auucagcauuggacccagaa

SEQ ID NO: 105932 - RNA, 20 nt, Artificial Sequence
  MKO10105932_B_Olfr885
  gRNA
gaaaaguaccagcucauuga

SEQ ID NO: 105933 - RNA, 20 nt, Artificial Sequence
  MKO10105933_B_Olfr885
  gRNA
uacuugagcaggagaguuua

SEQ ID NO: 105934 - RNA, 20 nt, Artificial Sequence
  MKO10105934_B_Olfr887
  gRNA
uugugcacgagagcuucaga

SEQ ID NO: 105935 - RNA, 20 nt, Artificial Sequence
  MKO10105935_B_Olfr887
  gRNA
ucuuaguauccauucugcag

SEQ ID NO: 105936 - RNA, 20 nt, Artificial Sequence
  MKO10105936_B_Olfr887
  gRNA
auucaacauugggccuacaa

SEQ ID NO: 105937 - RNA, 20 nt, Artificial Sequence
  MKO10105937_B_Olfr888
  gRNA
ucaggucugccacuugauga

SEQ ID NO: 105938 - RNA, 20 nt, Artificial Sequence
  MKO10105938_B_Olfr888
  gRNA
acacucccaccaucaucaag

SEQ ID NO: 105939 - RNA, 20 nt, Artificial Sequence
  MKO10105939_B_Olfr888
  gRNA
ucgaaagccuucaguacgug

SEQ ID NO: 105940 - RNA, 20 nt, Artificial Sequence
  MKO10105940_B_Olfr889
  gRNA
acauccccacugucaucaag

SEQ ID NO: 105941 - RNA, 20 nt, Artificial Sequence
  MKO10105941_B_Olfr889
  gRNA
aaucuauguggucucuguga

SEQ ID NO: 105942 - RNA, 20 nt, Artificial Sequence
  MKO10105942_B_Olfr889
  gRNA
uacuugugcaggagagcuuc

SEQ ID NO: 105943 - RNA, 20 nt, Artificial Sequence
  MKO10105943_B_Olfr890
  gRNA
aaugauguagccuucacaga

SEQ ID NO: 105944 - RNA, 20 nt, Artificial Sequence
  MKO10105944_B_Olfr890
  gRNA
ucaaaagcauucaggaccug

SEQ ID NO: 105945 - RNA, 20 nt, Artificial Sequence
  MKO10105945_B_Olfr890
  gRNA
agacaugacauuggaaagaa

SEQ ID NO: 105946 - RNA, 20 nt, Artificial Sequence
  MKO10105946_B_Olfr891
  gRNA
ucauacuugaugggagguau

SEQ ID NO: 105947 - RNA, 20 nt, Artificial Sequence
  MKO10105947_B_Olfr891
  gRNA
aguaugaaccaaacaucauc

SEQ ID NO: 105948 - RNA, 20 nt, Artificial Sequence
  MKO10105948_B_Olfr891
  gRNA
acgugaugaucauguacagc

SEQ ID NO: 105949 - RNA, 20 nt, Artificial Sequence
  MKO10105949_B_Olfr893
  gRNA
gaauuauacagcuaccguga

SEQ ID NO: 105950 - RNA, 20 nt, Artificial Sequence
  MKO10105950_B_Olfr893
  gRNA
auguguucccugcuaaugau

SEQ ID NO: 105951 - RNA, 20 nt, Artificial Sequence
  MKO10105951_B_Olfr893
  gRNA
auaaggauggcauauaccaa

SEQ ID NO: 105952 - RNA, 20 nt, Artificial Sequence
  MKO10105952_B_Olfr894
  gRNA
agcuugcuaugaagaaaucc

SEQ ID NO: 105953 - RNA, 20 nt, Artificial Sequence
  MKO10105953_B_Olfr894
  gRNA
cauacauccugugugagcug

SEQ ID NO: 105954 - RNA, 20 nt, Artificial Sequence
  MKO10105954_B_Olfr894
  gRNA
uccaucaucugcugaaacag

SEQ ID NO: 105955 - RNA, 20 nt, Artificial Sequence
  MKO10105955_B_Olfr895
  gRNA
uacaaagcuguuaugucacc

SEQ ID NO: 105956 - RNA, 20 nt, Artificial Sequence
  MKO10105956_B_Olfr895
  gRNA
auaacagcuuuguagagcag

SEQ ID NO: 105957 - RNA, 20 nt, Artificial Sequence
  MKO10105957_B_Olfr895
  gRNA
gugauaucuucccucucuuu

SEQ ID NO: 105958 - RNA, 20 nt, Artificial Sequence
  MKO10105958_B_Olfr898
  gRNA
ggagaccagacccauaaaag

SEQ ID NO: 105959 - RNA, 20 nt, Artificial Sequence
  MKO10105959_B_Olfr898
  gRNA
cagcacauaacauucagagu

SEQ ID NO: 105960 - RNA, 20 nt, Artificial Sequence
  MKO10105960_B_Olfr898
  gRNA
cauaaacccugugugaguca

SEQ ID NO: 105961 - RNA, 20 nt, Artificial Sequence
  MKO10105961_B_Olfr899
  gRNA
uauccauuugucaucaucua

SEQ ID NO: 105962 - RNA, 20 nt, Artificial Sequence
  MKO10105962_B_Olfr899
  gRNA
cuaaagacaguuacaaucca

SEQ ID NO: 105963 - RNA, 20 nt, Artificial Sequence
  MKO10105963_B_Olfr899
  gRNA
aaugcuugcugcacacuuga

SEQ ID NO: 105964 - RNA, 20 nt, Artificial Sequence
  MKO10105964_B_Olfr8
  gRNA
uaaagaugugaagaaagcuc

SEQ ID NO: 105965 - RNA, 20 nt, Artificial Sequence
  MKO10105965_B_Olfr8
  gRNA
cguguacuucccuugaacug

SEQ ID NO: 105966 - RNA, 20 nt, Artificial Sequence
  MKO10105966_B_Olfr8
  gRNA
acuauaaaauaagaagacaa

SEQ ID NO: 105967 - RNA, 20 nt, Artificial Sequence
  MKO10105967_B_Olfr900
  gRNA
ucauaaacccuguaugaguc

SEQ ID NO: 105968 - RNA, 20 nt, Artificial Sequence
  MKO10105968_B_Olfr900
  gRNA
cuguguaguuuaacaagaau

SEQ ID NO: 105969 - RNA, 20 nt, Artificial Sequence
  MKO10105969_B_Olfr900
  gRNA
cuugugagcucugcuguagu

SEQ ID NO: 105970 - RNA, 20 nt, Artificial Sequence
  MKO10105970_B_Olfr901
  gRNA
uaucuuaagccuucuccugu

SEQ ID NO: 105971 - RNA, 20 nt, Artificial Sequence
  MKO10105971_B_Olfr901
  gRNA
aagucuuaugcagugcaaug

SEQ ID NO: 105972 - RNA, 20 nt, Artificial Sequence
  MKO10105972_B_Olfr901
  gRNA
gucucagcaugcaaauugug

SEQ ID NO: 105973 - RNA, 20 nt, Artificial Sequence
  MKO10105973_B_Olfr902
  gRNA
cugagucauacauugcauau

SEQ ID NO: 105974 - RNA, 20 nt, Artificial Sequence
  MKO10105974_B_Olfr902
  gRNA
gauguguuaauccuacuaga

SEQ ID NO: 105975 - RNA, 20 nt, Artificial Sequence
  MKO10105975_B_Olfr902
  gRNA
auuagguuuaaacacacuug

SEQ ID NO: 105976 - RNA, 20 nt, Artificial Sequence
  MKO10105976_B_Olfr904
  gRNA
ggccucugcaaaugugucuu

SEQ ID NO: 105977 - RNA, 20 nt, Artificial Sequence
  MKO10105977_B_Olfr904
  gRNA
gagaugaagauagugaugcu

SEQ ID NO: 105978 - RNA, 20 nt, Artificial Sequence
  MKO10105978_B_Olfr904
  gRNA
uucaaaauuuccaucugcuc

SEQ ID NO: 105979 - RNA, 20 nt, Artificial Sequence
  MKO10105979_B_Olfr905
  gRNA
ucauguaugaacuaaacaua

SEQ ID NO: 105980 - RNA, 20 nt, Artificial Sequence
  MKO10105980_B_Olfr905
  gRNA
uaccuccaguucauugacau

SEQ ID NO: 105981 - RNA, 20 nt, Artificial Sequence
  MKO10105981_B_Olfr905
  gRNA
ccuguuucuaaugauguaug

SEQ ID NO: 105982 - RNA, 20 nt, Artificial Sequence
  MKO10105982_B_Olfr906
  gRNA
auguauauaguaacuaugac

SEQ ID NO: 105983 - RNA, 20 nt, Artificial Sequence
  MKO10105983_B_Olfr906
  gRNA
auagcaauauuauauaagag

SEQ ID NO: 105984 - RNA, 20 nt, Artificial Sequence
  MKO10105984_B_Olfr906
  gRNA
ccauaguuuccaccuacuca

SEQ ID NO: 105985 - RNA, 20 nt, Artificial Sequence
  MKO10105985_B_Olfr907
  gRNA
cguacaucaccagaaagagu

SEQ ID NO: 105986 - RNA, 20 nt, Artificial Sequence
  MKO10105986_B_Olfr907
  gRNA
ucacugaguucaucuugaug

SEQ ID NO: 105987 - RNA, 20 nt, Artificial Sequence
  MKO10105987_B_Olfr907
  gRNA
aacagggguauuuguagguc

SEQ ID NO: 105988 - RNA, 20 nt, Artificial Sequence
  MKO10105988_B_Olfr908
  gRNA
auguuguguucugucaucaa

SEQ ID NO: 105989 - RNA, 20 nt, Artificial Sequence
  MKO10105989_B_Olfr908
  gRNA
gagauugagauuauuauugu

SEQ ID NO: 105990 - RNA, 20 nt, Artificial Sequence
  MKO10105990_B_Olfr908
  gRNA
cuuccaaaugagaucuacug

SEQ ID NO: 105991 - RNA, 20 nt, Artificial Sequence
  MKO10105991_B_Olfr90
  gRNA
ggccuggacgauuggccuag

SEQ ID NO: 105992 - RNA, 20 nt, Artificial Sequence
  MKO10105992_B_Olfr90
  gRNA
uugccccucucucgagcaua

SEQ ID NO: 105993 - RNA, 20 nt, Artificial Sequence
  MKO10105993_B_Olfr90
  gRNA
caaaggccaucacugcuagc

SEQ ID NO: 105994 - RNA, 20 nt, Artificial Sequence
  MKO10105994_B_Olfr910
  gRNA
aaacuaaaaagagggguauu

SEQ ID NO: 105995 - RNA, 20 nt, Artificial Sequence
  MKO10105995_B_Olfr910
  gRNA
agaaaugaugaugacaauac

SEQ ID NO: 105996 - RNA, 20 nt, Artificial Sequence
  MKO10105996_B_Olfr910
  gRNA
uuauuuggagaauauuagag

SEQ ID NO: 105997 - RNA, 20 nt, Artificial Sequence
  MKO10105997_B_Olfr911-ps1
  gRNA
cugcaguggaucucauuuga

SEQ ID NO: 105998 - RNA, 20 nt, Artificial Sequence
  MKO10105998_B_Olfr911-ps1
  gRNA
gauuagaaucucuauuucau

SEQ ID NO: 105999 - RNA, 20 nt, Artificial Sequence
  MKO10105999_B_Olfr911-ps1
  gRNA
guacaggagagcugcaacag

SEQ ID NO: 106000 - RNA, 20 nt, Artificial Sequence
  MKO10106000_B_Olfr912
  gRNA
guucaucauggggacuacaa

SEQ ID NO: 106001 - RNA, 20 nt, Artificial Sequence
  MKO10106001_B_Olfr912
  gRNA
augcacaugacccauaaaac

SEQ ID NO: 106002 - RNA, 20 nt, Artificial Sequence
  MKO10106002_B_Olfr912
  gRNA
uaccugaaacccuccucugu

SEQ ID NO: 106003 - RNA, 20 nt, Artificial Sequence
  MKO10106003_B_Olfr913
  gRNA
uguauccuacaaaaaagagu

SEQ ID NO: 106004 - RNA, 20 nt, Artificial Sequence
  MKO10106004_B_Olfr913
  gRNA
cuuauugauagauagagcug

SEQ ID NO: 106005 - RNA, 20 nt, Artificial Sequence
  MKO10106005_B_Olfr913
  gRNA
guguuaugugcugaccucaa

SEQ ID NO: 106006 - RNA, 20 nt, Artificial Sequence
  MKO10106006_B_Olfr914
  gRNA
ggaagaauggcucuggcaaa

SEQ ID NO: 106007 - RNA, 20 nt, Artificial Sequence
  MKO10106007_B_Olfr914
  gRNA
gugaucaucuuugcuucuua

SEQ ID NO: 106008 - RNA, 20 nt, Artificial Sequence
  MKO10106008_B_Olfr914
  gRNA
gaagaacauuauuucuuaca

SEQ ID NO: 106009 - RNA, 20 nt, Artificial Sequence
  MKO10106009_B_Olfr915
  gRNA
uuauguuugaaccucauacu

SEQ ID NO: 106010 - RNA, 20 nt, Artificial Sequence
  MKO10106010_B_Olfr915
  gRNA
gaacauacaucacuagaaag

SEQ ID NO: 106011 - RNA, 20 nt, Artificial Sequence
  MKO10106011_B_Olfr915
  gRNA
gauguauguucucacuguau

SEQ ID NO: 106012 - RNA, 20 nt, Artificial Sequence
  MKO10106012_B_Olfr916
  gRNA
accauccucagcugagucua

SEQ ID NO: 106013 - RNA, 20 nt, Artificial Sequence
  MKO10106013_B_Olfr916
  gRNA
acccuuguucuuuauauuuc

SEQ ID NO: 106014 - RNA, 20 nt, Artificial Sequence
  MKO10106014_B_Olfr916
  gRNA
uucauccauagacucagcug

SEQ ID NO: 106015 - RNA, 20 nt, Artificial Sequence
  MKO10106015_B_Olfr917
  gRNA
ucaacuauauuugucuccua

SEQ ID NO: 106016 - RNA, 20 nt, Artificial Sequence
  MKO10106016_B_Olfr917
  gRNA
gagacaaauauaguugaagu

SEQ ID NO: 106017 - RNA, 20 nt, Artificial Sequence
  MKO10106017_B_Olfr917
  gRNA
uuucgcaucaguucuucuga

SEQ ID NO: 106018 - RNA, 20 nt, Artificial Sequence
  MKO10106018_B_Olfr918
  gRNA
ucaauaauaagcaugcugac

SEQ ID NO: 106019 - RNA, 20 nt, Artificial Sequence
  MKO10106019_B_Olfr918
  gRNA
ugcuggugcaagaaaguugg

SEQ ID NO: 106020 - RNA, 20 nt, Artificial Sequence
  MKO10106020_B_Olfr918
  gRNA
cugagucaugcaccccucau

SEQ ID NO: 106021 - RNA, 20 nt, Artificial Sequence
  MKO10106021_B_Olfr919
  gRNA
ggcuuugaaucugccuuccg

SEQ ID NO: 106022 - RNA, 20 nt, Artificial Sequence
  MKO10106022_B_Olfr919
  gRNA
cugagucauacauuccucau

SEQ ID NO: 106023 - RNA, 20 nt, Artificial Sequence
  MKO10106023_B_Olfr919
  gRNA
uauugaaagcacugagacac

SEQ ID NO: 106024 - RNA, 20 nt, Artificial Sequence
  MKO10106024_B_Olfr91
  gRNA
uguguccaguguuauucuug

SEQ ID NO: 106025 - RNA, 20 nt, Artificial Sequence
  MKO10106025_B_Olfr91
  gRNA
uugaagcagucccaucaucc

SEQ ID NO: 106026 - RNA, 20 nt, Artificial Sequence
  MKO10106026_B_Olfr91
  gRNA
acucggugguucccaaggac

SEQ ID NO: 106027 - RNA, 20 nt, Artificial Sequence
  MKO10106027_B_Olfr920
  gRNA
aauguacaugauaacugcau

SEQ ID NO: 106028 - RNA, 20 nt, Artificial Sequence
  MKO10106028_B_Olfr920
  gRNA
cugagucauacaacccacau

SEQ ID NO: 106029 - RNA, 20 nt, Artificial Sequence
  MKO10106029_B_Olfr920
  gRNA
uguacauuaauagaaagacc

SEQ ID NO: 106030 - RNA, 20 nt, Artificial Sequence
  MKO10106030_B_Olfr921
  gRNA
uuuccaaauaagauccacuu

SEQ ID NO: 106031 - RNA, 20 nt, Artificial Sequence
  MKO10106031_B_Olfr921
  gRNA
auaacacugccaugucccca

SEQ ID NO: 106032 - RNA, 20 nt, Artificial Sequence
  MKO10106032_B_Olfr921
  gRNA
uugaucaauagauacagcag

SEQ ID NO: 106033 - RNA, 20 nt, Artificial Sequence
  MKO10106033_B_Olfr922
  gRNA
gccucaucaugcaaccugug

SEQ ID NO: 106034 - RNA, 20 nt, Artificial Sequence
  MKO10106034_B_Olfr922
  gRNA
ucauuccaaucagagugagc

SEQ ID NO: 106035 - RNA, 20 nt, Artificial Sequence
  MKO10106035_B_Olfr922
  gRNA
uaguacauaggagugugaag

SEQ ID NO: 106036 - RNA, 20 nt, Artificial Sequence
  MKO10106036_B_Olfr923
  gRNA
cuuacgcaucagcuccacac

SEQ ID NO: 106037 - RNA, 20 nt, Artificial Sequence
  MKO10106037_B_Olfr923
  gRNA
auaauguuauauuauccccc

SEQ ID NO: 106038 - RNA, 20 nt, Artificial Sequence
  MKO10106038_B_Olfr923
  gRNA
uugagucaagcagccuguau

SEQ ID NO: 106039 - RNA, 20 nt, Artificial Sequence
  MKO10106039_B_Olfr924
  gRNA
uaacauugucaugucccaca

SEQ ID NO: 106040 - RNA, 20 nt, Artificial Sequence
  MKO10106040_B_Olfr924
  gRNA
aauauaugugaucacaguag

SEQ ID NO: 106041 - RNA, 20 nt, Artificial Sequence
  MKO10106041_B_Olfr924
  gRNA
agagugaaguugagaacuaa

SEQ ID NO: 106042 - RNA, 20 nt, Artificial Sequence
  MKO10106042_B_Olfr926
  gRNA
cauguaugcccagaaacaag

SEQ ID NO: 106043 - RNA, 20 nt, Artificial Sequence
  MKO10106043_B_Olfr926
  gRNA
auuacaguguuauaaagcag

SEQ ID NO: 106044 - RNA, 20 nt, Artificial Sequence
  MKO10106044_B_Olfr926
  gRNA
acagcaguacuucguugaua

SEQ ID NO: 106045 - RNA, 20 nt, Artificial Sequence
  MKO10106045_B_Olfr92
  gRNA
cccccaccuaugucgccagu

SEQ ID NO: 106046 - RNA, 20 nt, Artificial Sequence
  MKO10106046_B_Olfr92
  gRNA
cuucucugacaacccacaac

SEQ ID NO: 106047 - RNA, 20 nt, Artificial Sequence
  MKO10106047_B_Olfr92
  gRNA
acccucuuguauacacccug

SEQ ID NO: 106048 - RNA, 20 nt, Artificial Sequence
  MKO10106048_B_Olfr930
  gRNA
ugcugcagaaugauucccag

SEQ ID NO: 106049 - RNA, 20 nt, Artificial Sequence
  MKO10106049_B_Olfr930
  gRNA
gaaguaaugacuuaugaugu

SEQ ID NO: 106050 - RNA, 20 nt, Artificial Sequence
  MKO10106050_B_Olfr930
  gRNA
auugagauguguguuagagc

SEQ ID NO: 106051 - RNA, 20 nt, Artificial Sequence
  MKO10106051_B_Olfr933
  gRNA
gccuccuucaaguaacucuc

SEQ ID NO: 106052 - RNA, 20 nt, Artificial Sequence
  MKO10106052_B_Olfr933
  gRNA
uguaacaguuguguuugucu

SEQ ID NO: 106053 - RNA, 20 nt, Artificial Sequence
  MKO10106053_B_Olfr933
  gRNA
aacagcuagagugggcacca

SEQ ID NO: 106054 - RNA, 20 nt, Artificial Sequence
  MKO10106054_B_Olfr934
  gRNA
uaugagcaaguuccccacua

SEQ ID NO: 106055 - RNA, 20 nt, Artificial Sequence
  MKO10106055_B_Olfr934
  gRNA
uugccauaugcuucccucua

SEQ ID NO: 106056 - RNA, 20 nt, Artificial Sequence
  MKO10106056_B_Olfr934
  gRNA
augauuauugaguaccuuag

SEQ ID NO: 106057 - RNA, 20 nt, Artificial Sequence
  MKO10106057_B_Olfr935
  gRNA
aaacuccuaaaacaauugaa

SEQ ID NO: 106058 - RNA, 20 nt, Artificial Sequence
  MKO10106058_B_Olfr935
  gRNA
gugaaaaaauucuuccucuc

SEQ ID NO: 106059 - RNA, 20 nt, Artificial Sequence
  MKO10106059_B_Olfr935
  gRNA
cuuacgcauuaaauccacug

SEQ ID NO: 106060 - RNA, 20 nt, Artificial Sequence
  MKO10106060_B_Olfr936
  gRNA
ucuucaagcuccauagauga

SEQ ID NO: 106061 - RNA, 20 nt, Artificial Sequence
  MKO10106061_B_Olfr936
  gRNA
acaugaugcuacuguaaagc

SEQ ID NO: 106062 - RNA, 20 nt, Artificial Sequence
  MKO10106062_B_Olfr936
  gRNA
uguuucagaauguuucaugc

SEQ ID NO: 106063 - RNA, 20 nt, Artificial Sequence
  MKO10106063_B_Olfr937
  gRNA
aaucuauguggucacuguag

SEQ ID NO: 106064 - RNA, 20 nt, Artificial Sequence
  MKO10106064_B_Olfr937
  gRNA
agcccagucagaaugaacuc

SEQ ID NO: 106065 - RNA, 20 nt, Artificial Sequence
  MKO10106065_B_Olfr937
  gRNA
uaauauagacuccaaagauc

SEQ ID NO: 106066 - RNA, 20 nt, Artificial Sequence
  MKO10106066_B_Olfr938
  gRNA
gguucucuguuaacccagug

SEQ ID NO: 106067 - RNA, 20 nt, Artificial Sequence
  MKO10106067_B_Olfr938
  gRNA
agaaaucaaugauaccucag

SEQ ID NO: 106068 - RNA, 20 nt, Artificial Sequence
  MKO10106068_B_Olfr938
  gRNA
cuaucaagucuguucguuga

SEQ ID NO: 106069 - RNA, 20 nt, Artificial Sequence
  MKO10106069_B_Olfr93
  gRNA
acauaggcggggguggauua

SEQ ID NO: 106070 - RNA, 20 nt, Artificial Sequence
  MKO10106070_B_Olfr93
  gRNA
gugguauuugaacuauggau

SEQ ID NO: 106071 - RNA, 20 nt, Artificial Sequence
  MKO10106071_B_Olfr93
  gRNA
ucucuaauccgacucucuug

SEQ ID NO: 106072 - RNA, 20 nt, Artificial Sequence
  MKO10106072_B_Olfr943
  gRNA
aaauauacaccccuaaaauc

SEQ ID NO: 106073 - RNA, 20 nt, Artificial Sequence
  MKO10106073_B_Olfr943
  gRNA
ucuaucaaacucacugauga

SEQ ID NO: 106074 - RNA, 20 nt, Artificial Sequence
  MKO10106074_B_Olfr943
  gRNA
aagaaccucauuuccuaccc

SEQ ID NO: 106075 - RNA, 20 nt, Artificial Sequence
  MKO10106075_B_Olfr944
  gRNA
aaacaugaagccagugauua

SEQ ID NO: 106076 - RNA, 20 nt, Artificial Sequence
  MKO10106076_B_Olfr944
  gRNA
cccuuugaacuugcccucac

SEQ ID NO: 106077 - RNA, 20 nt, Artificial Sequence
  MKO10106077_B_Olfr944
  gRNA
gcccauagaauucaguaaug

SEQ ID NO: 106078 - RNA, 20 nt, Artificial Sequence
  MKO10106078_B_Olfr945
  gRNA
cacuguagucauguccuauc

SEQ ID NO: 106079 - RNA, 20 nt, Artificial Sequence
  MKO10106079_B_Olfr945
  gRNA
ugcaaaacugaauccuuguc

SEQ ID NO: 106080 - RNA, 20 nt, Artificial Sequence
  MKO10106080_B_Olfr945
  gRNA
aaucaacauuucaucgauau

SEQ ID NO: 106081 - RNA, 20 nt, Artificial Sequence
  MKO10106081_B_Olfr948
  gRNA
cugaauccuaauuauaaagc

SEQ ID NO: 106082 - RNA, 20 nt, Artificial Sequence
  MKO10106082_B_Olfr948
  gRNA
cuggggaugauugcauugau

SEQ ID NO: 106083 - RNA, 20 nt, Artificial Sequence
  MKO10106083_B_Olfr948
  gRNA
acagccuucaucagugaguu

SEQ ID NO: 106084 - RNA, 20 nt, Artificial Sequence
  MKO10106084_B_Olfr94
  gRNA
gccgcuacugugccgcacgc

SEQ ID NO: 106085 - RNA, 20 nt, Artificial Sequence
  MKO10106085_B_Olfr94
  gRNA
ccacacgcgcggcgaacauc

SEQ ID NO: 106086 - RNA, 20 nt, Artificial Sequence
  MKO10106086_B_Olfr94
  gRNA
gugccgaguuuaucccauau

SEQ ID NO: 106087 - RNA, 20 nt, Artificial Sequence
  MKO10106087_B_Olfr951
  gRNA
uccauugaacucacuuguga

SEQ ID NO: 106088 - RNA, 20 nt, Artificial Sequence
  MKO10106088_B_Olfr951
  gRNA
uguugccaucuguaacaccu

SEQ ID NO: 106089 - RNA, 20 nt, Artificial Sequence
  MKO10106089_B_Olfr951
  gRNA
ugcccucccuagagugaaug

SEQ ID NO: 106090 - RNA, 20 nt, Artificial Sequence
  MKO10106090_B_Olfr952
  gRNA
uagaucaugagauucaacac

SEQ ID NO: 106091 - RNA, 20 nt, Artificial Sequence
  MKO10106091_B_Olfr952
  gRNA
gaagauguuuccucaaaaca

SEQ ID NO: 106092 - RNA, 20 nt, Artificial Sequence
  MKO10106092_B_Olfr952
  gRNA
agauaaggaauagaggcaau

SEQ ID NO: 106093 - RNA, 20 nt, Artificial Sequence
  MKO10106093_B_Olfr954
  gRNA
cgaguaaguucaauagacca

SEQ ID NO: 106094 - RNA, 20 nt, Artificial Sequence
  MKO10106094_B_Olfr954
  gRNA
cucugcugugccaaaaauga

SEQ ID NO: 106095 - RNA, 20 nt, Artificial Sequence
  MKO10106095_B_Olfr954
  gRNA
uagagcugagccaagcauuc

SEQ ID NO: 106096 - RNA, 20 nt, Artificial Sequence
  MKO10106096_B_Olfr955
  gRNA
gugacagaguucauucuugc

SEQ ID NO: 106097 - RNA, 20 nt, Artificial Sequence
  MKO10106097_B_Olfr955
  gRNA
uguugcagaaugucacaugu

SEQ ID NO: 106098 - RNA, 20 nt, Artificial Sequence
  MKO10106098_B_Olfr955
  gRNA
aagaaugaacucugucacug

SEQ ID NO: 106099 - RNA, 20 nt, Artificial Sequence
  MKO10106099_B_Olfr957
  gRNA
agcaggggcagcuguagcgc

SEQ ID NO: 106100 - RNA, 20 nt, Artificial Sequence
  MKO10106100_B_Olfr957
  gRNA
auacacccccacuaccaucc

SEQ ID NO: 106101 - RNA, 20 nt, Artificial Sequence
  MKO10106101_B_Olfr957
  gRNA
cauuucuuaugcagaaugca

SEQ ID NO: 106102 - RNA, 20 nt, Artificial Sequence
  MKO10106102_B_Olfr958
  gRNA
ggugagggaaguuaagacgc

SEQ ID NO: 106103 - RNA, 20 nt, Artificial Sequence
  MKO10106103_B_Olfr958
  gRNA
ugauucguguauaggacaga

SEQ ID NO: 106104 - RNA, 20 nt, Artificial Sequence
  MKO10106104_B_Olfr958
  gRNA
gccuacaccaaaccccaugc

SEQ ID NO: 106105 - RNA, 20 nt, Artificial Sequence
  MKO10106105_B_Olfr959
  gRNA
gucauucauuacaacugcuc

SEQ ID NO: 106106 - RNA, 20 nt, Artificial Sequence
  MKO10106106_B_Olfr959
  gRNA
auaauuauugaguagcguaa

SEQ ID NO: 106107 - RNA, 20 nt, Artificial Sequence
  MKO10106107_B_Olfr959
  gRNA
ucacagaguuugugcgaucc

SEQ ID NO: 106108 - RNA, 20 nt, Artificial Sequence
  MKO10106108_B_Olfr95
  gRNA
uuccgcaucccauccgcugc

SEQ ID NO: 106109 - RNA, 20 nt, Artificial Sequence
  MKO10106109_B_Olfr95
  gRNA
agacugcaacgcugcaucug

SEQ ID NO: 106110 - RNA, 20 nt, Artificial Sequence
  MKO10106110_B_Olfr95
  gRNA
cuuuaucuauauccgcccua

SEQ ID NO: 106111 - RNA, 20 nt, Artificial Sequence
  MKO10106111_B_Olfr960
  gRNA
aguguuguuugucauguuca

SEQ ID NO: 106112 - RNA, 20 nt, Artificial Sequence
  MKO10106112_B_Olfr960
  gRNA
caaccucucuaucucugaca

SEQ ID NO: 106113 - RNA, 20 nt, Artificial Sequence
  MKO10106113_B_Olfr960
  gRNA
guuguguccuacacucgaau

SEQ ID NO: 106114 - RNA, 20 nt, Artificial Sequence
  MKO10106114_B_Olfr961
  gRNA
aauguaugccugugcccugc

SEQ ID NO: 106115 - RNA, 20 nt, Artificial Sequence
  MKO10106115_B_Olfr961
  gRNA
acagaaaccuaagucaaaga

SEQ ID NO: 106116 - RNA, 20 nt, Artificial Sequence
  MKO10106116_B_Olfr961
  gRNA
aaccucuccaucuuugacuu

SEQ ID NO: 106117 - RNA, 20 nt, Artificial Sequence
  MKO10106117_B_Olfr963
  gRNA
ucuaaaauucgcucaacaga

SEQ ID NO: 106118 - RNA, 20 nt, Artificial Sequence
  MKO10106118_B_Olfr963
  gRNA
ccuaauccuaguccauugcu

SEQ ID NO: 106119 - RNA, 20 nt, Artificial Sequence
  MKO10106119_B_Olfr963
  gRNA
ugaagguagauaacaaugac

SEQ ID NO: 106120 - RNA, 20 nt, Artificial Sequence
  MKO10106120_B_Olfr965
  gRNA
cauggugacauuauaccuca

SEQ ID NO: 106121 - RNA, 20 nt, Artificial Sequence
  MKO10106121_B_Olfr965
  gRNA
auaggugggguguauugcau

SEQ ID NO: 106122 - RNA, 20 nt, Artificial Sequence
  MKO10106122_B_Olfr965
  gRNA
ugucuuaccaagucuguuua

SEQ ID NO: 106123 - RNA, 20 nt, Artificial Sequence
  MKO10106123_B_Olfr967
  gRNA
gauauuugggguguauagca

SEQ ID NO: 106124 - RNA, 20 nt, Artificial Sequence
  MKO10106124_B_Olfr967
  gRNA
gagcaagaaagcuccaauaa

SEQ ID NO: 106125 - RNA, 20 nt, Artificial Sequence
  MKO10106125_B_Olfr967
  gRNA
acuaccucauugauaaaagu

SEQ ID NO: 106126 - RNA, 20 nt, Artificial Sequence
  MKO10106126_B_Olfr968
  gRNA
gccaucaucaaucaacucca

SEQ ID NO: 106127 - RNA, 20 nt, Artificial Sequence
  MKO10106127_B_Olfr968
  gRNA
ucagcaguugcuauauucuu

SEQ ID NO: 106128 - RNA, 20 nt, Artificial Sequence
  MKO10106128_B_Olfr968
  gRNA
cugugaucuuuccccacucc

SEQ ID NO: 106129 - RNA, 20 nt, Artificial Sequence
  MKO10106129_B_Olfr969
  gRNA
uguccuaucgagucuguucu

SEQ ID NO: 106130 - RNA, 20 nt, Artificial Sequence
  MKO10106130_B_Olfr969
  gRNA
gaacaagagaguuccaguag

SEQ ID NO: 106131 - RNA, 20 nt, Artificial Sequence
  MKO10106131_B_Olfr969
  gRNA
uauguacuugcagccaucuu

SEQ ID NO: 106132 - RNA, 20 nt, Artificial Sequence
  MKO10106132_B_Olfr96
  gRNA
guaaaagugaucaacuaagu

SEQ ID NO: 106133 - RNA, 20 nt, Artificial Sequence
  MKO10106133_B_Olfr96
  gRNA
gauugucuauaccuccacag

SEQ ID NO: 106134 - RNA, 20 nt, Artificial Sequence
  MKO10106134_B_Olfr96
  gRNA
ggcuugcucagauacccaag

SEQ ID NO: 106135 - RNA, 20 nt, Artificial Sequence
  MKO10106135_B_Olfr970
  gRNA
ggcuaugaugaagauguaag

SEQ ID NO: 106136 - RNA, 20 nt, Artificial Sequence
  MKO10106136_B_Olfr970
  gRNA
guuaagagugaauuucugua

SEQ ID NO: 106137 - RNA, 20 nt, Artificial Sequence
  MKO10106137_B_Olfr970
  gRNA
caugcagacugugugaguug

SEQ ID NO: 106138 - RNA, 20 nt, Artificial Sequence
  MKO10106138_B_Olfr971
  gRNA
cacagugggaguuuacacuu

SEQ ID NO: 106139 - RNA, 20 nt, Artificial Sequence
  MKO10106139_B_Olfr971
  gRNA
cuguaacccuuugcuuuaca

SEQ ID NO: 106140 - RNA, 20 nt, Artificial Sequence
  MKO10106140_B_Olfr971
  gRNA
uucauugaacuuacugaaga

SEQ ID NO: 106141 - RNA, 20 nt, Artificial Sequence
  MKO10106141_B_Olfr972
  gRNA
gauauuugguguauucagua

SEQ ID NO: 106142 - RNA, 20 nt, Artificial Sequence
  MKO10106142_B_Olfr972
  gRNA
ugucauuucaagucuguucc

SEQ ID NO: 106143 - RNA, 20 nt, Artificial Sequence
  MKO10106143_B_Olfr972
  gRNA
caaaaaagcauagcuguguc

SEQ ID NO: 106144 - RNA, 20 nt, Artificial Sequence
  MKO10106144_B_Olfr974
  gRNA
uugcucuagagacuauacca

SEQ ID NO: 106145 - RNA, 20 nt, Artificial Sequence
  MKO10106145_B_Olfr974
  gRNA
ccuguuucuguugaucuauu

SEQ ID NO: 106146 - RNA, 20 nt, Artificial Sequence
  MKO10106146_B_Olfr974
  gRNA
uaaccccucaaggacaaaua

SEQ ID NO: 106147 - RNA, 20 nt, Artificial Sequence
  MKO10106147_B_Olfr975
  gRNA
ugacauuuaucuuacucccc

SEQ ID NO: 106148 - RNA, 20 nt, Artificial Sequence
  MKO10106148_B_Olfr975
  gRNA
aaaagauaucgagcacugac

SEQ ID NO: 106149 - RNA, 20 nt, Artificial Sequence
  MKO10106149_B_Olfr975
  gRNA
gugggaaucccauauacagc

SEQ ID NO: 106150 - RNA, 20 nt, Artificial Sequence
  MKO10106150_B_Olfr976
  gRNA
cugaaaauccguuccucaga

SEQ ID NO: 106151 - RNA, 20 nt, Artificial Sequence
  MKO10106151_B_Olfr976
  gRNA
uucuauuccuuauaccccaa

SEQ ID NO: 106152 - RNA, 20 nt, Artificial Sequence
  MKO10106152_B_Olfr976
  gRNA
cuugacuuaacaucuuucuc

SEQ ID NO: 106153 - RNA, 20 nt, Artificial Sequence
  MKO10106153_B_Olfr978
  gRNA
cucagguagaugaagagacc

SEQ ID NO: 106154 - RNA, 20 nt, Artificial Sequence
  MKO10106154_B_Olfr978
  gRNA
acucagguacagcagcauga

SEQ ID NO: 106155 - RNA, 20 nt, Artificial Sequence
  MKO10106155_B_Olfr978
  gRNA
cuggucucuucaucuaccug

SEQ ID NO: 106156 - RNA, 20 nt, Artificial Sequence
  MKO10106156_B_Olfr979
  gRNA
gauuuacauucucacugugc

SEQ ID NO: 106157 - RNA, 20 nt, Artificial Sequence
  MKO10106157_B_Olfr979
  gRNA
cccugauuaccaucagaauc

SEQ ID NO: 106158 - RNA, 20 nt, Artificial Sequence
  MKO10106158_B_Olfr979
  gRNA
uccugauucugaugguaauc

SEQ ID NO: 106159 - RNA, 20 nt, Artificial Sequence
  MKO10106159_B_Olfr97
  gRNA
gugggaacugcauguagcca

SEQ ID NO: 106160 - RNA, 20 nt, Artificial Sequence
  MKO10106160_B_Olfr97
  gRNA
uugccauuucucugaguuac

SEQ ID NO: 106161 - RNA, 20 nt, Artificial Sequence
  MKO10106161_B_Olfr97
  gRNA
acugagagagcaacaaaaua

SEQ ID NO: 106162 - RNA, 20 nt, Artificial Sequence
  MKO10106162_B_Olfr980
  gRNA
gaaauaaugcugaaucucau

SEQ ID NO: 106163 - RNA, 20 nt, Artificial Sequence
  MKO10106163_B_Olfr980
  gRNA
aaugaaaaaucaguguaguc

SEQ ID NO: 106164 - RNA, 20 nt, Artificial Sequence
  MKO10106164_B_Olfr980
  gRNA
uucucauccugauggugauc

SEQ ID NO: 106165 - RNA, 20 nt, Artificial Sequence
  MKO10106165_B_Olfr981
  gRNA
aagagugguaccccgagcug

SEQ ID NO: 106166 - RNA, 20 nt, Artificial Sequence
  MKO10106166_B_Olfr981
  gRNA
gccaggccguagguaaauga

SEQ ID NO: 106167 - RNA, 20 nt, Artificial Sequence
  MKO10106167_B_Olfr981
  gRNA
gccugaauaugaaacucguu

SEQ ID NO: 106168 - RNA, 20 nt, Artificial Sequence
  MKO10106168_B_Olfr982
  gRNA
acccgcuuguucauaaccac

SEQ ID NO: 106169 - RNA, 20 nt, Artificial Sequence
  MKO10106169_B_Olfr982
  gRNA
ccguguacaucagacccucc

SEQ ID NO: 106170 - RNA, 20 nt, Artificial Sequence
  MKO10106170_B_Olfr982
  gRNA
uugcacagcacaucucaccg

SEQ ID NO: 106171 - RNA, 20 nt, Artificial Sequence
  MKO10106171_B_Olfr983
  gRNA
gcagcugugucaagcccaac

SEQ ID NO: 106172 - RNA, 20 nt, Artificial Sequence
  MKO10106172_B_Olfr983
  gRNA
uggaccuacccuuugcagaa

SEQ ID NO: 106173 - RNA, 20 nt, Artificial Sequence
  MKO10106173_B_Olfr983
  gRNA
gaaaaacuguucacuuaagu

SEQ ID NO: 106174 - RNA, 20 nt, Artificial Sequence
  MKO10106174_B_Olfr984
  gRNA
ucauaauuaguguguagcgu

SEQ ID NO: 106175 - RNA, 20 nt, Artificial Sequence
  MKO10106175_B_Olfr984
  gRNA
uacauaguugugugcaaacg

SEQ ID NO: 106176 - RNA, 20 nt, Artificial Sequence
  MKO10106176_B_Olfr984
  gRNA
uguuccacagcugaucaaau

SEQ ID NO: 106177 - RNA, 20 nt, Artificial Sequence
  MKO10106177_B_Olfr985
  gRNA
uaucucguauucugauugua

SEQ ID NO: 106178 - RNA, 20 nt, Artificial Sequence
  MKO10106178_B_Olfr985
  gRNA
ccuccgcauccacucuaaag

SEQ ID NO: 106179 - RNA, 20 nt, Artificial Sequence
  MKO10106179_B_Olfr985
  gRNA
gauuuacauagucacaaugg

SEQ ID NO: 106180 - RNA, 20 nt, Artificial Sequence
  MKO10106180_B_Olfr986
  gRNA
ucauaaugguuggguaacgg

SEQ ID NO: 106181 - RNA, 20 nt, Artificial Sequence
  MKO10106181_B_Olfr986
  gRNA
caguggcugaagggauccgu

SEQ ID NO: 106182 - RNA, 20 nt, Artificial Sequence
  MKO10106182_B_Olfr986
  gRNA
aggccauuacuugugcaaac

SEQ ID NO: 106183 - RNA, 20 nt, Artificial Sequence
  MKO10106183_B_Olfr987
  gRNA
augacuaugggauagcgcaa

SEQ ID NO: 106184 - RNA, 20 nt, Artificial Sequence
  MKO10106184_B_Olfr987
  gRNA
gaugguugcaaaaguaccau

SEQ ID NO: 106185 - RNA, 20 nt, Artificial Sequence
  MKO10106185_B_Olfr987
  gRNA
aaagcuuccauaucuuucau

SEQ ID NO: 106186 - RNA, 20 nt, Artificial Sequence
  MKO10106186_B_Olfr988
  gRNA
ggcagacaagacauaugugu

SEQ ID NO: 106187 - RNA, 20 nt, Artificial Sequence
  MKO10106187_B_Olfr988
  gRNA
gugccaagauuugugcuguc

SEQ ID NO: 106188 - RNA, 20 nt, Artificial Sequence
  MKO10106188_B_Olfr988
  gRNA
cuguaacauacaucccauga

SEQ ID NO: 106189 - RNA, 20 nt, Artificial Sequence
  MKO10106189_B_Olfr98
  gRNA
acccacgaugaacugcaguc

SEQ ID NO: 106190 - RNA, 20 nt, Artificial Sequence
  MKO10106190_B_Olfr98
  gRNA
agcagcuaccaccuccugag

SEQ ID NO: 106191 - RNA, 20 nt, Artificial Sequence
  MKO10106191_B_Olfr98
  gRNA
agagaggugggaacuacaug

SEQ ID NO: 106192 - RNA, 20 nt, Artificial Sequence
  MKO10106192_B_Olfr992
  gRNA
cauuuacauagccacuuuag

SEQ ID NO: 106193 - RNA, 20 nt, Artificial Sequence
  MKO10106193_B_Olfr992
  gRNA
caguauugaccucaauauca

SEQ ID NO: 106194 - RNA, 20 nt, Artificial Sequence
  MKO10106194_B_Olfr992
  gRNA
augauaauaggauagcgcag

SEQ ID NO: 106195 - RNA, 20 nt, Artificial Sequence
  MKO10106195_B_Olfr993
  gRNA
gaagacagauacauaucauu

SEQ ID NO: 106196 - RNA, 20 nt, Artificial Sequence
  MKO10106196_B_Olfr993
  gRNA
ccgaaaagucugcauccaga

SEQ ID NO: 106197 - RNA, 20 nt, Artificial Sequence
  MKO10106197_B_Olfr993
  gRNA
gauaacaagaaucuugauau

SEQ ID NO: 106198 - RNA, 20 nt, Artificial Sequence
  MKO10106198_B_Olfr994
  gRNA
gccuccuucagacaauuccg

SEQ ID NO: 106199 - RNA, 20 nt, Artificial Sequence
  MKO10106199_B_Olfr994
  gRNA
uagcaugaaagagugacaau

SEQ ID NO: 106200 - RNA, 20 nt, Artificial Sequence
  MKO10106200_B_Olfr994
  gRNA
cuuaucauacauauacauca

SEQ ID NO: 106201 - RNA, 20 nt, Artificial Sequence
  MKO10106201_B_Olfr995
  gRNA
aacuugucgagacaugauua

SEQ ID NO: 106202 - RNA, 20 nt, Artificial Sequence
  MKO10106202_B_Olfr995
  gRNA
gucuggaguuaguguuaaug

SEQ ID NO: 106203 - RNA, 20 nt, Artificial Sequence
  MKO10106203_B_Olfr995
  gRNA
ccacaagaaauacaacgaag

SEQ ID NO: 106204 - RNA, 20 nt, Artificial Sequence
  MKO10106204_B_Olfr996
  gRNA
ugacacccacauaaauaagu

SEQ ID NO: 106205 - RNA, 20 nt, Artificial Sequence
  MKO10106205_B_Olfr996
  gRNA
uguuguacuuauaagagcaa

SEQ ID NO: 106206 - RNA, 20 nt, Artificial Sequence
  MKO10106206_B_Olfr996
  gRNA
uggggaugaucgcucucaua

SEQ ID NO: 106207 - RNA, 20 nt, Artificial Sequence
  MKO10106207_B_Olfr998
  gRNA
auacucuccuuaugucucag

SEQ ID NO: 106208 - RNA, 20 nt, Artificial Sequence
  MKO10106208_B_Olfr998
  gRNA
auucgaccucaccugccugc

SEQ ID NO: 106209 - RNA, 20 nt, Artificial Sequence
  MKO10106209_B_Olfr998
  gRNA
gaacgguaagcaaaaagcca

SEQ ID NO: 106210 - RNA, 20 nt, Artificial Sequence
  MKO10106210_B_Olfr99
  gRNA
acuagaaccccacaucuaaa

SEQ ID NO: 106211 - RNA, 20 nt, Artificial Sequence
  MKO10106211_B_Olfr99
  gRNA
auugaggagaauccuaaaca

SEQ ID NO: 106212 - RNA, 20 nt, Artificial Sequence
  MKO10106212_B_Olfr99
  gRNA
gacccagcaaguagauaaca

SEQ ID NO: 106213 - RNA, 20 nt, Artificial Sequence
  MKO10106213_B_Olfr9
  gRNA
cguccccuucuuauugauug

SEQ ID NO: 106214 - RNA, 20 nt, Artificial Sequence
  MKO10106214_B_Olfr9
  gRNA
uguagaccaaaguaagaauc

SEQ ID NO: 106215 - RNA, 20 nt, Artificial Sequence
  MKO10106215_B_Olfr9
  gRNA
ucucuucaugagccgccuca

SEQ ID NO: 106216 - RNA, 20 nt, Artificial Sequence
  MKO10106216_B_Olig1
  gRNA
cgggaacuugcacaccgcac

SEQ ID NO: 106217 - RNA, 20 nt, Artificial Sequence
  MKO10106217_B_Olig1
  gRNA
gagccgcguucacacgcgcc

SEQ ID NO: 106218 - RNA, 20 nt, Artificial Sequence
  MKO10106218_B_Olig1
  gRNA
gcgcucgacgagccaccgug

SEQ ID NO: 106219 - RNA, 20 nt, Artificial Sequence
  MKO10106219_B_Olig2
  gRNA
ccgauggguggaagccggcg

SEQ ID NO: 106220 - RNA, 20 nt, Artificial Sequence
  MKO10106220_B_Olig2
  gRNA
cguaaggcaugaccucccgc

SEQ ID NO: 106221 - RNA, 20 nt, Artificial Sequence
  MKO10106221_B_Olig2
  gRNA
uguccucggucggauccauc

SEQ ID NO: 106222 - RNA, 20 nt, Artificial Sequence
  MKO10106222_B_Olig3
  gRNA
ccggcuuucggcugaaucca

SEQ ID NO: 106223 - RNA, 20 nt, Artificial Sequence
  MKO10106223_B_Olig3
  gRNA
caccgagggcccgugagcgu

SEQ ID NO: 106224 - RNA, 20 nt, Artificial Sequence
  MKO10106224_B_Olig3
  gRNA
agccgaaagccgggccaugu

SEQ ID NO: 106225 - RNA, 20 nt, Artificial Sequence
  MKO10106225_B_Olr1
  gRNA
cucguccagcuuccggguga

SEQ ID NO: 106226 - RNA, 20 nt, Artificial Sequence
  MKO10106226_B_Olr1
  gRNA
auuguguccacuguacaaua

SEQ ID NO: 106227 - RNA, 20 nt, Artificial Sequence
  MKO10106227_B_Olr1
  gRNA
ucucguucagcuucaaggug

SEQ ID NO: 106228 - RNA, 20 nt, Artificial Sequence
  MKO10106228_B_Oma1
  gRNA
cauuuguccccgagacagcu

SEQ ID NO: 106229 - RNA, 20 nt, Artificial Sequence
  MKO10106229_B_Oma1
  gRNA
uaacaguaguuuacuccuuc

SEQ ID NO: 106230 - RNA, 20 nt, Artificial Sequence
  MKO10106230_B_Oma1
  gRNA
cgguacucacggcgugcccc

SEQ ID NO: 106231 - RNA, 20 nt, Artificial Sequence
  MKO10106231_B_Omd
  gRNA
ggaagacgaccaugacaguc

SEQ ID NO: 106232 - RNA, 20 nt, Artificial Sequence
  MKO10106232_B_Omd
  gRNA
cacauucaccagcccgucca

SEQ ID NO: 106233 - RNA, 20 nt, Artificial Sequence
  MKO10106233_B_Omd
  gRNA
aaucuuauagaacucaacgu

SEQ ID NO: 106234 - RNA, 20 nt, Artificial Sequence
  MKO10106234_B_Omg
  gRNA
uccacgauaugcaguuugga

SEQ ID NO: 106235 - RNA, 20 nt, Artificial Sequence
  MKO10106235_B_Omg
  gRNA
gccuuccaaacugcauaucg

SEQ ID NO: 106236 - RNA, 20 nt, Artificial Sequence
  MKO10106236_B_Omg
  gRNA
gauugguauaugggguuaac

SEQ ID NO: 106237 - RNA, 20 nt, Artificial Sequence
  MKO10106237_B_Omp
  gRNA
cgccgccaucuucuggcgca

SEQ ID NO: 106238 - RNA, 20 nt, Artificial Sequence
  MKO10106238_B_Omp
  gRNA
ugaucuggccaagauccgca

SEQ ID NO: 106239 - RNA, 20 nt, Artificial Sequence
  MKO10106239_B_Omp
  gRNA
cuacucggagccgcaucugc

SEQ ID NO: 106240 - RNA, 20 nt, Artificial Sequence
  MKO10106240_B_Omt2a
  gRNA
gacacagucguguacauuau

SEQ ID NO: 106241 - RNA, 20 nt, Artificial Sequence
  MKO10106241_B_Omt2a
  gRNA
cucacauguuggaggguugc

SEQ ID NO: 106242 - RNA, 20 nt, Artificial Sequence
  MKO10106242_B_Omt2a
  gRNA
uuucucuuuagccagagccu

SEQ ID NO: 106243 - RNA, 20 nt, Artificial Sequence
  MKO10106243_B_Omt2b
  gRNA
ucccuucccagauuugaggc

SEQ ID NO: 106244 - RNA, 20 nt, Artificial Sequence
  MKO10106244_B_Omt2b
  gRNA
ccucuuaaaugaaguaccuc

SEQ ID NO: 106245 - RNA, 20 nt, Artificial Sequence
  MKO10106245_B_Omt2b
  gRNA
uuucucuuuagccagagccu

SEQ ID NO: 106246 - RNA, 20 nt, Artificial Sequence
  MKO10106246_B_Onecuu1
  gRNA
uuugguacaagugcucgaug

SEQ ID NO: 106247 - RNA, 20 nt, Artificial Sequence
  MKO10106247_B_Onecuu1
  gRNA
ucccgcgcacccgcguucca

SEQ ID NO: 106248 - RNA, 20 nt, Artificial Sequence
  MKO10106248_B_Onecuu1
  gRNA
cuccccguggcgaccgagca

SEQ ID NO: 106249 - RNA, 20 nt, Artificial Sequence
  MKO10106249_B_Onecuu2
  gRNA
auuucuccaggcugcgacgc

SEQ ID NO: 106250 - RNA, 20 nt, Artificial Sequence
  MKO10106250_B_Onecuu2
  gRNA
gucgcugccguccaagaucg

SEQ ID NO: 106251 - RNA, 20 nt, Artificial Sequence
  MKO10106251_B_Onecuu2
  gRNA
cgcggcgucgcgcucggcca

SEQ ID NO: 106252 - RNA, 20 nt, Artificial Sequence
  MKO10106252_B_Onecuu3
  gRNA
auccugcucuuuacgcuugc

SEQ ID NO: 106253 - RNA, 20 nt, Artificial Sequence
  MKO10106253_B_Onecuu3
  gRNA
ccgcccgcucgucgcgcaug

SEQ ID NO: 106254 - RNA, 20 nt, Artificial Sequence
  MKO10106254_B_Onecuu3
  gRNA
cgccccagaagcgccgcgug

SEQ ID NO: 106255 - RNA, 20 nt, Artificial Sequence
  MKO10106255_B_Ooep
  gRNA
ggcuggcuuuccgcuuccgc

SEQ ID NO: 106256 - RNA, 20 nt, Artificial Sequence
  MKO10106256_B_Ooep
  gRNA
ugucccugagacuucgcacu

SEQ ID NO: 106257 - RNA, 20 nt, Artificial Sequence
  MKO10106257_B_Ooep
  gRNA
cuaagcaaguuaaguaagaa

SEQ ID NO: 106258 - RNA, 20 nt, Artificial Sequence
  MKO10106258_B_Oog1
  gRNA
cugucuccauuguccagauc

SEQ ID NO: 106259 - RNA, 20 nt, Artificial Sequence
  MKO10106259_B_Oog1
  gRNA
gcauagccuucaaagucucc

SEQ ID NO: 106260 - RNA, 20 nt, Artificial Sequence
  MKO10106260_B_Oog1
  gRNA
uucuuuagaagaagucacag

SEQ ID NO: 106261 - RNA, 20 nt, Artificial Sequence
  MKO10106261_B_Oog2
  gRNA
auugcucaucuguuucagau

SEQ ID NO: 106262 - RNA, 20 nt, Artificial Sequence
  MKO10106262_B_Oog2
  gRNA
gguauagcucaucagcuagc

SEQ ID NO: 106263 - RNA, 20 nt, Artificial Sequence
  MKO10106263_B_Oog2
  gRNA
uugucuuugccuagaauauu

SEQ ID NO: 106264 - RNA, 20 nt, Artificial Sequence
  MKO10106264_B_Oog3
  gRNA
ugucuacuccccauccaccc

SEQ ID NO: 106265 - RNA, 20 nt, Artificial Sequence
  MKO10106265_B_Oog3
  gRNA
uaucuaccacauuuagaaca

SEQ ID NO: 106266 - RNA, 20 nt, Artificial Sequence
  MKO10106266_B_Oog3
  gRNA
gcaaacucagaguacucaaa

SEQ ID NO: 106267 - RNA, 20 nt, Artificial Sequence
  MKO10106267_B_Oog4
  gRNA
uugcacaaaaugaucgcucc

SEQ ID NO: 106268 - RNA, 20 nt, Artificial Sequence
  MKO10106268_B_Oog4
  gRNA
gguauaccucauaggucagc

SEQ ID NO: 106269 - RNA, 20 nt, Artificial Sequence
  MKO10106269_B_Oog4
  gRNA
ugaaggccaugauaccugua

SEQ ID NO: 106270 - RNA, 20 nt, Artificial Sequence
  MKO10106270_B_Oosp1
  gRNA
gauuucacuggugauccucc

SEQ ID NO: 106271 - RNA, 20 nt, Artificial Sequence
  MKO10106271_B_Oosp1
  gRNA
cucagaccugcucguuucag

SEQ ID NO: 106272 - RNA, 20 nt, Artificial Sequence
  MKO10106272_B_Oosp1
  gRNA
gucugcaaugugccgaccac

SEQ ID NO: 106273 - RNA, 20 nt, Artificial Sequence
  MKO10106273_B_Oosp2
  gRNA
aguuccaaacaauaauuccu

SEQ ID NO: 106274 - RNA, 20 nt, Artificial Sequence
  MKO10106274_B_Oosp2
  gRNA
gugcguguauuugaguuaca

SEQ ID NO: 106275 - RNA, 20 nt, Artificial Sequence
  MKO10106275_B_Oosp2
  gRNA
uaugccacuaucuacugagg

SEQ ID NO: 106276 - RNA, 20 nt, Artificial Sequence
  MKO10106276_B_Oosp3
  gRNA
ccuggcucaccuauaugccc

SEQ ID NO: 106277 - RNA, 20 nt, Artificial Sequence
  MKO10106277_B_Oosp3
  gRNA
cccugaugaauuauuauuag

SEQ ID NO: 106278 - RNA, 20 nt, Artificial Sequence
  MKO10106278_B_Oosp3
  gRNA
ggaauucuuacccaguuauu

SEQ ID NO: 106279 - RNA, 20 nt, Artificial Sequence
  MKO10106279_B_Opa1
  gRNA
aaaacuucgauauaucauac

SEQ ID NO: 106280 - RNA, 20 nt, Artificial Sequence
  MKO10106280_B_Opa1
  gRNA
cauaucuuuccauucaucga

SEQ ID NO: 106281 - RNA, 20 nt, Artificial Sequence
  MKO10106281_B_Opa1
  gRNA
caauccacuuauagucacua

SEQ ID NO: 106282 - RNA, 20 nt, Artificial Sequence
  MKO10106282_B_Opa3
  gRNA
gcggacgaagaugcgcauaa

SEQ ID NO: 106283 - RNA, 20 nt, Artificial Sequence
  MKO10106283_B_Opa3
  gRNA
ucguccgcaucuccacccag

SEQ ID NO: 106284 - RNA, 20 nt, Artificial Sequence
  MKO10106284_B_Opa3
  gRNA
gccuccgcccacaaugaaga

SEQ ID NO: 106285 - RNA, 20 nt, Artificial Sequence
  MKO10106285_B_Opalin
  gRNA
cgugcuuaccucagauauuu

SEQ ID NO: 106286 - RNA, 20 nt, Artificial Sequence
  MKO10106286_B_Opalin
  gRNA
cuuuacacugccaucgaaua

SEQ ID NO: 106287 - RNA, 20 nt, Artificial Sequence
  MKO10106287_B_Opalin
  gRNA
gcuuuggcacucgugacaac

SEQ ID NO: 106288 - RNA, 20 nt, Artificial Sequence
  MKO10106288_B_Opcml
  gRNA
uugaccaaaaugaucacucg

SEQ ID NO: 106289 - RNA, 20 nt, Artificial Sequence
  MKO10106289_B_Opcml
  gRNA
cugacgagauguucauuauc

SEQ ID NO: 106290 - RNA, 20 nt, Artificial Sequence
  MKO10106290_B_Opcml
  gRNA
ggguggcgcucucccccugc

SEQ ID NO: 106291 - RNA, 20 nt, Artificial Sequence
  MKO10106291_B_Ophn1
  gRNA
ugacuugcugaucaaacccc

SEQ ID NO: 106292 - RNA, 20 nt, Artificial Sequence
  MKO10106292_B_Ophn1
  gRNA
gaaagaaucucagcuacuag

SEQ ID NO: 106293 - RNA, 20 nt, Artificial Sequence
  MKO10106293_B_Ophn1
  gRNA
accuauauuaaucucaucau

SEQ ID NO: 106294 - RNA, 20 nt, Artificial Sequence
  MKO10106294_B_Oplah
  gRNA
cgcaccuuugacgggagagc

SEQ ID NO: 106295 - RNA, 20 nt, Artificial Sequence
  MKO10106295_B_Oplah
  gRNA
ggaagcccugcacauagcgc

SEQ ID NO: 106296 - RNA, 20 nt, Artificial Sequence
  MKO10106296_B_Oplah
  gRNA
gacucggggcauucacagcc

SEQ ID NO: 106297 - RNA, 20 nt, Artificial Sequence
  MKO10106297_B_Opn1mw
  gRNA
aacgaccacaagaaucaucc

SEQ ID NO: 106298 - RNA, 20 nt, Artificial Sequence
  MKO10106298_B_Opn1mw
  gRNA
gugauaauuggggccuucaa

SEQ ID NO: 106299 - RNA, 20 nt, Artificial Sequence
  MKO10106299_B_Opn1mw
  gRNA
uaccugcuccaaccaaagau

SEQ ID NO: 106300 - RNA, 20 nt, Artificial Sequence
  MKO10106300_B_Opn1sw
  gRNA
ccgauuguugaccauguaca

SEQ ID NO: 106301 - RNA, 20 nt, Artificial Sequence
  MKO10106301_B_Opn1sw
  gRNA
caagccguaaguccagcccg

SEQ ID NO: 106302 - RNA, 20 nt, Artificial Sequence
  MKO10106302_B_Opn1sw
  gRNA
caacguagcguucaaaagcc

SEQ ID NO: 106303 - RNA, 20 nt, Artificial Sequence
  MKO10106303_B_Opn3
  gRNA
cacacggauauaacguucau

SEQ ID NO: 106304 - RNA, 20 nt, Artificial Sequence
  MKO10106304_B_Opn3
  gRNA
uuacauugugacccgcuucu

SEQ ID NO: 106305 - RNA, 20 nt, Artificial Sequence
  MKO10106305_B_Opn3
  gRNA
auucuuauagaggacgcacu

SEQ ID NO: 106306 - RNA, 20 nt, Artificial Sequence
  MKO10106306_B_Opn4
  gRNA
gaccaugcucacuauacccu

SEQ ID NO: 106307 - RNA, 20 nt, Artificial Sequence
  MKO10106307_B_Opn4
  gRNA
ccagcagccucuacaagaag

SEQ ID NO: 106308 - RNA, 20 nt, Artificial Sequence
  MKO10106308_B_Opn4
  gRNA
guuaagcuugacaagacucu

SEQ ID NO: 106309 - RNA, 20 nt, Artificial Sequence
  MKO10106309_B_Opn5
  gRNA
uugauagucauuauuuccgc

SEQ ID NO: 106310 - RNA, 20 nt, Artificial Sequence
  MKO10106310_B_Opn5
  gRNA
uuacagauuugccuguugcc

SEQ ID NO: 106311 - RNA, 20 nt, Artificial Sequence
  MKO10106311_B_Opn5
  gRNA
guacaauccaaucaucuacc

SEQ ID NO: 106312 - RNA, 20 nt, Artificial Sequence
  MKO10106312_B_Oprd1
  gRNA
cgccaaugcgucggggucgc

SEQ ID NO: 106313 - RNA, 20 nt, Artificial Sequence
  MKO10106313_B_Oprd1
  gRNA
uugcacagcagcucgccaaa

SEQ ID NO: 106314 - RNA, 20 nt, Artificial Sequence
  MKO10106314_B_Oprd1
  gRNA
ccagagcgccaaguacuuga

SEQ ID NO: 106315 - RNA, 20 nt, Artificial Sequence
  MKO10106315_B_Oprk1
  gRNA
ugggcagaauccgacaguaa

SEQ ID NO: 106316 - RNA, 20 nt, Artificial Sequence
  MKO10106316_B_Oprk1
  gRNA
gauggccggagagaugugcg

SEQ ID NO: 106317 - RNA, 20 nt, Artificial Sequence
  MKO10106317_B_Oprk1
  gRNA
auauaccaacagaugaugcc

SEQ ID NO: 106318 - RNA, 20 nt, Artificial Sequence
  MKO10106318_B_Oprl1
  gRNA
uaaagcccaggccguuaaug

SEQ ID NO: 106319 - RNA, 20 nt, Artificial Sequence
  MKO10106319_B_Oprl1
  gRNA
agccaaguagagccccacga

SEQ ID NO: 106320 - RNA, 20 nt, Artificial Sequence
  MKO10106320_B_Oprl1
  gRNA
gaugggguacggucucauuu

SEQ ID NO: 106321 - RNA, 20 nt, Artificial Sequence
  MKO10106321_B_Oprm1
  gRNA
uggucugcccguaauguuca

SEQ ID NO: 106322 - RNA, 20 nt, Artificial Sequence
  MKO10106322_B_Oprm1
  gRNA
uuuaagguuaccugccaagc

SEQ ID NO: 106323 - RNA, 20 nt, Artificial Sequence
  MKO10106323_B_Oprm1
  gRNA
ccuguccaugcaacucuugc

SEQ ID NO: 106324 - RNA, 20 nt, Artificial Sequence
  MKO10106324_B_Opuc
  gRNA
auugucaccaaaccucacga

SEQ ID NO: 106325 - RNA, 20 nt, Artificial Sequence
  MKO10106325_B_Opuc
  gRNA
cacuuacgcgucccuguaug

SEQ ID NO: 106326 - RNA, 20 nt, Artificial Sequence
  MKO10106326_B_Opuc
  gRNA
gaaccauacccugagcauag

SEQ ID NO: 106327 - RNA, 20 nt, Artificial Sequence
  MKO10106327_B_Optn
  gRNA
uucaaacuccgcacaacucc

SEQ ID NO: 106328 - RNA, 20 nt, Artificial Sequence
  MKO10106328_B_Optn
  gRNA
ccaucaccuacaagcugaug

SEQ ID NO: 106329 - RNA, 20 nt, Artificial Sequence
  MKO10106329_B_Optn
  gRNA
cuaaauaaucaagcuaugaa

SEQ ID NO: 106330 - RNA, 20 nt, Artificial Sequence
  MKO10106330_B_Orai1
  gRNA
gugacucuuugaccgaguug

SEQ ID NO: 106331 - RNA, 20 nt, Artificial Sequence
  MKO10106331_B_Orai1
  gRNA
gcuuaaguagagcuugcgcc

SEQ ID NO: 106332 - RNA, 20 nt, Artificial Sequence
  MKO10106332_B_Orai1
  gRNA
ucaucaccucggaguaacuc

SEQ ID NO: 106333 - RNA, 20 nt, Artificial Sequence
  MKO10106333_B_Orai2
  gRNA
ugcagagcucaaugugccca

SEQ ID NO: 106334 - RNA, 20 nt, Artificial Sequence
  MKO10106334_B_Orai2
  gRNA
gccccugccugcccugaacc

SEQ ID NO: 106335 - RNA, 20 nt, Artificial Sequence
  MKO10106335_B_Orai2
  gRNA
ccggcuggaggcuuucagcu

SEQ ID NO: 106336 - RNA, 20 nt, Artificial Sequence
  MKO10106336_B_Orai3
  gRNA
cgaacaggccccgcugaacc

SEQ ID NO: 106337 - RNA, 20 nt, Artificial Sequence
  MKO10106337_B_Orai3
  gRNA
guucgugcaccgcggcuacc

SEQ ID NO: 106338 - RNA, 20 nt, Artificial Sequence
  MKO10106338_B_Orai3
  gRNA
ccgguacguggcugagcccg

SEQ ID NO: 106339 - RNA, 20 nt, Artificial Sequence
  MKO10106339_B_Oraov1
  gRNA
caacgugcagccagacuuca

SEQ ID NO: 106340 - RNA, 20 nt, Artificial Sequence
  MKO10106340_B_Oraov1
  gRNA
ggcucugauugcgcugcugc

SEQ ID NO: 106341 - RNA, 20 nt, Artificial Sequence
  MKO10106341_B_Oraov1
  gRNA
uuucaccagcgccacugugu

SEQ ID NO: 106342 - RNA, 20 nt, Artificial Sequence
  MKO10106342_B_Orc1
  gRNA
ccccaaugcaaagaagucgc

SEQ ID NO: 106343 - RNA, 20 nt, Artificial Sequence
  MKO10106343_B_Orc1
  gRNA
cuguacucgugcacauuucu

SEQ ID NO: 106344 - RNA, 20 nt, Artificial Sequence
  MKO10106344_B_Orc1
  gRNA
cuuaaugcugcaagcacuuc

SEQ ID NO: 106345 - RNA, 20 nt, Artificial Sequence
  MKO10106345_B_Orc2
  gRNA
uacuucagagaaagcuccac

SEQ ID NO: 106346 - RNA, 20 nt, Artificial Sequence
  MKO10106346_B_Orc2
  gRNA
cccugaagagaugacuaaau

SEQ ID NO: 106347 - RNA, 20 nt, Artificial Sequence
  MKO10106347_B_Orc2
  gRNA
uuagaacuagcaaaaacauc

SEQ ID NO: 106348 - RNA, 20 nt, Artificial Sequence
  MKO10106348_B_Orc3
  gRNA
uugaaacauauagcuugcua

SEQ ID NO: 106349 - RNA, 20 nt, Artificial Sequence
  MKO10106349_B_Orc3
  gRNA
uucuuugcagcaauuacagg

SEQ ID NO: 106350 - RNA, 20 nt, Artificial Sequence
  MKO10106350_B_Orc3
  gRNA
acuucugcagaaagucaacu

SEQ ID NO: 106351 - RNA, 20 nt, Artificial Sequence
  MKO10106351_B_Orc4
  gRNA
cucugcaugugcauuacucu

SEQ ID NO: 106352 - RNA, 20 nt, Artificial Sequence
  MKO10106352_B_Orc4
  gRNA
guggucuuuccugauccucg

SEQ ID NO: 106353 - RNA, 20 nt, Artificial Sequence
  MKO10106353_B_Orc4
  gRNA
auuguacuugcacuccaaag

SEQ ID NO: 106354 - RNA, 20 nt, Artificial Sequence
  MKO10106354_B_Orc5
  gRNA
ggcucaaagcauccaguauu

SEQ ID NO: 106355 - RNA, 20 nt, Artificial Sequence
  MKO10106355_B_Orc5
  gRNA
caacaauguuuguguuacau

SEQ ID NO: 106356 - RNA, 20 nt, Artificial Sequence
  MKO10106356_B_Orc5
  gRNA
ucaccaauucuugcagccua

SEQ ID NO: 106357 - RNA, 20 nt, Artificial Sequence
  MKO10106357_B_Orc6
  gRNA
accaaaaugauaacugcauc

SEQ ID NO: 106358 - RNA, 20 nt, Artificial Sequence
  MKO10106358_B_Orc6
  gRNA
cuguacagaagcagugaacu

SEQ ID NO: 106359 - RNA, 20 nt, Artificial Sequence
  MKO10106359_B_Orc6
  gRNA
ggacuugaaccaccagcaaa

SEQ ID NO: 106360 - RNA, 20 nt, Artificial Sequence
  MKO10106360_B_Orm1
  gRNA
uauugugucguuuaucaagu

SEQ ID NO: 106361 - RNA, 20 nt, Artificial Sequence
  MKO10106361_B_Orm1
  gRNA
gucuauaacuccacccaucu

SEQ ID NO: 106362 - RNA, 20 nt, Artificial Sequence
  MKO10106362_B_Orm1
  gRNA
uuucucucuggaauccuaga

SEQ ID NO: 106363 - RNA, 20 nt, Artificial Sequence
  MKO10106363_B_Orm2
  gRNA
caugcaucuucaagacuauc

SEQ ID NO: 106364 - RNA, 20 nt, Artificial Sequence
  MKO10106364_B_Orm2
  gRNA
aaacggggacugucccucaa

SEQ ID NO: 106365 - RNA, 20 nt, Artificial Sequence
  MKO10106365_B_Orm2
  gRNA
ucucuggauuccuagaugag

SEQ ID NO: 106366 - RNA, 20 nt, Artificial Sequence
  MKO10106366_B_Orm3
  gRNA
ugaauuuccugccuauaauc

SEQ ID NO: 106367 - RNA, 20 nt, Artificial Sequence
  MKO10106367_B_Orm3
  gRNA
cuccccagcuaucuggcaaa

SEQ ID NO: 106368 - RNA, 20 nt, Artificial Sequence
  MKO10106368_B_Orm3
  gRNA
uagaaggccagauauccccc

SEQ ID NO: 106369 - RNA, 20 nt, Artificial Sequence
  MKO10106369_B_Ormdl1
  gRNA
uauguggcugacauaugcgu

SEQ ID NO: 106370 - RNA, 20 nt, Artificial Sequence
  MKO10106370_B_Ormdl1
  gRNA
ucagcagagaagcuguguuu

SEQ ID NO: 106371 - RNA, 20 nt, Artificial Sequence
  MKO10106371_B_Ormdl1
  gRNA
augcgaacaccaugcagcug

SEQ ID NO: 106372 - RNA, 20 nt, Artificial Sequence
  MKO10106372_B_Ormdl2
  gRNA
cagcagcacgcugagcagcg

SEQ ID NO: 106373 - RNA, 20 nt, Artificial Sequence
  MKO10106373_B_Ormdl2
  gRNA
aucuuccuacauacagucaa

SEQ ID NO: 106374 - RNA, 20 nt, Artificial Sequence
  MKO10106374_B_Ormdl2
  gRNA
guacaauaggagagaugcug

SEQ ID NO: 106375 - RNA, 20 nt, Artificial Sequence
  MKO10106375_B_Ormdl3
  gRNA
acuuccuagaggcugugaac

SEQ ID NO: 106376 - RNA, 20 nt, Artificial Sequence
  MKO10106376_B_Ormdl3
  gRNA
uuuggaaucaauaaguacug

SEQ ID NO: 106377 - RNA, 20 nt, Artificial Sequence
  MKO10106377_B_Ormdl3
  gRNA
uccguggagcugggggagcu

SEQ ID NO: 106378 - RNA, 20 nt, Artificial Sequence
  MKO10106378_B_Os9
  gRNA
caccuuccauaugguacugc

SEQ ID NO: 106379 - RNA, 20 nt, Artificial Sequence
  MKO10106379_B_Os9
  gRNA
uaugagugccgccuaccagc

SEQ ID NO: 106380 - RNA, 20 nt, Artificial Sequence
  MKO10106380_B_Os9
  gRNA
uguuucgucgucccaguuga

SEQ ID NO: 106381 - RNA, 20 nt, Artificial Sequence
  MKO10106381_B_Osbp2
  gRNA
cugccgugcgaccaucaacu

SEQ ID NO: 106382 - RNA, 20 nt, Artificial Sequence
  MKO10106382_B_Osbp2
  gRNA
uuucaucaccguagucacug

SEQ ID NO: 106383 - RNA, 20 nt, Artificial Sequence
  MKO10106383_B_Osbp2
  gRNA
ugaggucauugcacgugcug

SEQ ID NO: 106384 - RNA, 20 nt, Artificial Sequence
  MKO10106384_B_Osbpl10
  gRNA
gcuccagcagagugugcgcc

SEQ ID NO: 106385 - RNA, 20 nt, Artificial Sequence
  MKO10106385_B_Osbpl10
  gRNA
caacucacagccggagccag

SEQ ID NO: 106386 - RNA, 20 nt, Artificial Sequence
  MKO10106386_B_Osbpl10
  gRNA
cacacuacgcugauccucca

SEQ ID NO: 106387 - RNA, 20 nt, Artificial Sequence
  MKO10106387_B_Osbpl11
  gRNA
cugccgcucuuuagcaucug

SEQ ID NO: 106388 - RNA, 20 nt, Artificial Sequence
  MKO10106388_B_Osbpl11
  gRNA
agcuuaccuguacugccacc

SEQ ID NO: 106389 - RNA, 20 nt, Artificial Sequence
  MKO10106389_B_Osbpl11
  gRNA
cauucugacuuggucuccgc

SEQ ID NO: 106390 - RNA, 20 nt, Artificial Sequence
  MKO10106390_B_Osbpl1a
  gRNA
gggggagaugcgcucuccaa

SEQ ID NO: 106391 - RNA, 20 nt, Artificial Sequence
  MKO10106391_B_Osbpl1a
  gRNA
ccagaaacgauuucagcauc

SEQ ID NO: 106392 - RNA, 20 nt, Artificial Sequence
  MKO10106392_B_Osbpl1a
  gRNA
ccagaugcugaaaucguuuc

SEQ ID NO: 106393 - RNA, 20 nt, Artificial Sequence
  MKO10106393_B_Osbpl2
  gRNA
agccacagcugagaccgcaa

SEQ ID NO: 106394 - RNA, 20 nt, Artificial Sequence
  MKO10106394_B_Osbpl2
  gRNA
ccagaagcgacuucagugug

SEQ ID NO: 106395 - RNA, 20 nt, Artificial Sequence
  MKO10106395_B_Osbpl2
  gRNA
gagagacauaugaguugauc

SEQ ID NO: 106396 - RNA, 20 nt, Artificial Sequence
  MKO10106396_B_Osbpl3
  gRNA
augagugacgagaagaaucu

SEQ ID NO: 106397 - RNA, 20 nt, Artificial Sequence
  MKO10106397_B_Osbpl3
  gRNA
uaccugccggcuuccuugcu

SEQ ID NO: 106398 - RNA, 20 nt, Artificial Sequence
  MKO10106398_B_Osbpl3
  gRNA
agcaaaaauccuuucugcac

SEQ ID NO: 106399 - RNA, 20 nt, Artificial Sequence
  MKO10106399_B_Osbpl5
  gRNA
agucccacggaaccugcuuc

SEQ ID NO: 106400 - RNA, 20 nt, Artificial Sequence
  MKO10106400_B_Osbpl5
  gRNA
cuuguaccaaccugggguga

SEQ ID NO: 106401 - RNA, 20 nt, Artificial Sequence
  MKO10106401_B_Osbpl5
  gRNA
cucucuugcaggcugaguac

SEQ ID NO: 106402 - RNA, 20 nt, Artificial Sequence
  MKO10106402_B_Osbpl6
  gRNA
aagcaguucucuccaaaacg

SEQ ID NO: 106403 - RNA, 20 nt, Artificial Sequence
  MKO10106403_B_Osbpl6
  gRNA
agaugugcucuuccguguca

SEQ ID NO: 106404 - RNA, 20 nt, Artificial Sequence
  MKO10106404_B_Osbpl6
  gRNA
accuugugccagcccuuuaa

SEQ ID NO: 106405 - RNA, 20 nt, Artificial Sequence
  MKO10106405_B_Osbpl7
  gRNA
ggaaagagacacgcccucuu

SEQ ID NO: 106406 - RNA, 20 nt, Artificial Sequence
  MKO10106406_B_Osbpl7
  gRNA
aaguugcuccccgaugagga

SEQ ID NO: 106407 - RNA, 20 nt, Artificial Sequence
  MKO10106407_B_Osbpl7
  gRNA
cgacaucaugccugagagac

SEQ ID NO: 106408 - RNA, 20 nt, Artificial Sequence
  MKO10106408_B_Osbpl8
  gRNA
agccccgaccuucagccagu

SEQ ID NO: 106409 - RNA, 20 nt, Artificial Sequence
  MKO10106409_B_Osbpl8
  gRNA
agaccccucugucauuguca

SEQ ID NO: 106410 - RNA, 20 nt, Artificial Sequence
  MKO10106410_B_Osbpl8
  gRNA
ucugaaucuaaacuauauaa

SEQ ID NO: 106411 - RNA, 20 nt, Artificial Sequence
  MKO10106411_B_Osbpl9
  gRNA
auuguucuaucaagaucugc

SEQ ID NO: 106412 - RNA, 20 nt, Artificial Sequence
  MKO10106412_B_Osbpl9
  gRNA
cuuugauaagaaacuuaccg

SEQ ID NO: 106413 - RNA, 20 nt, Artificial Sequence
  MKO10106413_B_Osbpl9
  gRNA
uaaguuucuuaucaaagucu

SEQ ID NO: 106414 - RNA, 20 nt, Artificial Sequence
  MKO10106414_B_Osbp
  gRNA
aacgacuugauagcuaagca

SEQ ID NO: 106415 - RNA, 20 nt, Artificial Sequence
  MKO10106415_B_Osbp
  gRNA
ucaagucguugcacgugcug

SEQ ID NO: 106416 - RNA, 20 nt, Artificial Sequence
  MKO10106416_B_Osbp
  gRNA
ggcaaagcagcacaaucacc

SEQ ID NO: 106417 - RNA, 20 nt, Artificial Sequence
  MKO10106417_B_Oscar
  gRNA
ccuucgaaacugaugaccag

SEQ ID NO: 106418 - RNA, 20 nt, Artificial Sequence
  MKO10106418_B_Oscar
  gRNA
gcaucauaguuacuugugau

SEQ ID NO: 106419 - RNA, 20 nt, Artificial Sequence
  MKO10106419_B_Oscar
  gRNA
ccagggaaaccucauccguu

SEQ ID NO: 106420 - RNA, 20 nt, Artificial Sequence
  MKO10106420_B_Oscp1
  gRNA
agugaccagcaacacguccu

SEQ ID NO: 106421 - RNA, 20 nt, Artificial Sequence
  MKO10106421_B_Oscp1
  gRNA
aggacuuaccuaaugacucc

SEQ ID NO: 106422 - RNA, 20 nt, Artificial Sequence
  MKO10106422_B_Oscp1
  gRNA
aggcacuuacucggauaugc

SEQ ID NO: 106423 - RNA, 20 nt, Artificial Sequence
  MKO10106423_B_Oser1
  gRNA
uccaucauaucucugucugu

SEQ ID NO: 106424 - RNA, 20 nt, Artificial Sequence
  MKO10106424_B_Oser1
  gRNA
acugucuuuagaugcacaca

SEQ ID NO: 106425 - RNA, 20 nt, Artificial Sequence
  MKO10106425_B_Oser1
  gRNA
ucuacaaggaagucuucacg

SEQ ID NO: 106426 - RNA, 20 nt, Artificial Sequence
  MKO10106426_B_Osgepl1
  gRNA
ggaauugaaagauuacgugc

SEQ ID NO: 106427 - RNA, 20 nt, Artificial Sequence
  MKO10106427_B_Osgepl1
  gRNA
auggaaucuauuuccgucuu

SEQ ID NO: 106428 - RNA, 20 nt, Artificial Sequence
  MKO10106428_B_Osgepl1
  gRNA
cuuguacauccgaaaagcau

SEQ ID NO: 106429 - RNA, 20 nt, Artificial Sequence
  MKO10106429_B_Osgep
  gRNA
agcuguuguugcccguacag

SEQ ID NO: 106430 - RNA, 20 nt, Artificial Sequence
  MKO10106430_B_Osgep
  gRNA
agcaauacaaucaauguccu

SEQ ID NO: 106431 - RNA, 20 nt, Artificial Sequence
  MKO10106431_B_Osgep
  gRNA
aucugcucaauguuguagcc

SEQ ID NO: 106432 - RNA, 20 nt, Artificial Sequence
  MKO10106432_B_Osgin1
  gRNA
cacauccccuacgugaaacc

SEQ ID NO: 106433 - RNA, 20 nt, Artificial Sequence
  MKO10106433_B_Osgin1
  gRNA
ggaaccuccccgggggcgcc

SEQ ID NO: 106434 - RNA, 20 nt, Artificial Sequence
  MKO10106434_B_Osgin1
  gRNA
uaggacaggcagauaccgga

SEQ ID NO: 106435 - RNA, 20 nt, Artificial Sequence
  MKO10106435_B_Osgin2
  gRNA
cccuuaccaagaacuaagug

SEQ ID NO: 106436 - RNA, 20 nt, Artificial Sequence
  MKO10106436_B_Osgin2
  gRNA
aacuuaccaauuauuaccau

SEQ ID NO: 106437 - RNA, 20 nt, Artificial Sequence
  MKO10106437_B_Osgin2
  gRNA
ucuauguugacaaucagcuu

SEQ ID NO: 106438 - RNA, 20 nt, Artificial Sequence
  MKO10106438_B_Osmr
  gRNA
ggguagauacgacuuugacu

SEQ ID NO: 106439 - RNA, 20 nt, Artificial Sequence
  MKO10106439_B_Osmr
  gRNA
agcuucuucacgcuucacag

SEQ ID NO: 106440 - RNA, 20 nt, Artificial Sequence
  MKO10106440_B_Osmr
  gRNA
ucaaguuguucuccauggau

SEQ ID NO: 106441 - RNA, 20 nt, Artificial Sequence
  MKO10106441_B_Osm
  gRNA
agaguuggagcagccacgau

SEQ ID NO: 106442 - RNA, 20 nt, Artificial Sequence
  MKO10106442_B_Osm
  gRNA
caggacccaguaugcagaca

SEQ ID NO: 106443 - RNA, 20 nt, Artificial Sequence
  MKO10106443_B_Osm
  gRNA
acgauggcuccacacgcagc

SEQ ID NO: 106444 - RNA, 20 nt, Artificial Sequence
  MKO10106444_B_Osr1
  gRNA
gacgcuacacucacaaguga

SEQ ID NO: 106445 - RNA, 20 nt, Artificial Sequence
  MKO10106445_B_Osr1
  gRNA
gggugaauggguaccggugc

SEQ ID NO: 106446 - RNA, 20 nt, Artificial Sequence
  MKO10106446_B_Osr1
  gRNA
ugucgcaccuguggucccgu

SEQ ID NO: 106447 - RNA, 20 nt, Artificial Sequence
  MKO10106447_B_Osr2
  gRNA
cccuacagcugcgagcagug

SEQ ID NO: 106448 - RNA, 20 nt, Artificial Sequence
  MKO10106448_B_Osr2
  gRNA
ggaaaggauucugucagucu

SEQ ID NO: 106449 - RNA, 20 nt, Artificial Sequence
  MKO10106449_B_Osr2
  gRNA
agaaaagcccuucaaauguc

SEQ ID NO: 106450 - RNA, 20 nt, Artificial Sequence
  MKO10106450_B_Ost4
  gRNA
uuacugccacguagugauag

SEQ ID NO: 106451 - RNA, 20 nt, Artificial Sequence
  MKO10106451_B_Ost4
  gRNA
aguaaacaaccccaagaagc

SEQ ID NO: 106452 - RNA, 20 nt, Artificial Sequence
  MKO10106452_B_Osuc
  gRNA
aguaaacggacaguauauca

SEQ ID NO: 106453 - RNA, 20 nt, Artificial Sequence
  MKO10106453_B_Osuc
  gRNA
uuucugcaggggcuaccuga

SEQ ID NO: 106454 - RNA, 20 nt, Artificial Sequence
  MKO10106454_B_Osuc
  gRNA
ucucugaugcccauguucau

SEQ ID NO: 106455 - RNA, 20 nt, Artificial Sequence
  MKO10106455_B_Ostf1
  gRNA
uugcaugaagcugcaaaaag

SEQ ID NO: 106456 - RNA, 20 nt, Artificial Sequence
  MKO10106456_B_Ostf1
  gRNA
ucuucaaaguauaauucauc

SEQ ID NO: 106457 - RNA, 20 nt, Artificial Sequence
  MKO10106457_B_Ostf1
  gRNA
gaugaauuauacuuugaaga

SEQ ID NO: 106458 - RNA, 20 nt, Artificial Sequence
  MKO10106458_B_Ostm1
  gRNA
cugcagcgacacgguguccg

SEQ ID NO: 106459 - RNA, 20 nt, Artificial Sequence
  MKO10106459_B_Ostm1
  gRNA
gagucgaaccuucaacuguu

SEQ ID NO: 106460 - RNA, 20 nt, Artificial Sequence
  MKO10106460_B_Ostm1
  gRNA
uccgccacagcgcgggcccu

SEQ ID NO: 106461 - RNA, 20 nt, Artificial Sequence
  MKO10106461_B_Ostn
  gRNA
gcuccugcgucuugaugauc

SEQ ID NO: 106462 - RNA, 20 nt, Artificial Sequence
  MKO10106462_B_Ostn
  gRNA
ggcaaguacacacuucaucc

SEQ ID NO: 106463 - RNA, 20 nt, Artificial Sequence
  MKO10106463_B_Ostn
  gRNA
acagcaucacaaucauagcc

SEQ ID NO: 106464 - RNA, 20 nt, Artificial Sequence
  MKO10106464_B_Ouc
  gRNA
uaccacacaagacauucacu

SEQ ID NO: 106465 - RNA, 20 nt, Artificial Sequence
  MKO10106465_B_Ouc
  gRNA
cuuucagcuguacuugacuu

SEQ ID NO: 106466 - RNA, 20 nt, Artificial Sequence
  MKO10106466_B_Ouc
  gRNA
aguagacucaccuguuucug

SEQ ID NO: 106467 - RNA, 20 nt, Artificial Sequence
  MKO10106467_B_Otoa
  gRNA
cuuguaggaagaaauaauag

SEQ ID NO: 106468 - RNA, 20 nt, Artificial Sequence
  MKO10106468_B_Otoa
  gRNA
acauccauuguugcagaaaa

SEQ ID NO: 106469 - RNA, 20 nt, Artificial Sequence
  MKO10106469_B_Otoa
  gRNA
cacauucuuugaguucagau

SEQ ID NO: 106470 - RNA, 20 nt, Artificial Sequence
  MKO10106470_B_Otof
  gRNA
auugccaaagucacuuuccg

SEQ ID NO: 106471 - RNA, 20 nt, Artificial Sequence
  MKO10106471_B_Otof
  gRNA
cagucuugaggugaacaauc

SEQ ID NO: 106472 - RNA, 20 nt, Artificial Sequence
  MKO10106472_B_Otof
  gRNA
ccacacccucgcaguucucc

SEQ ID NO: 106473 - RNA, 20 nt, Artificial Sequence
  MKO10106473_B_Otogl
  gRNA
cucacucugauguuucugac

SEQ ID NO: 106474 - RNA, 20 nt, Artificial Sequence
  MKO10106474_B_Otogl
  gRNA
ucuaugaaaaugaacagaga

SEQ ID NO: 106475 - RNA, 20 nt, Artificial Sequence
  MKO10106475_B_Otogl
  gRNA
ggcaccuugucccgagagcc

SEQ ID NO: 106476 - RNA, 20 nt, Artificial Sequence
  MKO10106476_B_Otog
  gRNA
acacucacccccauugaagc

SEQ ID NO: 106477 - RNA, 20 nt, Artificial Sequence
  MKO10106477_B_Otog
  gRNA
ggaggaugucacaacaguua

SEQ ID NO: 106478 - RNA, 20 nt, Artificial Sequence
  MKO10106478_B_Otog
  gRNA
uugugacauccuccacugca

SEQ ID NO: 106479 - RNA, 20 nt, Artificial Sequence
  MKO10106479_B_Otol1
  gRNA
gcaauggcugaguccaccgc

SEQ ID NO: 106480 - RNA, 20 nt, Artificial Sequence
  MKO10106480_B_Otol1
  gRNA
ccggaaugccaccugcuccu

SEQ ID NO: 106481 - RNA, 20 nt, Artificial Sequence
  MKO10106481_B_Otol1
  gRNA
cuaggcccuaaaggagagac

SEQ ID NO: 106482 - RNA, 20 nt, Artificial Sequence
  MKO10106482_B_Otop1
  gRNA
cgcguuuaucacugucgucc

SEQ ID NO: 106483 - RNA, 20 nt, Artificial Sequence
  MKO10106483_B_Otop1
  gRNA
uugaaagucgcauacuucau

SEQ ID NO: 106484 - RNA, 20 nt, Artificial Sequence
  MKO10106484_B_Otop1
  gRNA
uguucacgaaccuccuacug

SEQ ID NO: 106485 - RNA, 20 nt, Artificial Sequence
  MKO10106485_B_Otop2
  gRNA
aguggaugaguccgugcacc

SEQ ID NO: 106486 - RNA, 20 nt, Artificial Sequence
  MKO10106486_B_Otop2
  gRNA
guucuuaccgggucaggucc

SEQ ID NO: 106487 - RNA, 20 nt, Artificial Sequence
  MKO10106487_B_Otop2
  gRNA
agacuguauccauacccacc

SEQ ID NO: 106488 - RNA, 20 nt, Artificial Sequence
  MKO10106488_B_Otop3
  gRNA
aacccauucgaaauauguuc

SEQ ID NO: 106489 - RNA, 20 nt, Artificial Sequence
  MKO10106489_B_Otop3
  gRNA
cugccugaacauauuucgaa

SEQ ID NO: 106490 - RNA, 20 nt, Artificial Sequence
  MKO10106490_B_Otop3
  gRNA
cgagcucagccucaaucuca

SEQ ID NO: 106491 - RNA, 20 nt, Artificial Sequence
  MKO10106491_B_Otor
  gRNA
uaccgugguugggaucuccu

SEQ ID NO: 106492 - RNA, 20 nt, Artificial Sequence
  MKO10106492_B_Otor
  gRNA
ggccuugugguucuaugugc

SEQ ID NO: 106493 - RNA, 20 nt, Artificial Sequence
  MKO10106493_B_Otor
  gRNA
auccauaaauacaccaugcc

SEQ ID NO: 106494 - RNA, 20 nt, Artificial Sequence
  MKO10106494_B_Otos
  gRNA
gaauccccagcagcaugcca

SEQ ID NO: 106495 - RNA, 20 nt, Artificial Sequence
  MKO10106495_B_Otos
  gRNA
aaagcauuaccugcuuccuc

SEQ ID NO: 106496 - RNA, 20 nt, Artificial Sequence
  MKO10106496_B_Otos
  gRNA
gcuggcccuuggcaugcugc

SEQ ID NO: 106497 - RNA, 20 nt, Artificial Sequence
  MKO10106497_B_Otp
  gRNA
gcgcucaccgccagcgaagc

SEQ ID NO: 106498 - RNA, 20 nt, Artificial Sequence
  MKO10106498_B_Otp
  gRNA
gcugucucacgccgaccucc

SEQ ID NO: 106499 - RNA, 20 nt, Artificial Sequence
  MKO10106499_B_Otp
  gRNA
acucaccuagccuggcgucc

SEQ ID NO: 106500 - RNA, 20 nt, Artificial Sequence
  MKO10106500_B_Ouu
  gRNA
caggacacagacgugacagu

SEQ ID NO: 106501 - RNA, 20 nt, Artificial Sequence
  MKO10106501_B_Ouu
  gRNA
uguuucuaccugucaauuuc

SEQ ID NO: 106502 - RNA, 20 nt, Artificial Sequence
  MKO10106502_B_Ouu
  gRNA
ucaaccuagaaagucuaaca

SEQ ID NO: 106503 - RNA, 20 nt, Artificial Sequence
  MKO10106503_B_Otub1
  gRNA
accucaccucuugcugaauu

SEQ ID NO: 106504 - RNA, 20 nt, Artificial Sequence
  MKO10106504_B_Otub1
  gRNA
gauugcugugcagaauccuc

SEQ ID NO: 106505 - RNA, 20 nt, Artificial Sequence
  MKO10106505_B_Otub1
  gRNA
ccucagcauacuccuuguac

SEQ ID NO: 106506 - RNA, 20 nt, Artificial Sequence
  MKO10106506_B_Otub2
  gRNA
uucaggaugaucccgaagaa

SEQ ID NO: 106507 - RNA, 20 nt, Artificial Sequence
  MKO10106507_B_Otub2
  gRNA
gagacggaaacugcuucuac

SEQ ID NO: 106508 - RNA, 20 nt, Artificial Sequence
  MKO10106508_B_Otub2
  gRNA
acagaccccaaaugaccuuc

SEQ ID NO: 106509 - RNA, 20 nt, Artificial Sequence
  MKO10106509_B_Otud1
  gRNA
ggccggauaucccgaauugc

SEQ ID NO: 106510 - RNA, 20 nt, Artificial Sequence
  MKO10106510_B_Otud1
  gRNA
acccgguuccggcacccgcu

SEQ ID NO: 106511 - RNA, 20 nt, Artificial Sequence
  MKO10106511_B_Otud1
  gRNA
gcacaucgccgugcgggccc

SEQ ID NO: 106512 - RNA, 20 nt, Artificial Sequence
  MKO10106512_B_Otud3
  gRNA
uccgagaguggcccuccaac

SEQ ID NO: 106513 - RNA, 20 nt, Artificial Sequence
  MKO10106513_B_Otud3
  gRNA
ggaucaccacauucaauuga

SEQ ID NO: 106514 - RNA, 20 nt, Artificial Sequence
  MKO10106514_B_Otud3
  gRNA
aucagcuuaaugccccuuug

SEQ ID NO: 106515 - RNA, 20 nt, Artificial Sequence
  MKO10106515_B_Otud4
  gRNA
agguguugcacucucagucu

SEQ ID NO: 106516 - RNA, 20 nt, Artificial Sequence
  MKO10106516_B_Otud4
  gRNA
uuuaccuguacauaagugaa

SEQ ID NO: 106517 - RNA, 20 nt, Artificial Sequence
  MKO10106517_B_Otud4
  gRNA
ugaagaauauuuaaaacguu

SEQ ID NO: 106518 - RNA, 20 nt, Artificial Sequence
  MKO10106518_B_Otud5
  gRNA
accuacagcccgaaauagac

SEQ ID NO: 106519 - RNA, 20 nt, Artificial Sequence
  MKO10106519_B_Otud5
  gRNA
agagauguacaaccguccug

SEQ ID NO: 106520 - RNA, 20 nt, Artificial Sequence
  MKO10106520_B_Otud5
  gRNA
aggacggugccugucuauuu

SEQ ID NO: 106521 - RNA, 20 nt, Artificial Sequence
  MKO10106521_B_Otud6a
  gRNA
gcgcgaccgaagagcucacc

SEQ ID NO: 106522 - RNA, 20 nt, Artificial Sequence
  MKO10106522_B_Otud6a
  gRNA
acuggcugccaaccgucgug

SEQ ID NO: 106523 - RNA, 20 nt, Artificial Sequence
  MKO10106523_B_Otud6a
  gRNA
cgucugcccuugucguucuu

SEQ ID NO: 106524 - RNA, 20 nt, Artificial Sequence
  MKO10106524_B_Otud6b
  gRNA
cacggaagauguugcuaaau

SEQ ID NO: 106525 - RNA, 20 nt, Artificial Sequence
  MKO10106525_B_Otud6b
  gRNA
ugcuguuaacauuucaaacu

SEQ ID NO: 106526 - RNA, 20 nt, Artificial Sequence
  MKO10106526_B_Otud6b
  gRNA
uucccaaaaacgacaaaaag

SEQ ID NO: 106527 - RNA, 20 nt, Artificial Sequence
  MKO10106527_B_Otud7a
  gRNA
aguccucacuguacacgcuc

SEQ ID NO: 106528 - RNA, 20 nt, Artificial Sequence
  MKO10106528_B_Otud7a
  gRNA
agucgcuuagugcagcuguc

SEQ ID NO: 106529 - RNA, 20 nt, Artificial Sequence
  MKO10106529_B_Otud7a
  gRNA
ccuuuccaggucgccugaac

SEQ ID NO: 106530 - RNA, 20 nt, Artificial Sequence
  MKO10106530_B_Otud7b
  gRNA
ugucugcagggcgucugaau

SEQ ID NO: 106531 - RNA, 20 nt, Artificial Sequence
  MKO10106531_B_Otud7b
  gRNA
ccauccccaguaguugcuaa

SEQ ID NO: 106532 - RNA, 20 nt, Artificial Sequence
  MKO10106532_B_Otud7b
  gRNA
ggguuuccaugauagagacu

SEQ ID NO: 106533 - RNA, 20 nt, Artificial Sequence
  MKO10106533_B_Otx1
  gRNA
augaacgggcugggccuagc

SEQ ID NO: 106534 - RNA, 20 nt, Artificial Sequence
  MKO10106534_B_Otx1
  gRNA
ccaccccgcggaagcagcga

SEQ ID NO: 106535 - RNA, 20 nt, Artificial Sequence
  MKO10106535_B_Otx1
  gRNA
cccagcccguucaugccgua

SEQ ID NO: 106536 - RNA, 20 nt, Artificial Sequence
  MKO10106536_B_Otx2
  gRNA
ucugaacucacuucccgagc

SEQ ID NO: 106537 - RNA, 20 nt, Artificial Sequence
  MKO10106537_B_Otx2
  gRNA
uacuagaggggggacugaac

SEQ ID NO: 106538 - RNA, 20 nt, Artificial Sequence
  MKO10106538_B_Otx2
  gRNA
ccaccccccggaaacagcga

SEQ ID NO: 106539 - RNA, 20 nt, Artificial Sequence
  MKO10106539_B_Ovca2
  gRNA
gacacgcuggggccguuuga

SEQ ID NO: 106540 - RNA, 20 nt, Artificial Sequence
  MKO10106540_B_Ovca2
  gRNA
cgagucuggacacgaacccu

SEQ ID NO: 106541 - RNA, 20 nt, Artificial Sequence
  MKO10106541_B_Ovca2
  gRNA
cgaggguucguguccagacu

SEQ ID NO: 106542 - RNA, 20 nt, Artificial Sequence
  MKO10106542_B_Ovch2
  gRNA
agggcuauaucauagaucau

SEQ ID NO: 106543 - RNA, 20 nt, Artificial Sequence
  MKO10106543_B_Ovch2
  gRNA
uggaaaaggguuccuauccu

SEQ ID NO: 106544 - RNA, 20 nt, Artificial Sequence
  MKO10106544_B_Ovch2
  gRNA
ggauuuauuuguacaacugc

SEQ ID NO: 106545 - RNA, 20 nt, Artificial Sequence
  MKO10106545_B_Ovgp1
  gRNA
gccgaaguuccacccuccaa

SEQ ID NO: 106546 - RNA, 20 nt, Artificial Sequence
  MKO10106546_B_Ovgp1
  gRNA
gaggcagucccccacacgac

SEQ ID NO: 106547 - RNA, 20 nt, Artificial Sequence
  MKO10106547_B_Ovgp1
  gRNA
uggccgacuaugugcccaau

SEQ ID NO: 106548 - RNA, 20 nt, Artificial Sequence
  MKO10106548_B_Ovol1
  gRNA
ggcucggccaccgaugccuc

SEQ ID NO: 106549 - RNA, 20 nt, Artificial Sequence
  MKO10106549_B_Ovol1
  gRNA
ucgagacuccagcuauagcg

SEQ ID NO: 106550 - RNA, 20 nt, Artificial Sequence
  MKO10106550_B_Ovol1
  gRNA
ugugucgauucagcaugcgc

SEQ ID NO: 106551 - RNA, 20 nt, Artificial Sequence
  MKO10106551_B_Ovol2
  gRNA
cauccgccccuacaaaugug

SEQ ID NO: 106552 - RNA, 20 nt, Artificial Sequence
  MKO10106552_B_Ovol2
  gRNA
ccagagcuucacgacgccca

SEQ ID NO: 106553 - RNA, 20 nt, Artificial Sequence
  MKO10106553_B_Ovol2
  gRNA
ucaccuuaagugccacaacc

SEQ ID NO: 106554 - RNA, 20 nt, Artificial Sequence
  MKO10106554_B_Ovol3
  gRNA
agccagccagcuacgcuuac

SEQ ID NO: 106555 - RNA, 20 nt, Artificial Sequence
  MKO10106555_B_Ovol3
  gRNA
uaacgcccuaagccugaaug

SEQ ID NO: 106556 - RNA, 20 nt, Artificial Sequence
  MKO10106556_B_Ovol3
  gRNA
ggcguccacagccaccuaac

SEQ ID NO: 106557 - RNA, 20 nt, Artificial Sequence
  MKO10106557_B_Oxa1l
  gRNA
cuuggccucucugauucgag

SEQ ID NO: 106558 - RNA, 20 nt, Artificial Sequence
  MKO10106558_B_Oxa1l
  gRNA
uguccucuuacacguggcaa

SEQ ID NO: 106559 - RNA, 20 nt, Artificial Sequence
  MKO10106559_B_Oxa1l
  gRNA
ggaucuuggcugcuucucgc

SEQ ID NO: 106560 - RNA, 20 nt, Artificial Sequence
  MKO10106560_B_Oxcu1
  gRNA
uuugagcgacaguuccuuuc

SEQ ID NO: 106561 - RNA, 20 nt, Artificial Sequence
  MKO10106561_B_Oxcu1
  gRNA
aaagcuccuauaagauucuc

SEQ ID NO: 106562 - RNA, 20 nt, Artificial Sequence
  MKO10106562_B_Oxcu1
  gRNA
acugcagucagcaacaaugc

SEQ ID NO: 106563 - RNA, 20 nt, Artificial Sequence
  MKO10106563_B_Oxcu2a
  gRNA
gccguauugagaaaccugca

SEQ ID NO: 106564 - RNA, 20 nt, Artificial Sequence
  MKO10106564_B_Oxcu2a
  gRNA
acgcagcgcuugccggucaa

SEQ ID NO: 106565 - RNA, 20 nt, Artificial Sequence
  MKO10106565_B_Oxcu2a
  gRNA
gcgagaaguacgcgaguucc

SEQ ID NO: 106566 - RNA, 20 nt, Artificial Sequence
  MKO10106566_B_Oxcu2b
  gRNA
augggucgaccgucaugcuc

SEQ ID NO: 106567 - RNA, 20 nt, Artificial Sequence
  MKO10106567_B_Oxcu2b
  gRNA
ugaagaucacguugcccgag

SEQ ID NO: 106568 - RNA, 20 nt, Artificial Sequence
  MKO10106568_B_Oxcu2b
  gRNA
acgcagcgcuugccagucaa

SEQ ID NO: 106569 - RNA, 20 nt, Artificial Sequence
  MKO10106569_B_Oxgr1
  gRNA
cagauacagcaaguccguca

SEQ ID NO: 106570 - RNA, 20 nt, Artificial Sequence
  MKO10106570_B_Oxgr1
  gRNA
cuauagcaucaucuuccucg

SEQ ID NO: 106571 - RNA, 20 nt, Artificial Sequence
  MKO10106571_B_Oxgr1
  gRNA
uccgaaugacccucaagaug

SEQ ID NO: 106572 - RNA, 20 nt, Artificial Sequence
  MKO10106572_B_Oxld1
  gRNA
gggcccugugggguuccccc

SEQ ID NO: 106573 - RNA, 20 nt, Artificial Sequence
  MKO10106573_B_Oxld1
  gRNA
accagagcgcagcucgcacc

SEQ ID NO: 106574 - RNA, 20 nt, Artificial Sequence
  MKO10106574_B_Oxld1
  gRNA
ggaaaccccggcugcacgaa

SEQ ID NO: 106575 - RNA, 20 nt, Artificial Sequence
  MKO10106575_B_Oxnad1
  gRNA
uucugucucguucuagccgu

SEQ ID NO: 106576 - RNA, 20 nt, Artificial Sequence
  MKO10106576_B_Oxnad1
  gRNA
uuauugugaacccagacagc

SEQ ID NO: 106577 - RNA, 20 nt, Artificial Sequence
  MKO10106577_B_Oxnad1
  gRNA
gaacugccaguguccuccgc

SEQ ID NO: 106578 - RNA, 20 nt, Artificial Sequence
  MKO10106578_B_Oxr1
  gRNA
gucggaaagauucaggcucc

SEQ ID NO: 106579 - RNA, 20 nt, Artificial Sequence
  MKO10106579_B_Oxr1
  gRNA
cacauucugcccagaauuug

SEQ ID NO: 106580 - RNA, 20 nt, Artificial Sequence
  MKO10106580_B_Oxr1
  gRNA
gagccauuuaaaguaaguga

SEQ ID NO: 106581 - RNA, 20 nt, Artificial Sequence
  MKO10106581_B_Oxsm
  gRNA
gucccuaaagagccucuuga

SEQ ID NO: 106582 - RNA, 20 nt, Artificial Sequence
  MKO10106582_B_Oxsm
  gRNA
cguugggacucaacuaguuu

SEQ ID NO: 106583 - RNA, 20 nt, Artificial Sequence
  MKO10106583_B_Oxsm
  gRNA
aacggccggcaggcuagcuu

SEQ ID NO: 106584 - RNA, 20 nt, Artificial Sequence
  MKO10106584_B_Oxsr1
  gRNA
auccuccgagaagucuuaga

SEQ ID NO: 106585 - RNA, 20 nt, Artificial Sequence
  MKO10106585_B_Oxsr1
  gRNA
cucgucaugaagcugcuaag

SEQ ID NO: 106586 - RNA, 20 nt, Artificial Sequence
  MKO10106586_B_Oxsr1
  gRNA
gauggcauuggcucauggcc

SEQ ID NO: 106587 - RNA, 20 nt, Artificial Sequence
  MKO10106587_B_Oxtr
  gRNA
gucgucgcagcucgagucag

SEQ ID NO: 106588 - RNA, 20 nt, Artificial Sequence
  MKO10106588_B_Oxtr
  gRNA
aucgaguuggaccucgggag

SEQ ID NO: 106589 - RNA, 20 nt, Artificial Sequence
  MKO10106589_B_Oxtr
  gRNA
ugacccgugccaacgccgca

SEQ ID NO: 106590 - RNA, 20 nt, Artificial Sequence
  MKO10106590_B_Oxt
  gRNA
gcacagcccucuugccgccc

SEQ ID NO: 106591 - RNA, 20 nt, Artificial Sequence
  MKO10106591_B_Oxt
  gRNA
cgggcugcagcagaugccug

SEQ ID NO: 106592 - RNA, 20 nt, Artificial Sequence
  MKO10106592_B_Oxt
  gRNA
uccccacagugucuccccug

SEQ ID NO: 106593 - RNA, 20 nt, Artificial Sequence
  MKO10106593_B_P2rx1
  gRNA
ucacugacacacugcugaua

SEQ ID NO: 106594 - RNA, 20 nt, Artificial Sequence
  MKO10106594_B_P2rx1
  gRNA
ucuuggcauaugccaccuuc

SEQ ID NO: 106595 - RNA, 20 nt, Artificial Sequence
  MKO10106595_B_P2rx1
  gRNA
gaaauuggucauaacuacaa

SEQ ID NO: 106596 - RNA, 20 nt, Artificial Sequence
  MKO10106596_B_P2rx2
  gRNA
ggaaggaguaaccucgaucc

SEQ ID NO: 106597 - RNA, 20 nt, Artificial Sequence
  MKO10106597_B_P2rx2
  gRNA
ggaggaauacguaaagcccc

SEQ ID NO: 106598 - RNA, 20 nt, Artificial Sequence
  MKO10106598_B_P2rx2
  gRNA
ccacacagucgucaucuaaa

SEQ ID NO: 106599 - RNA, 20 nt, Artificial Sequence
  MKO10106599_B_P2rx3
  gRNA
ugaacuacagcucuguccgu

SEQ ID NO: 106600 - RNA, 20 nt, Artificial Sequence
  MKO10106600_B_P2rx3
  gRNA
cccccacccgggaagcgcuc

SEQ ID NO: 106601 - RNA, 20 nt, Artificial Sequence
  MKO10106601_B_P2rx3
  gRNA
cagagcuguaguucacgcag

SEQ ID NO: 106602 - RNA, 20 nt, Artificial Sequence
  MKO10106602_B_P2rx4
  gRNA
ugaccacagaguccguuucc

SEQ ID NO: 106603 - RNA, 20 nt, Artificial Sequence
  MKO10106603_B_P2rx4
  gRNA
cuggacagguacccugcguc

SEQ ID NO: 106604 - RNA, 20 nt, Artificial Sequence
  MKO10106604_B_P2rx4
  gRNA
gcaccaugcggccaccucac

SEQ ID NO: 106605 - RNA, 20 nt, Artificial Sequence
  MKO10106605_B_P2rx5
  gRNA
ugaucgugacuccuaaccag

SEQ ID NO: 106606 - RNA, 20 nt, Artificial Sequence
  MKO10106606_B_P2rx5
  gRNA
uacggguggggaacucuacc

SEQ ID NO: 106607 - RNA, 20 nt, Artificial Sequence
  MKO10106607_B_P2rx5
  gRNA
agacuccccagcgugacagu

SEQ ID NO: 106608 - RNA, 20 nt, Artificial Sequence
  MKO10106608_B_P2rx6
  gRNA
gcugaugaagacugccccga

SEQ ID NO: 106609 - RNA, 20 nt, Artificial Sequence
  MKO10106609_B_P2rx6
  gRNA
uuucccuaggugggcccucu

SEQ ID NO: 106610 - RNA, 20 nt, Artificial Sequence
  MKO10106610_B_P2rx6
  gRNA
cgugacaccagcucaagucc

SEQ ID NO: 106611 - RNA, 20 nt, Artificial Sequence
  MKO10106611_B_P2rx7
  gRNA
cgaauuauggcaccgucaag

SEQ ID NO: 106612 - RNA, 20 nt, Artificial Sequence
  MKO10106612_B_P2rx7
  gRNA
cagaacuuuaggccagcucc

SEQ ID NO: 106613 - RNA, 20 nt, Artificial Sequence
  MKO10106613_B_P2rx7
  gRNA
agacuuccaaaccacugcuc

SEQ ID NO: 106614 - RNA, 20 nt, Artificial Sequence
  MKO10106614_B_P2ry10
  gRNA
caacaugcaauggugaucac

SEQ ID NO: 106615 - RNA, 20 nt, Artificial Sequence
  MKO10106615_B_P2ry10
  gRNA
guuguaauugcugaacuugc

SEQ ID NO: 106616 - RNA, 20 nt, Artificial Sequence
  MKO10106616_B_P2ry10
  gRNA
ucaccauugcauguuguacc

SEQ ID NO: 106617 - RNA, 20 nt, Artificial Sequence
  MKO10106617_B_P2ry12
  gRNA
ggucuucagguagcggucaa

SEQ ID NO: 106618 - RNA, 20 nt, Artificial Sequence
  MKO10106618_B_P2ry12
  gRNA
guauaucaguauaucguucc

SEQ ID NO: 106619 - RNA, 20 nt, Artificial Sequence
  MKO10106619_B_P2ry12
  gRNA
ucuuguagucucugacgcac

SEQ ID NO: 106620 - RNA, 20 nt, Artificial Sequence
  MKO10106620_B_P2ry13
  gRNA
cuucuaugagacgauguaug

SEQ ID NO: 106621 - RNA, 20 nt, Artificial Sequence
  MKO10106621_B_P2ry13
  gRNA
ucaagaucaucaugccguuc

SEQ ID NO: 106622 - RNA, 20 nt, Artificial Sequence
  MKO10106622_B_P2ry13
  gRNA
cucgggacaaucaacaccac

SEQ ID NO: 106623 - RNA, 20 nt, Artificial Sequence
  MKO10106623_B_P2ry14
  gRNA
gaagaccauaccguacaaca

SEQ ID NO: 106624 - RNA, 20 nt, Artificial Sequence
  MKO10106624_B_P2ry14
  gRNA
auaucuucgugaguaucuuc

SEQ ID NO: 106625 - RNA, 20 nt, Artificial Sequence
  MKO10106625_B_P2ry14
  gRNA
gcacgaugcugaagauauug

SEQ ID NO: 106626 - RNA, 20 nt, Artificial Sequence
  MKO10106626_B_P2ry1
  gRNA
aaaugugugauuucaacgac

SEQ ID NO: 106627 - RNA, 20 nt, Artificial Sequence
  MKO10106627_B_P2ry1
  gRNA
auuggacguggugucauagc

SEQ ID NO: 106628 - RNA, 20 nt, Artificial Sequence
  MKO10106628_B_P2ry1
  gRNA
gccacuuaucagguaacaag

SEQ ID NO: 106629 - RNA, 20 nt, Artificial Sequence
  MKO10106629_B_P2ry2
  gRNA
cggcugcucaaaccggcuua

SEQ ID NO: 106630 - RNA, 20 nt, Artificial Sequence
  MKO10106630_B_P2ry2
  gRNA
gccgggcccguuaugcccgc

SEQ ID NO: 106631 - RNA, 20 nt, Artificial Sequence
  MKO10106631_B_P2ry2
  gRNA
acuacgcccggggugaccac

SEQ ID NO: 106632 - RNA, 20 nt, Artificial Sequence
  MKO10106632_B_P2ry4
  gRNA
aaucggucacccucauaagc

SEQ ID NO: 106633 - RNA, 20 nt, Artificial Sequence
  MKO10106633_B_P2ry4
  gRNA
caaaggucgauacagucgcc

SEQ ID NO: 106634 - RNA, 20 nt, Artificial Sequence
  MKO10106634_B_P2ry4
  gRNA
acguaguggucaaacuccuc

SEQ ID NO: 106635 - RNA, 20 nt, Artificial Sequence
  MKO10106635_B_P2ry6
  gRNA
ggcccgccgccugugucgcc

SEQ ID NO: 106636 - RNA, 20 nt, Artificial Sequence
  MKO10106636_B_P2ry6
  gRNA
caaggcggcucguauggcug

SEQ ID NO: 106637 - RNA, 20 nt, Artificial Sequence
  MKO10106637_B_P2ry6
  gRNA
caccaccugcgucuaccgug

SEQ ID NO: 106638 - RNA, 20 nt, Artificial Sequence
  MKO10106638_B_P4ha1
  gRNA
auuaacuugaaugcguuuac

SEQ ID NO: 106639 - RNA, 20 nt, Artificial Sequence
  MKO10106639_B_P4ha1
  gRNA
aguacugccucugaaugguu

SEQ ID NO: 106640 - RNA, 20 nt, Artificial Sequence
  MKO10106640_B_P4ha1
  gRNA
gagcugcuaaagcucuguuu

SEQ ID NO: 106641 - RNA, 20 nt, Artificial Sequence
  MKO10106641_B_P4ha2
  gRNA
ugaagcgguugaacacagac

SEQ ID NO: 106642 - RNA, 20 nt, Artificial Sequence
  MKO10106642_B_P4ha2
  gRNA
ccaagcucgccaagauuaag

SEQ ID NO: 106643 - RNA, 20 nt, Artificial Sequence
  MKO10106643_B_P4ha2
  gRNA
agaauugccgcugaacugag

SEQ ID NO: 106644 - RNA, 20 nt, Artificial Sequence
  MKO10106644_B_P4ha3
  gRNA
acuguacaggucggugaugg

SEQ ID NO: 106645 - RNA, 20 nt, Artificial Sequence
  MKO10106645_B_P4ha3
  gRNA
auccagggcgucuuccagac

SEQ ID NO: 106646 - RNA, 20 nt, Artificial Sequence
  MKO10106646_B_P4ha3
  gRNA
auuaccucggauguucucag

SEQ ID NO: 106647 - RNA, 20 nt, Artificial Sequence
  MKO10106647_B_P4hb
  gRNA
gcuauugaugacauaccuuu

SEQ ID NO: 106648 - RNA, 20 nt, Artificial Sequence
  MKO10106648_B_P4hb
  gRNA
cacuucgcuugaguccacca

SEQ ID NO: 106649 - RNA, 20 nt, Artificial Sequence
  MKO10106649_B_P4hb
  gRNA
ucucacccucaaaguuguug

SEQ ID NO: 106650 - RNA, 20 nt, Artificial Sequence
  MKO10106650_B_P4htm
  gRNA
aaguccagguggucgcgggc

SEQ ID NO: 106651 - RNA, 20 nt, Artificial Sequence
  MKO10106651_B_P4htm
  gRNA
gaucccugcccgcgaccacc

SEQ ID NO: 106652 - RNA, 20 nt, Artificial Sequence
  MKO10106652_B_P4htm
  gRNA
uaaggcagaauccaaugagc

SEQ ID NO: 106653 - RNA, 20 nt, Artificial Sequence
  MKO10106653_B_Pa2g4
  gRNA
cuuccuugaguauauagucc

SEQ ID NO: 106654 - RNA, 20 nt, Artificial Sequence
  MKO10106654_B_Pa2g4
  gRNA
cagugaccuugggguucaug

SEQ ID NO: 106655 - RNA, 20 nt, Artificial Sequence
  MKO10106655_B_Pa2g4
  gRNA
gugacacacacaguuauuua

SEQ ID NO: 106656 - RNA, 20 nt, Artificial Sequence
  MKO10106656_B_Pabpc1l
  gRNA
cucggugggaccacaugauu

SEQ ID NO: 106657 - RNA, 20 nt, Artificial Sequence
  MKO10106657_B_Pabpc1l
  gRNA
cagguaguauacaaugaaca

SEQ ID NO: 106658 - RNA, 20 nt, Artificial Sequence
  MKO10106658_B_Pabpc1l
  gRNA
ugugcauuucgagacccacg

SEQ ID NO: 106659 - RNA, 20 nt, Artificial Sequence
  MKO10106659_B_Pabpc1
  gRNA
guguacaaauccauagcccu

SEQ ID NO: 106660 - RNA, 20 nt, Artificial Sequence
  MKO10106660_B_Pabpc1
  gRNA
auuuguacacuuugaaacac

SEQ ID NO: 106661 - RNA, 20 nt, Artificial Sequence
  MKO10106661_B_Pabpc1
  gRNA
gcuuacaaauccaaauccuu

SEQ ID NO: 106662 - RNA, 20 nt, Artificial Sequence
  MKO10106662_B_Pabpc2
  gRNA
ccugacguucuucuuugcgc

SEQ ID NO: 106663 - RNA, 20 nt, Artificial Sequence
  MKO10106663_B_Pabpc2
  gRNA
acagcccgcuguuugcauac

SEQ ID NO: 106664 - RNA, 20 nt, Artificial Sequence
  MKO10106664_B_Pabpc2
  gRNA
caugggacagccugggucgc

SEQ ID NO: 106665 - RNA, 20 nt, Artificial Sequence
  MKO10106665_B_Pabpc4l
  gRNA
aggcguagccuagugaacgu

SEQ ID NO: 106666 - RNA, 20 nt, Artificial Sequence
  MKO10106666_B_Pabpc4l
  gRNA
cugauuucccaacguucacu

SEQ ID NO: 106667 - RNA, 20 nt, Artificial Sequence
  MKO10106667_B_Pabpc4l
  gRNA
ggccagauucaaaagccgua

SEQ ID NO: 106668 - RNA, 20 nt, Artificial Sequence
  MKO10106668_B_Pabpc4
  gRNA
cagguggucugugaugagaa

SEQ ID NO: 106669 - RNA, 20 nt, Artificial Sequence
  MKO10106669_B_Pabpc4
  gRNA
acaggacaagauguuuccaa

SEQ ID NO: 106670 - RNA, 20 nt, Artificial Sequence
  MKO10106670_B_Pabpc4
  gRNA
caugccauucaucuucucga

SEQ ID NO: 106671 - RNA, 20 nt, Artificial Sequence
  MKO10106671_B_Pabpc5
  gRNA
gucaucacauacgacuuuac

SEQ ID NO: 106672 - RNA, 20 nt, Artificial Sequence
  MKO10106672_B_Pabpc5
  gRNA
ugaaucgaccaacauauacc

SEQ ID NO: 106673 - RNA, 20 nt, Artificial Sequence
  MKO10106673_B_Pabpc5
  gRNA
cugcauggcaagucaauaga

SEQ ID NO: 106674 - RNA, 20 nt, Artificial Sequence
  MKO10106674_B_Pabpc6
  gRNA
uaugcccuacggcucugagu

SEQ ID NO: 106675 - RNA, 20 nt, Artificial Sequence
  MKO10106675_B_Pabpc6
  gRNA
cggacgcguagcccagcgag

SEQ ID NO: 106676 - RNA, 20 nt, Artificial Sequence
  MKO10106676_B_Pabpc6
  gRNA
ugguacgauuacuagugcaa

SEQ ID NO: 106677 - RNA, 20 nt, Artificial Sequence
  MKO10106677_B_Pabpn1l
  gRNA
auaccuugaugacccgaccu

SEQ ID NO: 106678 - RNA, 20 nt, Artificial Sequence
  MKO10106678_B_Pabpn1l
  gRNA
cugcugagcccugagaccgu

SEQ ID NO: 106679 - RNA, 20 nt, Artificial Sequence
  MKO10106679_B_Pabpn1l
  gRNA
cuggaugagagcaccuuccg

SEQ ID NO: 106680 - RNA, 20 nt, Artificial Sequence
  MKO10106680_B_Pabpn1
  gRNA
cauugccaacguagauagag

SEQ ID NO: 106681 - RNA, 20 nt, Artificial Sequence
  MKO10106681_B_Pabpn1
  gRNA
agagucagugaggacguccc

SEQ ID NO: 106682 - RNA, 20 nt, Artificial Sequence
  MKO10106682_B_Pabpn1
  gRNA
cuccuacuuacccuuuggga

SEQ ID NO: 106683 - RNA, 20 nt, Artificial Sequence
  MKO10106683_B_Pacrgl
  gRNA
uugagcuuaucacuuggccg

SEQ ID NO: 106684 - RNA, 20 nt, Artificial Sequence
  MKO10106684_B_Pacrgl
  gRNA
uaaauagcugcgaaugcagu

SEQ ID NO: 106685 - RNA, 20 nt, Artificial Sequence
  MKO10106685_B_Pacrgl
  gRNA
aggcuuuagggaguugcuuc

SEQ ID NO: 106686 - RNA, 20 nt, Artificial Sequence
  MKO10106686_B_Pacrg
  gRNA
uuccgaaaauguuaugagcg

SEQ ID NO: 106687 - RNA, 20 nt, Artificial Sequence
  MKO10106687_B_Pacrg
  gRNA
gcccuugagcaugacucgaa

SEQ ID NO: 106688 - RNA, 20 nt, Artificial Sequence
  MKO10106688_B_Pacrg
  gRNA
cuccguguuccagcaugucg

SEQ ID NO: 106689 - RNA, 20 nt, Artificial Sequence
  MKO10106689_B_Pacs1
  gRNA
ggcuggaaggaugaucucau

SEQ ID NO: 106690 - RNA, 20 nt, Artificial Sequence
  MKO10106690_B_Pacs1
  gRNA
ggugaugcaacacccuaaug

SEQ ID NO: 106691 - RNA, 20 nt, Artificial Sequence
  MKO10106691_B_Pacs1
  gRNA
agucauugcugugaagcugc

SEQ ID NO: 106692 - RNA, 20 nt, Artificial Sequence
  MKO10106692_B_Pacs2
  gRNA
ugcagaucaugcuacagcgc

SEQ ID NO: 106693 - RNA, 20 nt, Artificial Sequence
  MKO10106693_B_Pacs2
  gRNA
augugaucucaagacacgcu

SEQ ID NO: 106694 - RNA, 20 nt, Artificial Sequence
  MKO10106694_B_Pacs2
  gRNA
gaggguuaccugcaucuuga

SEQ ID NO: 106695 - RNA, 20 nt, Artificial Sequence
  MKO10106695_B_Pacsin1
  gRNA
gguaccugcuguucuccgcu

SEQ ID NO: 106696 - RNA, 20 nt, Artificial Sequence
  MKO10106696_B_Pacsin1
  gRNA
cgcuccaggcugccauacug

SEQ ID NO: 106697 - RNA, 20 nt, Artificial Sequence
  MKO10106697_B_Pacsin1
  gRNA
uggcuucaaggagacgaaag

SEQ ID NO: 106698 - RNA, 20 nt, Artificial Sequence
  MKO10106698_B_Pacsin2
  gRNA
uggucugaucaagcuccuuc

SEQ ID NO: 106699 - RNA, 20 nt, Artificial Sequence
  MKO10106699_B_Pacsin2
  gRNA
gcucaugcagacaguucaug

SEQ ID NO: 106700 - RNA, 20 nt, Artificial Sequence
  MKO10106700_B_Pacsin2
  gRNA
ucuccucuuugcacgcugug

SEQ ID NO: 106701 - RNA, 20 nt, Artificial Sequence
  MKO10106701_B_Pacsin3
  gRNA
agaacgugcccgcauugaga

SEQ ID NO: 106702 - RNA, 20 nt, Artificial Sequence
  MKO10106702_B_Pacsin3
  gRNA
guggaaagccccucgcugcc

SEQ ID NO: 106703 - RNA, 20 nt, Artificial Sequence
  MKO10106703_B_Pacsin3
  gRNA
gagcuaccacacagcccgca

SEQ ID NO: 106704 - RNA, 20 nt, Artificial Sequence
  MKO10106704_B_Padi1
  gRNA
ugcuaaccauuugaagucgc

SEQ ID NO: 106705 - RNA, 20 nt, Artificial Sequence
  MKO10106705_B_Padi1
  gRNA
gugcucuaccuaacugcugu

SEQ ID NO: 106706 - RNA, 20 nt, Artificial Sequence
  MKO10106706_B_Padi1
  gRNA
cacccuccagcgacuucaaa

SEQ ID NO: 106707 - RNA, 20 nt, Artificial Sequence
  MKO10106707_B_Padi2
  gRNA
cuugucugcagagaucucgc

SEQ ID NO: 106708 - RNA, 20 nt, Artificial Sequence
  MKO10106708_B_Padi2
  gRNA
ggaggacuguagugacgaaa

SEQ ID NO: 106709 - RNA, 20 nt, Artificial Sequence
  MKO10106709_B_Padi2
  gRNA
gggcagcgcccccauugacc

SEQ ID NO: 106710 - RNA, 20 nt, Artificial Sequence
  MKO10106710_B_Padi3
  gRNA
augcucucggcuggaguggu

SEQ ID NO: 106711 - RNA, 20 nt, Artificial Sequence
  MKO10106711_B_Padi3
  gRNA
cagccgagagcauuugcccc

SEQ ID NO: 106712 - RNA, 20 nt, Artificial Sequence
  MKO10106712_B_Padi3
  gRNA
ccacgaagcuccuguccugc

SEQ ID NO: 106713 - RNA, 20 nt, Artificial Sequence
  MKO10106713_B_Padi4
  gRNA
augacaucuacgaugacucc

SEQ ID NO: 106714 - RNA, 20 nt, Artificial Sequence
  MKO10106714_B_Padi4
  gRNA
ccgaagguuguguagcccuu

SEQ ID NO: 106715 - RNA, 20 nt, Artificial Sequence
  MKO10106715_B_Padi4
  gRNA
caagcccugaucuacaucac

SEQ ID NO: 106716 - RNA, 20 nt, Artificial Sequence
  MKO10106716_B_Padi6
  gRNA
gccugaugaacaguccuuuc

SEQ ID NO: 106717 - RNA, 20 nt, Artificial Sequence
  MKO10106717_B_Padi6
  gRNA
ugcaagucuuucaccauccg

SEQ ID NO: 106718 - RNA, 20 nt, Artificial Sequence
  MKO10106718_B_Padi6
  gRNA
gcuacaauucacaagcagga

SEQ ID NO: 106719 - RNA, 20 nt, Artificial Sequence
  MKO10106719_B_Paf1
  gRNA
acacaccauugggaucaaug

SEQ ID NO: 106720 - RNA, 20 nt, Artificial Sequence
  MKO10106720_B_Paf1
  gRNA
aaaccaggcccaauucccac

SEQ ID NO: 106721 - RNA, 20 nt, Artificial Sequence
  MKO10106721_B_Paf1
  gRNA
ucuagaagcuucucaucagc

SEQ ID NO: 106722 - RNA, 20 nt, Artificial Sequence
  MKO10106722_B_Pafah1b1
  gRNA
gaauuagauaagaaguaugc

SEQ ID NO: 106723 - RNA, 20 nt, Artificial Sequence
  MKO10106723_B_Pafah1b1
  gRNA
caggugugggauuaugagac

SEQ ID NO: 106724 - RNA, 20 nt, Artificial Sequence
  MKO10106724_B_Pafah1b1
  gRNA
uguuauuagauuacaaaaaa

SEQ ID NO: 106725 - RNA, 20 nt, Artificial Sequence
  MKO10106725_B_Pafah1b2
  gRNA
gugcagcuccuugauauaga

SEQ ID NO: 106726 - RNA, 20 nt, Artificial Sequence
  MKO10106726_B_Pafah1b2
  gRNA
ccacuucaugcucuuaauuu

SEQ ID NO: 106727 - RNA, 20 nt, Artificial Sequence
  MKO10106727_B_Pafah1b2
  gRNA
uuguacaacuuauaaacacg

SEQ ID NO: 106728 - RNA, 20 nt, Artificial Sequence
  MKO10106728_B_Pafah1b3
  gRNA
caucaaagccaucguacaac

SEQ ID NO: 106729 - RNA, 20 nt, Artificial Sequence
  MKO10106729_B_Pafah1b3
  gRNA
acuucgagagaaaaaccgac

SEQ ID NO: 106730 - RNA, 20 nt, Artificial Sequence
  MKO10106730_B_Pafah1b3
  gRNA
cuuguucaccaguuguacga

SEQ ID NO: 106731 - RNA, 20 nt, Artificial Sequence
  MKO10106731_B_Pafah2
  gRNA
acucuccagggcgucauacu

SEQ ID NO: 106732 - RNA, 20 nt, Artificial Sequence
  MKO10106732_B_Pafah2
  gRNA
cuaccugaggauuccugacg

SEQ ID NO: 106733 - RNA, 20 nt, Artificial Sequence
  MKO10106733_B_Pafah2
  gRNA
cuugucgcuugccuguuagc

SEQ ID NO: 106734 - RNA, 20 nt, Artificial Sequence
  MKO10106734_B_Pag1
  gRNA
cgaggcuuaccacauucauc

SEQ ID NO: 106735 - RNA, 20 nt, Artificial Sequence
  MKO10106735_B_Pag1
  gRNA
ugguccccgcuaugcugccg

SEQ ID NO: 106736 - RNA, 20 nt, Artificial Sequence
  MKO10106736_B_Pag1
  gRNA
uagccagugcaucuguuguc

SEQ ID NO: 106737 - RNA, 20 nt, Artificial Sequence
  MKO10106737_B_Pagr1a
  gRNA
acgcucgucgcucgcagcgc

SEQ ID NO: 106738 - RNA, 20 nt, Artificial Sequence
  MKO10106738_B_Pagr1a
  gRNA
ugaugagccaaugacaccaa

SEQ ID NO: 106739 - RNA, 20 nt, Artificial Sequence
  MKO10106739_B_Pagr1a
  gRNA
cugucaaucagugaguccuu

SEQ ID NO: 106740 - RNA, 20 nt, Artificial Sequence
  MKO10106740_B_Pah
  gRNA
cacuuaccucaaauaagcgc

SEQ ID NO: 106741 - RNA, 20 nt, Artificial Sequence
  MKO10106741_B_Pah
  gRNA
caaacugcuuucgucucgcc

SEQ ID NO: 106742 - RNA, 20 nt, Artificial Sequence
  MKO10106742_B_Pah
  gRNA
ucugauauucucacucaaag

SEQ ID NO: 106743 - RNA, 20 nt, Artificial Sequence
  MKO10106743_B_Paics
  gRNA
gugaaaugauccccauugag

SEQ ID NO: 106744 - RNA, 20 nt, Artificial Sequence
  MKO10106744_B_Paics
  gRNA
aagacccaguugcuauucuu

SEQ ID NO: 106745 - RNA, 20 nt, Artificial Sequence
  MKO10106745_B_Paics
  gRNA
gcugccccaggacuguacgc

SEQ ID NO: 106746 - RNA, 20 nt, Artificial Sequence
  MKO10106746_B_Paip1
  gRNA
ugaacuguaggaauccuaug

SEQ ID NO: 106747 - RNA, 20 nt, Artificial Sequence
  MKO10106747_B_Paip1
  gRNA
agaacuauaucuuaaccugg

SEQ ID NO: 106748 - RNA, 20 nt, Artificial Sequence
  MKO10106748_B_Paip1
  gRNA
gcuaaagaccaagcugcaaa

SEQ ID NO: 106749 - RNA, 20 nt, Artificial Sequence
  MKO10106749_B_Paip2b
  gRNA
cacuuacaacagcaguuaaa

SEQ ID NO: 106750 - RNA, 20 nt, Artificial Sequence
  MKO10106750_B_Paip2b
  gRNA
ugaagaggauuucaacagac

SEQ ID NO: 106751 - RNA, 20 nt, Artificial Sequence
  MKO10106751_B_Paip2b
  gRNA
acagcucaguacuucacucc

SEQ ID NO: 106752 - RNA, 20 nt, Artificial Sequence
  MKO10106752_B_Paip2
  gRNA
acaugucaguacuucacccc

SEQ ID NO: 106753 - RNA, 20 nt, Artificial Sequence
  MKO10106753_B_Paip2
  gRNA
caaucugaaucccaaugcaa

SEQ ID NO: 106754 - RNA, 20 nt, Artificial Sequence
  MKO10106754_B_Paip2
  gRNA
auccauuugcagaguacaug

SEQ ID NO: 106755 - RNA, 20 nt, Artificial Sequence
  MKO10106755_B_Pak1ip1
  gRNA
uuccuuucuauccacccguc

SEQ ID NO: 106756 - RNA, 20 nt, Artificial Sequence
  MKO10106756_B_Pak1ip1
  gRNA
cugccccacugauuaagugc

SEQ ID NO: 106757 - RNA, 20 nt, Artificial Sequence
  MKO10106757_B_Pak1ip1
  gRNA
uuggcaccgauaaaacauua

SEQ ID NO: 106758 - RNA, 20 nt, Artificial Sequence
  MKO10106758_B_Pak1
  gRNA
cguggagcaaucacuggagg

SEQ ID NO: 106759 - RNA, 20 nt, Artificial Sequence
  MKO10106759_B_Pak1
  gRNA
auuguaugcucaaaaucuga

SEQ ID NO: 106760 - RNA, 20 nt, Artificial Sequence
  MKO10106760_B_Pak1
  gRNA
uuauaauucuucuaacacuu

SEQ ID NO: 106761 - RNA, 20 nt, Artificial Sequence
  MKO10106761_B_Pak2
  gRNA
auggugugcucaaaaucaga

SEQ ID NO: 106762 - RNA, 20 nt, Artificial Sequence
  MKO10106762_B_Pak2
  gRNA
gacaucagcuguagugacag

SEQ ID NO: 106763 - RNA, 20 nt, Artificial Sequence
  MKO10106763_B_Pak2
  gRNA
cuuacugcugguguuccaga

SEQ ID NO: 106764 - RNA, 20 nt, Artificial Sequence
  MKO10106764_B_Pak3
  gRNA
aucguaugcucaaagucuga

SEQ ID NO: 106765 - RNA, 20 nt, Artificial Sequence
  MKO10106765_B_Pak3
  gRNA
acugaaaaugucugacagcu

SEQ ID NO: 106766 - RNA, 20 nt, Artificial Sequence
  MKO10106766_B_Pak3
  gRNA
gaugugcugcuauguaucca

SEQ ID NO: 106767 - RNA, 20 nt, Artificial Sequence
  MKO10106767_B_Pak4
  gRNA
ucuccaccacguucucgugc

SEQ ID NO: 106768 - RNA, 20 nt, Artificial Sequence
  MKO10106768_B_Pak4
  gRNA
cagagagugggcgcuuaucg

SEQ ID NO: 106769 - RNA, 20 nt, Artificial Sequence
  MKO10106769_B_Pak4
  gRNA
gcccacucacccggccauca

SEQ ID NO: 106770 - RNA, 20 nt, Artificial Sequence
  MKO10106770_B_Pak6
  gRNA
ugacuaccagcaccucaacg

SEQ ID NO: 106771 - RNA, 20 nt, Artificial Sequence
  MKO10106771_B_Pak6
  gRNA
ugcccgugucuucgccaccc

SEQ ID NO: 106772 - RNA, 20 nt, Artificial Sequence
  MKO10106772_B_Pak6
  gRNA
cuggacagcuacgugaagau

SEQ ID NO: 106773 - RNA, 20 nt, Artificial Sequence
  MKO10106773_B_Pak7
  gRNA
ggauuacgaucgagcacaga

SEQ ID NO: 106774 - RNA, 20 nt, Artificial Sequence
  MKO10106774_B_Pak7
  gRNA
acaugucaacuacguuguca

SEQ ID NO: 106775 - RNA, 20 nt, Artificial Sequence
  MKO10106775_B_Pak7
  gRNA
gcaccuacccuccaccuagc

SEQ ID NO: 106776 - RNA, 20 nt, Artificial Sequence
  MKO10106776_B_Palb2
  gRNA
caggacacuugcucgacuuc

SEQ ID NO: 106777 - RNA, 20 nt, Artificial Sequence
  MKO10106777_B_Palb2
  gRNA
uggaauguucauguaacucg

SEQ ID NO: 106778 - RNA, 20 nt, Artificial Sequence
  MKO10106778_B_Palb2
  gRNA
gcgugccaaaagagcugaga

SEQ ID NO: 106779 - RNA, 20 nt, Artificial Sequence
  MKO10106779_B_Pald1
  gRNA
agagccggcccauccuguaa

SEQ ID NO: 106780 - RNA, 20 nt, Artificial Sequence
  MKO10106780_B_Pald1
  gRNA
ucagcgcgcaagaacaccac

SEQ ID NO: 106781 - RNA, 20 nt, Artificial Sequence
  MKO10106781_B_Pald1
  gRNA
cgcacacgccauccucaccu

SEQ ID NO: 106782 - RNA, 20 nt, Artificial Sequence
  MKO10106782_B_Palld
  gRNA
ucauaucucugccgaccuga

SEQ ID NO: 106783 - RNA, 20 nt, Artificial Sequence
  MKO10106783_B_Palld
  gRNA
gcgaccugugucguccucaa

SEQ ID NO: 106784 - RNA, 20 nt, Artificial Sequence
  MKO10106784_B_Palld
  gRNA
cagcccauggugguuccguc

SEQ ID NO: 106785 - RNA, 20 nt, Artificial Sequence
  MKO10106785_B_Palm2
  gRNA
uccuccuccgcuguucccgc

SEQ ID NO: 106786 - RNA, 20 nt, Artificial Sequence
  MKO10106786_B_Palm2
  gRNA
uucuucagacugccugcgcc

SEQ ID NO: 106787 - RNA, 20 nt, Artificial Sequence
  MKO10106787_B_Palm2
  gRNA
gcacuuaccuccaucagcag

SEQ ID NO: 106788 - RNA, 20 nt, Artificial Sequence
  MKO10106788_B_Palm3
  gRNA
cguccaugagccaacguucu

SEQ ID NO: 106789 - RNA, 20 nt, Artificial Sequence
  MKO10106789_B_Palm3
  gRNA
cuguugcaaagugcguccac

SEQ ID NO: 106790 - RNA, 20 nt, Artificial Sequence
  MKO10106790_B_Palm3
  gRNA
ccuccagccgcugccgauag

SEQ ID NO: 106791 - RNA, 20 nt, Artificial Sequence
  MKO10106791_B_Palmd
  gRNA
uuccacugccgauuccaucc

SEQ ID NO: 106792 - RNA, 20 nt, Artificial Sequence
  MKO10106792_B_Palmd
  gRNA
acagaagcgucugaaaauag

SEQ ID NO: 106793 - RNA, 20 nt, Artificial Sequence
  MKO10106793_B_Palmd
  gRNA
aaauggcuccuggauggaau

SEQ ID NO: 106794 - RNA, 20 nt, Artificial Sequence
  MKO10106794_B_Palm
  gRNA
ugcacccacaggagaagcgu

SEQ ID NO: 106795 - RNA, 20 nt, Artificial Sequence
  MKO10106795_B_Palm
  gRNA
aagacagcugcaguaccuga

SEQ ID NO: 106796 - RNA, 20 nt, Artificial Sequence
  MKO10106796_B_Palm
  gRNA
caggguccuggcaacagaca

SEQ ID NO: 106797 - RNA, 20 nt, Artificial Sequence
  MKO10106797_B_Pam16
  gRNA
gaacacucaccuuugacugc

SEQ ID NO: 106798 - RNA, 20 nt, Artificial Sequence
  MKO10106798_B_Pam16
  gRNA
uaccugcaaacuccugccuc

SEQ ID NO: 106799 - RNA, 20 nt, Artificial Sequence
  MKO10106799_B_Pam16
  gRNA
caggcagccgcugacgcucg

SEQ ID NO: 106800 - RNA, 20 nt, Artificial Sequence
  MKO10106800_B_Pamr1
  gRNA
gucauuaaugaagccugucc

SEQ ID NO: 106801 - RNA, 20 nt, Artificial Sequence
  MKO10106801_B_Pamr1
  gRNA
caugugccaauaugacuaug

SEQ ID NO: 106802 - RNA, 20 nt, Artificial Sequence
  MKO10106802_B_Pamr1
  gRNA
gauucuacugcgcagagugc

SEQ ID NO: 106803 - RNA, 20 nt, Artificial Sequence
  MKO10106803_B_Pam
  gRNA
ugcaacaugcccucauccac

SEQ ID NO: 106804 - RNA, 20 nt, Artificial Sequence
  MKO10106804_B_Pam
  gRNA
cagacauaccuuuagggagc

SEQ ID NO: 106805 - RNA, 20 nt, Artificial Sequence
  MKO10106805_B_Pam
  gRNA
aagccaauauucuauaugcc

SEQ ID NO: 106806 - RNA, 20 nt, Artificial Sequence
  MKO10106806_B_Pan2
  gRNA
caguaugcagucgagacacc

SEQ ID NO: 106807 - RNA, 20 nt, Artificial Sequence
  MKO10106807_B_Pan2
  gRNA
ggaagaggauaccguucucc

SEQ ID NO: 106808 - RNA, 20 nt, Artificial Sequence
  MKO10106808_B_Pan2
  gRNA
ggggcugcagaaccacguac

SEQ ID NO: 106809 - RNA, 20 nt, Artificial Sequence
  MKO10106809_B_Pan3
  gRNA
cuuucuuucaguuccgggaa

SEQ ID NO: 106810 - RNA, 20 nt, Artificial Sequence
  MKO10106810_B_Pan3
  gRNA
ggcaccgaagucauuaaaca

SEQ ID NO: 106811 - RNA, 20 nt, Artificial Sequence
  MKO10106811_B_Pan3
  gRNA
ccugaaaauaccugcaucaa

SEQ ID NO: 106812 - RNA, 20 nt, Artificial Sequence
  MKO10106812_B_Pank1
  gRNA
uaugagcgauuuggccuuca

SEQ ID NO: 106813 - RNA, 20 nt, Artificial Sequence
  MKO10106813_B_Pank1
  gRNA
ggcgaggucuucuuugcuga

SEQ ID NO: 106814 - RNA, 20 nt, Artificial Sequence
  MKO10106814_B_Pank1
  gRNA
uaaaggcgacagcaccaaug

SEQ ID NO: 106815 - RNA, 20 nt, Artificial Sequence
  MKO10106815_B_Pank2
  gRNA
ucguggagauagcaccaaag

SEQ ID NO: 106816 - RNA, 20 nt, Artificial Sequence
  MKO10106816_B_Pank2
  gRNA
ucgaacuaauuuguccacuu

SEQ ID NO: 106817 - RNA, 20 nt, Artificial Sequence
  MKO10106817_B_Pank2
  gRNA
ccgauguucaccagaagcag

SEQ ID NO: 106818 - RNA, 20 nt, Artificial Sequence
  MKO10106818_B_Pank3
  gRNA
ccacugcugguagugaauau

SEQ ID NO: 106819 - RNA, 20 nt, Artificial Sequence
  MKO10106819_B_Pank3
  gRNA
gguuuaugcaguuuguugac

SEQ ID NO: 106820 - RNA, 20 nt, Artificial Sequence
  MKO10106820_B_Pank3
  gRNA
acgagaaacuguuaguaaag

SEQ ID NO: 106821 - RNA, 20 nt, Artificial Sequence
  MKO10106821_B_Pank4
  gRNA
cucuggcgucuccaucguga

SEQ ID NO: 106822 - RNA, 20 nt, Artificial Sequence
  MKO10106822_B_Pank4
  gRNA
agguggaucauugaccaagu

SEQ ID NO: 106823 - RNA, 20 nt, Artificial Sequence
  MKO10106823_B_Pank4
  gRNA
acccuaugagaucucagucc

SEQ ID NO: 106824 - RNA, 20 nt, Artificial Sequence
  MKO10106824_B_Panx1
  gRNA
cuugaaauguagaacaucga

SEQ ID NO: 106825 - RNA, 20 nt, Artificial Sequence
  MKO10106825_B_Panx1
  gRNA
gggagaagaacucucgccag

SEQ ID NO: 106826 - RNA, 20 nt, Artificial Sequence
  MKO10106826_B_Panx1
  gRNA
gguuuccagacucgcucugc

SEQ ID NO: 106827 - RNA, 20 nt, Artificial Sequence
  MKO10106827_B_Panx2
  gRNA
gccuugucguccugcgagcc

SEQ ID NO: 106828 - RNA, 20 nt, Artificial Sequence
  MKO10106828_B_Panx2
  gRNA
agaugcuccacuccccgaga

SEQ ID NO: 106829 - RNA, 20 nt, Artificial Sequence
  MKO10106829_B_Panx2
  gRNA
ccacaucagcacgcuguaug

SEQ ID NO: 106830 - RNA, 20 nt, Artificial Sequence
  MKO10106830_B_Panx3
  gRNA
cuuugagccgagagccccug

SEQ ID NO: 106831 - RNA, 20 nt, Artificial Sequence
  MKO10106831_B_Panx3
  gRNA
uuccagguaccgcucuagca

SEQ ID NO: 106832 - RNA, 20 nt, Artificial Sequence
  MKO10106832_B_Panx3
  gRNA
ugcagcacauguugcagauc

SEQ ID NO: 106833 - RNA, 20 nt, Artificial Sequence
  MKO10106833_B_Paox
  gRNA
auacauacucaaaagaaggc

SEQ ID NO: 106834 - RNA, 20 nt, Artificial Sequence
  MKO10106834_B_Paox
  gRNA
cccucucacuccaagacacc

SEQ ID NO: 106835 - RNA, 20 nt, Artificial Sequence
  MKO10106835_B_Paox
  gRNA
aggucuucacaugugcucug

SEQ ID NO: 106836 - RNA, 20 nt, Artificial Sequence
  MKO10106836_B_Papd4
  gRNA
auuaccuuaucuuuggccuc

SEQ ID NO: 106837 - RNA, 20 nt, Artificial Sequence
  MKO10106837_B_Papd4
  gRNA
ucaacaucuccauuauuucg

SEQ ID NO: 106838 - RNA, 20 nt, Artificial Sequence
  MKO10106838_B_Papd4
  gRNA
auaaaucgccaucacugcuu

SEQ ID NO: 106839 - RNA, 20 nt, Artificial Sequence
  MKO10106839_B_Papd5
  gRNA
cuaaccugguagguaaauac

SEQ ID NO: 106840 - RNA, 20 nt, Artificial Sequence
  MKO10106840_B_Papd5
  gRNA
guacaugucucccagacccg

SEQ ID NO: 106841 - RNA, 20 nt, Artificial Sequence
  MKO10106841_B_Papd5
  gRNA
cagcgacuuuguguuuccga

SEQ ID NO: 106842 - RNA, 20 nt, Artificial Sequence
  MKO10106842_B_Papd7
  gRNA
cgccugugaagaccucauuc

SEQ ID NO: 106843 - RNA, 20 nt, Artificial Sequence
  MKO10106843_B_Papd7
  gRNA
caucauaaagcucacagauc

SEQ ID NO: 106844 - RNA, 20 nt, Artificial Sequence
  MKO10106844_B_Papd7
  gRNA
agucgacaucagcuuuaaca

SEQ ID NO: 106845 - RNA, 20 nt, Artificial Sequence
  MKO10106845_B_Papln
  gRNA
uuucacaggcucgaaaugug

SEQ ID NO: 106846 - RNA, 20 nt, Artificial Sequence
  MKO10106846_B_Papln
  gRNA
gcgcgcggggcccacgcagc

SEQ ID NO: 106847 - RNA, 20 nt, Artificial Sequence
  MKO10106847_B_Papln
  gRNA
ucgcucugcaggagagacgg

SEQ ID NO: 106848 - RNA, 20 nt, Artificial Sequence
  MKO10106848_B_Papl
  gRNA
gcagcuuccgcagcgucacg

SEQ ID NO: 106849 - RNA, 20 nt, Artificial Sequence
  MKO10106849_B_Papl
  gRNA
acauucaccgcgugacgcug

SEQ ID NO: 106850 - RNA, 20 nt, Artificial Sequence
  MKO10106850_B_Papl
  gRNA
augugaucaaauuccgcugg

SEQ ID NO: 106851 - RNA, 20 nt, Artificial Sequence
  MKO10106851_B_Papola
  gRNA
cucgaauccauucuuucacc

SEQ ID NO: 106852 - RNA, 20 nt, Artificial Sequence
  MKO10106852_B_Papola
  gRNA
ucgagaaaucagugaaagca

SEQ ID NO: 106853 - RNA, 20 nt, Artificial Sequence
  MKO10106853_B_Papola
  gRNA
uuucaauuuaucauagaaug

SEQ ID NO: 106854 - RNA, 20 nt, Artificial Sequence
  MKO10106854_B_Papolb
  gRNA
cuuucguguguacuccuaau

SEQ ID NO: 106855 - RNA, 20 nt, Artificial Sequence
  MKO10106855_B_Papolb
  gRNA
gagccgguuguugugcuccu

SEQ ID NO: 106856 - RNA, 20 nt, Artificial Sequence
  MKO10106856_B_Papolb
  gRNA
gacgauaugccgaacugcuu

SEQ ID NO: 106857 - RNA, 20 nt, Artificial Sequence
  MKO10106857_B_Papolg
  gRNA
aggcuuggaguacacaccaa

SEQ ID NO: 106858 - RNA, 20 nt, Artificial Sequence
  MKO10106858_B_Papolg
  gRNA
gaaucucccaccuucuguug

SEQ ID NO: 106859 - RNA, 20 nt, Artificial Sequence
  MKO10106859_B_Papolg
  gRNA
uucugacaucagugaaagua

SEQ ID NO: 106860 - RNA, 20 nt, Artificial Sequence
  MKO10106860_B_Pappa2
  gRNA
guggccaagcaugccauaau

SEQ ID NO: 106861 - RNA, 20 nt, Artificial Sequence
  MKO10106861_B_Pappa2
  gRNA
caccaacaucaugauccaug

SEQ ID NO: 106862 - RNA, 20 nt, Artificial Sequence
  MKO10106862_B_Pappa2
  gRNA
ucauacacaacuccacugau

SEQ ID NO: 106863 - RNA, 20 nt, Artificial Sequence
  MKO10106863_B_Pappa
  gRNA
accuguagcucuugcgcccc

SEQ ID NO: 106864 - RNA, 20 nt, Artificial Sequence
  MKO10106864_B_Pappa
  gRNA
ccauugugugccccacaacc

SEQ ID NO: 106865 - RNA, 20 nt, Artificial Sequence
  MKO10106865_B_Pappa
  gRNA
cacaccaugauucaugagau

SEQ ID NO: 106866 - RNA, 20 nt, Artificial Sequence
  MKO10106866_B_Papss1
  gRNA
cuuuauaucgccuuacacac

SEQ ID NO: 106867 - RNA, 20 nt, Artificial Sequence
  MKO10106867_B_Papss1
  gRNA
cugcccgcgccuucuuguag

SEQ ID NO: 106868 - RNA, 20 nt, Artificial Sequence
  MKO10106868_B_Papss1
  gRNA
gcuuccgugguugcacaguu

SEQ ID NO: 106869 - RNA, 20 nt, Artificial Sequence
  MKO10106869_B_Papss2
  gRNA
gccuggccaccuccgcgauc

SEQ ID NO: 106870 - RNA, 20 nt, Artificial Sequence
  MKO10106870_B_Papss2
  gRNA
cgaaaaauccacgaaucagc

SEQ ID NO: 106871 - RNA, 20 nt, Artificial Sequence
  MKO10106871_B_Papss2
  gRNA
aguaagcgacugugugcaac

SEQ ID NO: 106872 - RNA, 20 nt, Artificial Sequence
  MKO10106872_B_Paqr3
  gRNA
agucagugcuccuauuguac

SEQ ID NO: 106873 - RNA, 20 nt, Artificial Sequence
  MKO10106873_B_Paqr3
  gRNA
ucacguacaucacaauuacu

SEQ ID NO: 106874 - RNA, 20 nt, Artificial Sequence
  MKO10106874_B_Paqr3
  gRNA
auacugggcugcuaugucuc

SEQ ID NO: 106875 - RNA, 20 nt, Artificial Sequence
  MKO10106875_B_Paqr4
  gRNA
uuucuaccuacacaacgagc

SEQ ID NO: 106876 - RNA, 20 nt, Artificial Sequence
  MKO10106876_B_Paqr4
  gRNA
ccuucuagggcuagcccugc

SEQ ID NO: 106877 - RNA, 20 nt, Artificial Sequence
  MKO10106877_B_Paqr4
  gRNA
gcucaccaaggguguugaca

SEQ ID NO: 106878 - RNA, 20 nt, Artificial Sequence
  MKO10106878_B_Paqr5
  gRNA
gccacgaguagcugucauuc

SEQ ID NO: 106879 - RNA, 20 nt, Artificial Sequence
  MKO10106879_B_Paqr5
  gRNA
cugcaagcuacuccgggucc

SEQ ID NO: 106880 - RNA, 20 nt, Artificial Sequence
  MKO10106880_B_Paqr5
  gRNA
gcaagugcguccagauguug

SEQ ID NO: 106881 - RNA, 20 nt, Artificial Sequence
  MKO10106881_B_Paqr6
  gRNA
cccauaccaccuaccgcugc

SEQ ID NO: 106882 - RNA, 20 nt, Artificial Sequence
  MKO10106882_B_Paqr6
  gRNA
ugaccgucucauuagucauc

SEQ ID NO: 106883 - RNA, 20 nt, Artificial Sequence
  MKO10106883_B_Paqr6
  gRNA
cuaugccgccuacuccaugc

SEQ ID NO: 106884 - RNA, 20 nt, Artificial Sequence
  MKO10106884_B_Paqr7
  gRNA
gaggcucguauaugccccuc

SEQ ID NO: 106885 - RNA, 20 nt, Artificial Sequence
  MKO10106885_B_Paqr7
  gRNA
gcagcgcgugagggucuucc

SEQ ID NO: 106886 - RNA, 20 nt, Artificial Sequence
  MKO10106886_B_Paqr7
  gRNA
ccaacucucaggcauaaccg

SEQ ID NO: 106887 - RNA, 20 nt, Artificial Sequence
  MKO10106887_B_Paqr8
  gRNA
agaagaaguaugcgcugacg

SEQ ID NO: 106888 - RNA, 20 nt, Artificial Sequence
  MKO10106888_B_Paqr8
  gRNA
augccaaguaucgcuaccga

SEQ ID NO: 106889 - RNA, 20 nt, Artificial Sequence
  MKO10106889_B_Paqr8
  gRNA
ccgacgugccccagcucuuu

SEQ ID NO: 106890 - RNA, 20 nt, Artificial Sequence
  MKO10106890_B_Paqr9
  gRNA
cgccggcgugaagggaccgc

SEQ ID NO: 106891 - RNA, 20 nt, Artificial Sequence
  MKO10106891_B_Paqr9
  gRNA
gcuucauccuguccggcuac

SEQ ID NO: 106892 - RNA, 20 nt, Artificial Sequence
  MKO10106892_B_Paqr9
  gRNA
gccgcuguggugcuaugcgu

SEQ ID NO: 106893 - RNA, 20 nt, Artificial Sequence
  MKO10106893_B_Pard3b
  gRNA
ugaaucuucacccaguaucc

SEQ ID NO: 106894 - RNA, 20 nt, Artificial Sequence
  MKO10106894_B_Pard3b
  gRNA
aagauaccuaccagaacaac

SEQ ID NO: 106895 - RNA, 20 nt, Artificial Sequence
  MKO10106895_B_Pard3b
  gRNA
gcuuucacugcacagaccga

SEQ ID NO: 106896 - RNA, 20 nt, Artificial Sequence
  MKO10106896_B_Pard3
  gRNA
ccauuggguggcuggcgcuc

SEQ ID NO: 106897 - RNA, 20 nt, Artificial Sequence
  MKO10106897_B_Pard3
  gRNA
ccgguaucagcauguccaac

SEQ ID NO: 106898 - RNA, 20 nt, Artificial Sequence
  MKO10106898_B_Pard3
  gRNA
ccgguuggacaugcugauac

SEQ ID NO: 106899 - RNA, 20 nt, Artificial Sequence
  MKO10106899_B_Pard6a
  gRNA
uagugcaaagcgucggaacu

SEQ ID NO: 106900 - RNA, 20 nt, Artificial Sequence
  MKO10106900_B_Pard6a
  gRNA
cagucccgauagcaucgucg

SEQ ID NO: 106901 - RNA, 20 nt, Artificial Sequence
  MKO10106901_B_Pard6a
  gRNA
cugcgcgccggaguccucug

SEQ ID NO: 106902 - RNA, 20 nt, Artificial Sequence
  MKO10106902_B_Pard6b
  gRNA
gauccccaaugucgacgugu

SEQ ID NO: 106903 - RNA, 20 nt, Artificial Sequence
  MKO10106903_B_Pard6b
  gRNA
agccgcugcucgccccgugc

SEQ ID NO: 106904 - RNA, 20 nt, Artificial Sequence
  MKO10106904_B_Pard6b
  gRNA
ucagcaugaaccgcggccac

SEQ ID NO: 106905 - RNA, 20 nt, Artificial Sequence
  MKO10106905_B_Pard6g
  gRNA
cgcugcagucguagaagcgu

SEQ ID NO: 106906 - RNA, 20 nt, Artificial Sequence
  MKO10106906_B_Pard6g
  gRNA
gugcacaucagcauagccga

SEQ ID NO: 106907 - RNA, 20 nt, Artificial Sequence
  MKO10106907_B_Pard6g
  gRNA
cuucuacgacugcagcgcug

SEQ ID NO: 106908 - RNA, 20 nt, Artificial Sequence
  MKO10106908_B_Parg
  gRNA
agguuaggugggauguauuu

SEQ ID NO: 106909 - RNA, 20 nt, Artificial Sequence
  MKO10106909_B_Parg
  gRNA
cuuguacccuguggaagaug

SEQ ID NO: 106910 - RNA, 20 nt, Artificial Sequence
  MKO10106910_B_Parg
  gRNA
ccaagacagcugaaucagaa

SEQ ID NO: 106911 - RNA, 20 nt, Artificial Sequence
  MKO10106911_B_Park2
  gRNA
cucccauauggagcccucug

SEQ ID NO: 106912 - RNA, 20 nt, Artificial Sequence
  MKO10106912_B_Park2
  gRNA
uuucaaagggcccaucuugc

SEQ ID NO: 106913 - RNA, 20 nt, Artificial Sequence
  MKO10106913_B_Park2
  gRNA
acgaugucuuaauuccaaac

SEQ ID NO: 106914 - RNA, 20 nt, Artificial Sequence
  MKO10106914_B_Park7
  gRNA
gauuuguccagauaccaguc

SEQ ID NO: 106915 - RNA, 20 nt, Artificial Sequence
  MKO10106915_B_Park7
  gRNA
ucucuagucgccuaugguga

SEQ ID NO: 106916 - RNA, 20 nt, Artificial Sequence
  MKO10106916_B_Park7
  gRNA
uagaucaaagucacuguugc

SEQ ID NO: 106917 - RNA, 20 nt, Artificial Sequence
  MKO10106917_B_Parl
  gRNA
cacgaguguucuuauaggau

SEQ ID NO: 106918 - RNA, 20 nt, Artificial Sequence
  MKO10106918_B_Parl
  gRNA
cucuccacaagcagaagacg

SEQ ID NO: 106919 - RNA, 20 nt, Artificial Sequence
  MKO10106919_B_Parl
  gRNA
gaaccucgaagaucagacac

SEQ ID NO: 106920 - RNA, 20 nt, Artificial Sequence
  MKO10106920_B_Parm1
  gRNA
cugcuggacgaccaugacua

SEQ ID NO: 106921 - RNA, 20 nt, Artificial Sequence
  MKO10106921_B_Parm1
  gRNA
gcccucugcaucuucaccgc

SEQ ID NO: 106922 - RNA, 20 nt, Artificial Sequence
  MKO10106922_B_Parm1
  gRNA
ccagaguaauauggucugca

SEQ ID NO: 106923 - RNA, 20 nt, Artificial Sequence
  MKO10106923_B_Parn
  gRNA
ugaggaccuacugaaaggcu

SEQ ID NO: 106924 - RNA, 20 nt, Artificial Sequence
  MKO10106924_B_Parn
  gRNA
uaaccuacuuggaaucugug

SEQ ID NO: 106925 - RNA, 20 nt, Artificial Sequence
  MKO10106925_B_Parn
  gRNA
agcuucugauaucucucuuc

SEQ ID NO: 106926 - RNA, 20 nt, Artificial Sequence
  MKO10106926_B_Parp10
  gRNA
ccagacccgagcaguacgug

SEQ ID NO: 106927 - RNA, 20 nt, Artificial Sequence
  MKO10106927_B_Parp10
  gRNA
guuauccacgccccuuucug

SEQ ID NO: 106928 - RNA, 20 nt, Artificial Sequence
  MKO10106928_B_Parp10
  gRNA
cacgcugaacaugaagcacc

SEQ ID NO: 106929 - RNA, 20 nt, Artificial Sequence
  MKO10106929_B_Parp11
  gRNA
gaacccugacguucccuacc

SEQ ID NO: 106930 - RNA, 20 nt, Artificial Sequence
  MKO10106930_B_Parp11
  gRNA
agaaaggagcccucuuuauu

SEQ ID NO: 106931 - RNA, 20 nt, Artificial Sequence
  MKO10106931_B_Parp11
  gRNA
gucuaucuuguagcugaauu

SEQ ID NO: 106932 - RNA, 20 nt, Artificial Sequence
  MKO10106932_B_Parp12
  gRNA
ggaguuuaaugcacugcuuu

SEQ ID NO: 106933 - RNA, 20 nt, Artificial Sequence
  MKO10106933_B_Parp12
  gRNA
gucaccaggcacuccuagcc

SEQ ID NO: 106934 - RNA, 20 nt, Artificial Sequence
  MKO10106934_B_Parp12
  gRNA
cuucucuuaccugucuuuac

SEQ ID NO: 106935 - RNA, 20 nt, Artificial Sequence
  MKO10106935_B_Parp14
  gRNA
accagugccgaacucucuuc

SEQ ID NO: 106936 - RNA, 20 nt, Artificial Sequence
  MKO10106936_B_Parp14
  gRNA
gccugagaaaguauccgaga

SEQ ID NO: 106937 - RNA, 20 nt, Artificial Sequence
  MKO10106937_B_Parp14
  gRNA
ugaggcuuccucagggucug

SEQ ID NO: 106938 - RNA, 20 nt, Artificial Sequence
  MKO10106938_B_Parp16
  gRNA
cacacacagcuacgcagcuc

SEQ ID NO: 106939 - RNA, 20 nt, Artificial Sequence
  MKO10106939_B_Parp16
  gRNA
uccuuucagcuugcggacac

SEQ ID NO: 106940 - RNA, 20 nt, Artificial Sequence
  MKO10106940_B_Parp16
  gRNA
cuguagaaguuccuucaagu

SEQ ID NO: 106941 - RNA, 20 nt, Artificial Sequence
  MKO10106941_B_Parp1
  gRNA
ccuuagucacccauguucga

SEQ ID NO: 106942 - RNA, 20 nt, Artificial Sequence
  MKO10106942_B_Parp1
  gRNA
ugggacuuucccaucgaaca

SEQ ID NO: 106943 - RNA, 20 nt, Artificial Sequence
  MKO10106943_B_Parp1
  gRNA
cggucaaucauacccagcug

SEQ ID NO: 106944 - RNA, 20 nt, Artificial Sequence
  MKO10106944_B_Parp2
  gRNA
caggcucauguguauuguga

SEQ ID NO: 106945 - RNA, 20 nt, Artificial Sequence
  MKO10106945_B_Parp2
  gRNA
cugcacacucuggguccaca

SEQ ID NO: 106946 - RNA, 20 nt, Artificial Sequence
  MKO10106946_B_Parp2
  gRNA
ugugaagaccuugcuguuaa

SEQ ID NO: 106947 - RNA, 20 nt, Artificial Sequence
  MKO10106947_B_Parp3
  gRNA
caacuccccugaugugcuuc

SEQ ID NO: 106948 - RNA, 20 nt, Artificial Sequence
  MKO10106948_B_Parp3
  gRNA
agguguacagcggcccugug

SEQ ID NO: 106949 - RNA, 20 nt, Artificial Sequence
  MKO10106949_B_Parp3
  gRNA
gaugaaccacuucaccugcc

SEQ ID NO: 106950 - RNA, 20 nt, Artificial Sequence
  MKO10106950_B_Parp4
  gRNA
uucucugggguguugucuga

SEQ ID NO: 106951 - RNA, 20 nt, Artificial Sequence
  MKO10106951_B_Parp4
  gRNA
uucagacaacaccccagaga

SEQ ID NO: 106952 - RNA, 20 nt, Artificial Sequence
  MKO10106952_B_Parp4
  gRNA
cagcucuaccaccacagucu

SEQ ID NO: 106953 - RNA, 20 nt, Artificial Sequence
  MKO10106953_B_Parp6
  gRNA
gaacagaaccuauuguguug

SEQ ID NO: 106954 - RNA, 20 nt, Artificial Sequence
  MKO10106954_B_Parp6
  gRNA
ggagucccaccugauggaca

SEQ ID NO: 106955 - RNA, 20 nt, Artificial Sequence
  MKO10106955_B_Parp6
  gRNA
aggacaucaaaggccaguuc

SEQ ID NO: 106956 - RNA, 20 nt, Artificial Sequence
  MKO10106956_B_Parp8
  gRNA
uguuaccuguugcuauucua

SEQ ID NO: 106957 - RNA, 20 nt, Artificial Sequence
  MKO10106957_B_Parp8
  gRNA
cuggguagucuucugagacg

SEQ ID NO: 106958 - RNA, 20 nt, Artificial Sequence
  MKO10106958_B_Parp8
  gRNA
ugcaaacaggcagucuuucu

SEQ ID NO: 106959 - RNA, 20 nt, Artificial Sequence
  MKO10106959_B_Parp9
  gRNA
cagucgauucuuagacaagc

SEQ ID NO: 106960 - RNA, 20 nt, Artificial Sequence
  MKO10106960_B_Parp9
  gRNA
aucaauccugucccgagagc

SEQ ID NO: 106961 - RNA, 20 nt, Artificial Sequence
  MKO10106961_B_Parp9
  gRNA
uuguacgucuccacaucuac

SEQ ID NO: 106962 - RNA, 20 nt, Artificial Sequence
  MKO10106962_B_Parpbp
  gRNA
caauguccugauaaaugacg

SEQ ID NO: 106963 - RNA, 20 nt, Artificial Sequence
  MKO10106963_B_Parpbp
  gRNA
uucuguacagguacggguau

SEQ ID NO: 106964 - RNA, 20 nt, Artificial Sequence
  MKO10106964_B_Parpbp
  gRNA
augcagccagaaugacgagc

SEQ ID NO: 106965 - RNA, 20 nt, Artificial Sequence
  MKO10106965_B_Pars2
  gRNA
gcuccccuuguuguuguacc

SEQ ID NO: 106966 - RNA, 20 nt, Artificial Sequence
  MKO10106966_B_Pars2
  gRNA
ugcccaggaaaccuacggcc

SEQ ID NO: 106967 - RNA, 20 nt, Artificial Sequence
  MKO10106967_B_Pars2
  gRNA
uuccguagagagaacuucga

SEQ ID NO: 106968 - RNA, 20 nt, Artificial Sequence
  MKO10106968_B_Parva
  gRNA
ucuuucaguauccgaguucc

SEQ ID NO: 106969 - RNA, 20 nt, Artificial Sequence
  MKO10106969_B_Parva
  gRNA
cucgcugaagaucucuauga

SEQ ID NO: 106970 - RNA, 20 nt, Artificial Sequence
  MKO10106970_B_Parva
  gRNA
uagccccaucuccuucgagc

SEQ ID NO: 106971 - RNA, 20 nt, Artificial Sequence
  MKO10106971_B_Parvb
  gRNA
ggaggaccuguacgauggcc

SEQ ID NO: 106972 - RNA, 20 nt, Artificial Sequence
  MKO10106972_B_Parvb
  gRNA
ugccccagguacuucuggac

SEQ ID NO: 106973 - RNA, 20 nt, Artificial Sequence
  MKO10106973_B_Parvb
  gRNA
cucaacagugacugacuuac

SEQ ID NO: 106974 - RNA, 20 nt, Artificial Sequence
  MKO10106974_B_Parvg
  gRNA
ggccgucaaccagaaccuac

SEQ ID NO: 106975 - RNA, 20 nt, Artificial Sequence
  MKO10106975_B_Parvg
  gRNA
ccuccuuugggagcugcaac

SEQ ID NO: 106976 - RNA, 20 nt, Artificial Sequence
  MKO10106976_B_Parvg
  gRNA
ucguggaagcucuuccuccg

SEQ ID NO: 106977 - RNA, 20 nt, Artificial Sequence
  MKO10106977_B_Pask
  gRNA
ccuccacauguuccucgcug

SEQ ID NO: 106978 - RNA, 20 nt, Artificial Sequence
  MKO10106978_B_Pask
  gRNA
ugccgaacaccacugcagcg

SEQ ID NO: 106979 - RNA, 20 nt, Artificial Sequence
  MKO10106979_B_Pask
  gRNA
cuugugcuguguagugguuc

SEQ ID NO: 106980 - RNA, 20 nt, Artificial Sequence
  MKO10106980_B_Paue2
  gRNA
gucauguaugaccaacugug

SEQ ID NO: 106981 - RNA, 20 nt, Artificial Sequence
  MKO10106981_B_Paue2
  gRNA
ucugucuguucugccaauau

SEQ ID NO: 106982 - RNA, 20 nt, Artificial Sequence
  MKO10106982_B_Paue2
  gRNA
ggguugcaggauguuugugc

SEQ ID NO: 106983 - RNA, 20 nt, Artificial Sequence
  MKO10106983_B_Paue4
  gRNA
acccuccacaaaacagagaa

SEQ ID NO: 106984 - RNA, 20 nt, Artificial Sequence
  MKO10106984_B_Paue4
  gRNA
cuuaccaacaaagugugaua

SEQ ID NO: 106985 - RNA, 20 nt, Artificial Sequence
  MKO10106985_B_Paul1
  gRNA
accaacugcaccugacccaa

SEQ ID NO: 106986 - RNA, 20 nt, Artificial Sequence
  MKO10106986_B_Paul1
  gRNA
uuuaauaccugagcaaguag

SEQ ID NO: 106987 - RNA, 20 nt, Artificial Sequence
  MKO10106987_B_Paul1
  gRNA
uagaagauccagcuaucaug

SEQ ID NO: 106988 - RNA, 20 nt, Artificial Sequence
  MKO10106988_B_Paul2
  gRNA
ucccuaccugcugugguacu

SEQ ID NO: 106989 - RNA, 20 nt, Artificial Sequence
  MKO10106989_B_Paul2
  gRNA
ggaggcggaguccaacagca

SEQ ID NO: 106990 - RNA, 20 nt, Artificial Sequence
  MKO10106990_B_Paul2
  gRNA
ucaccugccacauaaaaugc

SEQ ID NO: 106991 - RNA, 20 nt, Artificial Sequence
  MKO10106991_B_Pauz1
  gRNA
guacuugcgggccgcauaca

SEQ ID NO: 106992 - RNA, 20 nt, Artificial Sequence
  MKO10106992_B_Pauz1
  gRNA
ugagcgaccucacaaguguc

SEQ ID NO: 106993 - RNA, 20 nt, Artificial Sequence
  MKO10106993_B_Pauz1
  gRNA
uccaggccagaucacuugaa

SEQ ID NO: 106994 - RNA, 20 nt, Artificial Sequence
  MKO10106994_B_Pawr
  gRNA
cuacuugaggagaaacuagc

SEQ ID NO: 106995 - RNA, 20 nt, Artificial Sequence
  MKO10106995_B_Pawr
  gRNA
ggagggucgcagcuucauuc

SEQ ID NO: 106996 - RNA, 20 nt, Artificial Sequence
  MKO10106996_B_Pawr
  gRNA
gcaucagccucacaagucga

SEQ ID NO: 106997 - RNA, 20 nt, Artificial Sequence
  MKO10106997_B_Pax1
  gRNA
uaagcuaccgagugcauccg

SEQ ID NO: 106998 - RNA, 20 nt, Artificial Sequence
  MKO10106998_B_Pax1
  gRNA
accuaucucccggcccgccc

SEQ ID NO: 106999 - RNA, 20 nt, Artificial Sequence
  MKO10106999_B_Pax1
  gRNA
cugggcgggugugaaccgug

SEQ ID NO: 107000 - RNA, 20 nt, Artificial Sequence
  MKO10107000_B_Pax2
  gRNA
ggccccuacccgacguggug

SEQ ID NO: 107001 - RNA, 20 nt, Artificial Sequence
  MKO10107001_B_Pax2
  gRNA
gcagccuuuccacccaacgc

SEQ ID NO: 107002 - RNA, 20 nt, Artificial Sequence
  MKO10107002_B_Pax2
  gRNA
ucacaaacacccccccgagc

SEQ ID NO: 107003 - RNA, 20 nt, Artificial Sequence
  MKO10107003_B_Pax3
  gRNA
uccagcgggaagccgcugcg

SEQ ID NO: 107004 - RNA, 20 nt, Artificial Sequence
  MKO10107004_B_Pax3
  gRNA
gcaggugacaacgccugacg

SEQ ID NO: 107005 - RNA, 20 nt, Artificial Sequence
  MKO10107005_B_Pax3
  gRNA
gaucggaacacugugcccuc

SEQ ID NO: 107006 - RNA, 20 nt, Artificial Sequence
  MKO10107006_B_Pax4
  gRNA
ccucuaucaaucgaguacuu

SEQ ID NO: 107007 - RNA, 20 nt, Artificial Sequence
  MKO10107007_B_Pax4
  gRNA
gaauggccggccccuuccuc

SEQ ID NO: 107008 - RNA, 20 nt, Artificial Sequence
  MKO10107008_B_Pax4
  gRNA
uagcugcacaaucugcugcc

SEQ ID NO: 107009 - RNA, 20 nt, Artificial Sequence
  MKO10107009_B_Pax5
  gRNA
aagcugggaccggcugauug

SEQ ID NO: 107010 - RNA, 20 nt, Artificial Sequence
  MKO10107010_B_Pax5
  gRNA
uuggauccuccaaucacccc

SEQ ID NO: 107011 - RNA, 20 nt, Artificial Sequence
  MKO10107011_B_Pax5
  gRNA
gggcaaguuccacuauccuu

SEQ ID NO: 107012 - RNA, 20 nt, Artificial Sequence
  MKO10107012_B_Pax6
  gRNA
uaucccgggacuucaguacc

SEQ ID NO: 107013 - RNA, 20 nt, Artificial Sequence
  MKO10107013_B_Pax6
  gRNA
cuagcucuacgaucuucugc

SEQ ID NO: 107014 - RNA, 20 nt, Artificial Sequence
  MKO10107014_B_Pax6
  gRNA
cgacauuucccgaauucugc

SEQ ID NO: 107015 - RNA, 20 nt, Artificial Sequence
  MKO10107015_B_Pax7
  gRNA
caagauucugugccgauauc

SEQ ID NO: 107016 - RNA, 20 nt, Artificial Sequence
  MKO10107016_B_Pax7
  gRNA
cggucacugcgaccgaagca

SEQ ID NO: 107017 - RNA, 20 nt, Artificial Sequence
  MKO10107017_B_Pax7
  gRNA
caaggccgggucaaucagcu

SEQ ID NO: 107018 - RNA, 20 nt, Artificial Sequence
  MKO10107018_B_Pax8
  gRNA
uagagcccaaggaauccgac

SEQ ID NO: 107019 - RNA, 20 nt, Artificial Sequence
  MKO10107019_B_Pax8
  gRNA
uuggagcccccuaucacucc

SEQ ID NO: 107020 - RNA, 20 nt, Artificial Sequence
  MKO10107020_B_Pax8
  gRNA
uggaguagguacuacgagac

SEQ ID NO: 107021 - RNA, 20 nt, Artificial Sequence
  MKO10107021_B_Pax9
  gRNA
cugugacauucccgcaucgc

SEQ ID NO: 107022 - RNA, 20 nt, Artificial Sequence
  MKO10107022_B_Pax9
  gRNA
uccaauccauucacugcgug

SEQ ID NO: 107023 - RNA, 20 nt, Artificial Sequence
  MKO10107023_B_Pax9
  gRNA
ucccuugaaagccagcgaug

SEQ ID NO: 107024 - RNA, 20 nt, Artificial Sequence
  MKO10107024_B_Paxbp1
  gRNA
caccugggcggagcacguuc

SEQ ID NO: 107025 - RNA, 20 nt, Artificial Sequence
  MKO10107025_B_Paxbp1
  gRNA
agcauuggagaaggcgcccc

SEQ ID NO: 107026 - RNA, 20 nt, Artificial Sequence
  MKO10107026_B_Paxbp1
  gRNA
aagacgaggagcucagccgc

SEQ ID NO: 107027 - RNA, 20 nt, Artificial Sequence
  MKO10107027_B_Paxip1
  gRNA
ggcauuguaggagacuuccu

SEQ ID NO: 107028 - RNA, 20 nt, Artificial Sequence
  MKO10107028_B_Paxip1
  gRNA
caggagagcgccacauugca

SEQ ID NO: 107029 - RNA, 20 nt, Artificial Sequence
  MKO10107029_B_Paxip1
  gRNA
agaggugggagaagcccgug

SEQ ID NO: 107030 - RNA, 20 nt, Artificial Sequence
  MKO10107030_B_Pbdc1
  gRNA
acugcgacuggauuguuccc

SEQ ID NO: 107031 - RNA, 20 nt, Artificial Sequence
  MKO10107031_B_Pbdc1
  gRNA
uuuacagccugauauugaaa

SEQ ID NO: 107032 - RNA, 20 nt, Artificial Sequence
  MKO10107032_B_Pbdc1
  gRNA
guagauuuggucaucuacuu

SEQ ID NO: 107033 - RNA, 20 nt, Artificial Sequence
  MKO10107033_B_Pbk
  gRNA
cacaguuaccuuuagcccuc

SEQ ID NO: 107034 - RNA, 20 nt, Artificial Sequence
  MKO10107034_B_Pbk
  gRNA
caccuccauacuccauagca

SEQ ID NO: 107035 - RNA, 20 nt, Artificial Sequence
  MKO10107035_B_Pbk
  gRNA
ucuucaaauguuguaauuaa

SEQ ID NO: 107036 - RNA, 20 nt, Artificial Sequence
  MKO10107036_B_Pbld1
  gRNA
gugagugaaguccccuugug

SEQ ID NO: 107037 - RNA, 20 nt, Artificial Sequence
  MKO10107037_B_Pbld1
  gRNA
gagcuaaccuggggaaaggu

SEQ ID NO: 107038 - RNA, 20 nt, Artificial Sequence
  MKO10107038_B_Pbld1
  gRNA
ugucuacccaaccuuucccc

SEQ ID NO: 107039 - RNA, 20 nt, Artificial Sequence
  MKO10107039_B_Pbld2
  gRNA
uugcaguuugcggacaaaag

SEQ ID NO: 107040 - RNA, 20 nt, Artificial Sequence
  MKO10107040_B_Pbld2
  gRNA
gagcuaaccugggggaaggu

SEQ ID NO: 107041 - RNA, 20 nt, Artificial Sequence
  MKO10107041_B_Pbld2
  gRNA
ugucuacccaaccuuccccc

SEQ ID NO: 107042 - RNA, 20 nt, Artificial Sequence
  MKO10107042_B_Pbp2
  gRNA
guaggaagaaacccguguac

SEQ ID NO: 107043 - RNA, 20 nt, Artificial Sequence
  MKO10107043_B_Pbp2
  gRNA
acgaacccauccucaccaac

SEQ ID NO: 107044 - RNA, 20 nt, Artificial Sequence
  MKO10107044_B_Pbp2
  gRNA
guacacggguuucuuccuac

SEQ ID NO: 107045 - RNA, 20 nt, Artificial Sequence
  MKO10107045_B_Pbrm1
  gRNA
uaacaccauccgagacuaua

SEQ ID NO: 107046 - RNA, 20 nt, Artificial Sequence
  MKO10107046_B_Pbrm1
  gRNA
uuacaagcagcuuuauacuc

SEQ ID NO: 107047 - RNA, 20 nt, Artificial Sequence
  MKO10107047_B_Pbrm1
  gRNA
ucaaccagacuauuaugaag

SEQ ID NO: 107048 - RNA, 20 nt, Artificial Sequence
  MKO10107048_B_Pbsn
  gRNA
uuacuuagcugccaguacca

SEQ ID NO: 107049 - RNA, 20 nt, Artificial Sequence
  MKO10107049_B_Pbsn
  gRNA
ugccaacuguauaaagucau

SEQ ID NO: 107050 - RNA, 20 nt, Artificial Sequence
  MKO10107050_B_Pbsn
  gRNA
uuccuaugacuuuauacagu

SEQ ID NO: 107051 - RNA, 20 nt, Artificial Sequence
  MKO10107051_B_Pbx1
  gRNA
guaggacucaccucgcaucc

SEQ ID NO: 107052 - RNA, 20 nt, Artificial Sequence
  MKO10107052_B_Pbx1
  gRNA
augcauucccacgcuggggu

SEQ ID NO: 107053 - RNA, 20 nt, Artificial Sequence
  MKO10107053_B_Pbx1
  gRNA
uguuguccagucgcaugagc

SEQ ID NO: 107054 - RNA, 20 nt, Artificial Sequence
  MKO10107054_B_Pbx2
  gRNA
cucacgucaugaaccugcug

SEQ ID NO: 107055 - RNA, 20 nt, Artificial Sequence
  MKO10107055_B_Pbx2
  gRNA
gggaguagaaauacucauuc

SEQ ID NO: 107056 - RNA, 20 nt, Artificial Sequence
  MKO10107056_B_Pbx2
  gRNA
uucucugcagacggaaacgc

SEQ ID NO: 107057 - RNA, 20 nt, Artificial Sequence
  MKO10107057_B_Pbx3
  gRNA
cgacccccagcuaaugagac

SEQ ID NO: 107058 - RNA, 20 nt, Artificial Sequence
  MKO10107058_B_Pbx3
  gRNA
uuuccccgaaagagaucgaa

SEQ ID NO: 107059 - RNA, 20 nt, Artificial Sequence
  MKO10107059_B_Pbx3
  gRNA
gacgcguucuacucuguucu

SEQ ID NO: 107060 - RNA, 20 nt, Artificial Sequence
  MKO10107060_B_Pbx4
  gRNA
gcauugagcacucagacuac

SEQ ID NO: 107061 - RNA, 20 nt, Artificial Sequence
  MKO10107061_B_Pbx4
  gRNA
agagagcagacuucauccga

SEQ ID NO: 107062 - RNA, 20 nt, Artificial Sequence
  MKO10107062_B_Pbx4
  gRNA
auauucauucagcacgucug

SEQ ID NO: 107063 - RNA, 20 nt, Artificial Sequence
  MKO10107063_B_Pbxip1
  gRNA
ggccuccgucccaugaccau

SEQ ID NO: 107064 - RNA, 20 nt, Artificial Sequence
  MKO10107064_B_Pbxip1
  gRNA
cgggacuccuccaaggcaga

SEQ ID NO: 107065 - RNA, 20 nt, Artificial Sequence
  MKO10107065_B_Pbxip1
  gRNA
agaaucugagggagccuccc

SEQ ID NO: 107066 - RNA, 20 nt, Artificial Sequence
  MKO10107066_B_Pcbd1
  gRNA
guuguacacguuaaaccacu

SEQ ID NO: 107067 - RNA, 20 nt, Artificial Sequence
  MKO10107067_B_Pcbd1
  gRNA
ccuaggccggcaaggcacac

SEQ ID NO: 107068 - RNA, 20 nt, Artificial Sequence
  MKO10107068_B_Pcbd1
  gRNA
gcucagccugugugccuugc

SEQ ID NO: 107069 - RNA, 20 nt, Artificial Sequence
  MKO10107069_B_Pcbd2
  gRNA
cgccacagucaugcgaggug

SEQ ID NO: 107070 - RNA, 20 nt, Artificial Sequence
  MKO10107070_B_Pcbd2
  gRNA
ggcggugggagcgcguagcg

SEQ ID NO: 107071 - RNA, 20 nt, Artificial Sequence
  MKO10107071_B_Pcbd2
  gRNA
gagagggaccaacuuauucc

SEQ ID NO: 107072 - RNA, 20 nt, Artificial Sequence
  MKO10107072_B_Pcbp1
  gRNA
ggcgauagugauagcccgcu

SEQ ID NO: 107073 - RNA, 20 nt, Artificial Sequence
  MKO10107073_B_Pcbp1
  gRNA
cuagacgccuacucgauuca

SEQ ID NO: 107074 - RNA, 20 nt, Artificial Sequence
  MKO10107074_B_Pcbp1
  gRNA
cggcgcgcggaucaacaucu

SEQ ID NO: 107075 - RNA, 20 nt, Artificial Sequence
  MKO10107075_B_Pcbp2
  gRNA
caggaaguuggcaguaucau

SEQ ID NO: 107076 - RNA, 20 nt, Artificial Sequence
  MKO10107076_B_Pcbp2
  gRNA
uaauccaccuucaaucacac

SEQ ID NO: 107077 - RNA, 20 nt, Artificial Sequence
  MKO10107077_B_Pcbp2
  gRNA
auggacaccggugugauuga

SEQ ID NO: 107078 - RNA, 20 nt, Artificial Sequence
  MKO10107078_B_Pcbp3
  gRNA
ggauggucaggguuacguuc

SEQ ID NO: 107079 - RNA, 20 nt, Artificial Sequence
  MKO10107079_B_Pcbp3
  gRNA
aguaaagaagaugcgugaag

SEQ ID NO: 107080 - RNA, 20 nt, Artificial Sequence
  MKO10107080_B_Pcbp3
  gRNA
caggaaguuggaagcaucau

SEQ ID NO: 107081 - RNA, 20 nt, Artificial Sequence
  MKO10107081_B_Pcbp4
  gRNA
ucccaaucagugauccacac

SEQ ID NO: 107082 - RNA, 20 nt, Artificial Sequence
  MKO10107082_B_Pcbp4
  gRNA
cuuugugcugcuccugcaaa

SEQ ID NO: 107083 - RNA, 20 nt, Artificial Sequence
  MKO10107083_B_Pcbp4
  gRNA
caggaagugggcagcaucau

SEQ ID NO: 107084 - RNA, 20 nt, Artificial Sequence
  MKO10107084_B_Pcca
  gRNA
ucuuuagguucacgugaaaa

SEQ ID NO: 107085 - RNA, 20 nt, Artificial Sequence
  MKO10107085_B_Pcca
  gRNA
ggcaucaacaucacugugaa

SEQ ID NO: 107086 - RNA, 20 nt, Artificial Sequence
  MKO10107086_B_Pcca
  gRNA
aaaauucucauugcuaacag

SEQ ID NO: 107087 - RNA, 20 nt, Artificial Sequence
  MKO10107087_B_Pccb
  gRNA
cauggagagcgacauguuug

SEQ ID NO: 107088 - RNA, 20 nt, Artificial Sequence
  MKO10107088_B_Pccb
  gRNA
gauguccgcguagccagcca

SEQ ID NO: 107089 - RNA, 20 nt, Artificial Sequence
  MKO10107089_B_Pccb
  gRNA
auaguuucccggagauagug

SEQ ID NO: 107090 - RNA, 20 nt, Artificial Sequence
  MKO10107090_B_Pcdh10
  gRNA
ugggccacucugaccgaugc

SEQ ID NO: 107091 - RNA, 20 nt, Artificial Sequence
  MKO10107091_B_Pcdh10
  gRNA
gcccagugcuuuacauuccu

SEQ ID NO: 107092 - RNA, 20 nt, Artificial Sequence
  MKO10107092_B_Pcdh10
  gRNA
gauagcugagcucugcucgc

SEQ ID NO: 107093 - RNA, 20 nt, Artificial Sequence
  MKO10107093_B_Pcdh11x
  gRNA
cuuucaacaagucgccuauc

SEQ ID NO: 107094 - RNA, 20 nt, Artificial Sequence
  MKO10107094_B_Pcdh11x
  gRNA
aaacagucucuuagcgaugu

SEQ ID NO: 107095 - RNA, 20 nt, Artificial Sequence
  MKO10107095_B_Pcdh11x
  gRNA
cuggacucauccacauccac

SEQ ID NO: 107096 - RNA, 20 nt, Artificial Sequence
  MKO10107096_B_Pcdh12
  gRNA
auagcuucucccgauccagc

SEQ ID NO: 107097 - RNA, 20 nt, Artificial Sequence
  MKO10107097_B_Pcdh12
  gRNA
uaccuguauuaggguccaac

SEQ ID NO: 107098 - RNA, 20 nt, Artificial Sequence
  MKO10107098_B_Pcdh12
  gRNA
ggcucgggggcccuucuucc

SEQ ID NO: 107099 - RNA, 20 nt, Artificial Sequence
  MKO10107099_B_Pcdh15
  gRNA
agcuggggccaguaugacga

SEQ ID NO: 107100 - RNA, 20 nt, Artificial Sequence
  MKO10107100_B_Pcdh15
  gRNA
uggacuuaccaucgucauac

SEQ ID NO: 107101 - RNA, 20 nt, Artificial Sequence
  MKO10107101_B_Pcdh15
  gRNA
auugaugaagagagucgaaa

SEQ ID NO: 107102 - RNA, 20 nt, Artificial Sequence
  MKO10107102_B_Pcdh17
  gRNA
cgucacucaccuuguucgag

SEQ ID NO: 107103 - RNA, 20 nt, Artificial Sequence
  MKO10107103_B_Pcdh17
  gRNA
gcacggggacagcgaucagg

SEQ ID NO: 107104 - RNA, 20 nt, Artificial Sequence
  MKO10107104_B_Pcdh17
  gRNA
cucucggcccagaucccugu

SEQ ID NO: 107105 - RNA, 20 nt, Artificial Sequence
  MKO10107105_B_Pcdh18
  gRNA
gaaugacgggucucgagaau

SEQ ID NO: 107106 - RNA, 20 nt, Artificial Sequence
  MKO10107106_B_Pcdh18
  gRNA
gugcuuaaccaucucagcga

SEQ ID NO: 107107 - RNA, 20 nt, Artificial Sequence
  MKO10107107_B_Pcdh18
  gRNA
cuggaauucucccguccgug

SEQ ID NO: 107108 - RNA, 20 nt, Artificial Sequence
  MKO10107108_B_Pcdh19
  gRNA
acaccauugaugaucagguc

SEQ ID NO: 107109 - RNA, 20 nt, Artificial Sequence
  MKO10107109_B_Pcdh19
  gRNA
augacauccgccuuguaccu

SEQ ID NO: 107110 - RNA, 20 nt, Artificial Sequence
  MKO10107110_B_Pcdh19
  gRNA
ucacagcaguaucgcaguac

SEQ ID NO: 107111 - RNA, 20 nt, Artificial Sequence
  MKO10107111_B_Pcdh1
  gRNA
cgccauuggggccggcguca

SEQ ID NO: 107112 - RNA, 20 nt, Artificial Sequence
  MKO10107112_B_Pcdh1
  gRNA
gccccgaccaucgagauccg

SEQ ID NO: 107113 - RNA, 20 nt, Artificial Sequence
  MKO10107113_B_Pcdh1
  gRNA
cguggcaagcccccucgcua

SEQ ID NO: 107114 - RNA, 20 nt, Artificial Sequence
  MKO10107114_B_Pcdh20
  gRNA
ucccagggaaugcgcggccg

SEQ ID NO: 107115 - RNA, 20 nt, Artificial Sequence
  MKO10107115_B_Pcdh20
  gRNA
gcaagcugcgcgcguucccu

SEQ ID NO: 107116 - RNA, 20 nt, Artificial Sequence
  MKO10107116_B_Pcdh20
  gRNA
cugcccgccggagugcucau

SEQ ID NO: 107117 - RNA, 20 nt, Artificial Sequence
  MKO10107117_B_Pcdh7
  gRNA
gaaaacgucacucuacgaaa

SEQ ID NO: 107118 - RNA, 20 nt, Artificial Sequence
  MKO10107118_B_Pcdh7
  gRNA
cagccaaacaccguaaugua

SEQ ID NO: 107119 - RNA, 20 nt, Artificial Sequence
  MKO10107119_B_Pcdh7
  gRNA
caacuaugagaggaccacgc

SEQ ID NO: 107120 - RNA, 20 nt, Artificial Sequence
  MKO10107120_B_Pcdh8
  gRNA
cagauacguguccccgaaga

SEQ ID NO: 107121 - RNA, 20 nt, Artificial Sequence
  MKO10107121_B_Pcdh8
  gRNA
cugcgcccccuguugcaguc

SEQ ID NO: 107122 - RNA, 20 nt, Artificial Sequence
  MKO10107122_B_Pcdh8
  gRNA
cagccuuacggugccucucc

SEQ ID NO: 107123 - RNA, 20 nt, Artificial Sequence
  MKO10107123_B_Pcdh9
  gRNA
acaggacgaauucuacgacc

SEQ ID NO: 107124 - RNA, 20 nt, Artificial Sequence
  MKO10107124_B_Pcdh9
  gRNA
ucugggagaccacgagccgg

SEQ ID NO: 107125 - RNA, 20 nt, Artificial Sequence
  MKO10107125_B_Pcdh9
  gRNA
aggcacgauugagaguccua

SEQ ID NO: 107126 - RNA, 20 nt, Artificial Sequence
  MKO10107126_B_Pcdha10
  gRNA
guguccccuccggugggcgc

SEQ ID NO: 107127 - RNA, 20 nt, Artificial Sequence
  MKO10107127_B_Pcdha10
  gRNA
guuagcaggcuccugccgga

SEQ ID NO: 107128 - RNA, 20 nt, Artificial Sequence
  MKO10107128_B_Pcdha10
  gRNA
agaguagcgccagucagggu

SEQ ID NO: 107129 - RNA, 20 nt, Artificial Sequence
  MKO10107129_B_Pcdha11
  gRNA
guguccccuccggugggcgc

SEQ ID NO: 107130 - RNA, 20 nt, Artificial Sequence
  MKO10107130_B_Pcdha11
  gRNA
guuagcaggcuccugccgga

SEQ ID NO: 107131 - RNA, 20 nt, Artificial Sequence
  MKO10107131_B_Pcdha11
  gRNA
agaguagcgccagucagggu

SEQ ID NO: 107132 - RNA, 20 nt, Artificial Sequence
  MKO10107132_B_Pcdha12
  gRNA
guguccccuccggugggcgc

SEQ ID NO: 107133 - RNA, 20 nt, Artificial Sequence
  MKO10107133_B_Pcdha12
  gRNA
guuagcaggcuccugccgga

SEQ ID NO: 107134 - RNA, 20 nt, Artificial Sequence
  MKO10107134_B_Pcdha12
  gRNA
agaguagcgccagucagggu

SEQ ID NO: 107135 - RNA, 20 nt, Artificial Sequence
  MKO10107135_B_Pcdha1
  gRNA
guguccccuccggugggcgc

SEQ ID NO: 107136 - RNA, 20 nt, Artificial Sequence
  MKO10107136_B_Pcdha1
  gRNA
guuagcaggcuccugccgga

SEQ ID NO: 107137 - RNA, 20 nt, Artificial Sequence
  MKO10107137_B_Pcdha1
  gRNA
agaguagcgccagucagggu

SEQ ID NO: 107138 - RNA, 20 nt, Artificial Sequence
  MKO10107138_B_Pcdha2
  gRNA
guguccccuccggugggcgc

SEQ ID NO: 107139 - RNA, 20 nt, Artificial Sequence
  MKO10107139_B_Pcdha2
  gRNA
guuagcaggcuccugccgga

SEQ ID NO: 107140 - RNA, 20 nt, Artificial Sequence
  MKO10107140_B_Pcdha2
  gRNA
agaguagcgccagucagggu

SEQ ID NO: 107141 - RNA, 20 nt, Artificial Sequence
  MKO10107141_B_Pcdha3
  gRNA
uccuuucucccccgccgcaa

SEQ ID NO: 107142 - RNA, 20 nt, Artificial Sequence
  MKO10107142_B_Pcdha3
  gRNA
gaggcuggcauucuacgggc

SEQ ID NO: 107143 - RNA, 20 nt, Artificial Sequence
  MKO10107143_B_Pcdha3
  gRNA
agaguagcgccagucagggu

SEQ ID NO: 107144 - RNA, 20 nt, Artificial Sequence
  MKO10107144_B_Pcdha4-g
  gRNA
cgccagaacguguacauccc

SEQ ID NO: 107145 - RNA, 20 nt, Artificial Sequence
  MKO10107145_B_Pcdha4-g
  gRNA
agucaccuacccgcucgugc

SEQ ID NO: 107146 - RNA, 20 nt, Artificial Sequence
  MKO10107146_B_Pcdha4-g
  gRNA
gcagcaucucuguaucaaac

SEQ ID NO: 107147 - RNA, 20 nt, Artificial Sequence
  MKO10107147_B_Pcdha4
  gRNA
guguccccuccggugggcgc

SEQ ID NO: 107148 - RNA, 20 nt, Artificial Sequence
  MKO10107148_B_Pcdha4
  gRNA
guuagcaggcuccugccgga

SEQ ID NO: 107149 - RNA, 20 nt, Artificial Sequence
  MKO10107149_B_Pcdha4
  gRNA
agaguagcgccagucagggu

SEQ ID NO: 107150 - RNA, 20 nt, Artificial Sequence
  MKO10107150_B_Pcdha5
  gRNA
uccuuucucccccgccgcaa

SEQ ID NO: 107151 - RNA, 20 nt, Artificial Sequence
  MKO10107151_B_Pcdha5
  gRNA
gaggcuggcauucuacgggc

SEQ ID NO: 107152 - RNA, 20 nt, Artificial Sequence
  MKO10107152_B_Pcdha5
  gRNA
agaguagcgccagucagggu

SEQ ID NO: 107153 - RNA, 20 nt, Artificial Sequence
  MKO10107153_B_Pcdha6
  gRNA
uccuuucucccccgccgcaa

SEQ ID NO: 107154 - RNA, 20 nt, Artificial Sequence
  MKO10107154_B_Pcdha6
  gRNA
gaggcuggcauucuacgggc

SEQ ID NO: 107155 - RNA, 20 nt, Artificial Sequence
  MKO10107155_B_Pcdha6
  gRNA
agaguagcgccagucagggu

SEQ ID NO: 107156 - RNA, 20 nt, Artificial Sequence
  MKO10107156_B_Pcdha7
  gRNA
gaggcuggcauucuacgggc

SEQ ID NO: 107157 - RNA, 20 nt, Artificial Sequence
  MKO10107157_B_Pcdha7
  gRNA
cgacaaugcaccuacccugc

SEQ ID NO: 107158 - RNA, 20 nt, Artificial Sequence
  MKO10107158_B_Pcdha7
  gRNA
agaguagcgccagucagggu

SEQ ID NO: 107159 - RNA, 20 nt, Artificial Sequence
  MKO10107159_B_Pcdha8
  gRNA
uccuuucucccccgccgcaa

SEQ ID NO: 107160 - RNA, 20 nt, Artificial Sequence
  MKO10107160_B_Pcdha8
  gRNA
gaggcuggcauucuacgggc

SEQ ID NO: 107161 - RNA, 20 nt, Artificial Sequence
  MKO10107161_B_Pcdha8
  gRNA
agaguagcgccagucagggu

SEQ ID NO: 107162 - RNA, 20 nt, Artificial Sequence
  MKO10107162_B_Pcdha9
  gRNA
guguccccuccggugggcgc

SEQ ID NO: 107163 - RNA, 20 nt, Artificial Sequence
  MKO10107163_B_Pcdha9
  gRNA
guuagcaggcuccugccgga

SEQ ID NO: 107164 - RNA, 20 nt, Artificial Sequence
  MKO10107164_B_Pcdha9
  gRNA
agaguagcgccagucagggu

SEQ ID NO: 107165 - RNA, 20 nt, Artificial Sequence
  MKO10107165_B_Pcdhac1
  gRNA
guguccccuccggugggcgc

SEQ ID NO: 107166 - RNA, 20 nt, Artificial Sequence
  MKO10107166_B_Pcdhac1
  gRNA
guuagcaggcuccugccgga

SEQ ID NO: 107167 - RNA, 20 nt, Artificial Sequence
  MKO10107167_B_Pcdhac1
  gRNA
agaguagcgccagucagggu

SEQ ID NO: 107168 - RNA, 20 nt, Artificial Sequence
  MKO10107168_B_Pcdhac2
  gRNA
guguccccuccggugggcgc

SEQ ID NO: 107169 - RNA, 20 nt, Artificial Sequence
  MKO10107169_B_Pcdhac2
  gRNA
guuagcaggcuccugccgga

SEQ ID NO: 107170 - RNA, 20 nt, Artificial Sequence
  MKO10107170_B_Pcdhac2
  gRNA
agaguagcgccagucagggu

SEQ ID NO: 107171 - RNA, 20 nt, Artificial Sequence
  MKO10107171_B_Pcdhb10
  gRNA
gaacucuucugcgcccugua

SEQ ID NO: 107172 - RNA, 20 nt, Artificial Sequence
  MKO10107172_B_Pcdhb10
  gRNA
ugacgcucucacgcuguacu

SEQ ID NO: 107173 - RNA, 20 nt, Artificial Sequence
  MKO10107173_B_Pcdhb10
  gRNA
uucagaggaaacguuguccc

SEQ ID NO: 107174 - RNA, 20 nt, Artificial Sequence
  MKO10107174_B_Pcdhb11
  gRNA
aucuccauuaaccccgacaa

SEQ ID NO: 107175 - RNA, 20 nt, Artificial Sequence
  MKO10107175_B_Pcdhb11
  gRNA
ugucacacuucaagugcuac

SEQ ID NO: 107176 - RNA, 20 nt, Artificial Sequence
  MKO10107176_B_Pcdhb11
  gRNA
aauccgucuuagcaaagagc

SEQ ID NO: 107177 - RNA, 20 nt, Artificial Sequence
  MKO10107177_B_Pcdhb12
  gRNA
guggauugcaaccacucgug

SEQ ID NO: 107178 - RNA, 20 nt, Artificial Sequence
  MKO10107178_B_Pcdhb12
  gRNA
gccgccccacgauucacagc

SEQ ID NO: 107179 - RNA, 20 nt, Artificial Sequence
  MKO10107179_B_Pcdhb12
  gRNA
gaagaaggcgucucccuaau

SEQ ID NO: 107180 - RNA, 20 nt, Artificial Sequence
  MKO10107180_B_Pcdhb13
  gRNA
uggugaguucaaauugcgaa

SEQ ID NO: 107181 - RNA, 20 nt, Artificial Sequence
  MKO10107181_B_Pcdhb13
  gRNA
ugcgauugcgagugagcacg

SEQ ID NO: 107182 - RNA, 20 nt, Artificial Sequence
  MKO10107182_B_Pcdhb13
  gRNA
cuguuagcccgccaccaucu

SEQ ID NO: 107183 - RNA, 20 nt, Artificial Sequence
  MKO10107183_B_Pcdhb14
  gRNA
cucacccgcaaucacagcga

SEQ ID NO: 107184 - RNA, 20 nt, Artificial Sequence
  MKO10107184_B_Pcdhb14
  gRNA
ugaagaaaacuucuacacgu

SEQ ID NO: 107185 - RNA, 20 nt, Artificial Sequence
  MKO10107185_B_Pcdhb14
  gRNA
uucgcugauaaguacugaca

SEQ ID NO: 107186 - RNA, 20 nt, Artificial Sequence
  MKO10107186_B_Pcdhb15
  gRNA
uaaagugacugcacgaauug

SEQ ID NO: 107187 - RNA, 20 nt, Artificial Sequence
  MKO10107187_B_Pcdhb15
  gRNA
aacuuauucgauaacuauuc

SEQ ID NO: 107188 - RNA, 20 nt, Artificial Sequence
  MKO10107188_B_Pcdhb15
  gRNA
gcagcgcgauaaaucugaaa

SEQ ID NO: 107189 - RNA, 20 nt, Artificial Sequence
  MKO10107189_B_Pcdhb16
  gRNA
ccgagugagcacucgaaaau

SEQ ID NO: 107190 - RNA, 20 nt, Artificial Sequence
  MKO10107190_B_Pcdhb16
  gRNA
uucuggaaaaugcacgauuc

SEQ ID NO: 107191 - RNA, 20 nt, Artificial Sequence
  MKO10107191_B_Pcdhb16
  gRNA
agcgggcgaaccuccgucug

SEQ ID NO: 107192 - RNA, 20 nt, Artificial Sequence
  MKO10107192_B_Pcdhb17
  gRNA
gagugguuauuccgugccug

SEQ ID NO: 107193 - RNA, 20 nt, Artificial Sequence
  MKO10107193_B_Pcdhb17
  gRNA
uugcagcucaaccuucaauc

SEQ ID NO: 107194 - RNA, 20 nt, Artificial Sequence
  MKO10107194_B_Pcdhb17
  gRNA
gguggcgcuccuccccgguc

SEQ ID NO: 107195 - RNA, 20 nt, Artificial Sequence
  MKO10107195_B_Pcdhb18
  gRNA
accguucauaacagcgauga

SEQ ID NO: 107196 - RNA, 20 nt, Artificial Sequence
  MKO10107196_B_Pcdhb18
  gRNA
auguaaaaauuguccacgga

SEQ ID NO: 107197 - RNA, 20 nt, Artificial Sequence
  MKO10107197_B_Pcdhb18
  gRNA
uguuguucucgcgaacgaac

SEQ ID NO: 107198 - RNA, 20 nt, Artificial Sequence
  MKO10107198_B_Pcdhb19
  gRNA
ugacaacucccccguauucu

SEQ ID NO: 107199 - RNA, 20 nt, Artificial Sequence
  MKO10107199_B_Pcdhb19
  gRNA
uaauaucuaugaccuccacu

SEQ ID NO: 107200 - RNA, 20 nt, Artificial Sequence
  MKO10107200_B_Pcdhb19
  gRNA
uuugcuccuuagugaaccgc

SEQ ID NO: 107201 - RNA, 20 nt, Artificial Sequence
  MKO10107201_B_Pcdhb1
  gRNA
gcacguggucauugacgucc

SEQ ID NO: 107202 - RNA, 20 nt, Artificial Sequence
  MKO10107202_B_Pcdhb1
  gRNA
ucuccuccgccaccgaauag

SEQ ID NO: 107203 - RNA, 20 nt, Artificial Sequence
  MKO10107203_B_Pcdhb1
  gRNA
gacgauugucauugucgucc

SEQ ID NO: 107204 - RNA, 20 nt, Artificial Sequence
  MKO10107204_B_Pcdhb20
  gRNA
uaugcuccugaaugagcgac

SEQ ID NO: 107205 - RNA, 20 nt, Artificial Sequence
  MKO10107205_B_Pcdhb20
  gRNA
cucagcucgauagaacugua

SEQ ID NO: 107206 - RNA, 20 nt, Artificial Sequence
  MKO10107206_B_Pcdhb20
  gRNA
cugagccgguagcagcgagu

SEQ ID NO: 107207 - RNA, 20 nt, Artificial Sequence
  MKO10107207_B_Pcdhb21
  gRNA
aucucugacaaaccguucuc

SEQ ID NO: 107208 - RNA, 20 nt, Artificial Sequence
  MKO10107208_B_Pcdhb21
  gRNA
caaggugucugcgacagauu

SEQ ID NO: 107209 - RNA, 20 nt, Artificial Sequence
  MKO10107209_B_Pcdhb21
  gRNA
uggccggagaaguguccauc

SEQ ID NO: 107210 - RNA, 20 nt, Artificial Sequence
  MKO10107210_B_Pcdhb22
  gRNA
accccgccgcuacuuuguga

SEQ ID NO: 107211 - RNA, 20 nt, Artificial Sequence
  MKO10107211_B_Pcdhb22
  gRNA
caucaccuacucguugcugc

SEQ ID NO: 107212 - RNA, 20 nt, Artificial Sequence
  MKO10107212_B_Pcdhb22
  gRNA
ggugcgcgaccccagucacc

SEQ ID NO: 107213 - RNA, 20 nt, Artificial Sequence
  MKO10107213_B_Pcdhb2
  gRNA
cgugcucaagacuuagaugu

SEQ ID NO: 107214 - RNA, 20 nt, Artificial Sequence
  MKO10107214_B_Pcdhb2
  gRNA
auuuggacggugccagaccu

SEQ ID NO: 107215 - RNA, 20 nt, Artificial Sequence
  MKO10107215_B_Pcdhb2
  gRNA
ccgcgacccugcccaagaug

SEQ ID NO: 107216 - RNA, 20 nt, Artificial Sequence
  MKO10107216_B_Pcdhb3
  gRNA
ucuauacuauagcguccgaa

SEQ ID NO: 107217 - RNA, 20 nt, Artificial Sequence
  MKO10107217_B_Pcdhb3
  gRNA
ccccagauccgucgcuaaau

SEQ ID NO: 107218 - RNA, 20 nt, Artificial Sequence
  MKO10107218_B_Pcdhb3
  gRNA
uuucgacugaacuccaguac

SEQ ID NO: 107219 - RNA, 20 nt, Artificial Sequence
  MKO10107219_B_Pcdhb4
  gRNA
gguaacuccauacuauaaug

SEQ ID NO: 107220 - RNA, 20 nt, Artificial Sequence
  MKO10107220_B_Pcdhb4
  gRNA
cauagagcgauuguacaaac

SEQ ID NO: 107221 - RNA, 20 nt, Artificial Sequence
  MKO10107221_B_Pcdhb4
  gRNA
aauccgucuaagcaaaaagu

SEQ ID NO: 107222 - RNA, 20 nt, Artificial Sequence
  MKO10107222_B_Pcdhb5
  gRNA
gcccauaguccccaaccuaa

SEQ ID NO: 107223 - RNA, 20 nt, Artificial Sequence
  MKO10107223_B_Pcdhb5
  gRNA
cgaccccgcacaggaugauc

SEQ ID NO: 107224 - RNA, 20 nt, Artificial Sequence
  MKO10107224_B_Pcdhb5
  gRNA
gcagggcuucgaauucuacg

SEQ ID NO: 107225 - RNA, 20 nt, Artificial Sequence
  MKO10107225_B_Pcdhb6
  gRNA
ccagaucgcgaagcacuaug

SEQ ID NO: 107226 - RNA, 20 nt, Artificial Sequence
  MKO10107226_B_Pcdhb6
  gRNA
agagcucuugcagcuagaug

SEQ ID NO: 107227 - RNA, 20 nt, Artificial Sequence
  MKO10107227_B_Pcdhb6
  gRNA
gggggagcuccgcccaaguc

SEQ ID NO: 107228 - RNA, 20 nt, Artificial Sequence
  MKO10107228_B_Pcdhb7
  gRNA
gaaaggcuugguaauaguag

SEQ ID NO: 107229 - RNA, 20 nt, Artificial Sequence
  MKO10107229_B_Pcdhb7
  gRNA
cgaccccacacaggaaguug

SEQ ID NO: 107230 - RNA, 20 nt, Artificial Sequence
  MKO10107230_B_Pcdhb7
  gRNA
guuaccacugaauuuagccc

SEQ ID NO: 107231 - RNA, 20 nt, Artificial Sequence
  MKO10107231_B_Pcdhb8
  gRNA
ccagaucgcgaagcacugug

SEQ ID NO: 107232 - RNA, 20 nt, Artificial Sequence
  MKO10107232_B_Pcdhb8
  gRNA
ggcugacugcucuauuccug

SEQ ID NO: 107233 - RNA, 20 nt, Artificial Sequence
  MKO10107233_B_Pcdhb8
  gRNA
aucccagaguuaccauuaug

SEQ ID NO: 107234 - RNA, 20 nt, Artificial Sequence
  MKO10107234_B_Pcdhb9
  gRNA
uaaucgagauuaacgaagag

SEQ ID NO: 107235 - RNA, 20 nt, Artificial Sequence
  MKO10107235_B_Pcdhb9
  gRNA
uucucaauaaacgcaacuag

SEQ ID NO: 107236 - RNA, 20 nt, Artificial Sequence
  MKO10107236_B_Pcdhb9
  gRNA
gaaaggcucuguaacgauag

SEQ ID NO: 107237 - RNA, 20 nt, Artificial Sequence
  MKO10107237_B_Pcdhga10
  gRNA
cgccagaacguguacauccc

SEQ ID NO: 107238 - RNA, 20 nt, Artificial Sequence
  MKO10107238_B_Pcdhga10
  gRNA
agucaccuacccgcucgugc

SEQ ID NO: 107239 - RNA, 20 nt, Artificial Sequence
  MKO10107239_B_Pcdhga10
  gRNA
gcagcaucucuguaucaaac

SEQ ID NO: 107240 - RNA, 20 nt, Artificial Sequence
  MKO10107240_B_Pcdhga11
  gRNA
cgccagaacguguacauccc

SEQ ID NO: 107241 - RNA, 20 nt, Artificial Sequence
  MKO10107241_B_Pcdhga11
  gRNA
agucaccuacccgcucgugc

SEQ ID NO: 107242 - RNA, 20 nt, Artificial Sequence
  MKO10107242_B_Pcdhga11
  gRNA
gcagcaucucuguaucaaac

SEQ ID NO: 107243 - RNA, 20 nt, Artificial Sequence
  MKO10107243_B_Pcdhga12
  gRNA
cgccagaacguguacauccc

SEQ ID NO: 107244 - RNA, 20 nt, Artificial Sequence
  MKO10107244_B_Pcdhga12
  gRNA
agucaccuacccgcucgugc

SEQ ID NO: 107245 - RNA, 20 nt, Artificial Sequence
  MKO10107245_B_Pcdhga12
  gRNA
gcagcaucucuguaucaaac

SEQ ID NO: 107246 - RNA, 20 nt, Artificial Sequence
  MKO10107246_B_Pcdhga1
  gRNA
augagugaaauaacgacucc

SEQ ID NO: 107247 - RNA, 20 nt, Artificial Sequence
  MKO10107247_B_Pcdhga1
  gRNA
agucaccuacccgcucgugc

SEQ ID NO: 107248 - RNA, 20 nt, Artificial Sequence
  MKO10107248_B_Pcdhga1
  gRNA
gcagcaucucuguaucaaac

SEQ ID NO: 107249 - RNA, 20 nt, Artificial Sequence
  MKO10107249_B_Pcdhga2
  gRNA
cgccagaacguguacauccc

SEQ ID NO: 107250 - RNA, 20 nt, Artificial Sequence
  MKO10107250_B_Pcdhga2
  gRNA
agucaccuacccgcucgugc

SEQ ID NO: 107251 - RNA, 20 nt, Artificial Sequence
  MKO10107251_B_Pcdhga2
  gRNA
gcagcaucucuguaucaaac

SEQ ID NO: 107252 - RNA, 20 nt, Artificial Sequence
  MKO10107252_B_Pcdhga3
  gRNA
agcuuuguugugcgcgcucc

SEQ ID NO: 107253 - RNA, 20 nt, Artificial Sequence
  MKO10107253_B_Pcdhga3
  gRNA
agucaccuacccgcucgugc

SEQ ID NO: 107254 - RNA, 20 nt, Artificial Sequence
  MKO10107254_B_Pcdhga3
  gRNA
gcagcaucucuguaucaaac

SEQ ID NO: 107255 - RNA, 20 nt, Artificial Sequence
  MKO10107255_B_Pcdhga4
  gRNA
cgccagaacguguacauccc

SEQ ID NO: 107256 - RNA, 20 nt, Artificial Sequence
  MKO10107256_B_Pcdhga4
  gRNA
agucaccuacccgcucgugc

SEQ ID NO: 107257 - RNA, 20 nt, Artificial Sequence
  MKO10107257_B_Pcdhga4
  gRNA
gcagcaucucuguaucaaac

SEQ ID NO: 107258 - RNA, 20 nt, Artificial Sequence
  MKO10107258_B_Pcdhga5
  gRNA
cgccagaacguguacauccc

SEQ ID NO: 107259 - RNA, 20 nt, Artificial Sequence
  MKO10107259_B_Pcdhga5
  gRNA
agucaccuacccgcucgugc

SEQ ID NO: 107260 - RNA, 20 nt, Artificial Sequence
  MKO10107260_B_Pcdhga5
  gRNA
gcagcaucucuguaucaaac

SEQ ID NO: 107261 - RNA, 20 nt, Artificial Sequence
  MKO10107261_B_Pcdhga6
  gRNA
cgccagaacguguacauccc

SEQ ID NO: 107262 - RNA, 20 nt, Artificial Sequence
  MKO10107262_B_Pcdhga6
  gRNA
agucaccuacccgcucgugc

SEQ ID NO: 107263 - RNA, 20 nt, Artificial Sequence
  MKO10107263_B_Pcdhga6
  gRNA
gcagcaucucuguaucaaac

SEQ ID NO: 107264 - RNA, 20 nt, Artificial Sequence
  MKO10107264_B_Pcdhga7
  gRNA
cgccagaacguguacauccc

SEQ ID NO: 107265 - RNA, 20 nt, Artificial Sequence
  MKO10107265_B_Pcdhga7
  gRNA
agucaccuacccgcucgugc

SEQ ID NO: 107266 - RNA, 20 nt, Artificial Sequence
  MKO10107266_B_Pcdhga7
  gRNA
gcagcaucucuguaucaaac

SEQ ID NO: 107267 - RNA, 20 nt, Artificial Sequence
  MKO10107267_B_Pcdhga8
  gRNA
aauaauccgaaguuccaugu

SEQ ID NO: 107268 - RNA, 20 nt, Artificial Sequence
  MKO10107268_B_Pcdhga8
  gRNA
acgcugugcaagaucagcgu

SEQ ID NO: 107269 - RNA, 20 nt, Artificial Sequence
  MKO10107269_B_Pcdhga8
  gRNA
gcagcaucucuguaucaaac

SEQ ID NO: 107270 - RNA, 20 nt, Artificial Sequence
  MKO10107270_B_Pcdhga9
  gRNA
cacggaauagcggauuugcc

SEQ ID NO: 107271 - RNA, 20 nt, Artificial Sequence
  MKO10107271_B_Pcdhga9
  gRNA
agucaccuacccgcucgugc

SEQ ID NO: 107272 - RNA, 20 nt, Artificial Sequence
  MKO10107272_B_Pcdhga9
  gRNA
gcagcaucucuguaucaaac

SEQ ID NO: 107273 - RNA, 20 nt, Artificial Sequence
  MKO10107273_B_Pcdhgb1
  gRNA
agucaccuacccgcucgugc

SEQ ID NO: 107274 - RNA, 20 nt, Artificial Sequence
  MKO10107274_B_Pcdhgb1
  gRNA
aagcagagucguccgagacu

SEQ ID NO: 107275 - RNA, 20 nt, Artificial Sequence
  MKO10107275_B_Pcdhgb1
  gRNA
gcagcaucucuguaucaaac

SEQ ID NO: 107276 - RNA, 20 nt, Artificial Sequence
  MKO10107276_B_Pcdhgb2
  gRNA
cgccagaacguguacauccc

SEQ ID NO: 107277 - RNA, 20 nt, Artificial Sequence
  MKO10107277_B_Pcdhgb2
  gRNA
agucaccuacccgcucgugc

SEQ ID NO: 107278 - RNA, 20 nt, Artificial Sequence
  MKO10107278_B_Pcdhgb2
  gRNA
gcagcaucucuguaucaaac

SEQ ID NO: 107279 - RNA, 20 nt, Artificial Sequence
  MKO10107279_B_Pcdhgb4
  gRNA
cgccagaacguguacauccc

SEQ ID NO: 107280 - RNA, 20 nt, Artificial Sequence
  MKO10107280_B_Pcdhgb4
  gRNA
agucaccuacccgcucgugc

SEQ ID NO: 107281 - RNA, 20 nt, Artificial Sequence
  MKO10107281_B_Pcdhgb4
  gRNA
gcagcaucucuguaucaaac

SEQ ID NO: 107282 - RNA, 20 nt, Artificial Sequence
  MKO10107282_B_Pcdhgb5
  gRNA
auggaacucaccgguguuag

SEQ ID NO: 107283 - RNA, 20 nt, Artificial Sequence
  MKO10107283_B_Pcdhgb5
  gRNA
agucaccuacccgcucgugc

SEQ ID NO: 107284 - RNA, 20 nt, Artificial Sequence
  MKO10107284_B_Pcdhgb5
  gRNA
gcagcaucucuguaucaaac

SEQ ID NO: 107285 - RNA, 20 nt, Artificial Sequence
  MKO10107285_B_Pcdhgb6
  gRNA
gaauucuccuccgggagugg

SEQ ID NO: 107286 - RNA, 20 nt, Artificial Sequence
  MKO10107286_B_Pcdhgb6
  gRNA
ugcuggcuugccuuuguccg

SEQ ID NO: 107287 - RNA, 20 nt, Artificial Sequence
  MKO10107287_B_Pcdhgb6
  gRNA
gcagcaucucuguaucaaac

SEQ ID NO: 107288 - RNA, 20 nt, Artificial Sequence
  MKO10107288_B_Pcdhgb7
  gRNA
cgccagaacguguacauccc

SEQ ID NO: 107289 - RNA, 20 nt, Artificial Sequence
  MKO10107289_B_Pcdhgb7
  gRNA
agucaccuacccgcucgugc

SEQ ID NO: 107290 - RNA, 20 nt, Artificial Sequence
  MKO10107290_B_Pcdhgb7
  gRNA
gcagcaucucuguaucaaac

SEQ ID NO: 107291 - RNA, 20 nt, Artificial Sequence
  MKO10107291_B_Pcdhgb8
  gRNA
cgccagaacguguacauccc

SEQ ID NO: 107292 - RNA, 20 nt, Artificial Sequence
  MKO10107292_B_Pcdhgb8
  gRNA
agucaccuacccgcucgugc

SEQ ID NO: 107293 - RNA, 20 nt, Artificial Sequence
  MKO10107293_B_Pcdhgb8
  gRNA
gcagcaucucuguaucaaac

SEQ ID NO: 107294 - RNA, 20 nt, Artificial Sequence
  MKO10107294_B_Pcdhgc3
  gRNA
cgccagaacguguacauccc

SEQ ID NO: 107295 - RNA, 20 nt, Artificial Sequence
  MKO10107295_B_Pcdhgc3
  gRNA
agucaccuacccgcucgugc

SEQ ID NO: 107296 - RNA, 20 nt, Artificial Sequence
  MKO10107296_B_Pcdhgc3
  gRNA
gcagcaucucuguaucaaac

SEQ ID NO: 107297 - RNA, 20 nt, Artificial Sequence
  MKO10107297_B_Pcdhgc4
  gRNA
cgccagaacguguacauccc

SEQ ID NO: 107298 - RNA, 20 nt, Artificial Sequence
  MKO10107298_B_Pcdhgc4
  gRNA
agucaccuacccgcucgugc

SEQ ID NO: 107299 - RNA, 20 nt, Artificial Sequence
  MKO10107299_B_Pcdhgc4
  gRNA
gcagcaucucuguaucaaac

SEQ ID NO: 107300 - RNA, 20 nt, Artificial Sequence
  MKO10107300_B_Pcdhgc5
  gRNA
cgccagaacguguacauccc

SEQ ID NO: 107301 - RNA, 20 nt, Artificial Sequence
  MKO10107301_B_Pcdhgc5
  gRNA
agucaccuacccgcucgugc

SEQ ID NO: 107302 - RNA, 20 nt, Artificial Sequence
  MKO10107302_B_Pcdhgc5
  gRNA
gcagcaucucuguaucaaac

SEQ ID NO: 107303 - RNA, 20 nt, Artificial Sequence
  MKO10107303_B_Pced1a
  gRNA
caagguacucggaguaaacu

SEQ ID NO: 107304 - RNA, 20 nt, Artificial Sequence
  MKO10107304_B_Pced1a
  gRNA
gacgucgaaacaguguuucc

SEQ ID NO: 107305 - RNA, 20 nt, Artificial Sequence
  MKO10107305_B_Pced1a
  gRNA
ggaacgagucuuuguacgaa

SEQ ID NO: 107306 - RNA, 20 nt, Artificial Sequence
  MKO10107306_B_Pced1b
  gRNA
cuuguuugggcgcauggacc

SEQ ID NO: 107307 - RNA, 20 nt, Artificial Sequence
  MKO10107307_B_Pced1b
  gRNA
guacauggagagcguccuag

SEQ ID NO: 107308 - RNA, 20 nt, Artificial Sequence
  MKO10107308_B_Pced1b
  gRNA
caaggaauuccgcccauacc

SEQ ID NO: 107309 - RNA, 20 nt, Artificial Sequence
  MKO10107309_B_Pcf11
  gRNA
gcuuccaguuauguaccuua

SEQ ID NO: 107310 - RNA, 20 nt, Artificial Sequence
  MKO10107310_B_Pcf11
  gRNA
agagguuuaauaggccaagc

SEQ ID NO: 107311 - RNA, 20 nt, Artificial Sequence
  MKO10107311_B_Pcf11
  gRNA
gcuugaguuagaacaagcua

SEQ ID NO: 107312 - RNA, 20 nt, Artificial Sequence
  MKO10107312_B_Pcgf1
  gRNA
ugaacagcugagccuaugcc

SEQ ID NO: 107313 - RNA, 20 nt, Artificial Sequence
  MKO10107313_B_Pcgf1
  gRNA
cacucacugucuugcaagcc

SEQ ID NO: 107314 - RNA, 20 nt, Artificial Sequence
  MKO10107314_B_Pcgf1
  gRNA
ccccucaccucagccgcucc

SEQ ID NO: 107315 - RNA, 20 nt, Artificial Sequence
  MKO10107315_B_Pcgf2
  gRNA
ccgaggcgagguccuggaac

SEQ ID NO: 107316 - RNA, 20 nt, Artificial Sequence
  MKO10107316_B_Pcgf2
  gRNA
ccaacuuguagacaaugucc

SEQ ID NO: 107317 - RNA, 20 nt, Artificial Sequence
  MKO10107317_B_Pcgf2
  gRNA
ugcagcauacccccugacag

SEQ ID NO: 107318 - RNA, 20 nt, Artificial Sequence
  MKO10107318_B_Pcgf3
  gRNA
cagcacuuagauccccgaaa

SEQ ID NO: 107319 - RNA, 20 nt, Artificial Sequence
  MKO10107319_B_Pcgf3
  gRNA
agguaccaggugacaucaag

SEQ ID NO: 107320 - RNA, 20 nt, Artificial Sequence
  MKO10107320_B_Pcgf3
  gRNA
auuguuuacaagcuggugcc

SEQ ID NO: 107321 - RNA, 20 nt, Artificial Sequence
  MKO10107321_B_Pcgf5
  gRNA
uuacgaaauaaugggcaguc

SEQ ID NO: 107322 - RNA, 20 nt, Artificial Sequence
  MKO10107322_B_Pcgf5
  gRNA
agaagaacuucagcgugagu

SEQ ID NO: 107323 - RNA, 20 nt, Artificial Sequence
  MKO10107323_B_Pcgf5
  gRNA
caaauccauuagaaauguua

SEQ ID NO: 107324 - RNA, 20 nt, Artificial Sequence
  MKO10107324_B_Pcgf6
  gRNA
caaauuagugaucaaucuag

SEQ ID NO: 107325 - RNA, 20 nt, Artificial Sequence
  MKO10107325_B_Pcgf6
  gRNA
ucuuaccuuauauuauaaag

SEQ ID NO: 107326 - RNA, 20 nt, Artificial Sequence
  MKO10107326_B_Pcgf6
  gRNA
auacuaugucuuguaacugc

SEQ ID NO: 107327 - RNA, 20 nt, Artificial Sequence
  MKO10107327_B_Pcid2
  gRNA
uuccagguguaccuaugcug

SEQ ID NO: 107328 - RNA, 20 nt, Artificial Sequence
  MKO10107328_B_Pcid2
  gRNA
gcugcaaacauuucaucaua

SEQ ID NO: 107329 - RNA, 20 nt, Artificial Sequence
  MKO10107329_B_Pcid2
  gRNA
aaauguuugcagcucauuua

SEQ ID NO: 107330 - RNA, 20 nt, Artificial Sequence
  MKO10107330_B_Pcif1
  gRNA
gcuucaagaugagcugcgag

SEQ ID NO: 107331 - RNA, 20 nt, Artificial Sequence
  MKO10107331_B_Pcif1
  gRNA
cucugagagcugucgcuuuc

SEQ ID NO: 107332 - RNA, 20 nt, Artificial Sequence
  MKO10107332_B_Pcif1
  gRNA
aucgguugaaguaguaggga

SEQ ID NO: 107333 - RNA, 20 nt, Artificial Sequence
  MKO10107333_B_Pck1
  gRNA
ggcucgccgcuggccaagau

SEQ ID NO: 107334 - RNA, 20 nt, Artificial Sequence
  MKO10107334_B_Pck1
  gRNA
gacugucuugcuuucgaucc

SEQ ID NO: 107335 - RNA, 20 nt, Artificial Sequence
  MKO10107335_B_Pck1
  gRNA
cacacauucgaccuuccacc

SEQ ID NO: 107336 - RNA, 20 nt, Artificial Sequence
  MKO10107336_B_Pck2
  gRNA
accaccauagccgcugccga

SEQ ID NO: 107337 - RNA, 20 nt, Artificial Sequence
  MKO10107337_B_Pck2
  gRNA
ggcacugugucccgcugcga

SEQ ID NO: 107338 - RNA, 20 nt, Artificial Sequence
  MKO10107338_B_Pck2
  gRNA
gcucacugacucggcuuacg

SEQ ID NO: 107339 - RNA, 20 nt, Artificial Sequence
  MKO10107339_B_Pclo
  gRNA
ucuggcacacgaccuacgac

SEQ ID NO: 107340 - RNA, 20 nt, Artificial Sequence
  MKO10107340_B_Pclo
  gRNA
gguguggcuuggccagucgu

SEQ ID NO: 107341 - RNA, 20 nt, Artificial Sequence
  MKO10107341_B_Pclo
  gRNA
acccccagacgcaaaaccau

SEQ ID NO: 107342 - RNA, 20 nt, Artificial Sequence
  MKO10107342_B_Pcm1
  gRNA
ucaggccagagauccucagc

SEQ ID NO: 107343 - RNA, 20 nt, Artificial Sequence
  MKO10107343_B_Pcm1
  gRNA
aaacuucagugauuuagauc

SEQ ID NO: 107344 - RNA, 20 nt, Artificial Sequence
  MKO10107344_B_Pcm1
  gRNA
gacguugucaucucucucuu

SEQ ID NO: 107345 - RNA, 20 nt, Artificial Sequence
  MKO10107345_B_Pcmt1
  gRNA
aacaaucagugccccucaua

SEQ ID NO: 107346 - RNA, 20 nt, Artificial Sequence
  MKO10107346_B_Pcmt1
  gRNA
uaaagcuuaccuauugauug

SEQ ID NO: 107347 - RNA, 20 nt, Artificial Sequence
  MKO10107347_B_Pcmt1
  gRNA
cuuuagcaccuucaugcagc

SEQ ID NO: 107348 - RNA, 20 nt, Artificial Sequence
  MKO10107348_B_Pcmtd1
  gRNA
uuacggagccccacagaguc

SEQ ID NO: 107349 - RNA, 20 nt, Artificial Sequence
  MKO10107349_B_Pcmtd1
  gRNA
aaaaguaccugauccucuau

SEQ ID NO: 107350 - RNA, 20 nt, Artificial Sequence
  MKO10107350_B_Pcmtd1
  gRNA
guggugcaaaggaaaccgca

SEQ ID NO: 107351 - RNA, 20 nt, Artificial Sequence
  MKO10107351_B_Pcmtd2
  gRNA
gguccuuucggcgugaacca

SEQ ID NO: 107352 - RNA, 20 nt, Artificial Sequence
  MKO10107352_B_Pcmtd2
  gRNA
uguccugauuccgaacggca

SEQ ID NO: 107353 - RNA, 20 nt, Artificial Sequence
  MKO10107353_B_Pcmtd2
  gRNA
uugaccaagauaacacgcac

SEQ ID NO: 107354 - RNA, 20 nt, Artificial Sequence
  MKO10107354_B_Pcna
  gRNA
augucugcagaugugccccu

SEQ ID NO: 107355 - RNA, 20 nt, Artificial Sequence
  MKO10107355_B_Pcna
  gRNA
uccaaaauucuaaaaugugc

SEQ ID NO: 107356 - RNA, 20 nt, Artificial Sequence
  MKO10107356_B_Pcna
  gRNA
ugcuucgaauacuagugcua

SEQ ID NO: 107357 - RNA, 20 nt, Artificial Sequence
  MKO10107357_B_Pcnp
  gRNA
aagacuguuucuuccaguaa

SEQ ID NO: 107358 - RNA, 20 nt, Artificial Sequence
  MKO10107358_B_Pcnp
  gRNA
ucuugcuccaaaaacucugu

SEQ ID NO: 107359 - RNA, 20 nt, Artificial Sequence
  MKO10107359_B_Pcnp
  gRNA
agaguuggaacuguuuccuu

SEQ ID NO: 107360 - RNA, 20 nt, Artificial Sequence
  MKO10107360_B_Pcnt
  gRNA
aagagauggcgcuccgcagc

SEQ ID NO: 107361 - RNA, 20 nt, Artificial Sequence
  MKO10107361_B_Pcnt
  gRNA
uggcuaccgaacccuccucc

SEQ ID NO: 107362 - RNA, 20 nt, Artificial Sequence
  MKO10107362_B_Pcnt
  gRNA
cccaacagcgagcuccccca

SEQ ID NO: 107363 - RNA, 20 nt, Artificial Sequence
  MKO10107363_B_Pcnxl2
  gRNA
cgcaguagaacagcgcugug

SEQ ID NO: 107364 - RNA, 20 nt, Artificial Sequence
  MKO10107364_B_Pcnxl2
  gRNA
gucaccaaccaauggccccg

SEQ ID NO: 107365 - RNA, 20 nt, Artificial Sequence
  MKO10107365_B_Pcnxl2
  gRNA
gggaguggacacucugcccu

SEQ ID NO: 107366 - RNA, 20 nt, Artificial Sequence
  MKO10107366_B_Pcnxl3
  gRNA
gagcuucagcauuucucgau

SEQ ID NO: 107367 - RNA, 20 nt, Artificial Sequence
  MKO10107367_B_Pcnxl3
  gRNA
ggggcccagaauccuccauc

SEQ ID NO: 107368 - RNA, 20 nt, Artificial Sequence
  MKO10107368_B_Pcnxl3
  gRNA
cuuaucaggaguugcugccc

SEQ ID NO: 107369 - RNA, 20 nt, Artificial Sequence
  MKO10107369_B_Pcnxl4
  gRNA
aaugguggccuuccuugcgc

SEQ ID NO: 107370 - RNA, 20 nt, Artificial Sequence
  MKO10107370_B_Pcnxl4
  gRNA
guaaggagcuguccagcgca

SEQ ID NO: 107371 - RNA, 20 nt, Artificial Sequence
  MKO10107371_B_Pcnxl4
  gRNA
ggagccuugauacaggaauc

SEQ ID NO: 107372 - RNA, 20 nt, Artificial Sequence
  MKO10107372_B_Pcnx
  gRNA
ugcugcuguuccaagucgag

SEQ ID NO: 107373 - RNA, 20 nt, Artificial Sequence
  MKO10107373_B_Pcnx
  gRNA
uacacuccuaccugauugcu

SEQ ID NO: 107374 - RNA, 20 nt, Artificial Sequence
  MKO10107374_B_Pcnx
  gRNA
aguucuagucuuuguaaaga

SEQ ID NO: 107375 - RNA, 20 nt, Artificial Sequence
  MKO10107375_B_Pcolce2
  gRNA
cuacugcagauacgacuacg

SEQ ID NO: 107376 - RNA, 20 nt, Artificial Sequence
  MKO10107376_B_Pcolce2
  gRNA
acuucaggagaccgguauug

SEQ ID NO: 107377 - RNA, 20 nt, Artificial Sequence
  MKO10107377_B_Pcolce2
  gRNA
ggcauucuuaccggagaguc

SEQ ID NO: 107378 - RNA, 20 nt, Artificial Sequence
  MKO10107378_B_Pcolce
  gRNA
ggggacgugaccggggaguc

SEQ ID NO: 107379 - RNA, 20 nt, Artificial Sequence
  MKO10107379_B_Pcolce
  gRNA
cugugagugacgacucaaag

SEQ ID NO: 107380 - RNA, 20 nt, Artificial Sequence
  MKO10107380_B_Pcolce
  gRNA
gaaccuugaccacgcccaac

SEQ ID NO: 107381 - RNA, 20 nt, Artificial Sequence
  MKO10107381_B_Pcp2
  gRNA
gauggaaugcagaaacgacc

SEQ ID NO: 107382 - RNA, 20 nt, Artificial Sequence
  MKO10107382_B_Pcp2
  gRNA
cugcugcacucagcuuccgc

SEQ ID NO: 107383 - RNA, 20 nt, Artificial Sequence
  MKO10107383_B_Pcp2
  gRNA
gcuuacggcuuucuggguuc

SEQ ID NO: 107384 - RNA, 20 nt, Artificial Sequence
  MKO10107384_B_Pcp4l1
  gRNA
ucagaugccugguuggcugc

SEQ ID NO: 107385 - RNA, 20 nt, Artificial Sequence
  MKO10107385_B_Pcp4l1
  gRNA
ucucugucucuggcgcuguc

SEQ ID NO: 107386 - RNA, 20 nt, Artificial Sequence
  MKO10107386_B_Pcp4l1
  gRNA
gucaauuucuuccuccuccu

SEQ ID NO: 107387 - RNA, 20 nt, Artificial Sequence
  MKO10107387_B_Pcp4
  gRNA
uguuuauagagacaaagugc

SEQ ID NO: 107388 - RNA, 20 nt, Artificial Sequence
  MKO10107388_B_Pcp4
  gRNA
ugucgauaucaaauucuucu

SEQ ID NO: 107389 - RNA, 20 nt, Artificial Sequence
  MKO10107389_B_Pcp4
  gRNA
agagacagagcgugcagcug

SEQ ID NO: 107390 - RNA, 20 nt, Artificial Sequence
  MKO10107390_B_Pcsk1n
  gRNA
ucugcuacgcgucaaacgcc

SEQ ID NO: 107391 - RNA, 20 nt, Artificial Sequence
  MKO10107391_B_Pcsk1n
  gRNA
agagcccccaguacguucuc

SEQ ID NO: 107392 - RNA, 20 nt, Artificial Sequence
  MKO10107392_B_Pcsk1n
  gRNA
caccaaaaugccgacgcccc

SEQ ID NO: 107393 - RNA, 20 nt, Artificial Sequence
  MKO10107393_B_Pcsk1
  gRNA
gcgcucuucauaucacuaag

SEQ ID NO: 107394 - RNA, 20 nt, Artificial Sequence
  MKO10107394_B_Pcsk1
  gRNA
aucucuucaaugauccaaug

SEQ ID NO: 107395 - RNA, 20 nt, Artificial Sequence
  MKO10107395_B_Pcsk1
  gRNA
accuucauguaauaccuguu

SEQ ID NO: 107396 - RNA, 20 nt, Artificial Sequence
  MKO10107396_B_Pcsk2
  gRNA
accguaaaaagagaggguac

SEQ ID NO: 107397 - RNA, 20 nt, Artificial Sequence
  MKO10107397_B_Pcsk2
  gRNA
cucucucuagcugccgcuua

SEQ ID NO: 107398 - RNA, 20 nt, Artificial Sequence
  MKO10107398_B_Pcsk2
  gRNA
accaucauccauaauuccaa

SEQ ID NO: 107399 - RNA, 20 nt, Artificial Sequence
  MKO10107399_B_Pcsk4
  gRNA
agaaagaccacccggaccuc

SEQ ID NO: 107400 - RNA, 20 nt, Artificial Sequence
  MKO10107400_B_Pcsk4
  gRNA
agcucaccgguucucaucgu

SEQ ID NO: 107401 - RNA, 20 nt, Artificial Sequence
  MKO10107401_B_Pcsk4
  gRNA
ggaaccagggacugaccggc

SEQ ID NO: 107402 - RNA, 20 nt, Artificial Sequence
  MKO10107402_B_Pcsk5
  gRNA
gaauaucguggugacuaucc

SEQ ID NO: 107403 - RNA, 20 nt, Artificial Sequence
  MKO10107403_B_Pcsk5
  gRNA
uucucucgaugccgucaucc

SEQ ID NO: 107404 - RNA, 20 nt, Artificial Sequence
  MKO10107404_B_Pcsk5
  gRNA
aggucuguucucucgagcag

SEQ ID NO: 107405 - RNA, 20 nt, Artificial Sequence
  MKO10107405_B_Pcsk6
  gRNA
aaaaaugauaguaaucgucc

SEQ ID NO: 107406 - RNA, 20 nt, Artificial Sequence
  MKO10107406_B_Pcsk6
  gRNA
uaugcaagcuacgaugucaa

SEQ ID NO: 107407 - RNA, 20 nt, Artificial Sequence
  MKO10107407_B_Pcsk6
  gRNA
gguaaaauggcugcaacaac

SEQ ID NO: 107408 - RNA, 20 nt, Artificial Sequence
  MKO10107408_B_Pcsk7
  gRNA
cguaguugggugcgaugucc

SEQ ID NO: 107409 - RNA, 20 nt, Artificial Sequence
  MKO10107409_B_Pcsk7
  gRNA
auaccuagguauccgggugc

SEQ ID NO: 107410 - RNA, 20 nt, Artificial Sequence
  MKO10107410_B_Pcsk7
  gRNA
uggaccacuuacugacagua

SEQ ID NO: 107411 - RNA, 20 nt, Artificial Sequence
  MKO10107411_B_Pcsk9
  gRNA
cacgcuguugaagucgguga

SEQ ID NO: 107412 - RNA, 20 nt, Artificial Sequence
  MKO10107412_B_Pcsk9
  gRNA
augcugggauaauucgcucc

SEQ ID NO: 107413 - RNA, 20 nt, Artificial Sequence
  MKO10107413_B_Pcsk9
  gRNA
acagucagcggcacccucau

SEQ ID NO: 107414 - RNA, 20 nt, Artificial Sequence
  MKO10107414_B_Pcup
  gRNA
cacccgccagcgccgagacc

SEQ ID NO: 107415 - RNA, 20 nt, Artificial Sequence
  MKO10107415_B_Pcup
  gRNA
uuccguccuggcucauuaac

SEQ ID NO: 107416 - RNA, 20 nt, Artificial Sequence
  MKO10107416_B_Pcup
  gRNA
augaacagaugguggcauac

SEQ ID NO: 107417 - RNA, 20 nt, Artificial Sequence
  MKO10107417_B_Pcx
  gRNA
cugugcacgcacgaaacacu

SEQ ID NO: 107418 - RNA, 20 nt, Artificial Sequence
  MKO10107418_B_Pcx
  gRNA
ggguguccgccgauccuccu

SEQ ID NO: 107419 - RNA, 20 nt, Artificial Sequence
  MKO10107419_B_Pcx
  gRNA
uacuccagacgccggacauu

SEQ ID NO: 107420 - RNA, 20 nt, Artificial Sequence
  MKO10107420_B_Pcyox1l
  gRNA
gcuugacgaaguccugcaug

SEQ ID NO: 107421 - RNA, 20 nt, Artificial Sequence
  MKO10107421_B_Pcyox1l
  gRNA
agcgcugugugacgcccacc

SEQ ID NO: 107422 - RNA, 20 nt, Artificial Sequence
  MKO10107422_B_Pcyox1l
  gRNA
cugacagcuguuaucggagc

SEQ ID NO: 107423 - RNA, 20 nt, Artificial Sequence
  MKO10107423_B_Pcyox1
  gRNA
gaaaaguugaugcacgccau

SEQ ID NO: 107424 - RNA, 20 nt, Artificial Sequence
  MKO10107424_B_Pcyox1
  gRNA
uguaaucaacgugauuaagc

SEQ ID NO: 107425 - RNA, 20 nt, Artificial Sequence
  MKO10107425_B_Pcyox1
  gRNA
uuccauuguacacgcccacc

SEQ ID NO: 107426 - RNA, 20 nt, Artificial Sequence
  MKO10107426_B_Pcyt1a
  gRNA
gcggccugugagaguuuaug

SEQ ID NO: 107427 - RNA, 20 nt, Artificial Sequence
  MKO10107427_B_Pcyt1a
  gRNA
ccauccgcauaaacucucac

SEQ ID NO: 107428 - RNA, 20 nt, Artificial Sequence
  MKO10107428_B_Pcyt1a
  gRNA
cuuacacggaguuccccugc

SEQ ID NO: 107429 - RNA, 20 nt, Artificial Sequence
  MKO10107429_B_Pcyt1b
  gRNA
ccucaccugguguuccuaag

SEQ ID NO: 107430 - RNA, 20 nt, Artificial Sequence
  MKO10107430_B_Pcyt1b
  gRNA
uccuaccaacaaguagcugu

SEQ ID NO: 107431 - RNA, 20 nt, Artificial Sequence
  MKO10107431_B_Pcyt1b
  gRNA
ccaucugcauacacucuaac

SEQ ID NO: 107432 - RNA, 20 nt, Artificial Sequence
  MKO10107432_B_Pcyt2
  gRNA
gcccccgguguuuacccagg

SEQ ID NO: 107433 - RNA, 20 nt, Artificial Sequence
  MKO10107433_B_Pcyt2
  gRNA
caccucauccacccacuuga

SEQ ID NO: 107434 - RNA, 20 nt, Artificial Sequence
  MKO10107434_B_Pcyt2
  gRNA
uguguccaccacagaccucg

SEQ ID NO: 107435 - RNA, 20 nt, Artificial Sequence
  MKO10107435_B_Pdap1
  gRNA
ggcucguauacugccucacu

SEQ ID NO: 107436 - RNA, 20 nt, Artificial Sequence
  MKO10107436_B_Pdap1
  gRNA
agugaggcaguauacgagcc

SEQ ID NO: 107437 - RNA, 20 nt, Artificial Sequence
  MKO10107437_B_Pdap1
  gRNA
ggcuucaggugacccaaaaa

SEQ ID NO: 107438 - RNA, 20 nt, Artificial Sequence
  MKO10107438_B_Pdcd10
  gRNA
caccgagucccuccuucgua

SEQ ID NO: 107439 - RNA, 20 nt, Artificial Sequence
  MKO10107439_B_Pdcd10
  gRNA
caggcugaaaaggaaaaucc

SEQ ID NO: 107440 - RNA, 20 nt, Artificial Sequence
  MKO10107440_B_Pdcd10
  gRNA
ucugagagccgcuuucauua

SEQ ID NO: 107441 - RNA, 20 nt, Artificial Sequence
  MKO10107441_B_Pdcd11
  gRNA
aaauccgcauccccucacau

SEQ ID NO: 107442 - RNA, 20 nt, Artificial Sequence
  MKO10107442_B_Pdcd11
  gRNA
uacauccggcagaagaacaa

SEQ ID NO: 107443 - RNA, 20 nt, Artificial Sequence
  MKO10107443_B_Pdcd11
  gRNA
acacaccucaccaacauucc

SEQ ID NO: 107444 - RNA, 20 nt, Artificial Sequence
  MKO10107444_B_Pdcd1lg2
  gRNA
aacccaaaguccccagaacg

SEQ ID NO: 107445 - RNA, 20 nt, Artificial Sequence
  MKO10107445_B_Pdcd1lg2
  gRNA
aggcuugaggcgcagaacac

SEQ ID NO: 107446 - RNA, 20 nt, Artificial Sequence
  MKO10107446_B_Pdcd1lg2
  gRNA
caccaucgcuuugaucuucc

SEQ ID NO: 107447 - RNA, 20 nt, Artificial Sequence
  MKO10107447_B_Pdcd1
  gRNA
ugguuugagccaacccgucc

SEQ ID NO: 107448 - RNA, 20 nt, Artificial Sequence
  MKO10107448_B_Pdcd1
  gRNA
agcugagccccuacguccca

SEQ ID NO: 107449 - RNA, 20 nt, Artificial Sequence
  MKO10107449_B_Pdcd1
  gRNA
gauaucuuguugaggucucc

SEQ ID NO: 107450 - RNA, 20 nt, Artificial Sequence
  MKO10107450_B_Pdcd2l
  gRNA
uguccaccccuucucuccgc

SEQ ID NO: 107451 - RNA, 20 nt, Artificial Sequence
  MKO10107451_B_Pdcd2l
  gRNA
uucaugaaccuauaaaacgu

SEQ ID NO: 107452 - RNA, 20 nt, Artificial Sequence
  MKO10107452_B_Pdcd2l
  gRNA
gaagagaauugcugcuugcc

SEQ ID NO: 107453 - RNA, 20 nt, Artificial Sequence
  MKO10107453_B_Pdcd2
  gRNA
gauauuccagauugcccgug

SEQ ID NO: 107454 - RNA, 20 nt, Artificial Sequence
  MKO10107454_B_Pdcd2
  gRNA
cuuggauucgugcuuugcca

SEQ ID NO: 107455 - RNA, 20 nt, Artificial Sequence
  MKO10107455_B_Pdcd2
  gRNA
uguagacaaaauagaccaua

SEQ ID NO: 107456 - RNA, 20 nt, Artificial Sequence
  MKO10107456_B_Pdcd4
  gRNA
ggugaugagcacaaaugacg

SEQ ID NO: 107457 - RNA, 20 nt, Artificial Sequence
  MKO10107457_B_Pdcd4
  gRNA
cuagauaggcgguccagauc

SEQ ID NO: 107458 - RNA, 20 nt, Artificial Sequence
  MKO10107458_B_Pdcd4
  gRNA
ugcucaucaccgucccgcaa

SEQ ID NO: 107459 - RNA, 20 nt, Artificial Sequence
  MKO10107459_B_Pdcd5
  gRNA
uccuggugaugcagcccaac

SEQ ID NO: 107460 - RNA, 20 nt, Artificial Sequence
  MKO10107460_B_Pdcd5
  gRNA
caguaucuuagcccaaguuc

SEQ ID NO: 107461 - RNA, 20 nt, Artificial Sequence
  MKO10107461_B_Pdcd5
  gRNA
gccugaaaaaacuaaagcag

SEQ ID NO: 107462 - RNA, 20 nt, Artificial Sequence
  MKO10107462_B_Pdcd6ip
  gRNA
agaucugcuugacguucacg

SEQ ID NO: 107463 - RNA, 20 nt, Artificial Sequence
  MKO10107463_B_Pdcd6ip
  gRNA
uaccugguacugcuuagcag

SEQ ID NO: 107464 - RNA, 20 nt, Artificial Sequence
  MKO10107464_B_Pdcd6ip
  gRNA
cacccagaugaacgacgcca

SEQ ID NO: 107465 - RNA, 20 nt, Artificial Sequence
  MKO10107465_B_Pdcd6
  gRNA
uuuguaggguugauaaagac

SEQ ID NO: 107466 - RNA, 20 nt, Artificial Sequence
  MKO10107466_B_Pdcd6
  gRNA
cuucagcaagcauuauccaa

SEQ ID NO: 107467 - RNA, 20 nt, Artificial Sequence
  MKO10107467_B_Pdcd6
  gRNA
cccagaguugucccugucgu

SEQ ID NO: 107468 - RNA, 20 nt, Artificial Sequence
  MKO10107468_B_Pdcd7
  gRNA
ugcccgcgcucauucagaua

SEQ ID NO: 107469 - RNA, 20 nt, Artificial Sequence
  MKO10107469_B_Pdcd7
  gRNA
gcaugauugggaucaguacc

SEQ ID NO: 107470 - RNA, 20 nt, Artificial Sequence
  MKO10107470_B_Pdcd7
  gRNA
cuuucgagcaccaucuucag

SEQ ID NO: 107471 - RNA, 20 nt, Artificial Sequence
  MKO10107471_B_Pdcl2
  gRNA
gcgcuuacagcaggaggcca

SEQ ID NO: 107472 - RNA, 20 nt, Artificial Sequence
  MKO10107472_B_Pdcl2
  gRNA
agagaugaauuacaacccac

SEQ ID NO: 107473 - RNA, 20 nt, Artificial Sequence
  MKO10107473_B_Pdcl2
  gRNA
uuccauucuguaucuucguu

SEQ ID NO: 107474 - RNA, 20 nt, Artificial Sequence
  MKO10107474_B_Pdcl3
  gRNA
uuucacaucgggaaacuucc

SEQ ID NO: 107475 - RNA, 20 nt, Artificial Sequence
  MKO10107475_B_Pdcl3
  gRNA
cagcucacccuuguuuguac

SEQ ID NO: 107476 - RNA, 20 nt, Artificial Sequence
  MKO10107476_B_Pdcl3
  gRNA
accccaaugcagacaccgag

SEQ ID NO: 107477 - RNA, 20 nt, Artificial Sequence
  MKO10107477_B_Pdcl
  gRNA
cauuaguuccacaccugcag

SEQ ID NO: 107478 - RNA, 20 nt, Artificial Sequence
  MKO10107478_B_Pdcl
  gRNA
caaaaggugugaucaaugac

SEQ ID NO: 107479 - RNA, 20 nt, Artificial Sequence
  MKO10107479_B_Pdcl
  gRNA
cugucuccaacugcuugaag

SEQ ID NO: 107480 - RNA, 20 nt, Artificial Sequence
  MKO10107480_B_Pdc
  gRNA
ccaaucauuuauuacuccuu

SEQ ID NO: 107481 - RNA, 20 nt, Artificial Sequence
  MKO10107481_B_Pdc
  gRNA
ccaaaggaguaauaaaugau

SEQ ID NO: 107482 - RNA, 20 nt, Artificial Sequence
  MKO10107482_B_Pdc
  gRNA
caaaaucuucuucuaagcuu

SEQ ID NO: 107483 - RNA, 20 nt, Artificial Sequence
  MKO10107483_B_Pddc1
  gRNA
ugacugagagcaaugcccga

SEQ ID NO: 107484 - RNA, 20 nt, Artificial Sequence
  MKO10107484_B_Pddc1
  gRNA
uuccagggcuacagucugac

SEQ ID NO: 107485 - RNA, 20 nt, Artificial Sequence
  MKO10107485_B_Pddc1
  gRNA
ccccugggguggccaccugu

SEQ ID NO: 107486 - RNA, 20 nt, Artificial Sequence
  MKO10107486_B_Pde10a
  gRNA
uuggcagccacaaaagccga

SEQ ID NO: 107487 - RNA, 20 nt, Artificial Sequence
  MKO10107487_B_Pde10a
  gRNA
aaacaaauucaucuaauacc

SEQ ID NO: 107488 - RNA, 20 nt, Artificial Sequence
  MKO10107488_B_Pde10a
  gRNA
uuacauuauugcacucucca

SEQ ID NO: 107489 - RNA, 20 nt, Artificial Sequence
  MKO10107489_B_Pde11a
  gRNA
gaagagcugagcauuagaua

SEQ ID NO: 107490 - RNA, 20 nt, Artificial Sequence
  MKO10107490_B_Pde11a
  gRNA
ggacaucaguucaaaggauu

SEQ ID NO: 107491 - RNA, 20 nt, Artificial Sequence
  MKO10107491_B_Pde11a
  gRNA
caaauguaucuuccguucug

SEQ ID NO: 107492 - RNA, 20 nt, Artificial Sequence
  MKO10107492_B_Pde12
  gRNA
uuuaauaguacaccaucaac

SEQ ID NO: 107493 - RNA, 20 nt, Artificial Sequence
  MKO10107493_B_Pde12
  gRNA
uugcuaauacccaucucuac

SEQ ID NO: 107494 - RNA, 20 nt, Artificial Sequence
  MKO10107494_B_Pde12
  gRNA
gccgguugcgaccugcgagc

SEQ ID NO: 107495 - RNA, 20 nt, Artificial Sequence
  MKO10107495_B_Pde1a
  gRNA
ugaucuuaucaaccgcuuca

SEQ ID NO: 107496 - RNA, 20 nt, Artificial Sequence
  MKO10107496_B_Pde1a
  gRNA
uuugagugacgucagcugca

SEQ ID NO: 107497 - RNA, 20 nt, Artificial Sequence
  MKO10107497_B_Pde1a
  gRNA
cauuauauaaugcuucauac

SEQ ID NO: 107498 - RNA, 20 nt, Artificial Sequence
  MKO10107498_B_Pde1b
  gRNA
cucuucugcccugcgaccuu

SEQ ID NO: 107499 - RNA, 20 nt, Artificial Sequence
  MKO10107499_B_Pde1b
  gRNA
acccugcaggcugcgcuaca

SEQ ID NO: 107500 - RNA, 20 nt, Artificial Sequence
  MKO10107500_B_Pde1b
  gRNA
acccagcagacccgagccaa

SEQ ID NO: 107501 - RNA, 20 nt, Artificial Sequence
  MKO10107501_B_Pde1c
  gRNA
aucguccaugcggugcaagc

SEQ ID NO: 107502 - RNA, 20 nt, Artificial Sequence
  MKO10107502_B_Pde1c
  gRNA
cuucagugcaugaucuccac

SEQ ID NO: 107503 - RNA, 20 nt, Artificial Sequence
  MKO10107503_B_Pde1c
  gRNA
agccaaucccgaacuucuga

SEQ ID NO: 107504 - RNA, 20 nt, Artificial Sequence
  MKO10107504_B_Pde2a
  gRNA
gccaugcgccgacagccugc

SEQ ID NO: 107505 - RNA, 20 nt, Artificial Sequence
  MKO10107505_B_Pde2a
  gRNA
ccccccucaugagcugccac

SEQ ID NO: 107506 - RNA, 20 nt, Artificial Sequence
  MKO10107506_B_Pde2a
  gRNA
auuccucaggcggggccagc

SEQ ID NO: 107507 - RNA, 20 nt, Artificial Sequence
  MKO10107507_B_Pde3a
  gRNA
gcacuuaccugggauccucg

SEQ ID NO: 107508 - RNA, 20 nt, Artificial Sequence
  MKO10107508_B_Pde3a
  gRNA
gccuuccucagaguccgagc

SEQ ID NO: 107509 - RNA, 20 nt, Artificial Sequence
  MKO10107509_B_Pde3a
  gRNA
gcagagaagggucggccagg

SEQ ID NO: 107510 - RNA, 20 nt, Artificial Sequence
  MKO10107510_B_Pde3b
  gRNA
cucauuagucagcaacgaug

SEQ ID NO: 107511 - RNA, 20 nt, Artificial Sequence
  MKO10107511_B_Pde3b
  gRNA
acagacgaugaccucugcuu

SEQ ID NO: 107512 - RNA, 20 nt, Artificial Sequence
  MKO10107512_B_Pde3b
  gRNA
uccauacucaccugguaaug

SEQ ID NO: 107513 - RNA, 20 nt, Artificial Sequence
  MKO10107513_B_Pde4a
  gRNA
cuacaccuacuugugcuaag

SEQ ID NO: 107514 - RNA, 20 nt, Artificial Sequence
  MKO10107514_B_Pde4a
  gRNA
cugaccugcucauuuccgac

SEQ ID NO: 107515 - RNA, 20 nt, Artificial Sequence
  MKO10107515_B_Pde4a
  gRNA
cugaaaaagcugguacacac

SEQ ID NO: 107516 - RNA, 20 nt, Artificial Sequence
  MKO10107516_B_Pde4b
  gRNA
guuucuuacacuucgcaagc

SEQ ID NO: 107517 - RNA, 20 nt, Artificial Sequence
  MKO10107517_B_Pde4b
  gRNA
cccucaagccggcucuucgu

SEQ ID NO: 107518 - RNA, 20 nt, Artificial Sequence
  MKO10107518_B_Pde4b
  gRNA
acuggagccugacuagccgc

SEQ ID NO: 107519 - RNA, 20 nt, Artificial Sequence
  MKO10107519_B_Pde4c
  gRNA
uuccaauugugaagaccacg

SEQ ID NO: 107520 - RNA, 20 nt, Artificial Sequence
  MKO10107520_B_Pde4c
  gRNA
gauugucacgcccuucgccc

SEQ ID NO: 107521 - RNA, 20 nt, Artificial Sequence
  MKO10107521_B_Pde4c
  gRNA
gugauccugagacgguucuc

SEQ ID NO: 107522 - RNA, 20 nt, Artificial Sequence
  MKO10107522_B_Pde4dip
  gRNA
guaggggucucaugcaaguc

SEQ ID NO: 107523 - RNA, 20 nt, Artificial Sequence
  MKO10107523_B_Pde4dip
  gRNA
guacguggagcuguccgagc

SEQ ID NO: 107524 - RNA, 20 nt, Artificial Sequence
  MKO10107524_B_Pde4dip
  gRNA
uacgacaauccagagccuca

SEQ ID NO: 107525 - RNA, 20 nt, Artificial Sequence
  MKO10107525_B_Pde4d
  gRNA
cgcagcaaaguuguuccgua

SEQ ID NO: 107526 - RNA, 20 nt, Artificial Sequence
  MKO10107526_B_Pde4d
  gRNA
uuacauaucacuggcaaucg

SEQ ID NO: 107527 - RNA, 20 nt, Artificial Sequence
  MKO10107527_B_Pde4d
  gRNA
uggcuagccugcgaaccgua

SEQ ID NO: 107528 - RNA, 20 nt, Artificial Sequence
  MKO10107528_B_Pde5a
  gRNA
acagagacauggucaacgca

SEQ ID NO: 107529 - RNA, 20 nt, Artificial Sequence
  MKO10107529_B_Pde5a
  gRNA
gcagaaguugaccaaauuac

SEQ ID NO: 107530 - RNA, 20 nt, Artificial Sequence
  MKO10107530_B_Pde5a
  gRNA
gaacaauaccacagaaugcc

SEQ ID NO: 107531 - RNA, 20 nt, Artificial Sequence
  MKO10107531_B_Pde6a
  gRNA
aagaaacuuacccuuccguc

SEQ ID NO: 107532 - RNA, 20 nt, Artificial Sequence
  MKO10107532_B_Pde6a
  gRNA
aacugugacagauacuccgu

SEQ ID NO: 107533 - RNA, 20 nt, Artificial Sequence
  MKO10107533_B_Pde6a
  gRNA
uuuauucacagccaugauua

SEQ ID NO: 107534 - RNA, 20 nt, Artificial Sequence
  MKO10107534_B_Pde6b
  gRNA
uucgugggccugaguauggc

SEQ ID NO: 107535 - RNA, 20 nt, Artificial Sequence
  MKO10107535_B_Pde6b
  gRNA
cucugcgugucucacaguug

SEQ ID NO: 107536 - RNA, 20 nt, Artificial Sequence
  MKO10107536_B_Pde6b
  gRNA
agcuuaggugauagaucuuc

SEQ ID NO: 107537 - RNA, 20 nt, Artificial Sequence
  MKO10107537_B_Pde6c
  gRNA
gugcgacagcaacaaagcug

SEQ ID NO: 107538 - RNA, 20 nt, Artificial Sequence
  MKO10107538_B_Pde6c
  gRNA
gcuuuguugcugucgcacua

SEQ ID NO: 107539 - RNA, 20 nt, Artificial Sequence
  MKO10107539_B_Pde6c
  gRNA
cagagaaguuguauuuccgu

SEQ ID NO: 107540 - RNA, 20 nt, Artificial Sequence
  MKO10107540_B_Pde6d
  gRNA
ccgaaacagggaagauacuc

SEQ ID NO: 107541 - RNA, 20 nt, Artificial Sequence
  MKO10107541_B_Pde6d
  gRNA
ccagaguaucuucccuguuu

SEQ ID NO: 107542 - RNA, 20 nt, Artificial Sequence
  MKO10107542_B_Pde6d
  gRNA
gagacacugccuugcacuug

SEQ ID NO: 107543 - RNA, 20 nt, Artificial Sequence
  MKO10107543_B_Pde6g
  gRNA
cugacuaaaugaugccauac

SEQ ID NO: 107544 - RNA, 20 nt, Artificial Sequence
  MKO10107544_B_Pde6g
  gRNA
agguuuggggaugacauccc

SEQ ID NO: 107545 - RNA, 20 nt, Artificial Sequence
  MKO10107545_B_Pde6g
  gRNA
guccccaggccuuccauucc

SEQ ID NO: 107546 - RNA, 20 nt, Artificial Sequence
  MKO10107546_B_Pde6h
  gRNA
guuccuagccccuccaugcc

SEQ ID NO: 107547 - RNA, 20 nt, Artificial Sequence
  MKO10107547_B_Pde6h
  gRNA
agguuuggagaugacauccc

SEQ ID NO: 107548 - RNA, 20 nt, Artificial Sequence
  MKO10107548_B_Pde6h
  gRNA
caagcucaugcagcuccaga

SEQ ID NO: 107549 - RNA, 20 nt, Artificial Sequence
  MKO10107549_B_Pde7a
  gRNA
uugaagcaucagucuccgcc

SEQ ID NO: 107550 - RNA, 20 nt, Artificial Sequence
  MKO10107550_B_Pde7a
  gRNA
agucugaucagaacugucau

SEQ ID NO: 107551 - RNA, 20 nt, Artificial Sequence
  MKO10107551_B_Pde7a
  gRNA
cuguuugauagacuaacaaa

SEQ ID NO: 107552 - RNA, 20 nt, Artificial Sequence
  MKO10107552_B_Pde7b
  gRNA
cccggagaagccuagaugca

SEQ ID NO: 107553 - RNA, 20 nt, Artificial Sequence
  MKO10107553_B_Pde7b
  gRNA
aaagucccacguuccaacuu

SEQ ID NO: 107554 - RNA, 20 nt, Artificial Sequence
  MKO10107554_B_Pde7b
  gRNA
acacauuugacacucuguuc

SEQ ID NO: 107555 - RNA, 20 nt, Artificial Sequence
  MKO10107555_B_Pde8a
  gRNA
guuuguccuggaaacaggua

SEQ ID NO: 107556 - RNA, 20 nt, Artificial Sequence
  MKO10107556_B_Pde8a
  gRNA
cccgugugaagccagcagca

SEQ ID NO: 107557 - RNA, 20 nt, Artificial Sequence
  MKO10107557_B_Pde8a
  gRNA
uuaaugcccuuccuugcugc

SEQ ID NO: 107558 - RNA, 20 nt, Artificial Sequence
  MKO10107558_B_Pde8b
  gRNA
cgugugcucagagggguucg

SEQ ID NO: 107559 - RNA, 20 nt, Artificial Sequence
  MKO10107559_B_Pde8b
  gRNA
ugggcccaugagacugacac

SEQ ID NO: 107560 - RNA, 20 nt, Artificial Sequence
  MKO10107560_B_Pde8b
  gRNA
aggguccugugucagucuca

SEQ ID NO: 107561 - RNA, 20 nt, Artificial Sequence
  MKO10107561_B_Pde9a
  gRNA
gcuuaccgcucugaauucgc

SEQ ID NO: 107562 - RNA, 20 nt, Artificial Sequence
  MKO10107562_B_Pde9a
  gRNA
agaacgagaagaacuuaucc

SEQ ID NO: 107563 - RNA, 20 nt, Artificial Sequence
  MKO10107563_B_Pde9a
  gRNA
cucuuacagcacucccuaca

SEQ ID NO: 107564 - RNA, 20 nt, Artificial Sequence
  MKO10107564_B_Pdf
  gRNA
cugcuuguucaucgacaaaa

SEQ ID NO: 107565 - RNA, 20 nt, Artificial Sequence
  MKO10107565_B_Pdf
  gRNA
accuggcacacgugcgcgua

SEQ ID NO: 107566 - RNA, 20 nt, Artificial Sequence
  MKO10107566_B_Pdf
  gRNA
ccccgagcugcggcgcacua

SEQ ID NO: 107567 - RNA, 20 nt, Artificial Sequence
  MKO10107567_B_Pdgfa
  gRNA
caggccgcuucucgggcaca

SEQ ID NO: 107568 - RNA, 20 nt, Artificial Sequence
  MKO10107568_B_Pdgfa
  gRNA
cucuuggagauagacuccgu

SEQ ID NO: 107569 - RNA, 20 nt, Artificial Sequence
  MKO10107569_B_Pdgfa
  gRNA
uuaaccaugugcccgagaag

SEQ ID NO: 107570 - RNA, 20 nt, Artificial Sequence
  MKO10107570_B_Pdgfb
  gRNA
aacaugacccgagcacacuc

SEQ ID NO: 107571 - RNA, 20 nt, Artificial Sequence
  MKO10107571_B_Pdgfb
  gRNA
cugcugcacagagacuccgu

SEQ ID NO: 107572 - RNA, 20 nt, Artificial Sequence
  MKO10107572_B_Pdgfb
  gRNA
cacuacugucucacacuugc

SEQ ID NO: 107573 - RNA, 20 nt, Artificial Sequence
  MKO10107573_B_Pdgfc
  gRNA
ccauacgggaagagcuaaag

SEQ ID NO: 107574 - RNA, 20 nt, Artificial Sequence
  MKO10107574_B_Pdgfc
  gRNA
uaugaggaaacuucgggcug

SEQ ID NO: 107575 - RNA, 20 nt, Artificial Sequence
  MKO10107575_B_Pdgfc
  gRNA
acagauaccauauucuggcc

SEQ ID NO: 107576 - RNA, 20 nt, Artificial Sequence
  MKO10107576_B_Pdgfd
  gRNA
uaccaugaucggaaguccaa

SEQ ID NO: 107577 - RNA, 20 nt, Artificial Sequence
  MKO10107577_B_Pdgfd
  gRNA
uuuguucuugacguuauccu

SEQ ID NO: 107578 - RNA, 20 nt, Artificial Sequence
  MKO10107578_B_Pdgfd
  gRNA
acacuuuagguaugacuuug

SEQ ID NO: 107579 - RNA, 20 nt, Artificial Sequence
  MKO10107579_B_Pdgfra
  gRNA
ugaagaagacgaccccaacg

SEQ ID NO: 107580 - RNA, 20 nt, Artificial Sequence
  MKO10107580_B_Pdgfra
  gRNA
ggcauaaacauuaaacucgc

SEQ ID NO: 107581 - RNA, 20 nt, Artificial Sequence
  MKO10107581_B_Pdgfra
  gRNA
guaguagcaaguguaccauc

SEQ ID NO: 107582 - RNA, 20 nt, Artificial Sequence
  MKO10107582_B_Pdgfrb
  gRNA
cggucccaggagccauaaca

SEQ ID NO: 107583 - RNA, 20 nt, Artificial Sequence
  MKO10107583_B_Pdgfrb
  gRNA
ggccuagucaucacgccccc

SEQ ID NO: 107584 - RNA, 20 nt, Artificial Sequence
  MKO10107584_B_Pdgfrb
  gRNA
ucagugagugugaacgacca

SEQ ID NO: 107585 - RNA, 20 nt, Artificial Sequence
  MKO10107585_B_Pdgfrl
  gRNA
gacggggcugucacucgaca

SEQ ID NO: 107586 - RNA, 20 nt, Artificial Sequence
  MKO10107586_B_Pdgfrl
  gRNA
acaccggugaauucagcugc

SEQ ID NO: 107587 - RNA, 20 nt, Artificial Sequence
  MKO10107587_B_Pdgfrl
  gRNA
gugaagcagagugaacgcua

SEQ ID NO: 107588 - RNA, 20 nt, Artificial Sequence
  MKO10107588_B_Pdha1
  gRNA
uuucuaggcaagccgagugc

SEQ ID NO: 107589 - RNA, 20 nt, Artificial Sequence
  MKO10107589_B_Pdha1
  gRNA
cagugaugaggugguccgua

SEQ ID NO: 107590 - RNA, 20 nt, Artificial Sequence
  MKO10107590_B_Pdha1
  gRNA
ccauuucuaggacgaagagg

SEQ ID NO: 107591 - RNA, 20 nt, Artificial Sequence
  MKO10107591_B_Pdha2
  gRNA
uccauucucgccgagcugac

SEQ ID NO: 107592 - RNA, 20 nt, Artificial Sequence
  MKO10107592_B_Pdha2
  gRNA
cgugaacgauaacugauccc

SEQ ID NO: 107593 - RNA, 20 nt, Artificial Sequence
  MKO10107593_B_Pdha2
  gRNA
aauucggcgcauggaguuga

SEQ ID NO: 107594 - RNA, 20 nt, Artificial Sequence
  MKO10107594_B_Pdhb
  gRNA
gcuuuacagaugggcuuugc

SEQ ID NO: 107595 - RNA, 20 nt, Artificial Sequence
  MKO10107595_B_Pdhb
  gRNA
aaaacgccucuucagcagcc

SEQ ID NO: 107596 - RNA, 20 nt, Artificial Sequence
  MKO10107596_B_Pdhb
  gRNA
caucgacacccccaucucag

SEQ ID NO: 107597 - RNA, 20 nt, Artificial Sequence
  MKO10107597_B_Pdhx
  gRNA
uccagcugcccgcaacauuc

SEQ ID NO: 107598 - RNA, 20 nt, Artificial Sequence
  MKO10107598_B_Pdhx
  gRNA
aggagcacaaagggacggca

SEQ ID NO: 107599 - RNA, 20 nt, Artificial Sequence
  MKO10107599_B_Pdhx
  gRNA
agguggagcacugacauccu

SEQ ID NO: 107600 - RNA, 20 nt, Artificial Sequence
  MKO10107600_B_Pdia2
  gRNA
ugcuauguaugacgaggaag

SEQ ID NO: 107601 - RNA, 20 nt, Artificial Sequence
  MKO10107601_B_Pdia2
  gRNA
aaugaccaccauaucccauu

SEQ ID NO: 107602 - RNA, 20 nt, Artificial Sequence
  MKO10107602_B_Pdia2
  gRNA
ccaaacuucucaaaaaguug

SEQ ID NO: 107603 - RNA, 20 nt, Artificial Sequence
  MKO10107603_B_Pdia3
  gRNA
guaguuaucucucaaguugc

SEQ ID NO: 107604 - RNA, 20 nt, Artificial Sequence
  MKO10107604_B_Pdia3
  gRNA
gcugcagcaaccagauuaaa

SEQ ID NO: 107605 - RNA, 20 nt, Artificial Sequence
  MKO10107605_B_Pdia3
  gRNA
ccgaugcucaccuuugcuaa

SEQ ID NO: 107606 - RNA, 20 nt, Artificial Sequence
  MKO10107606_B_Pdia4
  gRNA
ccguugacuaugauggcucc

SEQ ID NO: 107607 - RNA, 20 nt, Artificial Sequence
  MKO10107607_B_Pdia4
  gRNA
gagaaguuucccagccugau

SEQ ID NO: 107608 - RNA, 20 nt, Artificial Sequence
  MKO10107608_B_Pdia4
  gRNA
ugacgaugacuuggaaguua

SEQ ID NO: 107609 - RNA, 20 nt, Artificial Sequence
  MKO10107609_B_Pdia5
  gRNA
aaggccaaggcaccgucugc

SEQ ID NO: 107610 - RNA, 20 nt, Artificial Sequence
  MKO10107610_B_Pdia5
  gRNA
gaaaguugaccucagcccaa

SEQ ID NO: 107611 - RNA, 20 nt, Artificial Sequence
  MKO10107611_B_Pdia5
  gRNA
ucaccuucaacgucacagcu

SEQ ID NO: 107612 - RNA, 20 nt, Artificial Sequence
  MKO10107612_B_Pdia6
  gRNA
guuagcuccaaauaucuuga

SEQ ID NO: 107613 - RNA, 20 nt, Artificial Sequence
  MKO10107613_B_Pdia6
  gRNA
accgcugacugcuagaaaga

SEQ ID NO: 107614 - RNA, 20 nt, Artificial Sequence
  MKO10107614_B_Pdia6
  gRNA
aaagguguggucacugccag

SEQ ID NO: 107615 - RNA, 20 nt, Artificial Sequence
  MKO10107615_B_Pdik1l
  gRNA
gaaguccgucccgcaugccg

SEQ ID NO: 107616 - RNA, 20 nt, Artificial Sequence
  MKO10107616_B_Pdik1l
  gRNA
acacaacaccguaacuaccu

SEQ ID NO: 107617 - RNA, 20 nt, Artificial Sequence
  MKO10107617_B_Pdik1l
  gRNA
ccagaagcgccuauuauuug

SEQ ID NO: 107618 - RNA, 20 nt, Artificial Sequence
  MKO10107618_B_Pdilt
  gRNA
ggcaaagccgcagagaucuu

SEQ ID NO: 107619 - RNA, 20 nt, Artificial Sequence
  MKO10107619_B_Pdilt
  gRNA
gucauaaagcaacagcucac

SEQ ID NO: 107620 - RNA, 20 nt, Artificial Sequence
  MKO10107620_B_Pdilt
  gRNA
gaagaagccaacgaugacca

SEQ ID NO: 107621 - RNA, 20 nt, Artificial Sequence
  MKO10107621_B_Pdk1
  gRNA
acaagaguugccuguuagau

SEQ ID NO: 107622 - RNA, 20 nt, Artificial Sequence
  MKO10107622_B_Pdk1
  gRNA
uagguauauccaaagccuuc

SEQ ID NO: 107623 - RNA, 20 nt, Artificial Sequence
  MKO10107623_B_Pdk1
  gRNA
caaugaugucauucccacca

SEQ ID NO: 107624 - RNA, 20 nt, Artificial Sequence
  MKO10107624_B_Pdk2
  gRNA
ugggcaccacgucauugugc

SEQ ID NO: 107625 - RNA, 20 nt, Artificial Sequence
  MKO10107625_B_Pdk2
  gRNA
gaacgggcagcuccugccgg

SEQ ID NO: 107626 - RNA, 20 nt, Artificial Sequence
  MKO10107626_B_Pdk2
  gRNA
aucgaugcugccaauguguu

SEQ ID NO: 107627 - RNA, 20 nt, Artificial Sequence
  MKO10107627_B_Pdk3
  gRNA
gguugguauaaaaccgaucc

SEQ ID NO: 107628 - RNA, 20 nt, Artificial Sequence
  MKO10107628_B_Pdk3
  gRNA
ccugcacauccgaaacauau

SEQ ID NO: 107629 - RNA, 20 nt, Artificial Sequence
  MKO10107629_B_Pdk3
  gRNA
ccaaggcgugauugaguaca

SEQ ID NO: 107630 - RNA, 20 nt, Artificial Sequence
  MKO10107630_B_Pdk4
  gRNA
ucgauacuuccaauguggcu

SEQ ID NO: 107631 - RNA, 20 nt, Artificial Sequence
  MKO10107631_B_Pdk4
  gRNA
uaucgacccaaacugugaug

SEQ ID NO: 107632 - RNA, 20 nt, Artificial Sequence
  MKO10107632_B_Pdk4
  gRNA
acaugaaccgcauuucuacu

SEQ ID NO: 107633 - RNA, 20 nt, Artificial Sequence
  MKO10107633_B_Pdlim1
  gRNA
uuccccuccucggucacuag

SEQ ID NO: 107634 - RNA, 20 nt, Artificial Sequence
  MKO10107634_B_Pdlim1
  gRNA
ccaggucacucccggaagca

SEQ ID NO: 107635 - RNA, 20 nt, Artificial Sequence
  MKO10107635_B_Pdlim1
  gRNA
cagaguccuugucaaugaua

SEQ ID NO: 107636 - RNA, 20 nt, Artificial Sequence
  MKO10107636_B_Pdlim2
  gRNA
gguggccaggguaggucaag

SEQ ID NO: 107637 - RNA, 20 nt, Artificial Sequence
  MKO10107637_B_Pdlim2
  gRNA
agugcuggcaaccagauucc

SEQ ID NO: 107638 - RNA, 20 nt, Artificial Sequence
  MKO10107638_B_Pdlim2
  gRNA
aggucccaaacagccucucc

SEQ ID NO: 107639 - RNA, 20 nt, Artificial Sequence
  MKO10107639_B_Pdlim3
  gRNA
cccagccgcuccucgccagu

SEQ ID NO: 107640 - RNA, 20 nt, Artificial Sequence
  MKO10107640_B_Pdlim3
  gRNA
ccagggcagaaacucgcuua

SEQ ID NO: 107641 - RNA, 20 nt, Artificial Sequence
  MKO10107641_B_Pdlim3
  gRNA
ugucaaucuugagacacaac

SEQ ID NO: 107642 - RNA, 20 nt, Artificial Sequence
  MKO10107642_B_Pdlim4
  gRNA
ccacgaucaucuuacgcucu

SEQ ID NO: 107643 - RNA, 20 nt, Artificial Sequence
  MKO10107643_B_Pdlim4
  gRNA
ucgggccugggaucuccaua

SEQ ID NO: 107644 - RNA, 20 nt, Artificial Sequence
  MKO10107644_B_Pdlim4
  gRNA
acacaugcagagcgcucauc

SEQ ID NO: 107645 - RNA, 20 nt, Artificial Sequence
  MKO10107645_B_Pdlim5
  gRNA
gacgugguucucagcaucga

SEQ ID NO: 107646 - RNA, 20 nt, Artificial Sequence
  MKO10107646_B_Pdlim5
  gRNA
cguaccuucuggacggaaac

SEQ ID NO: 107647 - RNA, 20 nt, Artificial Sequence
  MKO10107647_B_Pdlim5
  gRNA
agcugcagccaagagugagc

SEQ ID NO: 107648 - RNA, 20 nt, Artificial Sequence
  MKO10107648_B_Pdlim7
  gRNA
ugauggaggauaccgaagac

SEQ ID NO: 107649 - RNA, 20 nt, Artificial Sequence
  MKO10107649_B_Pdlim7
  gRNA
ggcucacccgagagauagag

SEQ ID NO: 107650 - RNA, 20 nt, Artificial Sequence
  MKO10107650_B_Pdlim7
  gRNA
cuuccgucugcaagggggca

SEQ ID NO: 107651 - RNA, 20 nt, Artificial Sequence
  MKO10107651_B_Pdp1
  gRNA
aggagaaugugugugugucc

SEQ ID NO: 107652 - RNA, 20 nt, Artificial Sequence
  MKO10107652_B_Pdp1
  gRNA
caucucauucgccaugcugu

SEQ ID NO: 107653 - RNA, 20 nt, Artificial Sequence
  MKO10107653_B_Pdp1
  gRNA
gccugcaaaugcacccauag

SEQ ID NO: 107654 - RNA, 20 nt, Artificial Sequence
  MKO10107654_B_Pdp2
  gRNA
cugagcugucccggcuuaag

SEQ ID NO: 107655 - RNA, 20 nt, Artificial Sequence
  MKO10107655_B_Pdp2
  gRNA
gggccacgcgugugcgcaag

SEQ ID NO: 107656 - RNA, 20 nt, Artificial Sequence
  MKO10107656_B_Pdp2
  gRNA
ucguggcagcccuugaguau

SEQ ID NO: 107657 - RNA, 20 nt, Artificial Sequence
  MKO10107657_B_Pdpk1
  gRNA
acugagcccgguucgucccc

SEQ ID NO: 107658 - RNA, 20 nt, Artificial Sequence
  MKO10107658_B_Pdpk1
  gRNA
guacuuacuagcauauucuc

SEQ ID NO: 107659 - RNA, 20 nt, Artificial Sequence
  MKO10107659_B_Pdpk1
  gRNA
cgcgcucaccagcuggcugg

SEQ ID NO: 107660 - RNA, 20 nt, Artificial Sequence
  MKO10107660_B_Pdpn
  gRNA
guuggcgucuuguuagccau

SEQ ID NO: 107661 - RNA, 20 nt, Artificial Sequence
  MKO10107661_B_Pdpn
  gRNA
gaguacaaccacugucaaag

SEQ ID NO: 107662 - RNA, 20 nt, Artificial Sequence
  MKO10107662_B_Pdpn
  gRNA
uggcuugccaguagucaccc

SEQ ID NO: 107663 - RNA, 20 nt, Artificial Sequence
  MKO10107663_B_Pdpr
  gRNA
cuucacguacugaucaaaaa

SEQ ID NO: 107664 - RNA, 20 nt, Artificial Sequence
  MKO10107664_B_Pdpr
  gRNA
cucugaagcguaucaacuca

SEQ ID NO: 107665 - RNA, 20 nt, Artificial Sequence
  MKO10107665_B_Pdpr
  gRNA
cggcacaguugacaaaauac

SEQ ID NO: 107666 - RNA, 20 nt, Artificial Sequence
  MKO10107666_B_Pdrg1
  gRNA
aaugccucacccuaagacga

SEQ ID NO: 107667 - RNA, 20 nt, Artificial Sequence
  MKO10107667_B_Pdrg1
  gRNA
uggaucauuuccuucgucuu

SEQ ID NO: 107668 - RNA, 20 nt, Artificial Sequence
  MKO10107668_B_Pdrg1
  gRNA
gcaacuuaccagagacacuc

SEQ ID NO: 107669 - RNA, 20 nt, Artificial Sequence
  MKO10107669_B_Pds5a
  gRNA
ucuauacagaccuugugugc

SEQ ID NO: 107670 - RNA, 20 nt, Artificial Sequence
  MKO10107670_B_Pds5a
  gRNA
uuuauuaccagacaguuaaa

SEQ ID NO: 107671 - RNA, 20 nt, Artificial Sequence
  MKO10107671_B_Pds5a
  gRNA
auugauuuaagaauuuagcu

SEQ ID NO: 107672 - RNA, 20 nt, Artificial Sequence
  MKO10107672_B_Pds5b
  gRNA
gcauaugaacuuucugauug

SEQ ID NO: 107673 - RNA, 20 nt, Artificial Sequence
  MKO10107673_B_Pds5b
  gRNA
caaagagcccucaauuuaau

SEQ ID NO: 107674 - RNA, 20 nt, Artificial Sequence
  MKO10107674_B_Pds5b
  gRNA
auauauuuauguuuauaaca

SEQ ID NO: 107675 - RNA, 20 nt, Artificial Sequence
  MKO10107675_B_Pdss1
  gRNA
ugugauauacuaugcauagu

SEQ ID NO: 107676 - RNA, 20 nt, Artificial Sequence
  MKO10107676_B_Pdss1
  gRNA
aaugauccacacugcuacuc

SEQ ID NO: 107677 - RNA, 20 nt, Artificial Sequence
  MKO10107677_B_Pdss1
  gRNA
gaugaugcaaguucucgaag

SEQ ID NO: 107678 - RNA, 20 nt, Artificial Sequence
  MKO10107678_B_Pdss2
  gRNA
gcucagcaauaucgccaugc

SEQ ID NO: 107679 - RNA, 20 nt, Artificial Sequence
  MKO10107679_B_Pdss2
  gRNA
uuacuaucccacgaugcacc

SEQ ID NO: 107680 - RNA, 20 nt, Artificial Sequence
  MKO10107680_B_Pdss2
  gRNA
cuuggugcauggaguauacc

SEQ ID NO: 107681 - RNA, 20 nt, Artificial Sequence
  MKO10107681_B_Pdx1
  gRNA
gcgagcgggggcacuucgua

SEQ ID NO: 107682 - RNA, 20 nt, Artificial Sequence
  MKO10107682_B_Pdx1
  gRNA
ggacccguacugccuacacc

SEQ ID NO: 107683 - RNA, 20 nt, Artificial Sequence
  MKO10107683_B_Pdx1
  gRNA
ccucccggaccuuucccgaa

SEQ ID NO: 107684 - RNA, 20 nt, Artificial Sequence
  MKO10107684_B_Pdxdc1
  gRNA
ggcaccuaccugccuuggag

SEQ ID NO: 107685 - RNA, 20 nt, Artificial Sequence
  MKO10107685_B_Pdxdc1
  gRNA
agacccuacauuagcugaaa

SEQ ID NO: 107686 - RNA, 20 nt, Artificial Sequence
  MKO10107686_B_Pdxdc1
  gRNA
aaaacuugaaagaggcgaug

SEQ ID NO: 107687 - RNA, 20 nt, Artificial Sequence
  MKO10107687_B_Pdxk
  gRNA
gggccaggugcugaaguccc

SEQ ID NO: 107688 - RNA, 20 nt, Artificial Sequence
  MKO10107688_B_Pdxk
  gRNA
uuccacuugucgcccaucac

SEQ ID NO: 107689 - RNA, 20 nt, Artificial Sequence
  MKO10107689_B_Pdxk
  gRNA
cgcagugugugacccuguga

SEQ ID NO: 107690 - RNA, 20 nt, Artificial Sequence
  MKO10107690_B_Pdxp
  gRNA
ggucacgcuggccagccguc

SEQ ID NO: 107691 - RNA, 20 nt, Artificial Sequence
  MKO10107691_B_Pdxp
  gRNA
cucgucguagccuacgagca

SEQ ID NO: 107692 - RNA, 20 nt, Artificial Sequence
  MKO10107692_B_Pdxp
  gRNA
cgcggcccugcgcgacgugc

SEQ ID NO: 107693 - RNA, 20 nt, Artificial Sequence
  MKO10107693_B_Pdyn
  gRNA
cgugaugcccucuaauguua

SEQ ID NO: 107694 - RNA, 20 nt, Artificial Sequence
  MKO10107694_B_Pdyn
  gRNA
uuccgagauggcccgggaug

SEQ ID NO: 107695 - RNA, 20 nt, Artificial Sequence
  MKO10107695_B_Pdyn
  gRNA
gcauucgccccaagcugaag

SEQ ID NO: 107696 - RNA, 20 nt, Artificial Sequence
  MKO10107696_B_Pdzd11
  gRNA
gucaacucauuguuguaguc

SEQ ID NO: 107697 - RNA, 20 nt, Artificial Sequence
  MKO10107697_B_Pdzd11
  gRNA
caucauucacagcuagaacu

SEQ ID NO: 107698 - RNA, 20 nt, Artificial Sequence
  MKO10107698_B_Pdzd11
  gRNA
gaugaagaugccuagcugcg

SEQ ID NO: 107699 - RNA, 20 nt, Artificial Sequence
  MKO10107699_B_Pdzd2
  gRNA
cuggacugacaacgaagacc

SEQ ID NO: 107700 - RNA, 20 nt, Artificial Sequence
  MKO10107700_B_Pdzd2
  gRNA
gaugaacugcuggugaucaa

SEQ ID NO: 107701 - RNA, 20 nt, Artificial Sequence
  MKO10107701_B_Pdzd2
  gRNA
gaggugagcgcuuugauccu

SEQ ID NO: 107702 - RNA, 20 nt, Artificial Sequence
  MKO10107702_B_Pdzd3
  gRNA
gaucgacccugcacaccaca

SEQ ID NO: 107703 - RNA, 20 nt, Artificial Sequence
  MKO10107703_B_Pdzd3
  gRNA
uugcucaacagacaaaagcg

SEQ ID NO: 107704 - RNA, 20 nt, Artificial Sequence
  MKO10107704_B_Pdzd3
  gRNA
ggggguuaccagauuggucc

SEQ ID NO: 107705 - RNA, 20 nt, Artificial Sequence
  MKO10107705_B_Pdzd4
  gRNA
cagcgccaugauaugcucga

SEQ ID NO: 107706 - RNA, 20 nt, Artificial Sequence
  MKO10107706_B_Pdzd4
  gRNA
cugugcgauagcacaccauc

SEQ ID NO: 107707 - RNA, 20 nt, Artificial Sequence
  MKO10107707_B_Pdzd4
  gRNA
guucauggagggcggcccgc

SEQ ID NO: 107708 - RNA, 20 nt, Artificial Sequence
  MKO10107708_B_Pdzd7
  gRNA
ugcgccggaccaucaugugu

SEQ ID NO: 107709 - RNA, 20 nt, Artificial Sequence
  MKO10107709_B_Pdzd7
  gRNA
gaagugcaguucaacgccgu

SEQ ID NO: 107710 - RNA, 20 nt, Artificial Sequence
  MKO10107710_B_Pdzd7
  gRNA
gucaucgaaccugacaccgu

SEQ ID NO: 107711 - RNA, 20 nt, Artificial Sequence
  MKO10107711_B_Pdzd8
  gRNA
cccaaacucaccugcugcga

SEQ ID NO: 107712 - RNA, 20 nt, Artificial Sequence
  MKO10107712_B_Pdzd8
  gRNA
acaaaggaguucuauuaaga

SEQ ID NO: 107713 - RNA, 20 nt, Artificial Sequence
  MKO10107713_B_Pdzd8
  gRNA
cuaacaauguaacuuuaagc

SEQ ID NO: 107714 - RNA, 20 nt, Artificial Sequence
  MKO10107714_B_Pdzd9
  gRNA
cugcggccccuuuauugaug

SEQ ID NO: 107715 - RNA, 20 nt, Artificial Sequence
  MKO10107715_B_Pdzd9
  gRNA
aauuuguagcacugucccua

SEQ ID NO: 107716 - RNA, 20 nt, Artificial Sequence
  MKO10107716_B_Pdzd9
  gRNA
cuacaaauuaaggcuuaccg

SEQ ID NO: 107717 - RNA, 20 nt, Artificial Sequence
  MKO10107717_B_Pdzk1ip1
  gRNA
gaaugccuacgagaauguuc

SEQ ID NO: 107718 - RNA, 20 nt, Artificial Sequence
  MKO10107718_B_Pdzk1ip1
  gRNA
gggagcacagugaugaucau

SEQ ID NO: 107719 - RNA, 20 nt, Artificial Sequence
  MKO10107719_B_Pdzk1ip1
  gRNA
ggauggcagauacuccucaa

SEQ ID NO: 107720 - RNA, 20 nt, Artificial Sequence
  MKO10107720_B_Pdzk1
  gRNA
gaugguaggucaaaucauua

SEQ ID NO: 107721 - RNA, 20 nt, Artificial Sequence
  MKO10107721_B_Pdzk1
  gRNA
ccuucuugaucacuaccacc

SEQ ID NO: 107722 - RNA, 20 nt, Artificial Sequence
  MKO10107722_B_Pdzk1
  gRNA
gaucacuugauugaagugaa

SEQ ID NO: 107723 - RNA, 20 nt, Artificial Sequence
  MKO10107723_B_Pdzrn3
  gRNA
aggcccgcugucaacuauuu

SEQ ID NO: 107724 - RNA, 20 nt, Artificial Sequence
  MKO10107724_B_Pdzrn3
  gRNA
auaucccccauguagucauu

SEQ ID NO: 107725 - RNA, 20 nt, Artificial Sequence
  MKO10107725_B_Pdzrn3
  gRNA
uaauccugucaugaauuugc

SEQ ID NO: 107726 - RNA, 20 nt, Artificial Sequence
  MKO10107726_B_Pdzrn4
  gRNA
cugccacucccuucauccga

SEQ ID NO: 107727 - RNA, 20 nt, Artificial Sequence
  MKO10107727_B_Pdzrn4
  gRNA
gcaagcuggagacguacuca

SEQ ID NO: 107728 - RNA, 20 nt, Artificial Sequence
  MKO10107728_B_Pdzrn4
  gRNA
gcccgugucuucuucaucau

SEQ ID NO: 107729 - RNA, 20 nt, Artificial Sequence
  MKO10107729_B_Pea15a
  gRNA
aaccuuuguccagcuuguug

SEQ ID NO: 107730 - RNA, 20 nt, Artificial Sequence
  MKO10107730_B_Pea15a
  gRNA
ccccuuguucaggccuucuu

SEQ ID NO: 107731 - RNA, 20 nt, Artificial Sequence
  MKO10107731_B_Pea15a
  gRNA
ugaagaagaaaucaucaaau

SEQ ID NO: 107732 - RNA, 20 nt, Artificial Sequence
  MKO10107732_B_Peak1
  gRNA
ccaguugggaucaauaucgu

SEQ ID NO: 107733 - RNA, 20 nt, Artificial Sequence
  MKO10107733_B_Peak1
  gRNA
gagucacucuccagucgacg

SEQ ID NO: 107734 - RNA, 20 nt, Artificial Sequence
  MKO10107734_B_Peak1
  gRNA
caaagaaucucgcacgaagu

SEQ ID NO: 107735 - RNA, 20 nt, Artificial Sequence
  MKO10107735_B_Pear1
  gRNA
gcaaaagcacgucccacucu

SEQ ID NO: 107736 - RNA, 20 nt, Artificial Sequence
  MKO10107736_B_Pear1
  gRNA
cagcuucaccacgaccacua

SEQ ID NO: 107737 - RNA, 20 nt, Artificial Sequence
  MKO10107737_B_Pear1
  gRNA
gcgcaggugggacuccuuag

SEQ ID NO: 107738 - RNA, 20 nt, Artificial Sequence
  MKO10107738_B_Pebp1
  gRNA
ugcccgccaccggggcuccc

SEQ ID NO: 107739 - RNA, 20 nt, Artificial Sequence
  MKO10107739_B_Pebp1
  gRNA
uggccgccgacaucagccag

SEQ ID NO: 107740 - RNA, 20 nt, Artificial Sequence
  MKO10107740_B_Pebp1
  gRNA
cagcucguccaccgucaccc

SEQ ID NO: 107741 - RNA, 20 nt, Artificial Sequence
  MKO10107741_B_Pebp4
  gRNA
uagcgguguagaccaguuuc

SEQ ID NO: 107742 - RNA, 20 nt, Artificial Sequence
  MKO10107742_B_Pebp4
  gRNA
acagggugcgcuguaccugc

SEQ ID NO: 107743 - RNA, 20 nt, Artificial Sequence
  MKO10107743_B_Pebp4
  gRNA
uuagaccugcugggggcauc

SEQ ID NO: 107744 - RNA, 20 nt, Artificial Sequence
  MKO10107744_B_Pecam1
  gRNA
ccuguccggauucaaauugc

SEQ ID NO: 107745 - RNA, 20 nt, Artificial Sequence
  MKO10107745_B_Pecam1
  gRNA
ucuuccagaugcaagccucc

SEQ ID NO: 107746 - RNA, 20 nt, Artificial Sequence
  MKO10107746_B_Pecam1
  gRNA
ccagcgugagucccagagcc

SEQ ID NO: 107747 - RNA, 20 nt, Artificial Sequence
  MKO10107747_B_Pecr
  gRNA
guugauccucacuccgcugc

SEQ ID NO: 107748 - RNA, 20 nt, Artificial Sequence
  MKO10107748_B_Pecr
  gRNA
aaaucuaccuuagcuaagua

SEQ ID NO: 107749 - RNA, 20 nt, Artificial Sequence
  MKO10107749_B_Pecr
  gRNA
cgugggccagcagcggagug

SEQ ID NO: 107750 - RNA, 20 nt, Artificial Sequence
  MKO10107750_B_Pef1
  gRNA
aggugguguccccccgaaug

SEQ ID NO: 107751 - RNA, 20 nt, Artificial Sequence
  MKO10107751_B_Pef1
  gRNA
uaauggagcccgagcggucc

SEQ ID NO: 107752 - RNA, 20 nt, Artificial Sequence
  MKO10107752_B_Pef1
  gRNA
uagcagagcgugcgcaguac

SEQ ID NO: 107753 - RNA, 20 nt, Artificial Sequence
  MKO10107753_B_Peg10
  gRNA
ccuucucucgaugugaauac

SEQ ID NO: 107754 - RNA, 20 nt, Artificial Sequence
  MKO10107754_B_Peg10
  gRNA
gacagcucugcgcgaauguc

SEQ ID NO: 107755 - RNA, 20 nt, Artificial Sequence
  MKO10107755_B_Peg10
  gRNA
gcauuggaguaguccacaac

SEQ ID NO: 107756 - RNA, 20 nt, Artificial Sequence
  MKO10107756_B_Peg12
  gRNA
cuccguagcagccgccucgc

SEQ ID NO: 107757 - RNA, 20 nt, Artificial Sequence
  MKO10107757_B_Peg12
  gRNA
ggccuuguccgccggcagcg

SEQ ID NO: 107758 - RNA, 20 nt, Artificial Sequence
  MKO10107758_B_Peg12
  gRNA
uucgcgagggcuacagcuac

SEQ ID NO: 107759 - RNA, 20 nt, Artificial Sequence
  MKO10107759_B_Peg3
  gRNA
ggaagagaaagaucccguug

SEQ ID NO: 107760 - RNA, 20 nt, Artificial Sequence
  MKO10107760_B_Peg3
  gRNA
ccucgaccaucucaugcuuu

SEQ ID NO: 107761 - RNA, 20 nt, Artificial Sequence
  MKO10107761_B_Peg3
  gRNA
cuacagaaagcugcucucgc

SEQ ID NO: 107762 - RNA, 20 nt, Artificial Sequence
  MKO10107762_B_Peli1
  gRNA
ucuucugugaacccauuacg

SEQ ID NO: 107763 - RNA, 20 nt, Artificial Sequence
  MKO10107763_B_Peli1
  gRNA
ucaguuacuacaaaaucaau

SEQ ID NO: 107764 - RNA, 20 nt, Artificial Sequence
  MKO10107764_B_Peli1
  gRNA
cuccuuccucuaucaccguu

SEQ ID NO: 107765 - RNA, 20 nt, Artificial Sequence
  MKO10107765_B_Peli2
  gRNA
ggcaucuucguucugaccgc

SEQ ID NO: 107766 - RNA, 20 nt, Artificial Sequence
  MKO10107766_B_Peli2
  gRNA
cccgcaaggaggcuucaccg

SEQ ID NO: 107767 - RNA, 20 nt, Artificial Sequence
  MKO10107767_B_Peli2
  gRNA
uguacuccaccacuaccguc

SEQ ID NO: 107768 - RNA, 20 nt, Artificial Sequence
  MKO10107768_B_Peli3
  gRNA
gcgggaauguguacacgcug

SEQ ID NO: 107769 - RNA, 20 nt, Artificial Sequence
  MKO10107769_B_Peli3
  gRNA
cggcuugccuuggagacgag

SEQ ID NO: 107770 - RNA, 20 nt, Artificial Sequence
  MKO10107770_B_Peli3
  gRNA
acuccggauggucugaugga

SEQ ID NO: 107771 - RNA, 20 nt, Artificial Sequence
  MKO10107771_B_Pelo
  gRNA
uggcggcuacucccgucagc

SEQ ID NO: 107772 - RNA, 20 nt, Artificial Sequence
  MKO10107772_B_Pelo
  gRNA
ggccaucgacuucgacuccc

SEQ ID NO: 107773 - RNA, 20 nt, Artificial Sequence
  MKO10107773_B_Pelo
  gRNA
gagcccgaccgagcguucua

SEQ ID NO: 107774 - RNA, 20 nt, Artificial Sequence
  MKO10107774_B_Pelp1
  gRNA
acagugugaacaaucagcuu

SEQ ID NO: 107775 - RNA, 20 nt, Artificial Sequence
  MKO10107775_B_Pelp1
  gRNA
gccaagaaacacaauguugc

SEQ ID NO: 107776 - RNA, 20 nt, Artificial Sequence
  MKO10107776_B_Pelp1
  gRNA
aaucucaguaaugcacaucu

SEQ ID NO: 107777 - RNA, 20 nt, Artificial Sequence
  MKO10107777_B_Pemt
  gRNA
cacauuucccuucagcgugc

SEQ ID NO: 107778 - RNA, 20 nt, Artificial Sequence
  MKO10107778_B_Pemt
  gRNA
uaugaugagccagcccaaga

SEQ ID NO: 107779 - RNA, 20 nt, Artificial Sequence
  MKO10107779_B_Pemt
  gRNA
ucauccacaggugacuacuu

SEQ ID NO: 107780 - RNA, 20 nt, Artificial Sequence
  MKO10107780_B_Penk
  gRNA
gauggacgagcuauauccca

SEQ ID NO: 107781 - RNA, 20 nt, Artificial Sequence
  MKO10107781_B_Penk
  gRNA
aagccucaggaaccgcgcca

SEQ ID NO: 107782 - RNA, 20 nt, Artificial Sequence
  MKO10107782_B_Penk
  gRNA
ccagaagaagaagcgaacgg

SEQ ID NO: 107783 - RNA, 20 nt, Artificial Sequence
  MKO10107783_B_Peo1
  gRNA
accugcagauaccguuuccc

SEQ ID NO: 107784 - RNA, 20 nt, Artificial Sequence
  MKO10107784_B_Peo1
  gRNA
accugaugcucuguuguccg

SEQ ID NO: 107785 - RNA, 20 nt, Artificial Sequence
  MKO10107785_B_Peo1
  gRNA
ccagccgugucacagcaaac

SEQ ID NO: 107786 - RNA, 20 nt, Artificial Sequence
  MKO10107786_B_Pepd
  gRNA
uucagggcgaauagugccag

SEQ ID NO: 107787 - RNA, 20 nt, Artificial Sequence
  MKO10107787_B_Pepd
  gRNA
ugauguccaguacacggaug

SEQ ID NO: 107788 - RNA, 20 nt, Artificial Sequence
  MKO10107788_B_Pepd
  gRNA
cgccucagcugucguguugc

SEQ ID NO: 107789 - RNA, 20 nt, Artificial Sequence
  MKO10107789_B_Per1
  gRNA
cgaauacacacuucgaaacc

SEQ ID NO: 107790 - RNA, 20 nt, Artificial Sequence
  MKO10107790_B_Per1
  gRNA
caucccguuugcaacgcagc

SEQ ID NO: 107791 - RNA, 20 nt, Artificial Sequence
  MKO10107791_B_Per1
  gRNA
ccugcucugagcucgcacuc

SEQ ID NO: 107792 - RNA, 20 nt, Artificial Sequence
  MKO10107792_B_Per2
  gRNA
gucucaccugcagccgcucg

SEQ ID NO: 107793 - RNA, 20 nt, Artificial Sequence
  MKO10107793_B_Per2
  gRNA
ucaccugcuucacgcuccgc

SEQ ID NO: 107794 - RNA, 20 nt, Artificial Sequence
  MKO10107794_B_Per2
  gRNA
cuucaagguugccagcgugc

SEQ ID NO: 107795 - RNA, 20 nt, Artificial Sequence
  MKO10107795_B_Per3
  gRNA
uggugcacauucauacugcg

SEQ ID NO: 107796 - RNA, 20 nt, Artificial Sequence
  MKO10107796_B_Per3
  gRNA
gcuuagugugccucucggcu

SEQ ID NO: 107797 - RNA, 20 nt, Artificial Sequence
  MKO10107797_B_Per3
  gRNA
guuaagagcaucuaggguac

SEQ ID NO: 107798 - RNA, 20 nt, Artificial Sequence
  MKO10107798_B_Perp
  gRNA
ggccgcccauccgaagccau

SEQ ID NO: 107799 - RNA, 20 nt, Artificial Sequence
  MKO10107799_B_Perp
  gRNA
cucucguucuucgcccugug

SEQ ID NO: 107800 - RNA, 20 nt, Artificial Sequence
  MKO10107800_B_Perp
  gRNA
cggucuuaccagccagugcg

SEQ ID NO: 107801 - RNA, 20 nt, Artificial Sequence
  MKO10107801_B_Pes1
  gRNA
aaccucaccugaagucaggc

SEQ ID NO: 107802 - RNA, 20 nt, Artificial Sequence
  MKO10107802_B_Pes1
  gRNA
cagggcucaccuuguacucu

SEQ ID NO: 107803 - RNA, 20 nt, Artificial Sequence
  MKO10107803_B_Pes1
  gRNA
aagccuauggaaagagcgaa

SEQ ID NO: 107804 - RNA, 20 nt, Artificial Sequence
  MKO10107804_B_Pet100
  gRNA
aagaauuuaagcagaagauc

SEQ ID NO: 107805 - RNA, 20 nt, Artificial Sequence
  MKO10107805_B_Pet100
  gRNA
gagcgagaugggggugaagc

SEQ ID NO: 107806 - RNA, 20 nt, Artificial Sequence
  MKO10107806_B_Pet100
  gRNA
accugacccuccuucucucu

SEQ ID NO: 107807 - RNA, 20 nt, Artificial Sequence
  MKO10107807_B_Pet112
  gRNA
ugccacuguccugcuccaac

SEQ ID NO: 107808 - RNA, 20 nt, Artificial Sequence
  MKO10107808_B_Pet112
  gRNA
gcuccaggaccacuucaaga

SEQ ID NO: 107809 - RNA, 20 nt, Artificial Sequence
  MKO10107809_B_Pet112
  gRNA
ugccaagccagucaucaccg

SEQ ID NO: 107810 - RNA, 20 nt, Artificial Sequence
  MKO10107810_B_Pet117
  gRNA
agcagaaagagagaagaugu

SEQ ID NO: 107811 - RNA, 20 nt, Artificial Sequence
  MKO10107811_B_Pet117
  gRNA
gggaaugucgaggaguucga

SEQ ID NO: 107812 - RNA, 20 nt, Artificial Sequence
  MKO10107812_B_Pet117
  gRNA
ccgccgucagcagcaccgag

SEQ ID NO: 107813 - RNA, 20 nt, Artificial Sequence
  MKO10107813_B_Pet2
  gRNA
ucaccaaacgcuuagucaug

SEQ ID NO: 107814 - RNA, 20 nt, Artificial Sequence
  MKO10107814_B_Pet2
  gRNA
ucaccagccuccaacucgua

SEQ ID NO: 107815 - RNA, 20 nt, Artificial Sequence
  MKO10107815_B_Pet2
  gRNA
ccuguuccaccguuaugagu

SEQ ID NO: 107816 - RNA, 20 nt, Artificial Sequence
  MKO10107816_B_Pex10
  gRNA
gaaagagaucgaguugcucu

SEQ ID NO: 107817 - RNA, 20 nt, Artificial Sequence
  MKO10107817_B_Pex10
  gRNA
gcugggagugcaucaccgag

SEQ ID NO: 107818 - RNA, 20 nt, Artificial Sequence
  MKO10107818_B_Pex10
  gRNA
cugccuccaucggcuccacg

SEQ ID NO: 107819 - RNA, 20 nt, Artificial Sequence
  MKO10107819_B_Pex11a
  gRNA
ccgagucgccaaccaaagcc

SEQ ID NO: 107820 - RNA, 20 nt, Artificial Sequence
  MKO10107820_B_Pex11a
  gRNA
ccuggcuuugguuggcgacu

SEQ ID NO: 107821 - RNA, 20 nt, Artificial Sequence
  MKO10107821_B_Pex11a
  gRNA
ccgugguacugaagcucaag

SEQ ID NO: 107822 - RNA, 20 nt, Artificial Sequence
  MKO10107822_B_Pex11b
  gRNA
aucucagaacgacaucugac

SEQ ID NO: 107823 - RNA, 20 nt, Artificial Sequence
  MKO10107823_B_Pex11b
  gRNA
uuaugagauucgccuauuga

SEQ ID NO: 107824 - RNA, 20 nt, Artificial Sequence
  MKO10107824_B_Pex11b
  gRNA
acagaaacagauucgacaac

SEQ ID NO: 107825 - RNA, 20 nt, Artificial Sequence
  MKO10107825_B_Pex11g
  gRNA
cugccgaugccaagguccuc

SEQ ID NO: 107826 - RNA, 20 nt, Artificial Sequence
  MKO10107826_B_Pex11g
  gRNA
uaagcuucagcauuguccac

SEQ ID NO: 107827 - RNA, 20 nt, Artificial Sequence
  MKO10107827_B_Pex11g
  gRNA
uuuaacucuacucagcaacc

SEQ ID NO: 107828 - RNA, 20 nt, Artificial Sequence
  MKO10107828_B_Pex12
  gRNA
acuaagcucuuucaguucuc

SEQ ID NO: 107829 - RNA, 20 nt, Artificial Sequence
  MKO10107829_B_Pex12
  gRNA
gagacccgcucuucagcaug

SEQ ID NO: 107830 - RNA, 20 nt, Artificial Sequence
  MKO10107830_B_Pex12
  gRNA
cgaccagccauccaucuuug

SEQ ID NO: 107831 - RNA, 20 nt, Artificial Sequence
  MKO10107831_B_Pex13
  gRNA
acucugcucuugcaacuacg

SEQ ID NO: 107832 - RNA, 20 nt, Artificial Sequence
  MKO10107832_B_Pex13
  gRNA
agucacuaccaccaauccuu

SEQ ID NO: 107833 - RNA, 20 nt, Artificial Sequence
  MKO10107833_B_Pex13
  gRNA
gaggaagaucaucuacacgg

SEQ ID NO: 107834 - RNA, 20 nt, Artificial Sequence
  MKO10107834_B_Pex14
  gRNA
cggcagcugugcccgacugc

SEQ ID NO: 107835 - RNA, 20 nt, Artificial Sequence
  MKO10107835_B_Pex14
  gRNA
aucucgccaucgggagccuc

SEQ ID NO: 107836 - RNA, 20 nt, Artificial Sequence
  MKO10107836_B_Pex14
  gRNA
ggccacuuaccuuguagagu

SEQ ID NO: 107837 - RNA, 20 nt, Artificial Sequence
  MKO10107837_B_Pex16
  gRNA
ugcgcaugcuccuguugauc

SEQ ID NO: 107838 - RNA, 20 nt, Artificial Sequence
  MKO10107838_B_Pex16
  gRNA
ugagagcaaugacgagccaa

SEQ ID NO: 107839 - RNA, 20 nt, Artificial Sequence
  MKO10107839_B_Pex16
  gRNA
uucagacagcucgugugaau

SEQ ID NO: 107840 - RNA, 20 nt, Artificial Sequence
  MKO10107840_B_Pex19
  gRNA
gguacagcacauccuuagac

SEQ ID NO: 107841 - RNA, 20 nt, Artificial Sequence
  MKO10107841_B_Pex19
  gRNA
ggccacuuaacgucuccuuu

SEQ ID NO: 107842 - RNA, 20 nt, Artificial Sequence
  MKO10107842_B_Pex19
  gRNA
gaacucgggcaugucugaag

SEQ ID NO: 107843 - RNA, 20 nt, Artificial Sequence
  MKO10107843_B_Pex1
  gRNA
ccuguuggcaagauaccaca

SEQ ID NO: 107844 - RNA, 20 nt, Artificial Sequence
  MKO10107844_B_Pex1
  gRNA
cgcuugagaguccaaguuuc

SEQ ID NO: 107845 - RNA, 20 nt, Artificial Sequence
  MKO10107845_B_Pex1
  gRNA
ccaaagcuguuguucccauc

SEQ ID NO: 107846 - RNA, 20 nt, Artificial Sequence
  MKO10107846_B_Pex26
  gRNA
gcgcucugcggccuucagcg

SEQ ID NO: 107847 - RNA, 20 nt, Artificial Sequence
  MKO10107847_B_Pex26
  gRNA
ucuggauccggcggaagagc

SEQ ID NO: 107848 - RNA, 20 nt, Artificial Sequence
  MKO10107848_B_Pex26
  gRNA
cugguaguaccggaggaccc

SEQ ID NO: 107849 - RNA, 20 nt, Artificial Sequence
  MKO10107849_B_Pex2
  gRNA
acuuugacagaacgccuccu

SEQ ID NO: 107850 - RNA, 20 nt, Artificial Sequence
  MKO10107850_B_Pex2
  gRNA
ggaugcacuugaacugaaua

SEQ ID NO: 107851 - RNA, 20 nt, Artificial Sequence
  MKO10107851_B_Pex2
  gRNA
aaccgucauuuagcgucuuu

SEQ ID NO: 107852 - RNA, 20 nt, Artificial Sequence
  MKO10107852_B_Pex3
  gRNA
cuuuaggccuucaaacaagc

SEQ ID NO: 107853 - RNA, 20 nt, Artificial Sequence
  MKO10107853_B_Pex3
  gRNA
caugcugccgacacugagag

SEQ ID NO: 107854 - RNA, 20 nt, Artificial Sequence
  MKO10107854_B_Pex3
  gRNA
cauauuuccagcuuguuuga

SEQ ID NO: 107855 - RNA, 20 nt, Artificial Sequence
  MKO10107855_B_Pex5l
  gRNA
aaugccaccucagcgucucc

SEQ ID NO: 107856 - RNA, 20 nt, Artificial Sequence
  MKO10107856_B_Pex5l
  gRNA
uaccuucucacuggccgaga

SEQ ID NO: 107857 - RNA, 20 nt, Artificial Sequence
  MKO10107857_B_Pex5l
  gRNA
gaauugcagcuuccaugaac

SEQ ID NO: 107858 - RNA, 20 nt, Artificial Sequence
  MKO10107858_B_Pex5
  gRNA
ugaacagucaaacuuucgcc

SEQ ID NO: 107859 - RNA, 20 nt, Artificial Sequence
  MKO10107859_B_Pex5
  gRNA
ugccaacccgcugaugaagc

SEQ ID NO: 107860 - RNA, 20 nt, Artificial Sequence
  MKO10107860_B_Pex5
  gRNA
gggauacaagaguugcauuc

SEQ ID NO: 107861 - RNA, 20 nt, Artificial Sequence
  MKO10107861_B_Pex6
  gRNA
ucgccucacuacagugcuaa

SEQ ID NO: 107862 - RNA, 20 nt, Artificial Sequence
  MKO10107862_B_Pex6
  gRNA
guguugugugugucaacagc

SEQ ID NO: 107863 - RNA, 20 nt, Artificial Sequence
  MKO10107863_B_Pex6
  gRNA
cauaccugggcagucucucc

SEQ ID NO: 107864 - RNA, 20 nt, Artificial Sequence
  MKO10107864_B_Pex7
  gRNA
gcgugugcucuuuauagacu

SEQ ID NO: 107865 - RNA, 20 nt, Artificial Sequence
  MKO10107865_B_Pex7
  gRNA
gugucauuuacagcacaauc

SEQ ID NO: 107866 - RNA, 20 nt, Artificial Sequence
  MKO10107866_B_Pex7
  gRNA
cuguggaacucuauuaguau

SEQ ID NO: 107867 - RNA, 20 nt, Artificial Sequence
  MKO10107867_B_Pf4
  gRNA
aagaucuccaucgcuuucuu

SEQ ID NO: 107868 - RNA, 20 nt, Artificial Sequence
  MKO10107868_B_Pf4
  gRNA
ccuguuguuucugccagcgg

SEQ ID NO: 107869 - RNA, 20 nt, Artificial Sequence
  MKO10107869_B_Pf4
  gRNA
gacagagccacccugaagaa

SEQ ID NO: 107870 - RNA, 20 nt, Artificial Sequence
  MKO10107870_B_Pfas
  gRNA
cuccaucgacauacuagcug

SEQ ID NO: 107871 - RNA, 20 nt, Artificial Sequence
  MKO10107871_B_Pfas
  gRNA
gcaacaucaucccgcaccaa

SEQ ID NO: 107872 - RNA, 20 nt, Artificial Sequence
  MKO10107872_B_Pfas
  gRNA
caccuccagcaacaaaucgu

SEQ ID NO: 107873 - RNA, 20 nt, Artificial Sequence
  MKO10107873_B_Pfdn1
  gRNA
ccuccuugacgcuccgcucc

SEQ ID NO: 107874 - RNA, 20 nt, Artificial Sequence
  MKO10107874_B_Pfdn1
  gRNA
uccgcgccaucagcaucucc

SEQ ID NO: 107875 - RNA, 20 nt, Artificial Sequence
  MKO10107875_B_Pfdn1
  gRNA
uagguuuauucuacagucca

SEQ ID NO: 107876 - RNA, 20 nt, Artificial Sequence
  MKO10107876_B_Pfdn2
  gRNA
gacccgcaagugcuaccgca

SEQ ID NO: 107877 - RNA, 20 nt, Artificial Sequence
  MKO10107877_B_Pfdn2
  gRNA
gcaaagaacugaacgaauuc

SEQ ID NO: 107878 - RNA, 20 nt, Artificial Sequence
  MKO10107878_B_Pfdn2
  gRNA
agccccucuguuccugccga

SEQ ID NO: 107879 - RNA, 20 nt, Artificial Sequence
  MKO10107879_B_Pfdn4
  gRNA
ugaugaaaacgucuccgauc

SEQ ID NO: 107880 - RNA, 20 nt, Artificial Sequence
  MKO10107880_B_Pfdn4
  gRNA
gagucgaaucacagagcuaa

SEQ ID NO: 107881 - RNA, 20 nt, Artificial Sequence
  MKO10107881_B_Pfdn4
  gRNA
gauggcggccaccaugaaga

SEQ ID NO: 107882 - RNA, 20 nt, Artificial Sequence
  MKO10107882_B_Pfdn5
  gRNA
cagcacguucagacaguccu

SEQ ID NO: 107883 - RNA, 20 nt, Artificial Sequence
  MKO10107883_B_Pfdn5
  gRNA
gaccaaguacguggaagcca

SEQ ID NO: 107884 - RNA, 20 nt, Artificial Sequence
  MKO10107884_B_Pfdn5
  gRNA
gcagaacuuacccugcuuca

SEQ ID NO: 107885 - RNA, 20 nt, Artificial Sequence
  MKO10107885_B_Pfkfb1
  gRNA
gugugcucuagcagcccuaa

SEQ ID NO: 107886 - RNA, 20 nt, Artificial Sequence
  MKO10107886_B_Pfkfb1
  gRNA
gauacuuauggacauccuuu

SEQ ID NO: 107887 - RNA, 20 nt, Artificial Sequence
  MKO10107887_B_Pfkfb1
  gRNA
auucuuucgcccagacaaca

SEQ ID NO: 107888 - RNA, 20 nt, Artificial Sequence
  MKO10107888_B_Pfkfb2
  gRNA
cuuucgacaugacaaugaag

SEQ ID NO: 107889 - RNA, 20 nt, Artificial Sequence
  MKO10107889_B_Pfkfb2
  gRNA
aacuaacacgcuaccucaac

SEQ ID NO: 107890 - RNA, 20 nt, Artificial Sequence
  MKO10107890_B_Pfkfb2
  gRNA
cccacucucuucaguaaaau

SEQ ID NO: 107891 - RNA, 20 nt, Artificial Sequence
  MKO10107891_B_Pfkfb3
  gRNA
uuggaacaccuauccaguug

SEQ ID NO: 107892 - RNA, 20 nt, Artificial Sequence
  MKO10107892_B_Pfkfb3
  gRNA
cguuggaacugacccagagc

SEQ ID NO: 107893 - RNA, 20 nt, Artificial Sequence
  MKO10107893_B_Pfkfb3
  gRNA
cuucuuccgcccugacaaug

SEQ ID NO: 107894 - RNA, 20 nt, Artificial Sequence
  MKO10107894_B_Pfkfb4
  gRNA
uaggcacgccaauccaguug

SEQ ID NO: 107895 - RNA, 20 nt, Artificial Sequence
  MKO10107895_B_Pfkfb4
  gRNA
uguacgucuugacuaugucc

SEQ ID NO: 107896 - RNA, 20 nt, Artificial Sequence
  MKO10107896_B_Pfkfb4
  gRNA
agaucaucgcucuccgcucu

SEQ ID NO: 107897 - RNA, 20 nt, Artificial Sequence
  MKO10107897_B_Pfkl
  gRNA
uccaucgauaacgacuucug

SEQ ID NO: 107898 - RNA, 20 nt, Artificial Sequence
  MKO10107898_B_Pfkl
  gRNA
cguuuccaauaucauccagc

SEQ ID NO: 107899 - RNA, 20 nt, Artificial Sequence
  MKO10107899_B_Pfkl
  gRNA
ccucaccagcuggaugauau

SEQ ID NO: 107900 - RNA, 20 nt, Artificial Sequence
  MKO10107900_B_Pfkm
  gRNA
cauugucgauugagccaacc

SEQ ID NO: 107901 - RNA, 20 nt, Artificial Sequence
  MKO10107901_B_Pfkm
  gRNA
cauagacacgcucucccacg

SEQ ID NO: 107902 - RNA, 20 nt, Artificial Sequence
  MKO10107902_B_Pfkm
  gRNA
ccgcgucuucuuuguccaug

SEQ ID NO: 107903 - RNA, 20 nt, Artificial Sequence
  MKO10107903_B_Pfkp
  gRNA
ugcgcaugggaaucuacacg

SEQ ID NO: 107904 - RNA, 20 nt, Artificial Sequence
  MKO10107904_B_Pfkp
  gRNA
gaaguauuccuaccucaacg

SEQ ID NO: 107905 - RNA, 20 nt, Artificial Sequence
  MKO10107905_B_Pfkp
  gRNA
ccaccauacccaccacguug

SEQ ID NO: 107906 - RNA, 20 nt, Artificial Sequence
  MKO10107906_B_Pfn1
  gRNA
cgucuugcagcagugagucc

SEQ ID NO: 107907 - RNA, 20 nt, Artificial Sequence
  MKO10107907_B_Pfn1
  gRNA
ucuuguugaucaaaccaccg

SEQ ID NO: 107908 - RNA, 20 nt, Artificial Sequence
  MKO10107908_B_Pfn1
  gRNA
uccagcgcuaguccugcuga

SEQ ID NO: 107909 - RNA, 20 nt, Artificial Sequence
  MKO10107909_B_Pfn2
  gRNA
agagauagccuauacguuga

SEQ ID NO: 107910 - RNA, 20 nt, Artificial Sequence
  MKO10107910_B_Pfn2
  gRNA
ucuuauucaauccgccucca

SEQ ID NO: 107911 - RNA, 20 nt, Artificial Sequence
  MKO10107911_B_Pfn2
  gRNA
gaauaagaaggcauacucaa

SEQ ID NO: 107912 - RNA, 20 nt, Artificial Sequence
  MKO10107912_B_Pfn3
  gRNA
gaucgugcacugucuuauug

SEQ ID NO: 107913 - RNA, 20 nt, Artificial Sequence
  MKO10107913_B_Pfn3
  gRNA
acacacagcgauuguccgag

SEQ ID NO: 107914 - RNA, 20 nt, Artificial Sequence
  MKO10107914_B_Pfn3
  gRNA
acucggacaaucgcugugug

SEQ ID NO: 107915 - RNA, 20 nt, Artificial Sequence
  MKO10107915_B_Pfn4
  gRNA
cuuacuguuagauacccugc

SEQ ID NO: 107916 - RNA, 20 nt, Artificial Sequence
  MKO10107916_B_Pfn4
  gRNA
ugccaccacaagauacaugu

SEQ ID NO: 107917 - RNA, 20 nt, Artificial Sequence
  MKO10107917_B_Pfn4
  gRNA
uucacccuuacacuaaaucc

SEQ ID NO: 107918 - RNA, 20 nt, Artificial Sequence
  MKO10107918_B_Pfpl
  gRNA
auguacgacagaauaucuug

SEQ ID NO: 107919 - RNA, 20 nt, Artificial Sequence
  MKO10107919_B_Pfpl
  gRNA
caguugugccgucaauuauc

SEQ ID NO: 107920 - RNA, 20 nt, Artificial Sequence
  MKO10107920_B_Pfpl
  gRNA
cagggaugaccaucgaaacc

SEQ ID NO: 107921 - RNA, 20 nt, Artificial Sequence
  MKO10107921_B_Pga5
  gRNA
ggaagaccgaagcggguuga

SEQ ID NO: 107922 - RNA, 20 nt, Artificial Sequence
  MKO10107922_B_Pga5
  gRNA
cacccgucuuugacaaccug

SEQ ID NO: 107923 - RNA, 20 nt, Artificial Sequence
  MKO10107923_B_Pga5
  gRNA
cagcauuggcacgcccccuc

SEQ ID NO: 107924 - RNA, 20 nt, Artificial Sequence
  MKO10107924_B_Pgam1
  gRNA
cugugcagaagagagcaauc

SEQ ID NO: 107925 - RNA, 20 nt, Artificial Sequence
  MKO10107925_B_Pgam1
  gRNA
gaugcuuaacgaugccccga

SEQ ID NO: 107926 - RNA, 20 nt, Artificial Sequence
  MKO10107926_B_Pgam1
  gRNA
ccccuccugugagagccuga

SEQ ID NO: 107927 - RNA, 20 nt, Artificial Sequence
  MKO10107927_B_Pgam2
  gRNA
ccccaggaccgccgcuaugc

SEQ ID NO: 107928 - RNA, 20 nt, Artificial Sequence
  MKO10107928_B_Pgam2
  gRNA
ugcuucagggauguccgacc

SEQ ID NO: 107929 - RNA, 20 nt, Artificial Sequence
  MKO10107929_B_Pgam2
  gRNA
cugguccagcucauacacaa

SEQ ID NO: 107930 - RNA, 20 nt, Artificial Sequence
  MKO10107930_B_Pgam5
  gRNA
gagucauaccuaaugguguc

SEQ ID NO: 107931 - RNA, 20 nt, Artificial Sequence
  MKO10107931_B_Pgam5
  gRNA
ggccuuauagugauccagcc

SEQ ID NO: 107932 - RNA, 20 nt, Artificial Sequence
  MKO10107932_B_Pgam5
  gRNA
ggggcuccgacuugcaagcc

SEQ ID NO: 107933 - RNA, 20 nt, Artificial Sequence
  MKO10107933_B_Pgap1
  gRNA
aagucaguccugaacgaacu

SEQ ID NO: 107934 - RNA, 20 nt, Artificial Sequence
  MKO10107934_B_Pgap1
  gRNA
ccuguaaugaaacgaucuaa

SEQ ID NO: 107935 - RNA, 20 nt, Artificial Sequence
  MKO10107935_B_Pgap1
  gRNA
aaugcacucguguacaaacu

SEQ ID NO: 107936 - RNA, 20 nt, Artificial Sequence
  MKO10107936_B_Pgap2
  gRNA
aggucccccaacgcuacgug

SEQ ID NO: 107937 - RNA, 20 nt, Artificial Sequence
  MKO10107937_B_Pgap2
  gRNA
uuaggacaacaguguacucc

SEQ ID NO: 107938 - RNA, 20 nt, Artificial Sequence
  MKO10107938_B_Pgap2
  gRNA
cacuguuguccuaaccaaca

SEQ ID NO: 107939 - RNA, 20 nt, Artificial Sequence
  MKO10107939_B_Pgap3
  gRNA
uacccaagcgaaggccaugc

SEQ ID NO: 107940 - RNA, 20 nt, Artificial Sequence
  MKO10107940_B_Pgap3
  gRNA
uguggcccuccugaagguag

SEQ ID NO: 107941 - RNA, 20 nt, Artificial Sequence
  MKO10107941_B_Pgap3
  gRNA
cucaggugucucucaaugcu

SEQ ID NO: 107942 - RNA, 20 nt, Artificial Sequence
  MKO10107942_B_Pgbd1
  gRNA
cagcucgaucacucuaaauu

SEQ ID NO: 107943 - RNA, 20 nt, Artificial Sequence
  MKO10107943_B_Pgbd1
  gRNA
guaacaucgaagauguaaca

SEQ ID NO: 107944 - RNA, 20 nt, Artificial Sequence
  MKO10107944_B_Pgbd1
  gRNA
guuacauccucaaccacugc

SEQ ID NO: 107945 - RNA, 20 nt, Artificial Sequence
  MKO10107945_B_Pgbd5
  gRNA
ccggagccugugccggaacg

SEQ ID NO: 107946 - RNA, 20 nt, Artificial Sequence
  MKO10107946_B_Pgbd5
  gRNA
gcaacaugucacugaucugc

SEQ ID NO: 107947 - RNA, 20 nt, Artificial Sequence
  MKO10107947_B_Pgbd5
  gRNA
ccacaggcgucaucaucaag

SEQ ID NO: 107948 - RNA, 20 nt, Artificial Sequence
  MKO10107948_B_Pgc
  gRNA
ugccaagguagacaccgaag

SEQ ID NO: 107949 - RNA, 20 nt, Artificial Sequence
  MKO10107949_B_Pgc
  gRNA
ucuggccagggucauacuug

SEQ ID NO: 107950 - RNA, 20 nt, Artificial Sequence
  MKO10107950_B_Pgc
  gRNA
aagaaccacaaguaugaccc

SEQ ID NO: 107951 - RNA, 20 nt, Artificial Sequence
  MKO10107951_B_Pgd
  gRNA
gaacacuuacugucgugucc

SEQ ID NO: 107952 - RNA, 20 nt, Artificial Sequence
  MKO10107952_B_Pgd
  gRNA
uacgggccgucacucaugcc

SEQ ID NO: 107953 - RNA, 20 nt, Artificial Sequence
  MKO10107953_B_Pgd
  gRNA
agagcugacauugcacugau

SEQ ID NO: 107954 - RNA, 20 nt, Artificial Sequence
  MKO10107954_B_Pgf
  gRNA
ucuugaagauuccccccaau

SEQ ID NO: 107955 - RNA, 20 nt, Artificial Sequence
  MKO10107955_B_Pgf
  gRNA
uugaguuguucccagcagac

SEQ ID NO: 107956 - RNA, 20 nt, Artificial Sequence
  MKO10107956_B_Pgf
  gRNA
ccgcagggggcccugucugc

SEQ ID NO: 107957 - RNA, 20 nt, Artificial Sequence
  MKO10107957_B_Pggu1b
  gRNA
acaaagacgauauaauagag

SEQ ID NO: 107958 - RNA, 20 nt, Artificial Sequence
  MKO10107958_B_Pggu1b
  gRNA
uuuccgagguucuucauacc

SEQ ID NO: 107959 - RNA, 20 nt, Artificial Sequence
  MKO10107959_B_Pggu1b
  gRNA
cagcuacauuagaagaagua

SEQ ID NO: 107960 - RNA, 20 nt, Artificial Sequence
  MKO10107960_B_Pgk1
  gRNA
accagauaacaaacaaccaa

SEQ ID NO: 107961 - RNA, 20 nt, Artificial Sequence
  MKO10107961_B_Pgk1
  gRNA
gauuugaguucagcagcaac

SEQ ID NO: 107962 - RNA, 20 nt, Artificial Sequence
  MKO10107962_B_Pgk1
  gRNA
uccaagcaucaaauucugcu

SEQ ID NO: 107963 - RNA, 20 nt, Artificial Sequence
  MKO10107963_B_Pgk2
  gRNA
auaugacguccuuguucagc

SEQ ID NO: 107964 - RNA, 20 nt, Artificial Sequence
  MKO10107964_B_Pgk2
  gRNA
cugcuacuugcugcgccaaa

SEQ ID NO: 107965 - RNA, 20 nt, Artificial Sequence
  MKO10107965_B_Pgk2
  gRNA
aggaugauagacccauuauc

SEQ ID NO: 107966 - RNA, 20 nt, Artificial Sequence
  MKO10107966_B_Pgls
  gRNA
cagcagagggcgcccgugcg

SEQ ID NO: 107967 - RNA, 20 nt, Artificial Sequence
  MKO10107967_B_Pgls
  gRNA
cccugaccauccccuccuac

SEQ ID NO: 107968 - RNA, 20 nt, Artificial Sequence
  MKO10107968_B_Pgls
  gRNA
cuuugggcugcguucagcac

SEQ ID NO: 107969 - RNA, 20 nt, Artificial Sequence
  MKO10107969_B_Pglyrp1
  gRNA
gaggacggucaugucuauga

SEQ ID NO: 107970 - RNA, 20 nt, Artificial Sequence
  MKO10107970_B_Pglyrp1
  gRNA
agcacggagggcccgcuuug

SEQ ID NO: 107971 - RNA, 20 nt, Artificial Sequence
  MKO10107971_B_Pglyrp1
  gRNA
caugaccguccucuccaaua

SEQ ID NO: 107972 - RNA, 20 nt, Artificial Sequence
  MKO10107972_B_Pglyrp2
  gRNA
uguuccgaaguaacuuccga

SEQ ID NO: 107973 - RNA, 20 nt, Artificial Sequence
  MKO10107973_B_Pglyrp2
  gRNA
ccugcgcgaauugcgcagcu

SEQ ID NO: 107974 - RNA, 20 nt, Artificial Sequence
  MKO10107974_B_Pglyrp2
  gRNA
caccugcuaagagaguacua

SEQ ID NO: 107975 - RNA, 20 nt, Artificial Sequence
  MKO10107975_B_Pglyrp3
  gRNA
ugggugacagguagccauuc

SEQ ID NO: 107976 - RNA, 20 nt, Artificial Sequence
  MKO10107976_B_Pglyrp3
  gRNA
cgcugcuuuaucagcuacag

SEQ ID NO: 107977 - RNA, 20 nt, Artificial Sequence
  MKO10107977_B_Pglyrp3
  gRNA
caggcucagugguacucugc

SEQ ID NO: 107978 - RNA, 20 nt, Artificial Sequence
  MKO10107978_B_Pglyrp4
  gRNA
cuugucauacaccauauccc

SEQ ID NO: 107979 - RNA, 20 nt, Artificial Sequence
  MKO10107979_B_Pglyrp4
  gRNA
caaacugaucaggugucaga

SEQ ID NO: 107980 - RNA, 20 nt, Artificial Sequence
  MKO10107980_B_Pglyrp4
  gRNA
gccaccugaggaugcugucc

SEQ ID NO: 107981 - RNA, 20 nt, Artificial Sequence
  MKO10107981_B_Pgm1
  gRNA
cauuucuagguuugcccggc

SEQ ID NO: 107982 - RNA, 20 nt, Artificial Sequence
  MKO10107982_B_Pgm1
  gRNA
ugcgacugcauuuaucaccc

SEQ ID NO: 107983 - RNA, 20 nt, Artificial Sequence
  MKO10107983_B_Pgm1
  gRNA
ugccucgcacaauccaaagc

SEQ ID NO: 107984 - RNA, 20 nt, Artificial Sequence
  MKO10107984_B_Pgm2l1
  gRNA
ucaggggauguacaaauacc

SEQ ID NO: 107985 - RNA, 20 nt, Artificial Sequence
  MKO10107985_B_Pgm2l1
  gRNA
ugcaggacuucgaucugcca

SEQ ID NO: 107986 - RNA, 20 nt, Artificial Sequence
  MKO10107986_B_Pgm2l1
  gRNA
uuguugugggcuaugacacu

SEQ ID NO: 107987 - RNA, 20 nt, Artificial Sequence
  MKO10107987_B_Pgm2
  gRNA
gaugcaagauacggcagggg

SEQ ID NO: 107988 - RNA, 20 nt, Artificial Sequence
  MKO10107988_B_Pgm2
  gRNA
acacaccccgucaccaucaa

SEQ ID NO: 107989 - RNA, 20 nt, Artificial Sequence
  MKO10107989_B_Pgm2
  gRNA
cuucgauugucuugcugauu

SEQ ID NO: 107990 - RNA, 20 nt, Artificial Sequence
  MKO10107990_B_Pgm3
  gRNA
aaugucucaccugauucgua

SEQ ID NO: 107991 - RNA, 20 nt, Artificial Sequence
  MKO10107991_B_Pgm3
  gRNA
ggggccaacauuucccccaa

SEQ ID NO: 107992 - RNA, 20 nt, Artificial Sequence
  MKO10107992_B_Pgm3
  gRNA
cacagcuucuuucuccacga

SEQ ID NO: 107993 - RNA, 20 nt, Artificial Sequence
  MKO10107993_B_Pgm5
  gRNA
aauucgaagaucuggacaua

SEQ ID NO: 107994 - RNA, 20 nt, Artificial Sequence
  MKO10107994_B_Pgm5
  gRNA
uagauuggucgacugauuau

SEQ ID NO: 107995 - RNA, 20 nt, Artificial Sequence
  MKO10107995_B_Pgm5
  gRNA
auccguguugaugcuaugca

SEQ ID NO: 107996 - RNA, 20 nt, Artificial Sequence
  MKO10107996_B_Pgpep1l
  gRNA
cucgcaaggcuuugcccaga

SEQ ID NO: 107997 - RNA, 20 nt, Artificial Sequence
  MKO10107997_B_Pgpep1l
  gRNA
gaacagugugguaagaaccg

SEQ ID NO: 107998 - RNA, 20 nt, Artificial Sequence
  MKO10107998_B_Pgpep1l
  gRNA
ggcuguugagaaugucgaag

SEQ ID NO: 107999 - RNA, 20 nt, Artificial Sequence
  MKO10107999_B_Pgpep1
  gRNA
gcauguguacgagauccccg

SEQ ID NO: 108000 - RNA, 20 nt, Artificial Sequence
  MKO10108000_B_Pgpep1
  gRNA
cugcaccgucugguauucca

SEQ ID NO: 108001 - RNA, 20 nt, Artificial Sequence
  MKO10108001_B_Pgpep1
  gRNA
caucgacuccaucaucgaca

SEQ ID NO: 108002 - RNA, 20 nt, Artificial Sequence
  MKO10108002_B_Pgp
  gRNA
caacccggagcgcaccguca

SEQ ID NO: 108003 - RNA, 20 nt, Artificial Sequence
  MKO10108003_B_Pgp
  gRNA
acgcugcuguucgacugcga

SEQ ID NO: 108004 - RNA, 20 nt, Artificial Sequence
  MKO10108004_B_Pgp
  gRNA
caccacuaccgcgcgcacgu

SEQ ID NO: 108005 - RNA, 20 nt, Artificial Sequence
  MKO10108005_B_Pgr15l
  gRNA
aaguaaguaucccgaguuga

SEQ ID NO: 108006 - RNA, 20 nt, Artificial Sequence
  MKO10108006_B_Pgr15l
  gRNA
ggcucggagaaaauaucagu

SEQ ID NO: 108007 - RNA, 20 nt, Artificial Sequence
  MKO10108007_B_Pgr15l
  gRNA
ugcaucugcucgucaacuca

SEQ ID NO: 108008 - RNA, 20 nt, Artificial Sequence
  MKO10108008_B_Pgrmc1
  gRNA
uugccggaagagaugcaucc

SEQ ID NO: 108009 - RNA, 20 nt, Artificial Sequence
  MKO10108009_B_Pgrmc1
  gRNA
gccccuggaugcaucucuuc

SEQ ID NO: 108010 - RNA, 20 nt, Artificial Sequence
  MKO10108010_B_Pgrmc1
  gRNA
aaccaaaagacgagacagcu

SEQ ID NO: 108011 - RNA, 20 nt, Artificial Sequence
  MKO10108011_B_Pgrmc2
  gRNA
uugcuggcagggacgccucc

SEQ ID NO: 108012 - RNA, 20 nt, Artificial Sequence
  MKO10108012_B_Pgrmc2
  gRNA
caccaaggaucacaguaaac

SEQ ID NO: 108013 - RNA, 20 nt, Artificial Sequence
  MKO10108013_B_Pgrmc2
  gRNA
guccuguuuacugugauccu

SEQ ID NO: 108014 - RNA, 20 nt, Artificial Sequence
  MKO10108014_B_Pgr
  gRNA
aggucguacaagcaugucag

SEQ ID NO: 108015 - RNA, 20 nt, Artificial Sequence
  MKO10108015_B_Pgr
  gRNA
cacuuucucagacgacaugc

SEQ ID NO: 108016 - RNA, 20 nt, Artificial Sequence
  MKO10108016_B_Pgr
  gRNA
cagaagaucugcuuaaucug

SEQ ID NO: 108017 - RNA, 20 nt, Artificial Sequence
  MKO10108017_B_Pgs1
  gRNA
agaguucuucgagcucauga

SEQ ID NO: 108018 - RNA, 20 nt, Artificial Sequence
  MKO10108018_B_Pgs1
  gRNA
ugccaucacaacucgccucu

SEQ ID NO: 108019 - RNA, 20 nt, Artificial Sequence
  MKO10108019_B_Pgs1
  gRNA
gaaguuuccuuccgaccuca

SEQ ID NO: 108020 - RNA, 20 nt, Artificial Sequence
  MKO10108020_B_Phacur1
  gRNA
auccuggccucugcgagaua

SEQ ID NO: 108021 - RNA, 20 nt, Artificial Sequence
  MKO10108021_B_Phacur1
  gRNA
uugaaggagaucuacgauaa

SEQ ID NO: 108022 - RNA, 20 nt, Artificial Sequence
  MKO10108022_B_Phacur1
  gRNA
ggcuccauuuccgacagagc

SEQ ID NO: 108023 - RNA, 20 nt, Artificial Sequence
  MKO10108023_B_Phacur2
  gRNA
gaucaggcaauuccuuaagc

SEQ ID NO: 108024 - RNA, 20 nt, Artificial Sequence
  MKO10108024_B_Phacur2
  gRNA
gauaagaaggggccugcuua

SEQ ID NO: 108025 - RNA, 20 nt, Artificial Sequence
  MKO10108025_B_Phacur2
  gRNA
gcuacccaagaggagaaugu

SEQ ID NO: 108026 - RNA, 20 nt, Artificial Sequence
  MKO10108026_B_Phacur3
  gRNA
ggauucgaacucccccugug

SEQ ID NO: 108027 - RNA, 20 nt, Artificial Sequence
  MKO10108027_B_Phacur3
  gRNA
uguaucauccagaugagcau

SEQ ID NO: 108028 - RNA, 20 nt, Artificial Sequence
  MKO10108028_B_Phacur3
  gRNA
uauaccgucugcauccacug

SEQ ID NO: 108029 - RNA, 20 nt, Artificial Sequence
  MKO10108029_B_Phacur4
  gRNA
aaaagcaaguucucagcguu

SEQ ID NO: 108030 - RNA, 20 nt, Artificial Sequence
  MKO10108030_B_Phacur4
  gRNA
agaaacagcaaccccaucau

SEQ ID NO: 108031 - RNA, 20 nt, Artificial Sequence
  MKO10108031_B_Phacur4
  gRNA
ccacccccauaggcagugcc

SEQ ID NO: 108032 - RNA, 20 nt, Artificial Sequence
  MKO10108032_B_Phax
  gRNA
uuccugggcuucgucgagag

SEQ ID NO: 108033 - RNA, 20 nt, Artificial Sequence
  MKO10108033_B_Phax
  gRNA
gagaugugucaucguccucc

SEQ ID NO: 108034 - RNA, 20 nt, Artificial Sequence
  MKO10108034_B_Phax
  gRNA
ucccaaguauccucacuacu

SEQ ID NO: 108035 - RNA, 20 nt, Artificial Sequence
  MKO10108035_B_Phb2
  gRNA
gcugccguccauuguuaaug

SEQ ID NO: 108036 - RNA, 20 nt, Artificial Sequence
  MKO10108036_B_Phb2
  gRNA
cccgccauuaccugaaguga

SEQ ID NO: 108037 - RNA, 20 nt, Artificial Sequence
  MKO10108037_B_Phb2
  gRNA
agagcugacagagcgcgcca

SEQ ID NO: 108038 - RNA, 20 nt, Artificial Sequence
  MKO10108038_B_Phb
  gRNA
ccagucaucacugguagcaa

SEQ ID NO: 108039 - RNA, 20 nt, Artificial Sequence
  MKO10108039_B_Phb
  gRNA
ccacagacacaucugaccuu

SEQ ID NO: 108040 - RNA, 20 nt, Artificial Sequence
  MKO10108040_B_Phb
  gRNA
ccuuugcuaccagugaugac

SEQ ID NO: 108041 - RNA, 20 nt, Artificial Sequence
  MKO10108041_B_Phc1
  gRNA
gcacugcuugccguucauac

SEQ ID NO: 108042 - RNA, 20 nt, Artificial Sequence
  MKO10108042_B_Phc1
  gRNA
ugcuaccacccugacgcagu

SEQ ID NO: 108043 - RNA, 20 nt, Artificial Sequence
  MKO10108043_B_Phc1
  gRNA
uggaaauauugagccgcauu

SEQ ID NO: 108044 - RNA, 20 nt, Artificial Sequence
  MKO10108044_B_Phc2
  gRNA
guagcucguaccuugcaggu

SEQ ID NO: 108045 - RNA, 20 nt, Artificial Sequence
  MKO10108045_B_Phc2
  gRNA
ggugggacgcucgucccugc

SEQ ID NO: 108046 - RNA, 20 nt, Artificial Sequence
  MKO10108046_B_Phc2
  gRNA
gugaaaaagucccacucguu

SEQ ID NO: 108047 - RNA, 20 nt, Artificial Sequence
  MKO10108047_B_Phc3
  gRNA
guaccugcagcagauguacg

SEQ ID NO: 108048 - RNA, 20 nt, Artificial Sequence
  MKO10108048_B_Phc3
  gRNA
gauguaucuccgagcucaga

SEQ ID NO: 108049 - RNA, 20 nt, Artificial Sequence
  MKO10108049_B_Phc3
  gRNA
ggauguagauggucuuccac

SEQ ID NO: 108050 - RNA, 20 nt, Artificial Sequence
  MKO10108050_B_Phex
  gRNA
uggagaaaucagucagccga

SEQ ID NO: 108051 - RNA, 20 nt, Artificial Sequence
  MKO10108051_B_Phex
  gRNA
ccuaaguuuccaagcuaaac

SEQ ID NO: 108052 - RNA, 20 nt, Artificial Sequence
  MKO10108052_B_Phex
  gRNA
ccugaagauaugccaagcua

SEQ ID NO: 108053 - RNA, 20 nt, Artificial Sequence
  MKO10108053_B_Phf10
  gRNA
uaguauucuccuguuucauc

SEQ ID NO: 108054 - RNA, 20 nt, Artificial Sequence
  MKO10108054_B_Phf10
  gRNA
ugaugacguuuaauucucuc

SEQ ID NO: 108055 - RNA, 20 nt, Artificial Sequence
  MKO10108055_B_Phf10
  gRNA
uccauguaaaaggaggcgaa

SEQ ID NO: 108056 - RNA, 20 nt, Artificial Sequence
  MKO10108056_B_Phf11a
  gRNA
aaccugcagcuguauucauc

SEQ ID NO: 108057 - RNA, 20 nt, Artificial Sequence
  MKO10108057_B_Phf11a
  gRNA
ucaaaguuucuaacuguauu

SEQ ID NO: 108058 - RNA, 20 nt, Artificial Sequence
  MKO10108058_B_Phf11a
  gRNA
caucaacuuguagaauugcg

SEQ ID NO: 108059 - RNA, 20 nt, Artificial Sequence
  MKO10108059_B_Phf11b
  gRNA
auccugcagcuguauucauc

SEQ ID NO: 108060 - RNA, 20 nt, Artificial Sequence
  MKO10108060_B_Phf11b
  gRNA
caucaacuuguagaauugcg

SEQ ID NO: 108061 - RNA, 20 nt, Artificial Sequence
  MKO10108061_B_Phf11b
  gRNA
uuaccacuuauccugugcca

SEQ ID NO: 108062 - RNA, 20 nt, Artificial Sequence
  MKO10108062_B_Phf11c
  gRNA
acauccuccacaacaagaag

SEQ ID NO: 108063 - RNA, 20 nt, Artificial Sequence
  MKO10108063_B_Phf11c
  gRNA
ucuuguuguggaggauguuc

SEQ ID NO: 108064 - RNA, 20 nt, Artificial Sequence
  MKO10108064_B_Phf11c
  gRNA
agaaagaaacgccucucauc

SEQ ID NO: 108065 - RNA, 20 nt, Artificial Sequence
  MKO10108065_B_Phf11d
  gRNA
acauucuccagaacaagaag

SEQ ID NO: 108066 - RNA, 20 nt, Artificial Sequence
  MKO10108066_B_Phf11d
  gRNA
ucuuguucuggagaauguuc

SEQ ID NO: 108067 - RNA, 20 nt, Artificial Sequence
  MKO10108067_B_Phf11d
  gRNA
caguccaaucauagaaaaga

SEQ ID NO: 108068 - RNA, 20 nt, Artificial Sequence
  MKO10108068_B_Phf12
  gRNA
ucgcuaaccugguagugcag

SEQ ID NO: 108069 - RNA, 20 nt, Artificial Sequence
  MKO10108069_B_Phf12
  gRNA
cgacagcugcgauagcugca

SEQ ID NO: 108070 - RNA, 20 nt, Artificial Sequence
  MKO10108070_B_Phf12
  gRNA
cagcaugaguuagaccauaa

SEQ ID NO: 108071 - RNA, 20 nt, Artificial Sequence
  MKO10108071_B_Phf13
  gRNA
gaccauugacagcgacggcu

SEQ ID NO: 108072 - RNA, 20 nt, Artificial Sequence
  MKO10108072_B_Phf13
  gRNA
gcccgcauaugccaagacga

SEQ ID NO: 108073 - RNA, 20 nt, Artificial Sequence
  MKO10108073_B_Phf13
  gRNA
aguacucccccacuuguaag

SEQ ID NO: 108074 - RNA, 20 nt, Artificial Sequence
  MKO10108074_B_Phf14
  gRNA
cuagguuguuauggagucga

SEQ ID NO: 108075 - RNA, 20 nt, Artificial Sequence
  MKO10108075_B_Phf14
  gRNA
aggagauacaccacauuuac

SEQ ID NO: 108076 - RNA, 20 nt, Artificial Sequence
  MKO10108076_B_Phf14
  gRNA
uaucauaaucaagagcuucc

SEQ ID NO: 108077 - RNA, 20 nt, Artificial Sequence
  MKO10108077_B_Phf19
  gRNA
ccaguuggcaucaacugcga

SEQ ID NO: 108078 - RNA, 20 nt, Artificial Sequence
  MKO10108078_B_Phf19
  gRNA
augaacgagauccucaucug

SEQ ID NO: 108079 - RNA, 20 nt, Artificial Sequence
  MKO10108079_B_Phf19
  gRNA
gcccaagugugacgucugca

SEQ ID NO: 108080 - RNA, 20 nt, Artificial Sequence
  MKO10108080_B_Phf1
  gRNA
ugaggacgauucccaguuuc

SEQ ID NO: 108081 - RNA, 20 nt, Artificial Sequence
  MKO10108081_B_Phf1
  gRNA
ucccuaugcccgggccaugc

SEQ ID NO: 108082 - RNA, 20 nt, Artificial Sequence
  MKO10108082_B_Phf1
  gRNA
agcugugagaagugucgcca

SEQ ID NO: 108083 - RNA, 20 nt, Artificial Sequence
  MKO10108083_B_Phf20l1
  gRNA
gaugacuccagcgcucaaaa

SEQ ID NO: 108084 - RNA, 20 nt, Artificial Sequence
  MKO10108084_B_Phf20l1
  gRNA
uuuguuaauugcuucaaucu

SEQ ID NO: 108085 - RNA, 20 nt, Artificial Sequence
  MKO10108085_B_Phf20l1
  gRNA
gcacauuaaagccaugccug

SEQ ID NO: 108086 - RNA, 20 nt, Artificial Sequence
  MKO10108086_B_Phf20
  gRNA
gaggguuuacaugaugagga

SEQ ID NO: 108087 - RNA, 20 nt, Artificial Sequence
  MKO10108087_B_Phf20
  gRNA
cuuguucacagcagugacuc

SEQ ID NO: 108088 - RNA, 20 nt, Artificial Sequence
  MKO10108088_B_Phf20
  gRNA
cagagucacugcugugaaca

SEQ ID NO: 108089 - RNA, 20 nt, Artificial Sequence
  MKO10108089_B_Phf21a
  gRNA
ggcucuuaaaguggaaauuc

SEQ ID NO: 108090 - RNA, 20 nt, Artificial Sequence
  MKO10108090_B_Phf21a
  gRNA
accugugaugcaguuagacu

SEQ ID NO: 108091 - RNA, 20 nt, Artificial Sequence
  MKO10108091_B_Phf21a
  gRNA
ccuguggauccugcuucauu

SEQ ID NO: 108092 - RNA, 20 nt, Artificial Sequence
  MKO10108092_B_Phf21b
  gRNA
ucgggcucugcugaacucuc

SEQ ID NO: 108093 - RNA, 20 nt, Artificial Sequence
  MKO10108093_B_Phf21b
  gRNA
ucaagaagcagcuccacgaa

SEQ ID NO: 108094 - RNA, 20 nt, Artificial Sequence
  MKO10108094_B_Phf21b
  gRNA
ggaagaucagccccccagca

SEQ ID NO: 108095 - RNA, 20 nt, Artificial Sequence
  MKO10108095_B_Phf23
  gRNA
uuacauccccccuagcaaag

SEQ ID NO: 108096 - RNA, 20 nt, Artificial Sequence
  MKO10108096_B_Phf23
  gRNA
ggaaguaugcgucaaugaug

SEQ ID NO: 108097 - RNA, 20 nt, Artificial Sequence
  MKO10108097_B_Phf23
  gRNA
ccauuuagccaccggagaaa

SEQ ID NO: 108098 - RNA, 20 nt, Artificial Sequence
  MKO10108098_B_Phf2
  gRNA
aacauucuacgugagugaug

SEQ ID NO: 108099 - RNA, 20 nt, Artificial Sequence
  MKO10108099_B_Phf2
  gRNA
gacgugaaaccagugcagaa

SEQ ID NO: 108100 - RNA, 20 nt, Artificial Sequence
  MKO10108100_B_Phf2
  gRNA
acucacguguggacuugcca

SEQ ID NO: 108101 - RNA, 20 nt, Artificial Sequence
  MKO10108101_B_Phf3
  gRNA
uuaccuugugccauuaaacg

SEQ ID NO: 108102 - RNA, 20 nt, Artificial Sequence
  MKO10108102_B_Phf3
  gRNA
aagaaaaucaccucguuuaa

SEQ ID NO: 108103 - RNA, 20 nt, Artificial Sequence
  MKO10108103_B_Phf3
  gRNA
ugagccaaccacauuuaccu

SEQ ID NO: 108104 - RNA, 20 nt, Artificial Sequence
  MKO10108104_B_Phf5a
  gRNA
cacccacaccagccugcuug

SEQ ID NO: 108105 - RNA, 20 nt, Artificial Sequence
  MKO10108105_B_Phf5a
  gRNA
uuguccaaagauugucaauu

SEQ ID NO: 108106 - RNA, 20 nt, Artificial Sequence
  MKO10108106_B_Phf5a
  gRNA
acucacauccuucuccugaa

SEQ ID NO: 108107 - RNA, 20 nt, Artificial Sequence
  MKO10108107_B_Phf6
  gRNA
caagaaaacugcacauaacu

SEQ ID NO: 108108 - RNA, 20 nt, Artificial Sequence
  MKO10108108_B_Phf6
  gRNA
acuaagaagaaaagucgcaa

SEQ ID NO: 108109 - RNA, 20 nt, Artificial Sequence
  MKO10108109_B_Phf6
  gRNA
cauucugauaaugagagucu

SEQ ID NO: 108110 - RNA, 20 nt, Artificial Sequence
  MKO10108110_B_Phf7
  gRNA
ucuggacacacugaucauuc

SEQ ID NO: 108111 - RNA, 20 nt, Artificial Sequence
  MKO10108111_B_Phf7
  gRNA
gucuagcagacugccucaga

SEQ ID NO: 108112 - RNA, 20 nt, Artificial Sequence
  MKO10108112_B_Phf7
  gRNA
aggaagcugucuucaagucc

SEQ ID NO: 108113 - RNA, 20 nt, Artificial Sequence
  MKO10108113_B_Phf8
  gRNA
aaguucugccccgaaguucu

SEQ ID NO: 108114 - RNA, 20 nt, Artificial Sequence
  MKO10108114_B_Phf8
  gRNA
uuaccacugcccuaacugug

SEQ ID NO: 108115 - RNA, 20 nt, Artificial Sequence
  MKO10108115_B_Phf8
  gRNA
acaucccucacagugaauga

SEQ ID NO: 108116 - RNA, 20 nt, Artificial Sequence
  MKO10108116_B_Phgdh
  gRNA
accucuuaccuucauuccaa

SEQ ID NO: 108117 - RNA, 20 nt, Artificial Sequence
  MKO10108117_B_Phgdh
  gRNA
gccacccgaaugcaauccuu

SEQ ID NO: 108118 - RNA, 20 nt, Artificial Sequence
  MKO10108118_B_Phgdh
  gRNA
acugugaaggccucauuguc

SEQ ID NO: 108119 - RNA, 20 nt, Artificial Sequence
  MKO10108119_B_Phgr1
  gRNA
ggugguccacacccuggcca

SEQ ID NO: 108120 - RNA, 20 nt, Artificial Sequence
  MKO10108120_B_Phgr1
  gRNA
gggugagggccacagugccc

SEQ ID NO: 108121 - RNA, 20 nt, Artificial Sequence
  MKO10108121_B_Phgr1
  gRNA
ugucccucaugacagugucc

SEQ ID NO: 108122 - RNA, 20 nt, Artificial Sequence
  MKO10108122_B_Phip
  gRNA
ccuaguaaagucuguacucc

SEQ ID NO: 108123 - RNA, 20 nt, Artificial Sequence
  MKO10108123_B_Phip
  gRNA
cauauuugcagcaagugauc

SEQ ID NO: 108124 - RNA, 20 nt, Artificial Sequence
  MKO10108124_B_Phip
  gRNA
ccuccuucucggccacuucg

SEQ ID NO: 108125 - RNA, 20 nt, Artificial Sequence
  MKO10108125_B_Phka1
  gRNA
agauaauguguacaguaucc

SEQ ID NO: 108126 - RNA, 20 nt, Artificial Sequence
  MKO10108126_B_Phka1
  gRNA
gcugcacugcaugaucagac

SEQ ID NO: 108127 - RNA, 20 nt, Artificial Sequence
  MKO10108127_B_Phka1
  gRNA
cagaaguagcauccaacugc

SEQ ID NO: 108128 - RNA, 20 nt, Artificial Sequence
  MKO10108128_B_Phka2
  gRNA
ggacaauaucuauagcauau

SEQ ID NO: 108129 - RNA, 20 nt, Artificial Sequence
  MKO10108129_B_Phka2
  gRNA
gcuugggcgagaugcggagc

SEQ ID NO: 108130 - RNA, 20 nt, Artificial Sequence
  MKO10108130_B_Phka2
  gRNA
acccaccacagugcuacaug

SEQ ID NO: 108131 - RNA, 20 nt, Artificial Sequence
  MKO10108131_B_Phkb
  gRNA
gaccugauaaugaaacucua

SEQ ID NO: 108132 - RNA, 20 nt, Artificial Sequence
  MKO10108132_B_Phkb
  gRNA
aauuccucucauacacuuua

SEQ ID NO: 108133 - RNA, 20 nt, Artificial Sequence
  MKO10108133_B_Phkb
  gRNA
ucccauagaguuucauuauc

SEQ ID NO: 108134 - RNA, 20 nt, Artificial Sequence
  MKO10108134_B_Phkg1
  gRNA
gaagccggagaauauccuuu

SEQ ID NO: 108135 - RNA, 20 nt, Artificial Sequence
  MKO10108135_B_Phkg1
  gRNA
gcuucgggaagccacccuga

SEQ ID NO: 108136 - RNA, 20 nt, Artificial Sequence
  MKO10108136_B_Phkg1
  gRNA
ucuccggcuucaggucccga

SEQ ID NO: 108137 - RNA, 20 nt, Artificial Sequence
  MKO10108137_B_Phkg2
  gRNA
caaucccuuaggaugcggaa

SEQ ID NO: 108138 - RNA, 20 nt, Artificial Sequence
  MKO10108138_B_Phkg2
  gRNA
ugacuaucucaccgagaaag

SEQ ID NO: 108139 - RNA, 20 nt, Artificial Sequence
  MKO10108139_B_Phkg2
  gRNA
cagauacgccuuucagauuu

SEQ ID NO: 108140 - RNA, 20 nt, Artificial Sequence
  MKO10108140_B_Phlda1
  gRNA
gccacuagguugggacgguu

SEQ ID NO: 108141 - RNA, 20 nt, Artificial Sequence
  MKO10108141_B_Phlda1
  gRNA
gccgaaccgucccaaccuag

SEQ ID NO: 108142 - RNA, 20 nt, Artificial Sequence
  MKO10108142_B_Phlda1
  gRNA
ccgcccggagcgcgcagaga

SEQ ID NO: 108143 - RNA, 20 nt, Artificial Sequence
  MKO10108143_B_Phlda2
  gRNA
cuccgacgagauccuuugcg

SEQ ID NO: 108144 - RNA, 20 nt, Artificial Sequence
  MKO10108144_B_Phlda2
  gRNA
gcuccacgcaguccaccuug

SEQ ID NO: 108145 - RNA, 20 nt, Artificial Sequence
  MKO10108145_B_Phlda2
  gRNA
caucgucaccaacuauuaca

SEQ ID NO: 108146 - RNA, 20 nt, Artificial Sequence
  MKO10108146_B_Phlda3
  gRNA
gucgaucucgcccccgccuu

SEQ ID NO: 108147 - RNA, 20 nt, Artificial Sequence
  MKO10108147_B_Phlda3
  gRNA
ucacuagcgugaaguagaug

SEQ ID NO: 108148 - RNA, 20 nt, Artificial Sequence
  MKO10108148_B_Phlda3
  gRNA
gaagagcugcagcccgcgcu

SEQ ID NO: 108149 - RNA, 20 nt, Artificial Sequence
  MKO10108149_B_Phldb1
  gRNA
cccgucucaaucagauccaa

SEQ ID NO: 108150 - RNA, 20 nt, Artificial Sequence
  MKO10108150_B_Phldb1
  gRNA
acucucacccuguacccuug

SEQ ID NO: 108151 - RNA, 20 nt, Artificial Sequence
  MKO10108151_B_Phldb1
  gRNA
ccuggggcccggaccccugc

SEQ ID NO: 108152 - RNA, 20 nt, Artificial Sequence
  MKO10108152_B_Phldb2
  gRNA
ugcaauggaagacgcccgga

SEQ ID NO: 108153 - RNA, 20 nt, Artificial Sequence
  MKO10108153_B_Phldb2
  gRNA
gucuguguucgaggacgcuc

SEQ ID NO: 108154 - RNA, 20 nt, Artificial Sequence
  MKO10108154_B_Phldb2
  gRNA
ggauauggaaugcgcucuuu

SEQ ID NO: 108155 - RNA, 20 nt, Artificial Sequence
  MKO10108155_B_Phldb3
  gRNA
ucggcugggucuccacccgc

SEQ ID NO: 108156 - RNA, 20 nt, Artificial Sequence
  MKO10108156_B_Phldb3
  gRNA
ggaguuacagcgccagaaga

SEQ ID NO: 108157 - RNA, 20 nt, Artificial Sequence
  MKO10108157_B_Phldb3
  gRNA
ucuccacaugaucccgcucc

SEQ ID NO: 108158 - RNA, 20 nt, Artificial Sequence
  MKO10108158_B_Phlpp1
  gRNA
cuguuuagcguucagcucuu

SEQ ID NO: 108159 - RNA, 20 nt, Artificial Sequence
  MKO10108159_B_Phlpp1
  gRNA
aaaggcuccuaggugguuau

SEQ ID NO: 108160 - RNA, 20 nt, Artificial Sequence
  MKO10108160_B_Phlpp1
  gRNA
uugcaguucaccaaguccuc

SEQ ID NO: 108161 - RNA, 20 nt, Artificial Sequence
  MKO10108161_B_Phlpp2
  gRNA
agccuccuccuguaugcgca

SEQ ID NO: 108162 - RNA, 20 nt, Artificial Sequence
  MKO10108162_B_Phlpp2
  gRNA
cuggaucgaauccuacuguc

SEQ ID NO: 108163 - RNA, 20 nt, Artificial Sequence
  MKO10108163_B_Phlpp2
  gRNA
ccagcgucagaaauaugugc

SEQ ID NO: 108164 - RNA, 20 nt, Artificial Sequence
  MKO10108164_B_Phospho1
  gRNA
ucgaucgugcgugccgcgcc

SEQ ID NO: 108165 - RNA, 20 nt, Artificial Sequence
  MKO10108165_B_Phospho1
  gRNA
auuguaguagcccucgcgau

SEQ ID NO: 108166 - RNA, 20 nt, Artificial Sequence
  MKO10108166_B_Phospho1
  gRNA
ccugcgugccaccuaucgcg

SEQ ID NO: 108167 - RNA, 20 nt, Artificial Sequence
  MKO10108167_B_Phospho2
  gRNA
gucucaaaaucuugagccua

SEQ ID NO: 108168 - RNA, 20 nt, Artificial Sequence
  MKO10108168_B_Phospho2
  gRNA
ucuauuguaguuuggucuuc

SEQ ID NO: 108169 - RNA, 20 nt, Artificial Sequence
  MKO10108169_B_Phospho2
  gRNA
gagaaguucuaucaucccug

SEQ ID NO: 108170 - RNA, 20 nt, Artificial Sequence
  MKO10108170_B_Phox2a
  gRNA
caaaggcgcggcgggagcga

SEQ ID NO: 108171 - RNA, 20 nt, Artificial Sequence
  MKO10108171_B_Phox2a
  gRNA
ccccgacauuuacacucgcg

SEQ ID NO: 108172 - RNA, 20 nt, Artificial Sequence
  MKO10108172_B_Phox2a
  gRNA
gagcacucgugaacguugug

SEQ ID NO: 108173 - RNA, 20 nt, Artificial Sequence
  MKO10108173_B_Phox2b
  gRNA
ccguaccuggacucucgccu

SEQ ID NO: 108174 - RNA, 20 nt, Artificial Sequence
  MKO10108174_B_Phox2b
  gRNA
cgcagccgcaccgcccuugc

SEQ ID NO: 108175 - RNA, 20 nt, Artificial Sequence
  MKO10108175_B_Phox2b
  gRNA
uuugagcugcgcgcuuguga

SEQ ID NO: 108176 - RNA, 20 nt, Artificial Sequence
  MKO10108176_B_Phpt1
  gRNA
acacguguaucuuccugucc

SEQ ID NO: 108177 - RNA, 20 nt, Artificial Sequence
  MKO10108177_B_Phpt1
  gRNA
ucaguagccaucgucagccc

SEQ ID NO: 108178 - RNA, 20 nt, Artificial Sequence
  MKO10108178_B_Phpt1
  gRNA
agccaaguauccugacuaug

SEQ ID NO: 108179 - RNA, 20 nt, Artificial Sequence
  MKO10108179_B_Phrf1
  gRNA
accauucgaugaugcaaucc

SEQ ID NO: 108180 - RNA, 20 nt, Artificial Sequence
  MKO10108180_B_Phrf1
  gRNA
auugcaucaucgaauggucc

SEQ ID NO: 108181 - RNA, 20 nt, Artificial Sequence
  MKO10108181_B_Phrf1
  gRNA
aucuuaccagaucuauccuc

SEQ ID NO: 108182 - RNA, 20 nt, Artificial Sequence
  MKO10108182_B_Phtf1
  gRNA
auugauguugacuuaaucag

SEQ ID NO: 108183 - RNA, 20 nt, Artificial Sequence
  MKO10108183_B_Phtf1
  gRNA
gagcauaugaucagcagaua

SEQ ID NO: 108184 - RNA, 20 nt, Artificial Sequence
  MKO10108184_B_Phtf1
  gRNA
aagucaacaucaaucaaguc

SEQ ID NO: 108185 - RNA, 20 nt, Artificial Sequence
  MKO10108185_B_Phtf2
  gRNA
acguuacuuguaaccaccag

SEQ ID NO: 108186 - RNA, 20 nt, Artificial Sequence
  MKO10108186_B_Phtf2
  gRNA
cguuuaccgccugugccuag

SEQ ID NO: 108187 - RNA, 20 nt, Artificial Sequence
  MKO10108187_B_Phtf2
  gRNA
cucagggucugcauuugcua

SEQ ID NO: 108188 - RNA, 20 nt, Artificial Sequence
  MKO10108188_B_Phyhd1
  gRNA
aauucuguccggcagugcag

SEQ ID NO: 108189 - RNA, 20 nt, Artificial Sequence
  MKO10108189_B_Phyhd1
  gRNA
gagucccucacaacucaaga

SEQ ID NO: 108190 - RNA, 20 nt, Artificial Sequence
  MKO10108190_B_Phyhd1
  gRNA
auccgauucuucuuugaaaa

SEQ ID NO: 108191 - RNA, 20 nt, Artificial Sequence
  MKO10108191_B_Phyhipl
  gRNA
caaugaaguagugcgugaug

SEQ ID NO: 108192 - RNA, 20 nt, Artificial Sequence
  MKO10108192_B_Phyhipl
  gRNA
caguguccacgaacagucau

SEQ ID NO: 108193 - RNA, 20 nt, Artificial Sequence
  MKO10108193_B_Phyhipl
  gRNA
cauaucccaugagaucuuga

SEQ ID NO: 108194 - RNA, 20 nt, Artificial Sequence
  MKO10108194_B_Phyhip
  gRNA
uauuguugaucucgaugcug

SEQ ID NO: 108195 - RNA, 20 nt, Artificial Sequence
  MKO10108195_B_Phyhip
  gRNA
guucuaccgcaaccaucaca

SEQ ID NO: 108196 - RNA, 20 nt, Artificial Sequence
  MKO10108196_B_Phyhip
  gRNA
ggccgugccucugcccauga

SEQ ID NO: 108197 - RNA, 20 nt, Artificial Sequence
  MKO10108197_B_Phyh
  gRNA
guuucucgucauuaagaauc

SEQ ID NO: 108198 - RNA, 20 nt, Artificial Sequence
  MKO10108198_B_Phyh
  gRNA
ucucucauuauaacgauccc

SEQ ID NO: 108199 - RNA, 20 nt, Artificial Sequence
  MKO10108199_B_Phyh
  gRNA
gaucguuauaaugagagaug

SEQ ID NO: 108200 - RNA, 20 nt, Artificial Sequence
  MKO10108200_B_Phykpl
  gRNA
guacugucgagcuagucuca

SEQ ID NO: 108201 - RNA, 20 nt, Artificial Sequence
  MKO10108201_B_Phykpl
  gRNA
aguccacgauguugucaugc

SEQ ID NO: 108202 - RNA, 20 nt, Artificial Sequence
  MKO10108202_B_Phykpl
  gRNA
acccagauuccggaacuugu

SEQ ID NO: 108203 - RNA, 20 nt, Artificial Sequence
  MKO10108203_B_Pi15
  gRNA
cagaauuugucuguacgaac

SEQ ID NO: 108204 - RNA, 20 nt, Artificial Sequence
  MKO10108204_B_Pi15
  gRNA
acauccuauucgauuagaag

SEQ ID NO: 108205 - RNA, 20 nt, Artificial Sequence
  MKO10108205_B_Pi15
  gRNA
caugggcagcaacuugcauu

SEQ ID NO: 108206 - RNA, 20 nt, Artificial Sequence
  MKO10108206_B_Pi16
  gRNA
ggagguugcgcucgacuugc

SEQ ID NO: 108207 - RNA, 20 nt, Artificial Sequence
  MKO10108207_B_Pi16
  gRNA
ucccaaggccgagucgccag

SEQ ID NO: 108208 - RNA, 20 nt, Artificial Sequence
  MKO10108208_B_Pi16
  gRNA
gccguaagcccuaccaggag

SEQ ID NO: 108209 - RNA, 20 nt, Artificial Sequence
  MKO10108209_B_Pi4k2a
  gRNA
caacauuguaccacguacaa

SEQ ID NO: 108210 - RNA, 20 nt, Artificial Sequence
  MKO10108210_B_Pi4k2a
  gRNA
gggucacugaccuuuguacg

SEQ ID NO: 108211 - RNA, 20 nt, Artificial Sequence
  MKO10108211_B_Pi4k2a
  gRNA
gaucaaauaugacuguccga

SEQ ID NO: 108212 - RNA, 20 nt, Artificial Sequence
  MKO10108212_B_Pi4k2b
  gRNA
cagccgcggagggucgcgcc

SEQ ID NO: 108213 - RNA, 20 nt, Artificial Sequence
  MKO10108213_B_Pi4k2b
  gRNA
uaggaggaaguccuauccga

SEQ ID NO: 108214 - RNA, 20 nt, Artificial Sequence
  MKO10108214_B_Pi4k2b
  gRNA
gauuaaguuugacauccacc

SEQ ID NO: 108215 - RNA, 20 nt, Artificial Sequence
  MKO10108215_B_Pi4ka
  gRNA
ucuucuacccaauacacuuu

SEQ ID NO: 108216 - RNA, 20 nt, Artificial Sequence
  MKO10108216_B_Pi4ka
  gRNA
cuuaucuucuucgacuucuc

SEQ ID NO: 108217 - RNA, 20 nt, Artificial Sequence
  MKO10108217_B_Pi4ka
  gRNA
gcaagccacaucagacagca

SEQ ID NO: 108218 - RNA, 20 nt, Artificial Sequence
  MKO10108218_B_Pi4kb
  gRNA
ugaugcuguccaccgagaac

SEQ ID NO: 108219 - RNA, 20 nt, Artificial Sequence
  MKO10108219_B_Pi4kb
  gRNA
gacuugaugaauucucgcuc

SEQ ID NO: 108220 - RNA, 20 nt, Artificial Sequence
  MKO10108220_B_Pi4kb
  gRNA
gucuucagggucucguuuga

SEQ ID NO: 108221 - RNA, 20 nt, Artificial Sequence
  MKO10108221_B_Pianp
  gRNA
auccaucaucaucguucuug

SEQ ID NO: 108222 - RNA, 20 nt, Artificial Sequence
  MKO10108222_B_Pianp
  gRNA
cugagggccugcgccgcuuc

SEQ ID NO: 108223 - RNA, 20 nt, Artificial Sequence
  MKO10108223_B_Pianp
  gRNA
gggggcaucacagauucacc

SEQ ID NO: 108224 - RNA, 20 nt, Artificial Sequence
  MKO10108224_B_Pias1
  gRNA
cugaucugcugcaccuguug

SEQ ID NO: 108225 - RNA, 20 nt, Artificial Sequence
  MKO10108225_B_Pias1
  gRNA
ggugggaagugaucuucuug

SEQ ID NO: 108226 - RNA, 20 nt, Artificial Sequence
  MKO10108226_B_Pias1
  gRNA
caaaugugacuucacagugc

SEQ ID NO: 108227 - RNA, 20 nt, Artificial Sequence
  MKO10108227_B_Pias2
  gRNA
aaacucaccgcagcuggacu

SEQ ID NO: 108228 - RNA, 20 nt, Artificial Sequence
  MKO10108228_B_Pias2
  gRNA
caguucaaagcaguauucag

SEQ ID NO: 108229 - RNA, 20 nt, Artificial Sequence
  MKO10108229_B_Pias2
  gRNA
cauauuucucuaacuugcug

SEQ ID NO: 108230 - RNA, 20 nt, Artificial Sequence
  MKO10108230_B_Pias3
  gRNA
uuccucgaaccucuggcugg

SEQ ID NO: 108231 - RNA, 20 nt, Artificial Sequence
  MKO10108231_B_Pias3
  gRNA
ggggggaaauaguccuccug

SEQ ID NO: 108232 - RNA, 20 nt, Artificial Sequence
  MKO10108232_B_Pias3
  gRNA
ucccauuaaccuuaacaaag

SEQ ID NO: 108233 - RNA, 20 nt, Artificial Sequence
  MKO10108233_B_Pias4
  gRNA
cucugauaccagcuguccgc

SEQ ID NO: 108234 - RNA, 20 nt, Artificial Sequence
  MKO10108234_B_Pias4
  gRNA
uugaccuucacagcgauguu

SEQ ID NO: 108235 - RNA, 20 nt, Artificial Sequence
  MKO10108235_B_Pias4
  gRNA
gcuccccuucuucaacaugc

SEQ ID NO: 108236 - RNA, 20 nt, Artificial Sequence
  MKO10108236_B_Pibf1
  gRNA
ugugcagauugaggagcuag

SEQ ID NO: 108237 - RNA, 20 nt, Artificial Sequence
  MKO10108237_B_Pibf1
  gRNA
ccaacugaagcagcugacgg

SEQ ID NO: 108238 - RNA, 20 nt, Artificial Sequence
  MKO10108238_B_Pibf1
  gRNA
cuuugucauaguucucuuga

SEQ ID NO: 108239 - RNA, 20 nt, Artificial Sequence
  MKO10108239_B_Picalm
  gRNA
gaagugcauccauuugauuu

SEQ ID NO: 108240 - RNA, 20 nt, Artificial Sequence
  MKO10108240_B_Picalm
  gRNA
gauuucacaaaagugaagag

SEQ ID NO: 108241 - RNA, 20 nt, Artificial Sequence
  MKO10108241_B_Picalm
  gRNA
auaugucuacauuuauuaga

SEQ ID NO: 108242 - RNA, 20 nt, Artificial Sequence
  MKO10108242_B_Pick1
  gRNA
uccuugucucuauaucgucc

SEQ ID NO: 108243 - RNA, 20 nt, Artificial Sequence
  MKO10108243_B_Pick1
  gRNA
caucuucgccaccucuaccu

SEQ ID NO: 108244 - RNA, 20 nt, Artificial Sequence
  MKO10108244_B_Pick1
  gRNA
ccgccugcagcuuguuguaa

SEQ ID NO: 108245 - RNA, 20 nt, Artificial Sequence
  MKO10108245_B_Pid1
  gRNA
agcaguccucuuccaugagc

SEQ ID NO: 108246 - RNA, 20 nt, Artificial Sequence
  MKO10108246_B_Pid1
  gRNA
accugcaggcgcucaguagc

SEQ ID NO: 108247 - RNA, 20 nt, Artificial Sequence
  MKO10108247_B_Pid1
  gRNA
cggcuggaagauguggcagc

SEQ ID NO: 108248 - RNA, 20 nt, Artificial Sequence
  MKO10108248_B_Piezo1
  gRNA
guugagacaccuucacccaa

SEQ ID NO: 108249 - RNA, 20 nt, Artificial Sequence
  MKO10108249_B_Piezo1
  gRNA
ccugggugcgccgacucugc

SEQ ID NO: 108250 - RNA, 20 nt, Artificial Sequence
  MKO10108250_B_Piezo1
  gRNA
ccuacacaccgugccucacc

SEQ ID NO: 108251 - RNA, 20 nt, Artificial Sequence
  MKO10108251_B_Piezo2
  gRNA
cuuaccuugcaucguugcuu

SEQ ID NO: 108252 - RNA, 20 nt, Artificial Sequence
  MKO10108252_B_Piezo2
  gRNA
ucauugcaagucugaccauc

SEQ ID NO: 108253 - RNA, 20 nt, Artificial Sequence
  MKO10108253_B_Piezo2
  gRNA
cuuaccuugcaggcucaaca

SEQ ID NO: 108254 - RNA, 20 nt, Artificial Sequence
  MKO10108254_B_Pif1
  gRNA
ggcaugcgcagcuucuucac

SEQ ID NO: 108255 - RNA, 20 nt, Artificial Sequence
  MKO10108255_B_Pif1
  gRNA
gggguggcagccugccacau

SEQ ID NO: 108256 - RNA, 20 nt, Artificial Sequence
  MKO10108256_B_Pif1
  gRNA
aguccccacagaugaugagc

SEQ ID NO: 108257 - RNA, 20 nt, Artificial Sequence
  MKO10108257_B_Pifo
  gRNA
agucagucccaaaaguuacu

SEQ ID NO: 108258 - RNA, 20 nt, Artificial Sequence
  MKO10108258_B_Pifo
  gRNA
auaucuugaugccucgauuu

SEQ ID NO: 108259 - RNA, 20 nt, Artificial Sequence
  MKO10108259_B_Pifo
  gRNA
guguggggcauuccccuaag

SEQ ID NO: 108260 - RNA, 20 nt, Artificial Sequence
  MKO10108260_B_Piga
  gRNA
ucucucugccacguuccgcc

SEQ ID NO: 108261 - RNA, 20 nt, Artificial Sequence
  MKO10108261_B_Piga
  gRNA
ccaugcagaacgcuucagug

SEQ ID NO: 108262 - RNA, 20 nt, Artificial Sequence
  MKO10108262_B_Piga
  gRNA
ccucacugaagcguucugca

SEQ ID NO: 108263 - RNA, 20 nt, Artificial Sequence
  MKO10108263_B_Pigb
  gRNA
aggucuccaugguguucgug

SEQ ID NO: 108264 - RNA, 20 nt, Artificial Sequence
  MKO10108264_B_Pigb
  gRNA
gaauggacggagcgauugag

SEQ ID NO: 108265 - RNA, 20 nt, Artificial Sequence
  MKO10108265_B_Pigb
  gRNA
caucuucgccaguauuuaca

SEQ ID NO: 108266 - RNA, 20 nt, Artificial Sequence
  MKO10108266_B_Pigc
  gRNA
ggccgaccugaagaguacuc

SEQ ID NO: 108267 - RNA, 20 nt, Artificial Sequence
  MKO10108267_B_Pigc
  gRNA
cuguacugacagacuccguc

SEQ ID NO: 108268 - RNA, 20 nt, Artificial Sequence
  MKO10108268_B_Pigc
  gRNA
uccggaaaaacaucuaugcc

SEQ ID NO: 108269 - RNA, 20 nt, Artificial Sequence
  MKO10108269_B_Pigf
  gRNA
ucucgccacucuggaucuac

SEQ ID NO: 108270 - RNA, 20 nt, Artificial Sequence
  MKO10108270_B_Pigf
  gRNA
guaccuugucucuguuuguu

SEQ ID NO: 108271 - RNA, 20 nt, Artificial Sequence
  MKO10108271_B_Pigf
  gRNA
auagaacaaaaaugauguga

SEQ ID NO: 108272 - RNA, 20 nt, Artificial Sequence
  MKO10108272_B_Pigg
  gRNA
uggucacaagcucagcgaaa

SEQ ID NO: 108273 - RNA, 20 nt, Artificial Sequence
  MKO10108273_B_Pigg
  gRNA
ccacacuucacugcugucga

SEQ ID NO: 108274 - RNA, 20 nt, Artificial Sequence
  MKO10108274_B_Pigg
  gRNA
uuucuacaggcauugaugac

SEQ ID NO: 108275 - RNA, 20 nt, Artificial Sequence
  MKO10108275_B_Pigh
  gRNA
cuucaaucaagcaguccaac

SEQ ID NO: 108276 - RNA, 20 nt, Artificial Sequence
  MKO10108276_B_Pigh
  gRNA
cgaugauuaguagagucucc

SEQ ID NO: 108277 - RNA, 20 nt, Artificial Sequence
  MKO10108277_B_Pigh
  gRNA
ucgaguaguuccugucuucc

SEQ ID NO: 108278 - RNA, 20 nt, Artificial Sequence
  MKO10108278_B_Pigk
  gRNA
cuguuuauagaagcgucaag

SEQ ID NO: 108279 - RNA, 20 nt, Artificial Sequence
  MKO10108279_B_Pigk
  gRNA
caauguguauggagacgaug

SEQ ID NO: 108280 - RNA, 20 nt, Artificial Sequence
  MKO10108280_B_Pigk
  gRNA
cacaaauaacugggcuguuu

SEQ ID NO: 108281 - RNA, 20 nt, Artificial Sequence
  MKO10108281_B_Pigl
  gRNA
uaugugcugaaggagggugc

SEQ ID NO: 108282 - RNA, 20 nt, Artificial Sequence
  MKO10108282_B_Pigl
  gRNA
uugcuuuguacaaagcugug

SEQ ID NO: 108283 - RNA, 20 nt, Artificial Sequence
  MKO10108283_B_Pigl
  gRNA
uccuccagggcccugcacuc

SEQ ID NO: 108284 - RNA, 20 nt, Artificial Sequence
  MKO10108284_B_Pigm
  gRNA
uguagcgguaggucgcccgc

SEQ ID NO: 108285 - RNA, 20 nt, Artificial Sequence
  MKO10108285_B_Pigm
  gRNA
cgggcggcacccgaaaguuc

SEQ ID NO: 108286 - RNA, 20 nt, Artificial Sequence
  MKO10108286_B_Pigm
  gRNA
cgcgaagccauagaacaccg

SEQ ID NO: 108287 - RNA, 20 nt, Artificial Sequence
  MKO10108287_B_Pign
  gRNA
ggccauguagccuugauagc

SEQ ID NO: 108288 - RNA, 20 nt, Artificial Sequence
  MKO10108288_B_Pign
  gRNA
uuaaugaaagcaaguacacg

SEQ ID NO: 108289 - RNA, 20 nt, Artificial Sequence
  MKO10108289_B_Pign
  gRNA
aucuugcccauguuugccaa

SEQ ID NO: 108290 - RNA, 20 nt, Artificial Sequence
  MKO10108290_B_Pigo
  gRNA
caggggacucauagaacgcc

SEQ ID NO: 108291 - RNA, 20 nt, Artificial Sequence
  MKO10108291_B_Pigo
  gRNA
uccggggaagaggucucucc

SEQ ID NO: 108292 - RNA, 20 nt, Artificial Sequence
  MKO10108292_B_Pigo
  gRNA
cccaucccguuugggaacac

SEQ ID NO: 108293 - RNA, 20 nt, Artificial Sequence
  MKO10108293_B_Pigp
  gRNA
aggccaguaaguuaagccua

SEQ ID NO: 108294 - RNA, 20 nt, Artificial Sequence
  MKO10108294_B_Pigp
  gRNA
agggcccaucaugagagggc

SEQ ID NO: 108295 - RNA, 20 nt, Artificial Sequence
  MKO10108295_B_Pigp
  gRNA
cugcaguacuuuaucuugug

SEQ ID NO: 108296 - RNA, 20 nt, Artificial Sequence
  MKO10108296_B_Pigq
  gRNA
cauuggccagcuguccaauu

SEQ ID NO: 108297 - RNA, 20 nt, Artificial Sequence
  MKO10108297_B_Pigq
  gRNA
cugcugggcucaagaugaau

SEQ ID NO: 108298 - RNA, 20 nt, Artificial Sequence
  MKO10108298_B_Pigq
  gRNA
gcucaauaaagggggacaua

SEQ ID NO: 108299 - RNA, 20 nt, Artificial Sequence
  MKO10108299_B_Pigr
  gRNA
cggaaauacuggugccgaca

SEQ ID NO: 108300 - RNA, 20 nt, Artificial Sequence
  MKO10108300_B_Pigr
  gRNA
gagcguugugcacaugccgc

SEQ ID NO: 108301 - RNA, 20 nt, Artificial Sequence
  MKO10108301_B_Pigr
  gRNA
caaucgucgcucuguuguga

SEQ ID NO: 108302 - RNA, 20 nt, Artificial Sequence
  MKO10108302_B_Pigs
  gRNA
guagcuucucuuggucgucc

SEQ ID NO: 108303 - RNA, 20 nt, Artificial Sequence
  MKO10108303_B_Pigs
  gRNA
cuucuccggcucagcuaaca

SEQ ID NO: 108304 - RNA, 20 nt, Artificial Sequence
  MKO10108304_B_Pigs
  gRNA
ccggagagcuuuggagcacg

SEQ ID NO: 108305 - RNA, 20 nt, Artificial Sequence
  MKO10108305_B_Pigu
  gRNA
ugucuaguguggauaagucc

SEQ ID NO: 108306 - RNA, 20 nt, Artificial Sequence
  MKO10108306_B_Pigu
  gRNA
ccaugacuuacucugcagau

SEQ ID NO: 108307 - RNA, 20 nt, Artificial Sequence
  MKO10108307_B_Pigu
  gRNA
cucacucaccuuggaacugc

SEQ ID NO: 108308 - RNA, 20 nt, Artificial Sequence
  MKO10108308_B_Pigu
  gRNA
cggaugaguucagccacauc

SEQ ID NO: 108309 - RNA, 20 nt, Artificial Sequence
  MKO10108309_B_Pigu
  gRNA
gcgcuacaucccucugaaag

SEQ ID NO: 108310 - RNA, 20 nt, Artificial Sequence
  MKO10108310_B_Pigu
  gRNA
ccaauucugcauagucaauu

SEQ ID NO: 108311 - RNA, 20 nt, Artificial Sequence
  MKO10108311_B_Pigv
  gRNA
cauccugacucuagugcuac

SEQ ID NO: 108312 - RNA, 20 nt, Artificial Sequence
  MKO10108312_B_Pigv
  gRNA
aggaucaagaaccgcugcug

SEQ ID NO: 108313 - RNA, 20 nt, Artificial Sequence
  MKO10108313_B_Pigv
  gRNA
cgaaucucagcaccucuuuc

SEQ ID NO: 108314 - RNA, 20 nt, Artificial Sequence
  MKO10108314_B_Pigw
  gRNA
acaauccacgacuuauuuaa

SEQ ID NO: 108315 - RNA, 20 nt, Artificial Sequence
  MKO10108315_B_Pigw
  gRNA
caaucacagugagauucucg

SEQ ID NO: 108316 - RNA, 20 nt, Artificial Sequence
  MKO10108316_B_Pigw
  gRNA
caggaacauucuaccgagua

SEQ ID NO: 108317 - RNA, 20 nt, Artificial Sequence
  MKO10108317_B_Pigx
  gRNA
ucguagugaagccaacucau

SEQ ID NO: 108318 - RNA, 20 nt, Artificial Sequence
  MKO10108318_B_Pigx
  gRNA
cugugcacuaucgcuaucac

SEQ ID NO: 108319 - RNA, 20 nt, Artificial Sequence
  MKO10108319_B_Pigx
  gRNA
auuaagcauuacauuccacc

SEQ ID NO: 108320 - RNA, 20 nt, Artificial Sequence
  MKO10108320_B_Pigyl
  gRNA
cuggcgcuggugcagcccuc

SEQ ID NO: 108321 - RNA, 20 nt, Artificial Sequence
  MKO10108321_B_Pigyl
  gRNA
gaagcucuucagacauaacu

SEQ ID NO: 108322 - RNA, 20 nt, Artificial Sequence
  MKO10108322_B_Pigyl
  gRNA
ccugcucuacuccgccuccg

SEQ ID NO: 108323 - RNA, 20 nt, Artificial Sequence
  MKO10108323_B_Pigz
  gRNA
cgauaugaugguggcagccc

SEQ ID NO: 108324 - RNA, 20 nt, Artificial Sequence
  MKO10108324_B_Pigz
  gRNA
uguacgaucuggccccguug

SEQ ID NO: 108325 - RNA, 20 nt, Artificial Sequence
  MKO10108325_B_Pigz
  gRNA
gacccguuuguggggaugca

SEQ ID NO: 108326 - RNA, 20 nt, Artificial Sequence
  MKO10108326_B_Pih1d1
  gRNA
aacugguggucaccaucgcc

SEQ ID NO: 108327 - RNA, 20 nt, Artificial Sequence
  MKO10108327_B_Pih1d1
  gRNA
ccucaccaggauuuagcugu

SEQ ID NO: 108328 - RNA, 20 nt, Artificial Sequence
  MKO10108328_B_Pih1d1
  gRNA
guuucucaccaggcuuuggc

SEQ ID NO: 108329 - RNA, 20 nt, Artificial Sequence
  MKO10108329_B_Pih1d2
  gRNA
ucgcuccucgaugcacagca

SEQ ID NO: 108330 - RNA, 20 nt, Artificial Sequence
  MKO10108330_B_Pih1d2
  gRNA
auuucuguauuaaucgauuc

SEQ ID NO: 108331 - RNA, 20 nt, Artificial Sequence
  MKO10108331_B_Pih1d2
  gRNA
cagaccagaagacuccgcug

SEQ ID NO: 108332 - RNA, 20 nt, Artificial Sequence
  MKO10108332_B_Pih1d3
  gRNA
aguaaacuuuccccagcccg

SEQ ID NO: 108333 - RNA, 20 nt, Artificial Sequence
  MKO10108333_B_Pih1d3
  gRNA
auaccuaggauuaacaagaa

SEQ ID NO: 108334 - RNA, 20 nt, Artificial Sequence
  MKO10108334_B_Pih1d3
  gRNA
gauccuuucuuguuaauccu

SEQ ID NO: 108335 - RNA, 20 nt, Artificial Sequence
  MKO10108335_B_Pik3ap1
  gRNA
cuacugucggcggggcuggu

SEQ ID NO: 108336 - RNA, 20 nt, Artificial Sequence
  MKO10108336_B_Pik3ap1
  gRNA
gucgagugcugcaaauccug

SEQ ID NO: 108337 - RNA, 20 nt, Artificial Sequence
  MKO10108337_B_Pik3ap1
  gRNA
ugccuaccccacagcgaaug

SEQ ID NO: 108338 - RNA, 20 nt, Artificial Sequence
  MKO10108338_B_Pik3c2a
  gRNA
uuugugcagugaucaguaua

SEQ ID NO: 108339 - RNA, 20 nt, Artificial Sequence
  MKO10108339_B_Pik3c2a
  gRNA
agucaucauguacccagcaa

SEQ ID NO: 108340 - RNA, 20 nt, Artificial Sequence
  MKO10108340_B_Pik3c2a
  gRNA
uguagaagagaacuuccagu

SEQ ID NO: 108341 - RNA, 20 nt, Artificial Sequence
  MKO10108341_B_Pik3c2b
  gRNA
cugagaccucaaacaauucg

SEQ ID NO: 108342 - RNA, 20 nt, Artificial Sequence
  MKO10108342_B_Pik3c2b
  gRNA
auccaggacuauucccuaac

SEQ ID NO: 108343 - RNA, 20 nt, Artificial Sequence
  MKO10108343_B_Pik3c2b
  gRNA
gcuacacucacgaugagcug

SEQ ID NO: 108344 - RNA, 20 nt, Artificial Sequence
  MKO10108344_B_Pik3c2g
  gRNA
cuacuuuaaaagcugguauc

SEQ ID NO: 108345 - RNA, 20 nt, Artificial Sequence
  MKO10108345_B_Pik3c2g
  gRNA
uuucaucaaugcuaauccaa

SEQ ID NO: 108346 - RNA, 20 nt, Artificial Sequence
  MKO10108346_B_Pik3c2g
  gRNA
gaugugcuaaagaaagagau

SEQ ID NO: 108347 - RNA, 20 nt, Artificial Sequence
  MKO10108347_B_Pik3c3
  gRNA
guguccuugccgaugagccu

SEQ ID NO: 108348 - RNA, 20 nt, Artificial Sequence
  MKO10108348_B_Pik3c3
  gRNA
gccuguguaccuuggcgagg

SEQ ID NO: 108349 - RNA, 20 nt, Artificial Sequence
  MKO10108349_B_Pik3c3
  gRNA
cccacuggcacagcgcuucc

SEQ ID NO: 108350 - RNA, 20 nt, Artificial Sequence
  MKO10108350_B_Pik3ca
  gRNA
uacuucugcuugucguuguu

SEQ ID NO: 108351 - RNA, 20 nt, Artificial Sequence
  MKO10108351_B_Pik3ca
  gRNA
gaauguuccuucgaaagucu

SEQ ID NO: 108352 - RNA, 20 nt, Artificial Sequence
  MKO10108352_B_Pik3ca
  gRNA
ucuuaccuaggauuggaaca

SEQ ID NO: 108353 - RNA, 20 nt, Artificial Sequence
  MKO10108353_B_Pik3cb
  gRNA
uauacgagucaauguccaug

SEQ ID NO: 108354 - RNA, 20 nt, Artificial Sequence
  MKO10108354_B_Pik3cb
  gRNA
cuuccuuuccacgaauagug

SEQ ID NO: 108355 - RNA, 20 nt, Artificial Sequence
  MKO10108355_B_Pik3cb
  gRNA
cugugaccccgcagaaaaau

SEQ ID NO: 108356 - RNA, 20 nt, Artificial Sequence
  MKO10108356_B_Pik3cd
  gRNA
ggccugugcccuccgaaaaa

SEQ ID NO: 108357 - RNA, 20 nt, Artificial Sequence
  MKO10108357_B_Pik3cd
  gRNA
agaagucaacaaccacgcuc

SEQ ID NO: 108358 - RNA, 20 nt, Artificial Sequence
  MKO10108358_B_Pik3cd
  gRNA
cgaacuucacguugaccagc

SEQ ID NO: 108359 - RNA, 20 nt, Artificial Sequence
  MKO10108359_B_Pik3cg
  gRNA
gauaccuaccaccaggguac

SEQ ID NO: 108360 - RNA, 20 nt, Artificial Sequence
  MKO10108360_B_Pik3cg
  gRNA
agccucgcagguacgccucc

SEQ ID NO: 108361 - RNA, 20 nt, Artificial Sequence
  MKO10108361_B_Pik3cg
  gRNA
acuaaaagccgguacccugg

SEQ ID NO: 108362 - RNA, 20 nt, Artificial Sequence
  MKO10108362_B_Pik3ip1
  gRNA
aacccggaccaggacccgcg

SEQ ID NO: 108363 - RNA, 20 nt, Artificial Sequence
  MKO10108363_B_Pik3ip1
  gRNA
ucgugggcuacacuuacaag

SEQ ID NO: 108364 - RNA, 20 nt, Artificial Sequence
  MKO10108364_B_Pik3ip1
  gRNA
cugcuaacgcccuaccagcc

SEQ ID NO: 108365 - RNA, 20 nt, Artificial Sequence
  MKO10108365_B_Pik3r1
  gRNA
uugaguuaauaaaccacuac

SEQ ID NO: 108366 - RNA, 20 nt, Artificial Sequence
  MKO10108366_B_Pik3r1
  gRNA
gacgcaucuacuaaaaugca

SEQ ID NO: 108367 - RNA, 20 nt, Artificial Sequence
  MKO10108367_B_Pik3r1
  gRNA
guaccauucagcauccugca

SEQ ID NO: 108368 - RNA, 20 nt, Artificial Sequence
  MKO10108368_B_Pik3r2
  gRNA
ugacccugcucccccgauuc

SEQ ID NO: 108369 - RNA, 20 nt, Artificial Sequence
  MKO10108369_B_Pik3r2
  gRNA
aggcuuuaccucgaagugcc

SEQ ID NO: 108370 - RNA, 20 nt, Artificial Sequence
  MKO10108370_B_Pik3r2
  gRNA
cagcugcaggcaacgccagc

SEQ ID NO: 108371 - RNA, 20 nt, Artificial Sequence
  MKO10108371_B_Pik3r3
  gRNA
gucauuggcuuagguggcuu

SEQ ID NO: 108372 - RNA, 20 nt, Artificial Sequence
  MKO10108372_B_Pik3r3
  gRNA
uucauuccauuugugacugc

SEQ ID NO: 108373 - RNA, 20 nt, Artificial Sequence
  MKO10108373_B_Pik3r3
  gRNA
cgaacuaagaagguaccauc

SEQ ID NO: 108374 - RNA, 20 nt, Artificial Sequence
  MKO10108374_B_Pik3r4
  gRNA
gugggacaagagaacgucgu

SEQ ID NO: 108375 - RNA, 20 nt, Artificial Sequence
  MKO10108375_B_Pik3r4
  gRNA
cgagacggcucugcgauucc

SEQ ID NO: 108376 - RNA, 20 nt, Artificial Sequence
  MKO10108376_B_Pik3r4
  gRNA
gaugaagccacgcguccuaa

SEQ ID NO: 108377 - RNA, 20 nt, Artificial Sequence
  MKO10108377_B_Pik3r5
  gRNA
agacuccgaccuccugcuga

SEQ ID NO: 108378 - RNA, 20 nt, Artificial Sequence
  MKO10108378_B_Pik3r5
  gRNA
ggucauaggugccuuucucu

SEQ ID NO: 108379 - RNA, 20 nt, Artificial Sequence
  MKO10108379_B_Pik3r5
  gRNA
cuugaguucagcaucaauga

SEQ ID NO: 108380 - RNA, 20 nt, Artificial Sequence
  MKO10108380_B_Pik3r6
  gRNA
accagaauggagcucuuucc

SEQ ID NO: 108381 - RNA, 20 nt, Artificial Sequence
  MKO10108381_B_Pik3r6
  gRNA
acagacuccauggagagcuc

SEQ ID NO: 108382 - RNA, 20 nt, Artificial Sequence
  MKO10108382_B_Pik3r6
  gRNA
cccucucaccuuagugagca

SEQ ID NO: 108383 - RNA, 20 nt, Artificial Sequence
  MKO10108383_B_Pikfyve
  gRNA
cuggcauccaauauugcuuc

SEQ ID NO: 108384 - RNA, 20 nt, Artificial Sequence
  MKO10108384_B_Pikfyve
  gRNA
uguuguaaucaagaaauccc

SEQ ID NO: 108385 - RNA, 20 nt, Artificial Sequence
  MKO10108385_B_Pikfyve
  gRNA
ggcugguucugcuuuccuuc

SEQ ID NO: 108386 - RNA, 20 nt, Artificial Sequence
  MKO10108386_B_Pilra
  gRNA
ugggauugauaguguuccuc

SEQ ID NO: 108387 - RNA, 20 nt, Artificial Sequence
  MKO10108387_B_Pilra
  gRNA
ggauuucagcuuuagucuuc

SEQ ID NO: 108388 - RNA, 20 nt, Artificial Sequence
  MKO10108388_B_Pilra
  gRNA
aacacucucauguuucucac

SEQ ID NO: 108389 - RNA, 20 nt, Artificial Sequence
  MKO10108389_B_Pilrb1
  gRNA
uuggucauaguccuagucua

SEQ ID NO: 108390 - RNA, 20 nt, Artificial Sequence
  MKO10108390_B_Pilrb1
  gRNA
agggacuccagccauggcuc

SEQ ID NO: 108391 - RNA, 20 nt, Artificial Sequence
  MKO10108391_B_Pilrb1
  gRNA
ucaucaggcugucugcaugc

SEQ ID NO: 108392 - RNA, 20 nt, Artificial Sequence
  MKO10108392_B_Pilrb2
  gRNA
ggaaauucagcaagaucaaa

SEQ ID NO: 108393 - RNA, 20 nt, Artificial Sequence
  MKO10108393_B_Pilrb2
  gRNA
gcuuugcugaucucgcuucc

SEQ ID NO: 108394 - RNA, 20 nt, Artificial Sequence
  MKO10108394_B_Pilrb2
  gRNA
ccacucaccagcaugcagac

SEQ ID NO: 108395 - RNA, 20 nt, Artificial Sequence
  MKO10108395_B_Pim1
  gRNA
cucgggcgucauuagacuuc

SEQ ID NO: 108396 - RNA, 20 nt, Artificial Sequence
  MKO10108396_B_Pim1
  gRNA
agaaggaccggauuuccgau

SEQ ID NO: 108397 - RNA, 20 nt, Artificial Sequence
  MKO10108397_B_Pim1
  gRNA
cgaugguagcgaauccacuc

SEQ ID NO: 108398 - RNA, 20 nt, Artificial Sequence
  MKO10108398_B_Pim2
  gRNA
gugugauacgccuucuugac

SEQ ID NO: 108399 - RNA, 20 nt, Artificial Sequence
  MKO10108399_B_Pim2
  gRNA
ugugcuaggcugguccaccg

SEQ ID NO: 108400 - RNA, 20 nt, Artificial Sequence
  MKO10108400_B_Pim2
  gRNA
agguguccuacucuaugaca

SEQ ID NO: 108401 - RNA, 20 nt, Artificial Sequence
  MKO10108401_B_Pim3
  gRNA
gcgggcagccgcaucgccga

SEQ ID NO: 108402 - RNA, 20 nt, Artificial Sequence
  MKO10108402_B_Pim3
  gRNA
gcccgugauaucggugauau

SEQ ID NO: 108403 - RNA, 20 nt, Artificial Sequence
  MKO10108403_B_Pim3
  gRNA
auccgauaucaccgauauca

SEQ ID NO: 108404 - RNA, 20 nt, Artificial Sequence
  MKO10108404_B_Pin1rt1
  gRNA
gcugagcucacuuuaucuca

SEQ ID NO: 108405 - RNA, 20 nt, Artificial Sequence
  MKO10108405_B_Pin1rt1
  gRNA
ugaagcacagccaaucucgg

SEQ ID NO: 108406 - RNA, 20 nt, Artificial Sequence
  MKO10108406_B_Pin1rt1
  gRNA
acgagaagcugccgcccggc

SEQ ID NO: 108407 - RNA, 20 nt, Artificial Sequence
  MKO10108407_B_Pin1
  gRNA
gaugcccgaguccgugaaca

SEQ ID NO: 108408 - RNA, 20 nt, Artificial Sequence
  MKO10108408_B_Pin1
  gRNA
cucauacgcuucucccagcc

SEQ ID NO: 108409 - RNA, 20 nt, Artificial Sequence
  MKO10108409_B_Pin1
  gRNA
gcaaacgacgcauccucaaa

SEQ ID NO: 108410 - RNA, 20 nt, Artificial Sequence
  MKO10108410_B_Pin4
  gRNA
acugcauugccaccaccuuu

SEQ ID NO: 108411 - RNA, 20 nt, Artificial Sequence
  MKO10108411_B_Pin4
  gRNA
uuuaucuucacuauauugug

SEQ ID NO: 108412 - RNA, 20 nt, Artificial Sequence
  MKO10108412_B_Pin4
  gRNA
cacauucugugugaaaaaca

SEQ ID NO: 108413 - RNA, 20 nt, Artificial Sequence
  MKO10108413_B_Pink1
  gRNA
gggcccggaugucguccuga

SEQ ID NO: 108414 - RNA, 20 nt, Artificial Sequence
  MKO10108414_B_Pink1
  gRNA
cggaaaacccggaugauguu

SEQ ID NO: 108415 - RNA, 20 nt, Artificial Sequence
  MKO10108415_B_Pink1
  gRNA
acagugugcgaccguggccc

SEQ ID NO: 108416 - RNA, 20 nt, Artificial Sequence
  MKO10108416_B_Pinlyp
  gRNA
ugcgucuuugccgucuucac

SEQ ID NO: 108417 - RNA, 20 nt, Artificial Sequence
  MKO10108417_B_Pinlyp
  gRNA
cucuguagcacagccccucg

SEQ ID NO: 108418 - RNA, 20 nt, Artificial Sequence
  MKO10108418_B_Pinlyp
  gRNA
auucucuguccgauuguuca

SEQ ID NO: 108419 - RNA, 20 nt, Artificial Sequence
  MKO10108419_B_Pinx1
  gRNA
uaccugcuguuuccugaccg

SEQ ID NO: 108420 - RNA, 20 nt, Artificial Sequence
  MKO10108420_B_Pinx1
  gRNA
uccacaggguuugggagcuc

SEQ ID NO: 108421 - RNA, 20 nt, Artificial Sequence
  MKO10108421_B_Pinx1
  gRNA
ugaauuucauauaaugaacc

SEQ ID NO: 108422 - RNA, 20 nt, Artificial Sequence
  MKO10108422_B_Pip4k2a
  gRNA
gccaccggcuaucuguauau

SEQ ID NO: 108423 - RNA, 20 nt, Artificial Sequence
  MKO10108423_B_Pip4k2a
  gRNA
auugggaaggggugcacuuc

SEQ ID NO: 108424 - RNA, 20 nt, Artificial Sequence
  MKO10108424_B_Pip4k2a
  gRNA
accgagccccgcugcgagcc

SEQ ID NO: 108425 - RNA, 20 nt, Artificial Sequence
  MKO10108425_B_Pip4k2b
  gRNA
cgaugccgaaccucucccug

SEQ ID NO: 108426 - RNA, 20 nt, Artificial Sequence
  MKO10108426_B_Pip4k2b
  gRNA
auguaccgccugaccgugga

SEQ ID NO: 108427 - RNA, 20 nt, Artificial Sequence
  MKO10108427_B_Pip4k2b
  gRNA
uguuccugucaugcuaaugc

SEQ ID NO: 108428 - RNA, 20 nt, Artificial Sequence
  MKO10108428_B_Pip4k2c
  gRNA
agugucgagcgaagauauug

SEQ ID NO: 108429 - RNA, 20 nt, Artificial Sequence
  MKO10108429_B_Pip4k2c
  gRNA
aggucauacuuccuaugcac

SEQ ID NO: 108430 - RNA, 20 nt, Artificial Sequence
  MKO10108430_B_Pip4k2c
  gRNA
gucaucgucuuccugugcau

SEQ ID NO: 108431 - RNA, 20 nt, Artificial Sequence
  MKO10108431_B_Pip5k1a
  gRNA
cacgcucugguuuggugcuc

SEQ ID NO: 108432 - RNA, 20 nt, Artificial Sequence
  MKO10108432_B_Pip5k1a
  gRNA
caucgaaguguugauuccuc

SEQ ID NO: 108433 - RNA, 20 nt, Artificial Sequence
  MKO10108433_B_Pip5k1a
  gRNA
cuuguauguagucucuccag

SEQ ID NO: 108434 - RNA, 20 nt, Artificial Sequence
  MKO10108434_B_Pip5k1b
  gRNA
auguccugccgcgugccaug

SEQ ID NO: 108435 - RNA, 20 nt, Artificial Sequence
  MKO10108435_B_Pip5k1b
  gRNA
cgcguucuggcuuggacgug

SEQ ID NO: 108436 - RNA, 20 nt, Artificial Sequence
  MKO10108436_B_Pip5k1b
  gRNA
ccggaaggccagcggugcgu

SEQ ID NO: 108437 - RNA, 20 nt, Artificial Sequence
  MKO10108437_B_Pip5k1c
  gRNA
cucccgacgcauccacgccu

SEQ ID NO: 108438 - RNA, 20 nt, Artificial Sequence
  MKO10108438_B_Pip5k1c
  gRNA
ugcaugagcacgucccgcuc

SEQ ID NO: 108439 - RNA, 20 nt, Artificial Sequence
  MKO10108439_B_Pip5k1c
  gRNA
gaccaccucguccacccuga

SEQ ID NO: 108440 - RNA, 20 nt, Artificial Sequence
  MKO10108440_B_Pip5kl1
  gRNA
gggucuucacaaagaagcgc

SEQ ID NO: 108441 - RNA, 20 nt, Artificial Sequence
  MKO10108441_B_Pip5kl1
  gRNA
uagaaugacacgaaugaugc

SEQ ID NO: 108442 - RNA, 20 nt, Artificial Sequence
  MKO10108442_B_Pip5kl1
  gRNA
uuccuaccucuucgugaacu

SEQ ID NO: 108443 - RNA, 20 nt, Artificial Sequence
  MKO10108443_B_Pipox
  gRNA
augcagaagccgguuggucc

SEQ ID NO: 108444 - RNA, 20 nt, Artificial Sequence
  MKO10108444_B_Pipox
  gRNA
cuggccccccaccacaucua

SEQ ID NO: 108445 - RNA, 20 nt, Artificial Sequence
  MKO10108445_B_Pipox
  gRNA
ccacugacgaaagauacuca

SEQ ID NO: 108446 - RNA, 20 nt, Artificial Sequence
  MKO10108446_B_Pip
  gRNA
gcuggggaucauugaaagcc

SEQ ID NO: 108447 - RNA, 20 nt, Artificial Sequence
  MKO10108447_B_Pip
  gRNA
agauguuccaucaacagcac

SEQ ID NO: 108448 - RNA, 20 nt, Artificial Sequence
  MKO10108448_B_Pip
  gRNA
gguuuacuuacucaucaucc

SEQ ID NO: 108449 - RNA, 20 nt, Artificial Sequence
  MKO10108449_B_Pira11
  gRNA
cuucuggagaccacagagug

SEQ ID NO: 108450 - RNA, 20 nt, Artificial Sequence
  MKO10108450_B_Pira11
  gRNA
caggacugacucugagccuc

SEQ ID NO: 108451 - RNA, 20 nt, Artificial Sequence
  MKO10108451_B_Pira11
  gRNA
acacacucaccugucagcac

SEQ ID NO: 108452 - RNA, 20 nt, Artificial Sequence
  MKO10108452_B_Pira1
  gRNA
cuucuggagaccacagagug

SEQ ID NO: 108453 - RNA, 20 nt, Artificial Sequence
  MKO10108453_B_Pira1
  gRNA
caggacugacucugagccuc

SEQ ID NO: 108454 - RNA, 20 nt, Artificial Sequence
  MKO10108454_B_Pira1
  gRNA
acacacucaccugucagcac

SEQ ID NO: 108455 - RNA, 20 nt, Artificial Sequence
  MKO10108455_B_Pira2
  gRNA
acacacucaccugucagcac

SEQ ID NO: 108456 - RNA, 20 nt, Artificial Sequence
  MKO10108456_B_Pira2
  gRNA
gacacccagccuuucagccc

SEQ ID NO: 108457 - RNA, 20 nt, Artificial Sequence
  MKO10108457_B_Pira2
  gRNA
accugagaccaggagcucca

SEQ ID NO: 108458 - RNA, 20 nt, Artificial Sequence
  MKO10108458_B_Pira4
  gRNA
cuucuggagaccacagagug

SEQ ID NO: 108459 - RNA, 20 nt, Artificial Sequence
  MKO10108459_B_Pira4
  gRNA
caggacugacucugagccuc

SEQ ID NO: 108460 - RNA, 20 nt, Artificial Sequence
  MKO10108460_B_Pira4
  gRNA
acacacucaccugucagcac

SEQ ID NO: 108461 - RNA, 20 nt, Artificial Sequence
  MKO10108461_B_Pira6
  gRNA
ggcuuaguugauguuccuug

SEQ ID NO: 108462 - RNA, 20 nt, Artificial Sequence
  MKO10108462_B_Pira6
  gRNA
cuccacagccacagagaacc

SEQ ID NO: 108463 - RNA, 20 nt, Artificial Sequence
  MKO10108463_B_Pira6
  gRNA
acaguucacaauaccacaac

SEQ ID NO: 108464 - RNA, 20 nt, Artificial Sequence
  MKO10108464_B_Pira7
  gRNA
cuucuggagaccacagagug

SEQ ID NO: 108465 - RNA, 20 nt, Artificial Sequence
  MKO10108465_B_Pira7
  gRNA
caggacugacucugagccuc

SEQ ID NO: 108466 - RNA, 20 nt, Artificial Sequence
  MKO10108466_B_Pira7
  gRNA
acacacucaccugucagcac

SEQ ID NO: 108467 - RNA, 20 nt, Artificial Sequence
  MKO10108467_B_Pirb
  gRNA
gcauguuguagugucacaga

SEQ ID NO: 108468 - RNA, 20 nt, Artificial Sequence
  MKO10108468_B_Pirb
  gRNA
caggacugacucugagccuc

SEQ ID NO: 108469 - RNA, 20 nt, Artificial Sequence
  MKO10108469_B_Pirb
  gRNA
acacacucaccugucagcac

SEQ ID NO: 108470 - RNA, 20 nt, Artificial Sequence
  MKO10108470_B_Pirt
  gRNA
auaaaguugugcaagugcuc

SEQ ID NO: 108471 - RNA, 20 nt, Artificial Sequence
  MKO10108471_B_Pirt
  gRNA
guuccagaagugagucuguc

SEQ ID NO: 108472 - RNA, 20 nt, Artificial Sequence
  MKO10108472_B_Pirt
  gRNA
caccuguguggccuacaucu

SEQ ID NO: 108473 - RNA, 20 nt, Artificial Sequence
  MKO10108473_B_Pir
  gRNA
cccacuguaccuuuaggaau

SEQ ID NO: 108474 - RNA, 20 nt, Artificial Sequence
  MKO10108474_B_Pir
  gRNA
ucgcacaccaaccuuauauc

SEQ ID NO: 108475 - RNA, 20 nt, Artificial Sequence
  MKO10108475_B_Pir
  gRNA
cauguugguaaaaugaaccc

SEQ ID NO: 108476 - RNA, 20 nt, Artificial Sequence
  MKO10108476_B_Pisd
  gRNA
ggcaguagauucauagugac

SEQ ID NO: 108477 - RNA, 20 nt, Artificial Sequence
  MKO10108477_B_Pisd
  gRNA
agguccucuguauuggcucg

SEQ ID NO: 108478 - RNA, 20 nt, Artificial Sequence
  MKO10108478_B_Pisd
  gRNA
cguauguggcuugcacugug

SEQ ID NO: 108479 - RNA, 20 nt, Artificial Sequence
  MKO10108479_B_Pithd1
  gRNA
gcaguuuguugaaagugaug

SEQ ID NO: 108480 - RNA, 20 nt, Artificial Sequence
  MKO10108480_B_Pithd1
  gRNA
cuaauucuccuguaaugucu

SEQ ID NO: 108481 - RNA, 20 nt, Artificial Sequence
  MKO10108481_B_Pithd1
  gRNA
ccugcggggagaguggacug

SEQ ID NO: 108482 - RNA, 20 nt, Artificial Sequence
  MKO10108482_B_Pitpna
  gRNA
aggcuuucucguguauauuc

SEQ ID NO: 108483 - RNA, 20 nt, Artificial Sequence
  MKO10108483_B_Pitpna
  gRNA
cuuaccucaucuacagacac

SEQ ID NO: 108484 - RNA, 20 nt, Artificial Sequence
  MKO10108484_B_Pitpna
  gRNA
ccugccugugucuguagaug

SEQ ID NO: 108485 - RNA, 20 nt, Artificial Sequence
  MKO10108485_B_Pitpnb
  gRNA
acaaaaucuaccaccugaag

SEQ ID NO: 108486 - RNA, 20 nt, Artificial Sequence
  MKO10108486_B_Pitpnb
  gRNA
gcaaucauccucacaaaugc

SEQ ID NO: 108487 - RNA, 20 nt, Artificial Sequence
  MKO10108487_B_Pitpnb
  gRNA
cuuaccucuugaacagaaca

SEQ ID NO: 108488 - RNA, 20 nt, Artificial Sequence
  MKO10108488_B_Pitpnc1
  gRNA
cgugcagaacgagcccuuug

SEQ ID NO: 108489 - RNA, 20 nt, Artificial Sequence
  MKO10108489_B_Pitpnc1
  gRNA
ucccuuguugucuucauacu

SEQ ID NO: 108490 - RNA, 20 nt, Artificial Sequence
  MKO10108490_B_Pitpnc1
  gRNA
aaccaaguaugaagacaaca

SEQ ID NO: 108491 - RNA, 20 nt, Artificial Sequence
  MKO10108491_B_Pitpnm1
  gRNA
acgcaugcuagcgcagcgua

SEQ ID NO: 108492 - RNA, 20 nt, Artificial Sequence
  MKO10108492_B_Pitpnm1
  gRNA
ccuaacgucuucaaccugag

SEQ ID NO: 108493 - RNA, 20 nt, Artificial Sequence
  MKO10108493_B_Pitpnm1
  gRNA
cuuacccauauacccggaca

SEQ ID NO: 108494 - RNA, 20 nt, Artificial Sequence
  MKO10108494_B_Pitpnm2
  gRNA
agacaucaucgacaucguca

SEQ ID NO: 108495 - RNA, 20 nt, Artificial Sequence
  MKO10108495_B_Pitpnm2
  gRNA
cccggcaagucuugacugac

SEQ ID NO: 108496 - RNA, 20 nt, Artificial Sequence
  MKO10108496_B_Pitpnm2
  gRNA
gauggugagggcccaccggc

SEQ ID NO: 108497 - RNA, 20 nt, Artificial Sequence
  MKO10108497_B_Pitpnm3
  gRNA
caugaaucucgauacuuccu

SEQ ID NO: 108498 - RNA, 20 nt, Artificial Sequence
  MKO10108498_B_Pitpnm3
  gRNA
aguaucgagauucaugaaga

SEQ ID NO: 108499 - RNA, 20 nt, Artificial Sequence
  MKO10108499_B_Pitpnm3
  gRNA
cgcccgggacauggccaagg

SEQ ID NO: 108500 - RNA, 20 nt, Artificial Sequence
  MKO10108500_B_Pitrm1
  gRNA
acgagcucuacaguauaaag

SEQ ID NO: 108501 - RNA, 20 nt, Artificial Sequence
  MKO10108501_B_Pitrm1
  gRNA
auacuguagagcucguucac

SEQ ID NO: 108502 - RNA, 20 nt, Artificial Sequence
  MKO10108502_B_Pitrm1
  gRNA
gaaccuccucuccguguauu

SEQ ID NO: 108503 - RNA, 20 nt, Artificial Sequence
  MKO10108503_B_Pitx1
  gRNA
uuuaccuggcagaucagcgu

SEQ ID NO: 108504 - RNA, 20 nt, Artificial Sequence
  MKO10108504_B_Pitx1
  gRNA
accucacugaaccgcgagug

SEQ ID NO: 108505 - RNA, 20 nt, Artificial Sequence
  MKO10108505_B_Pitx1
  gRNA
guagcgguuccuuuggaacg

SEQ ID NO: 108506 - RNA, 20 nt, Artificial Sequence
  MKO10108506_B_Pitx2
  gRNA
cacggcgauuucuucgcgag

SEQ ID NO: 108507 - RNA, 20 nt, Artificial Sequence
  MKO10108507_B_Pitx2
  gRNA
uccccccuuaccauuggcgc

SEQ ID NO: 108508 - RNA, 20 nt, Artificial Sequence
  MKO10108508_B_Pitx2
  gRNA
ggcgccuuaccugcgacuuc

SEQ ID NO: 108509 - RNA, 20 nt, Artificial Sequence
  MKO10108509_B_Pitx3
  gRNA
gcguccgauaacgacagcgc

SEQ ID NO: 108510 - RNA, 20 nt, Artificial Sequence
  MKO10108510_B_Pitx3
  gRNA
aagcccugcgcugucguuau

SEQ ID NO: 108511 - RNA, 20 nt, Artificial Sequence
  MKO10108511_B_Pitx3
  gRNA
uccacaccgcgaucucuucg

SEQ ID NO: 108512 - RNA, 20 nt, Artificial Sequence
  MKO10108512_B_Piwil1
  gRNA
gaagccuucgggccuccauc

SEQ ID NO: 108513 - RNA, 20 nt, Artificial Sequence
  MKO10108513_B_Piwil1
  gRNA
caucgacuacaauccccuga

SEQ ID NO: 108514 - RNA, 20 nt, Artificial Sequence
  MKO10108514_B_Piwil1
  gRNA
cgccgagacuuccaugaccu

SEQ ID NO: 108515 - RNA, 20 nt, Artificial Sequence
  MKO10108515_B_Piwil2
  gRNA
gcacucugccgaucccccuc

SEQ ID NO: 108516 - RNA, 20 nt, Artificial Sequence
  MKO10108516_B_Piwil2
  gRNA
aaacgagaagugccuccuuu

SEQ ID NO: 108517 - RNA, 20 nt, Artificial Sequence
  MKO10108517_B_Piwil2
  gRNA
guacacaccugaaagucaca

SEQ ID NO: 108518 - RNA, 20 nt, Artificial Sequence
  MKO10108518_B_Piwil4
  gRNA
acugguacagcugccaaucc

SEQ ID NO: 108519 - RNA, 20 nt, Artificial Sequence
  MKO10108519_B_Piwil4
  gRNA
aaugacacuugucccaccuc

SEQ ID NO: 108520 - RNA, 20 nt, Artificial Sequence
  MKO10108520_B_Piwil4
  gRNA
aagaguugggugucuguacc

SEQ ID NO: 108521 - RNA, 20 nt, Artificial Sequence
  MKO10108521_B_Pja1
  gRNA
uugccagcacacgucgucgc

SEQ ID NO: 108522 - RNA, 20 nt, Artificial Sequence
  MKO10108522_B_Pja1
  gRNA
cagaaucuuccucguaguau

SEQ ID NO: 108523 - RNA, 20 nt, Artificial Sequence
  MKO10108523_B_Pja1
  gRNA
cgugagcgaagaccucgaag

SEQ ID NO: 108524 - RNA, 20 nt, Artificial Sequence
  MKO10108524_B_Pja2
  gRNA
auagucugauauccuccugc

SEQ ID NO: 108525 - RNA, 20 nt, Artificial Sequence
  MKO10108525_B_Pja2
  gRNA
auggacuugauccaaugaac

SEQ ID NO: 108526 - RNA, 20 nt, Artificial Sequence
  MKO10108526_B_Pja2
  gRNA
gaaagaagcuugggucgggc

SEQ ID NO: 108527 - RNA, 20 nt, Artificial Sequence
  MKO10108527_B_Pkd1l2
  gRNA
gucaaagaugaagcucccgu

SEQ ID NO: 108528 - RNA, 20 nt, Artificial Sequence
  MKO10108528_B_Pkd1l2
  gRNA
cacccacagguagcuacccc

SEQ ID NO: 108529 - RNA, 20 nt, Artificial Sequence
  MKO10108529_B_Pkd1l2
  gRNA
ccgauguagccgcagcuccc

SEQ ID NO: 108530 - RNA, 20 nt, Artificial Sequence
  MKO10108530_B_Pkd1l3
  gRNA
aggggaaaccugacgcugcc

SEQ ID NO: 108531 - RNA, 20 nt, Artificial Sequence
  MKO10108531_B_Pkd1l3
  gRNA
gguuggugacacauggcuaa

SEQ ID NO: 108532 - RNA, 20 nt, Artificial Sequence
  MKO10108532_B_Pkd1l3
  gRNA
acagccgccuuucccccuca

SEQ ID NO: 108533 - RNA, 20 nt, Artificial Sequence
  MKO10108533_B_Pkd1
  gRNA
guuccagcguguugagcuaa

SEQ ID NO: 108534 - RNA, 20 nt, Artificial Sequence
  MKO10108534_B_Pkd1
  gRNA
ccacaaccuacuucagacgc

SEQ ID NO: 108535 - RNA, 20 nt, Artificial Sequence
  MKO10108535_B_Pkd1
  gRNA
ccuggugaaccuuucagcac

SEQ ID NO: 108536 - RNA, 20 nt, Artificial Sequence
  MKO10108536_B_Pkd2l1
  gRNA
cucacaagcuacagcggggg

SEQ ID NO: 108537 - RNA, 20 nt, Artificial Sequence
  MKO10108537_B_Pkd2l1
  gRNA
gguauacauaguguuccucg

SEQ ID NO: 108538 - RNA, 20 nt, Artificial Sequence
  MKO10108538_B_Pkd2l1
  gRNA
acuagaacuugucauuccgu

SEQ ID NO: 108539 - RNA, 20 nt, Artificial Sequence
  MKO10108539_B_Pkd2l2
  gRNA
gaguaacaacuccucgagug

SEQ ID NO: 108540 - RNA, 20 nt, Artificial Sequence
  MKO10108540_B_Pkd2l2
  gRNA
uaauccaguuguucagucga

SEQ ID NO: 108541 - RNA, 20 nt, Artificial Sequence
  MKO10108541_B_Pkd2l2
  gRNA
ggagguuaacaccacacucg

SEQ ID NO: 108542 - RNA, 20 nt, Artificial Sequence
  MKO10108542_B_Pkd2
  gRNA
acagagcuccauuuggaccg

SEQ ID NO: 108543 - RNA, 20 nt, Artificial Sequence
  MKO10108543_B_Pkd2
  gRNA
cacagaugcacaagacuacg

SEQ ID NO: 108544 - RNA, 20 nt, Artificial Sequence
  MKO10108544_B_Pkd2
  gRNA
aguaccugaaaaguguguua

SEQ ID NO: 108545 - RNA, 20 nt, Artificial Sequence
  MKO10108545_B_Pkdcc
  gRNA
ugcacggugucucuuccacg

SEQ ID NO: 108546 - RNA, 20 nt, Artificial Sequence
  MKO10108546_B_Pkdcc
  gRNA
uggaaacucuagcgugcagu

SEQ ID NO: 108547 - RNA, 20 nt, Artificial Sequence
  MKO10108547_B_Pkdcc
  gRNA
gcucuauggcuauugcuacc

SEQ ID NO: 108548 - RNA, 20 nt, Artificial Sequence
  MKO10108548_B_Pkdrej
  gRNA
caugcucaagcuucggacgu

SEQ ID NO: 108549 - RNA, 20 nt, Artificial Sequence
  MKO10108549_B_Pkdrej
  gRNA
aaccggcgaguauucuucuc

SEQ ID NO: 108550 - RNA, 20 nt, Artificial Sequence
  MKO10108550_B_Pkdrej
  gRNA
ccagcccuacgccgccccgu

SEQ ID NO: 108551 - RNA, 20 nt, Artificial Sequence
  MKO10108551_B_Pkhd1l1
  gRNA
cuacucuguucgagucagug

SEQ ID NO: 108552 - RNA, 20 nt, Artificial Sequence
  MKO10108552_B_Pkhd1l1
  gRNA
cacacugacucgaacagagu

SEQ ID NO: 108553 - RNA, 20 nt, Artificial Sequence
  MKO10108553_B_Pkhd1l1
  gRNA
ugugaugcuccuuauugugg

SEQ ID NO: 108554 - RNA, 20 nt, Artificial Sequence
  MKO10108554_B_Pkhd1
  gRNA
uuccaguuugaacccgcaga

SEQ ID NO: 108555 - RNA, 20 nt, Artificial Sequence
  MKO10108555_B_Pkhd1
  gRNA
gaaggccggagagacgucac

SEQ ID NO: 108556 - RNA, 20 nt, Artificial Sequence
  MKO10108556_B_Pkhd1
  gRNA
uacucccuggaaaugcgcuc

SEQ ID NO: 108557 - RNA, 20 nt, Artificial Sequence
  MKO10108557_B_Pkia
  gRNA
uuuguuagcaaugacugaug

SEQ ID NO: 108558 - RNA, 20 nt, Artificial Sequence
  MKO10108558_B_Pkia
  gRNA
gaauuagccuuaaaacuagc

SEQ ID NO: 108559 - RNA, 20 nt, Artificial Sequence
  MKO10108559_B_Pkia
  gRNA
aaaugcaauacaugauaucc

SEQ ID NO: 108560 - RNA, 20 nt, Artificial Sequence
  MKO10108560_B_Pkib
  gRNA
ccuugcugaggacgcaaagc

SEQ ID NO: 108561 - RNA, 20 nt, Artificial Sequence
  MKO10108561_B_Pkib
  gRNA
ccaaaaacaccccuaaauga

SEQ ID NO: 108562 - RNA, 20 nt, Artificial Sequence
  MKO10108562_B_Pkib
  gRNA
aagaaugaagagaaagacca

SEQ ID NO: 108563 - RNA, 20 nt, Artificial Sequence
  MKO10108563_B_Pkig
  gRNA
cuggcugcuggcuuccuugu

SEQ ID NO: 108564 - RNA, 20 nt, Artificial Sequence
  MKO10108564_B_Pkig
  gRNA
ggaagucgaguccuccuacu

SEQ ID NO: 108565 - RNA, 20 nt, Artificial Sequence
  MKO10108565_B_Pkig
  gRNA
uccgagucacccuggauguc

SEQ ID NO: 108566 - RNA, 20 nt, Artificial Sequence
  MKO10108566_B_Pklr
  gRNA
cgguccacagagcgugacgc

SEQ ID NO: 108567 - RNA, 20 nt, Artificial Sequence
  MKO10108567_B_Pklr
  gRNA
gaagguguccgccauagcug

SEQ ID NO: 108568 - RNA, 20 nt, Artificial Sequence
  MKO10108568_B_Pklr
  gRNA
gcucugagucgauauccaga

SEQ ID NO: 108569 - RNA, 20 nt, Artificial Sequence
  MKO10108569_B_Pkmyt1
  gRNA
gcugcggaagcccuaagucg

SEQ ID NO: 108570 - RNA, 20 nt, Artificial Sequence
  MKO10108570_B_Pkmyt1
  gRNA
ggcuggugcauccugccagu

SEQ ID NO: 108571 - RNA, 20 nt, Artificial Sequence
  MKO10108571_B_Pkmyt1
  gRNA
ggcccaccggccacaccacc

SEQ ID NO: 108572 - RNA, 20 nt, Artificial Sequence
  MKO10108572_B_Pkm
  gRNA
ugggggcagagucaaugucc

SEQ ID NO: 108573 - RNA, 20 nt, Artificial Sequence
  MKO10108573_B_Pkm
  gRNA
agggccugcuucccgaucug

SEQ ID NO: 108574 - RNA, 20 nt, Artificial Sequence
  MKO10108574_B_Pkm
  gRNA
ccuucagcaucuccacagau

SEQ ID NO: 108575 - RNA, 20 nt, Artificial Sequence
  MKO10108575_B_Pkn1
  gRNA
cugcaugcuccacucgaaaa

SEQ ID NO: 108576 - RNA, 20 nt, Artificial Sequence
  MKO10108576_B_Pkn1
  gRNA
augauccagaccuauagcaa

SEQ ID NO: 108577 - RNA, 20 nt, Artificial Sequence
  MKO10108577_B_Pkn1
  gRNA
gcgcucuucgaagcugcaug

SEQ ID NO: 108578 - RNA, 20 nt, Artificial Sequence
  MKO10108578_B_Pkn2
  gRNA
aaaugcacacaucguuguau

SEQ ID NO: 108579 - RNA, 20 nt, Artificial Sequence
  MKO10108579_B_Pkn2
  gRNA
ugauaagcccucuugagcuu

SEQ ID NO: 108580 - RNA, 20 nt, Artificial Sequence
  MKO10108580_B_Pkn2
  gRNA
acagaaauuggacgacauca

SEQ ID NO: 108581 - RNA, 20 nt, Artificial Sequence
  MKO10108581_B_Pkn3
  gRNA
gcagcaccgacuucgaguag

SEQ ID NO: 108582 - RNA, 20 nt, Artificial Sequence
  MKO10108582_B_Pkn3
  gRNA
ccuuaccuugggggugccgc

SEQ ID NO: 108583 - RNA, 20 nt, Artificial Sequence
  MKO10108583_B_Pkn3
  gRNA
ggcucucggaggcuuuacau

SEQ ID NO: 108584 - RNA, 20 nt, Artificial Sequence
  MKO10108584_B_Pknox1
  gRNA
guacuccccugugcaauccc

SEQ ID NO: 108585 - RNA, 20 nt, Artificial Sequence
  MKO10108585_B_Pknox1
  gRNA
cagauucagagugccaucac

SEQ ID NO: 108586 - RNA, 20 nt, Artificial Sequence
  MKO10108586_B_Pknox1
  gRNA
cucaauguccacaucgaagc

SEQ ID NO: 108587 - RNA, 20 nt, Artificial Sequence
  MKO10108587_B_Pknox2
  gRNA
cgagaacuuuguccaccagc

SEQ ID NO: 108588 - RNA, 20 nt, Artificial Sequence
  MKO10108588_B_Pknox2
  gRNA
gaggauccaccugcuagagu

SEQ ID NO: 108589 - RNA, 20 nt, Artificial Sequence
  MKO10108589_B_Pknox2
  gRNA
ccccgaggucauuccugagc

SEQ ID NO: 108590 - RNA, 20 nt, Artificial Sequence
  MKO10108590_B_Pkp1
  gRNA
ugccggggcccugcgcaacc

SEQ ID NO: 108591 - RNA, 20 nt, Artificial Sequence
  MKO10108591_B_Pkp1
  gRNA
cucucggcaggucuaucagc

SEQ ID NO: 108592 - RNA, 20 nt, Artificial Sequence
  MKO10108592_B_Pkp1
  gRNA
gcugacaauuacaacaacua

SEQ ID NO: 108593 - RNA, 20 nt, Artificial Sequence
  MKO10108593_B_Pkp2
  gRNA
guaugucuacaagcuacacg

SEQ ID NO: 108594 - RNA, 20 nt, Artificial Sequence
  MKO10108594_B_Pkp2
  gRNA
uguagcuuguagacauacuc

SEQ ID NO: 108595 - RNA, 20 nt, Artificial Sequence
  MKO10108595_B_Pkp2
  gRNA
uucagaacgaagauguucaa

SEQ ID NO: 108596 - RNA, 20 nt, Artificial Sequence
  MKO10108596_B_Pkp3
  gRNA
acccauugugccgcgacugc

SEQ ID NO: 108597 - RNA, 20 nt, Artificial Sequence
  MKO10108597_B_Pkp3
  gRNA
cauagugugauauugaccuc

SEQ ID NO: 108598 - RNA, 20 nt, Artificial Sequence
  MKO10108598_B_Pkp3
  gRNA
ucccgaucccagggcaugag

SEQ ID NO: 108599 - RNA, 20 nt, Artificial Sequence
  MKO10108599_B_Pkp4
  gRNA
cacuauucuagcuuccguga

SEQ ID NO: 108600 - RNA, 20 nt, Artificial Sequence
  MKO10108600_B_Pkp4
  gRNA
uguccugaugagauaguugu

SEQ ID NO: 108601 - RNA, 20 nt, Artificial Sequence
  MKO10108601_B_Pkp4
  gRNA
cuugcagaugugccaaaucc

SEQ ID NO: 108602 - RNA, 20 nt, Artificial Sequence
  MKO10108602_B_Pla1a
  gRNA
ccagacugacaccaaugaug

SEQ ID NO: 108603 - RNA, 20 nt, Artificial Sequence
  MKO10108603_B_Pla1a
  gRNA
cagcauccaagcguuccucc

SEQ ID NO: 108604 - RNA, 20 nt, Artificial Sequence
  MKO10108604_B_Pla1a
  gRNA
cugguguacucugguccagc

SEQ ID NO: 108605 - RNA, 20 nt, Artificial Sequence
  MKO10108605_B_Pla2g10
  gRNA
agccacgugacgccauugac

SEQ ID NO: 108606 - RNA, 20 nt, Artificial Sequence
  MKO10108606_B_Pla2g10
  gRNA
caccagucaauggcgucacg

SEQ ID NO: 108607 - RNA, 20 nt, Artificial Sequence
  MKO10108607_B_Pla2g10
  gRNA
gugagccugucaauugcacu

SEQ ID NO: 108608 - RNA, 20 nt, Artificial Sequence
  MKO10108608_B_Pla2g12a
  gRNA
uuauauccauagcguggaac

SEQ ID NO: 108609 - RNA, 20 nt, Artificial Sequence
  MKO10108609_B_Pla2g12a
  gRNA
gacaccagcaugcagcccgc

SEQ ID NO: 108610 - RNA, 20 nt, Artificial Sequence
  MKO10108610_B_Pla2g12a
  gRNA
gacagaugcuacgagaccug

SEQ ID NO: 108611 - RNA, 20 nt, Artificial Sequence
  MKO10108611_B_Pla2g12b
  gRNA
ugcccgcugacuguucauaa

SEQ ID NO: 108612 - RNA, 20 nt, Artificial Sequence
  MKO10108612_B_Pla2g12b
  gRNA
uccacucaccauaucgacac

SEQ ID NO: 108613 - RNA, 20 nt, Artificial Sequence
  MKO10108613_B_Pla2g12b
  gRNA
cgagucugucaacagcuacg

SEQ ID NO: 108614 - RNA, 20 nt, Artificial Sequence
  MKO10108614_B_Pla2g15
  gRNA
uucgaggugcucccuaugau

SEQ ID NO: 108615 - RNA, 20 nt, Artificial Sequence
  MKO10108615_B_Pla2g15
  gRNA
acgugcgugucccuggcuuu

SEQ ID NO: 108616 - RNA, 20 nt, Artificial Sequence
  MKO10108616_B_Pla2g15
  gRNA
uccugcagugccuggugauu

SEQ ID NO: 108617 - RNA, 20 nt, Artificial Sequence
  MKO10108617_B_Pla2g16
  gRNA
uuggcggccuugggccucgu

SEQ ID NO: 108618 - RNA, 20 nt, Artificial Sequence
  MKO10108618_B_Pla2g16
  gRNA
ugauggauacgugauccacc

SEQ ID NO: 108619 - RNA, 20 nt, Artificial Sequence
  MKO10108619_B_Pla2g16
  gRNA
uccgcccuauguacagacac

SEQ ID NO: 108620 - RNA, 20 nt, Artificial Sequence
  MKO10108620_B_Pla2g1b
  gRNA
ccccaguggacgacuuagac

SEQ ID NO: 108621 - RNA, 20 nt, Artificial Sequence
  MKO10108621_B_Pla2g1b
  gRNA
gacaggcuaacagaauuucc

SEQ ID NO: 108622 - RNA, 20 nt, Artificial Sequence
  MKO10108622_B_Pla2g1b
  gRNA
uguagcaguggucaugaguc

SEQ ID NO: 108623 - RNA, 20 nt, Artificial Sequence
  MKO10108623_B_Pla2g2a
  gRNA
ugacuguugcuacaagcgcc

SEQ ID NO: 108624 - RNA, 20 nt, Artificial Sequence
  MKO10108624_B_Pla2g2a
  gRNA
cuuaccaaaggccaugaucg

SEQ ID NO: 108625 - RNA, 20 nt, Artificial Sequence
  MKO10108625_B_Pla2g2a
  gRNA
ucuuaccagaacaggugauu

SEQ ID NO: 108626 - RNA, 20 nt, Artificial Sequence
  MKO10108626_B_Pla2g2c
  gRNA
cuccacagguggaugcaccg

SEQ ID NO: 108627 - RNA, 20 nt, Artificial Sequence
  MKO10108627_B_Pla2g2c
  gRNA
ggucaccgucccauugacaa

SEQ ID NO: 108628 - RNA, 20 nt, Artificial Sequence
  MKO10108628_B_Pla2g2c
  gRNA
agccauauuccuuaagcuug

SEQ ID NO: 108629 - RNA, 20 nt, Artificial Sequence
  MKO10108629_B_Pla2g2d
  gRNA
uaugcccaccugaagaucga

SEQ ID NO: 108630 - RNA, 20 nt, Artificial Sequence
  MKO10108630_B_Pla2g2d
  gRNA
ggcagguauaacugcaaccc

SEQ ID NO: 108631 - RNA, 20 nt, Artificial Sequence
  MKO10108631_B_Pla2g2d
  gRNA
aaguccacagugacagccgu

SEQ ID NO: 108632 - RNA, 20 nt, Artificial Sequence
  MKO10108632_B_Pla2g2e
  gRNA
gcccugcaguacaaugacua

SEQ ID NO: 108633 - RNA, 20 nt, Artificial Sequence
  MKO10108633_B_Pla2g2e
  gRNA
gaugaaaccucccauugccc

SEQ ID NO: 108634 - RNA, 20 nt, Artificial Sequence
  MKO10108634_B_Pla2g2e
  gRNA
acucgagacaacaucuucug

SEQ ID NO: 108635 - RNA, 20 nt, Artificial Sequence
  MKO10108635_B_Pla2g2f
  gRNA
gcuucucauagcaacagucg

SEQ ID NO: 108636 - RNA, 20 nt, Artificial Sequence
  MKO10108636_B_Pla2g2f
  gRNA
acgcggccaucccauggaug

SEQ ID NO: 108637 - RNA, 20 nt, Artificial Sequence
  MKO10108637_B_Pla2g2f
  gRNA
auucuuugccaucgcagucc

SEQ ID NO: 108638 - RNA, 20 nt, Artificial Sequence
  MKO10108638_B_Pla2g3
  gRNA
cacgcccaugaugucggaga

SEQ ID NO: 108639 - RNA, 20 nt, Artificial Sequence
  MKO10108639_B_Pla2g3
  gRNA
uauaguaaguccugggccga

SEQ ID NO: 108640 - RNA, 20 nt, Artificial Sequence
  MKO10108640_B_Pla2g3
  gRNA
gguaguugugcugugacguc

SEQ ID NO: 108641 - RNA, 20 nt, Artificial Sequence
  MKO10108641_B_Pla2g4a
  gRNA
acgugccaccaaaguaacca

SEQ ID NO: 108642 - RNA, 20 nt, Artificial Sequence
  MKO10108642_B_Pla2g4a
  gRNA
cccuguaucuucaaugaaag

SEQ ID NO: 108643 - RNA, 20 nt, Artificial Sequence
  MKO10108643_B_Pla2g4a
  gRNA
auaaugauauaaaccccgug

SEQ ID NO: 108644 - RNA, 20 nt, Artificial Sequence
  MKO10108644_B_Pla2g4b
  gRNA
agcguguggcuggaagccgu

SEQ ID NO: 108645 - RNA, 20 nt, Artificial Sequence
  MKO10108645_B_Pla2g4b
  gRNA
auugucagugcuguuugacg

SEQ ID NO: 108646 - RNA, 20 nt, Artificial Sequence
  MKO10108646_B_Pla2g4b
  gRNA
acuuccacuuccggauccau

SEQ ID NO: 108647 - RNA, 20 nt, Artificial Sequence
  MKO10108647_B_Pla2g4c
  gRNA
ugugcacaaacgcaguccca

SEQ ID NO: 108648 - RNA, 20 nt, Artificial Sequence
  MKO10108648_B_Pla2g4c
  gRNA
ucuucacucuacaccaagaa

SEQ ID NO: 108649 - RNA, 20 nt, Artificial Sequence
  MKO10108649_B_Pla2g4c
  gRNA
aucgguaugagaagaaugag

SEQ ID NO: 108650 - RNA, 20 nt, Artificial Sequence
  MKO10108650_B_Pla2g4d
  gRNA
gggaccagaagaguuagaug

SEQ ID NO: 108651 - RNA, 20 nt, Artificial Sequence
  MKO10108651_B_Pla2g4d
  gRNA
aaccuucagccugaauccuc

SEQ ID NO: 108652 - RNA, 20 nt, Artificial Sequence
  MKO10108652_B_Pla2g4d
  gRNA
ucuuacccaccugaggauuc

SEQ ID NO: 108653 - RNA, 20 nt, Artificial Sequence
  MKO10108653_B_Pla2g4e
  gRNA
cuacuuacuucucuucgagu

SEQ ID NO: 108654 - RNA, 20 nt, Artificial Sequence
  MKO10108654_B_Pla2g4e
  gRNA
gaaguucccacucaacccag

SEQ ID NO: 108655 - RNA, 20 nt, Artificial Sequence
  MKO10108655_B_Pla2g4e
  gRNA
ucagauccagacucaaguaa

SEQ ID NO: 108656 - RNA, 20 nt, Artificial Sequence
  MKO10108656_B_Pla2g4f
  gRNA
ggagcuugcccuuuaugacg

SEQ ID NO: 108657 - RNA, 20 nt, Artificial Sequence
  MKO10108657_B_Pla2g4f
  gRNA
cuugcacaaaaaacuucacc

SEQ ID NO: 108658 - RNA, 20 nt, Artificial Sequence
  MKO10108658_B_Pla2g4f
  gRNA
uguguaggauccaaaagagc

SEQ ID NO: 108659 - RNA, 20 nt, Artificial Sequence
  MKO10108659_B_Pla2g5
  gRNA
cugugccugugaccggaagc

SEQ ID NO: 108660 - RNA, 20 nt, Artificial Sequence
  MKO10108660_B_Pla2g5
  gRNA
cacccuuaccgcagaugacu

SEQ ID NO: 108661 - RNA, 20 nt, Artificial Sequence
  MKO10108661_B_Pla2g5
  gRNA
acucaaguccaugauugaga

SEQ ID NO: 108662 - RNA, 20 nt, Artificial Sequence
  MKO10108662_B_Pla2g6
  gRNA
uguccccuugcacagcguaa

SEQ ID NO: 108663 - RNA, 20 nt, Artificial Sequence
  MKO10108663_B_Pla2g6
  gRNA
gccuuccauuacgcugugca

SEQ ID NO: 108664 - RNA, 20 nt, Artificial Sequence
  MKO10108664_B_Pla2g6
  gRNA
agcaccugaccgaccucauc

SEQ ID NO: 108665 - RNA, 20 nt, Artificial Sequence
  MKO10108665_B_Pla2g7
  gRNA
aacauaccuguguucgacag

SEQ ID NO: 108666 - RNA, 20 nt, Artificial Sequence
  MKO10108666_B_Pla2g7
  gRNA
cucugacaacuccugcaagc

SEQ ID NO: 108667 - RNA, 20 nt, Artificial Sequence
  MKO10108667_B_Pla2g7
  gRNA
aggcgaccuugaucuugagc

SEQ ID NO: 108668 - RNA, 20 nt, Artificial Sequence
  MKO10108668_B_Pla2r1
  gRNA
acuucucgucuucuucguau

SEQ ID NO: 108669 - RNA, 20 nt, Artificial Sequence
  MKO10108669_B_Pla2r1
  gRNA
guggauugguuugaaccagc

SEQ ID NO: 108670 - RNA, 20 nt, Artificial Sequence
  MKO10108670_B_Pla2r1
  gRNA
caccacucagcuaccugaac

SEQ ID NO: 108671 - RNA, 20 nt, Artificial Sequence
  MKO10108671_B_Plaa
  gRNA
agggucauacagccgcagua

SEQ ID NO: 108672 - RNA, 20 nt, Artificial Sequence
  MKO10108672_B_Plaa
  gRNA
guuagcauuaagcccuguuc

SEQ ID NO: 108673 - RNA, 20 nt, Artificial Sequence
  MKO10108673_B_Plaa
  gRNA
aaauuugggacauuacuuag

SEQ ID NO: 108674 - RNA, 20 nt, Artificial Sequence
  MKO10108674_B_Plac1
  gRNA
cugcaguuggguuguucgcu

SEQ ID NO: 108675 - RNA, 20 nt, Artificial Sequence
  MKO10108675_B_Plac1
  gRNA
aaugaaccuucgcaaguucc

SEQ ID NO: 108676 - RNA, 20 nt, Artificial Sequence
  MKO10108676_B_Plac1
  gRNA
auauuucguugaugagcccu

SEQ ID NO: 108677 - RNA, 20 nt, Artificial Sequence
  MKO10108677_B_Plac8l1
  gRNA
agcauuuaaucucgaacuug

SEQ ID NO: 108678 - RNA, 20 nt, Artificial Sequence
  MKO10108678_B_Plac8l1
  gRNA
gucuugagugugacauugcc

SEQ ID NO: 108679 - RNA, 20 nt, Artificial Sequence
  MKO10108679_B_Plac8l1
  gRNA
acuucuaacuaugagcugga

SEQ ID NO: 108680 - RNA, 20 nt, Artificial Sequence
  MKO10108680_B_Plac8
  gRNA
gguugagucacgauaacugu

SEQ ID NO: 108681 - RNA, 20 nt, Artificial Sequence
  MKO10108681_B_Plac8
  gRNA
agcuccuuagaaagcguuca

SEQ ID NO: 108682 - RNA, 20 nt, Artificial Sequence
  MKO10108682_B_Plac8
  gRNA
agagccaugaacgcuuucua

SEQ ID NO: 108683 - RNA, 20 nt, Artificial Sequence
  MKO10108683_B_Plac9a
  gRNA
gccgcgugucugucacagcc

SEQ ID NO: 108684 - RNA, 20 nt, Artificial Sequence
  MKO10108684_B_Plac9a
  gRNA
ccagacgguggagaagacag

SEQ ID NO: 108685 - RNA, 20 nt, Artificial Sequence
  MKO10108685_B_Plac9a
  gRNA
ucaccaucuccaagcaaguc

SEQ ID NO: 108686 - RNA, 20 nt, Artificial Sequence
  MKO10108686_B_Plac9b
  gRNA
gccgcgugucugucacagcc

SEQ ID NO: 108687 - RNA, 20 nt, Artificial Sequence
  MKO10108687_B_Plac9b
  gRNA
ccagacgguggagaagacag

SEQ ID NO: 108688 - RNA, 20 nt, Artificial Sequence
  MKO10108688_B_Plac9b
  gRNA
ucaccaucuccaagcaaguc

SEQ ID NO: 108689 - RNA, 20 nt, Artificial Sequence
  MKO10108689_B_Plag1
  gRNA
ccacgcuuacguuucccuga

SEQ ID NO: 108690 - RNA, 20 nt, Artificial Sequence
  MKO10108690_B_Plag1
  gRNA
gugucgcuuaaaaccaagcu

SEQ ID NO: 108691 - RNA, 20 nt, Artificial Sequence
  MKO10108691_B_Plag1
  gRNA
ucuacacccggaaggauguc

SEQ ID NO: 108692 - RNA, 20 nt, Artificial Sequence
  MKO10108692_B_Plagl1
  gRNA
gaacuucuccagggugacga

SEQ ID NO: 108693 - RNA, 20 nt, Artificial Sequence
  MKO10108693_B_Plagl1
  gRNA
uccuacgcgugugacgauug

SEQ ID NO: 108694 - RNA, 20 nt, Artificial Sequence
  MKO10108694_B_Plagl1
  gRNA
cgccauugcucgccgagugc

SEQ ID NO: 108695 - RNA, 20 nt, Artificial Sequence
  MKO10108695_B_Plagl2
  gRNA
gccuugccgcagugcagcug

SEQ ID NO: 108696 - RNA, 20 nt, Artificial Sequence
  MKO10108696_B_Plagl2
  gRNA
aguggugcacacaggucgua

SEQ ID NO: 108697 - RNA, 20 nt, Artificial Sequence
  MKO10108697_B_Plagl2
  gRNA
ucuucuugacauggcguguc

SEQ ID NO: 108698 - RNA, 20 nt, Artificial Sequence
  MKO10108698_B_Plau
  gRNA
gcaucaccuacagaggcacg

SEQ ID NO: 108699 - RNA, 20 nt, Artificial Sequence
  MKO10108699_B_Plau
  gRNA
agcgaaccaagaugcuucaa

SEQ ID NO: 108700 - RNA, 20 nt, Artificial Sequence
  MKO10108700_B_Plau
  gRNA
ucucuuugcagggaauacau

SEQ ID NO: 108701 - RNA, 20 nt, Artificial Sequence
  MKO10108701_B_Plaur
  gRNA
uggcgcacacggucucuguc

SEQ ID NO: 108702 - RNA, 20 nt, Artificial Sequence
  MKO10108702_B_Plaur
  gRNA
ucugcaggacuaccgugcuu

SEQ ID NO: 108703 - RNA, 20 nt, Artificial Sequence
  MKO10108703_B_Plaur
  gRNA
caccugggccaccauugcag

SEQ ID NO: 108704 - RNA, 20 nt, Artificial Sequence
  MKO10108704_B_Plau
  gRNA
agaccugaugcuauuagccu

SEQ ID NO: 108705 - RNA, 20 nt, Artificial Sequence
  MKO10108705_B_Plau
  gRNA
uugcaggguggcaguguacu

SEQ ID NO: 108706 - RNA, 20 nt, Artificial Sequence
  MKO10108706_B_Plau
  gRNA
gcuaugugcagauuggccua

SEQ ID NO: 108707 - RNA, 20 nt, Artificial Sequence
  MKO10108707_B_Plb1
  gRNA
uuagggcccucccaaaucca

SEQ ID NO: 108708 - RNA, 20 nt, Artificial Sequence
  MKO10108708_B_Plb1
  gRNA
cucuucuggagagaacacau

SEQ ID NO: 108709 - RNA, 20 nt, Artificial Sequence
  MKO10108709_B_Plb1
  gRNA
uugagugugcuuucugaguc

SEQ ID NO: 108710 - RNA, 20 nt, Artificial Sequence
  MKO10108710_B_Plbd1
  gRNA
gacaagaauggggacgccua

SEQ ID NO: 108711 - RNA, 20 nt, Artificial Sequence
  MKO10108711_B_Plbd1
  gRNA
uauguggugacccagcucga

SEQ ID NO: 108712 - RNA, 20 nt, Artificial Sequence
  MKO10108712_B_Plbd1
  gRNA
accaguaugcuguugcacag

SEQ ID NO: 108713 - RNA, 20 nt, Artificial Sequence
  MKO10108713_B_Plbd2
  gRNA
uacgcaucaucaagaaguac

SEQ ID NO: 108714 - RNA, 20 nt, Artificial Sequence
  MKO10108714_B_Plbd2
  gRNA
ggccguuuaaccuucccaac

SEQ ID NO: 108715 - RNA, 20 nt, Artificial Sequence
  MKO10108715_B_Plbd2
  gRNA
gagguucaccaucaaacccu

SEQ ID NO: 108716 - RNA, 20 nt, Artificial Sequence
  MKO10108716_B_Plcb1
  gRNA
aucaucccacuugacgaauu

SEQ ID NO: 108717 - RNA, 20 nt, Artificial Sequence
  MKO10108717_B_Plcb1
  gRNA
guucccuaccuugggagcuu

SEQ ID NO: 108718 - RNA, 20 nt, Artificial Sequence
  MKO10108718_B_Plcb1
  gRNA
cacaccuggcauccuugaca

SEQ ID NO: 108719 - RNA, 20 nt, Artificial Sequence
  MKO10108719_B_Plcb2
  gRNA
aguccauguugaagaccucc

SEQ ID NO: 108720 - RNA, 20 nt, Artificial Sequence
  MKO10108720_B_Plcb2
  gRNA
cgaggagcauugacugucau

SEQ ID NO: 108721 - RNA, 20 nt, Artificial Sequence
  MKO10108721_B_Plcb2
  gRNA
acuucccaaagcgaguaucu

SEQ ID NO: 108722 - RNA, 20 nt, Artificial Sequence
  MKO10108722_B_Plcb3
  gRNA
cccuaagauucgagaaguac

SEQ ID NO: 108723 - RNA, 20 nt, Artificial Sequence
  MKO10108723_B_Plcb3
  gRNA
cccaguacuucucgaaucuu

SEQ ID NO: 108724 - RNA, 20 nt, Artificial Sequence
  MKO10108724_B_Plcb3
  gRNA
cagggucaccagguuccgac

SEQ ID NO: 108725 - RNA, 20 nt, Artificial Sequence
  MKO10108725_B_Plcb4
  gRNA
ucgccaagcagccauaccaa

SEQ ID NO: 108726 - RNA, 20 nt, Artificial Sequence
  MKO10108726_B_Plcb4
  gRNA
uuccugacguggaagaguga

SEQ ID NO: 108727 - RNA, 20 nt, Artificial Sequence
  MKO10108727_B_Plcb4
  gRNA
uuaccuuugguauggcugcu

SEQ ID NO: 108728 - RNA, 20 nt, Artificial Sequence
  MKO10108728_B_Plcd1
  gRNA
cacggucgaucucugcccgc

SEQ ID NO: 108729 - RNA, 20 nt, Artificial Sequence
  MKO10108729_B_Plcd1
  gRNA
gauucacuccugcuugcgaa

SEQ ID NO: 108730 - RNA, 20 nt, Artificial Sequence
  MKO10108730_B_Plcd1
  gRNA
uuuaucagccuuucgcaagc

SEQ ID NO: 108731 - RNA, 20 nt, Artificial Sequence
  MKO10108731_B_Plcd3
  gRNA
auuggucuaggcgcucccgc

SEQ ID NO: 108732 - RNA, 20 nt, Artificial Sequence
  MKO10108732_B_Plcd3
  gRNA
ggacauccucauccuccguc

SEQ ID NO: 108733 - RNA, 20 nt, Artificial Sequence
  MKO10108733_B_Plcd3
  gRNA
guacgcuuaccgccucuuca

SEQ ID NO: 108734 - RNA, 20 nt, Artificial Sequence
  MKO10108734_B_Plcd4
  gRNA
cucaguacuagccacugauc

SEQ ID NO: 108735 - RNA, 20 nt, Artificial Sequence
  MKO10108735_B_Plcd4
  gRNA
gagcuucucugaaacucauc

SEQ ID NO: 108736 - RNA, 20 nt, Artificial Sequence
  MKO10108736_B_Plcd4
  gRNA
agaaggcacaaugaugcgca

SEQ ID NO: 108737 - RNA, 20 nt, Artificial Sequence
  MKO10108737_B_Plce1
  gRNA
guucuccacuuugagacgug

SEQ ID NO: 108738 - RNA, 20 nt, Artificial Sequence
  MKO10108738_B_Plce1
  gRNA
ggcagugaucucuggcauuc

SEQ ID NO: 108739 - RNA, 20 nt, Artificial Sequence
  MKO10108739_B_Plce1
  gRNA
ggcccagcaugagucuuccg

SEQ ID NO: 108740 - RNA, 20 nt, Artificial Sequence
  MKO10108740_B_Plcg1
  gRNA
uuagcaccuaccgauccucu

SEQ ID NO: 108741 - RNA, 20 nt, Artificial Sequence
  MKO10108741_B_Plcg1
  gRNA
gcuaauggaggauacacugc

SEQ ID NO: 108742 - RNA, 20 nt, Artificial Sequence
  MKO10108742_B_Plcg1
  gRNA
ccggaagcaguucuacucag

SEQ ID NO: 108743 - RNA, 20 nt, Artificial Sequence
  MKO10108743_B_Plcg2
  gRNA
uugccaaacugagcgugcug

SEQ ID NO: 108744 - RNA, 20 nt, Artificial Sequence
  MKO10108744_B_Plcg2
  gRNA
cgcucacuuugaaguugacc

SEQ ID NO: 108745 - RNA, 20 nt, Artificial Sequence
  MKO10108745_B_Plcg2
  gRNA
uagaucaaacccgaagaaac

SEQ ID NO: 108746 - RNA, 20 nt, Artificial Sequence
  MKO10108746_B_Plch1
  gRNA
aucugccccgcagaaaaguc

SEQ ID NO: 108747 - RNA, 20 nt, Artificial Sequence
  MKO10108747_B_Plch1
  gRNA
cuccaucuacaaagucaccg

SEQ ID NO: 108748 - RNA, 20 nt, Artificial Sequence
  MKO10108748_B_Plch1
  gRNA
cauuuaguuuaugcaucagc

SEQ ID NO: 108749 - RNA, 20 nt, Artificial Sequence
  MKO10108749_B_Plch2
  gRNA
gacuacggcuuggauaugcc

SEQ ID NO: 108750 - RNA, 20 nt, Artificial Sequence
  MKO10108750_B_Plch2
  gRNA
agcaccgcuccugccuccga

SEQ ID NO: 108751 - RNA, 20 nt, Artificial Sequence
  MKO10108751_B_Plch2
  gRNA
auugguccgcuucuacuacc

SEQ ID NO: 108752 - RNA, 20 nt, Artificial Sequence
  MKO10108752_B_Plcl1
  gRNA
gaacgccauagugucuguua

SEQ ID NO: 108753 - RNA, 20 nt, Artificial Sequence
  MKO10108753_B_Plcl1
  gRNA
gaaggacugcuuuccuuacc

SEQ ID NO: 108754 - RNA, 20 nt, Artificial Sequence
  MKO10108754_B_Plcl1
  gRNA
auuccaagcgaagcucucaa

SEQ ID NO: 108755 - RNA, 20 nt, Artificial Sequence
  MKO10108755_B_Plcl2
  gRNA
gcugcaagccaucgugccug

SEQ ID NO: 108756 - RNA, 20 nt, Artificial Sequence
  MKO10108756_B_Plcl2
  gRNA
ugccgugucuccucgauucc

SEQ ID NO: 108757 - RNA, 20 nt, Artificial Sequence
  MKO10108757_B_Plcl2
  gRNA
cuuuaagauuguaauauucc

SEQ ID NO: 108758 - RNA, 20 nt, Artificial Sequence
  MKO10108758_B_Plcxd1
  gRNA
ccggcgcaugcgcgauccgc

SEQ ID NO: 108759 - RNA, 20 nt, Artificial Sequence
  MKO10108759_B_Plcxd1
  gRNA
gcaaucacacccccgcgagg

SEQ ID NO: 108760 - RNA, 20 nt, Artificial Sequence
  MKO10108760_B_Plcxd1
  gRNA
ccagcugcugcgucacgucc

SEQ ID NO: 108761 - RNA, 20 nt, Artificial Sequence
  MKO10108761_B_Plcxd2
  gRNA
ggauccgcuacuuugaccua

SEQ ID NO: 108762 - RNA, 20 nt, Artificial Sequence
  MKO10108762_B_Plcxd2
  gRNA
guucaacucaaucacagucg

SEQ ID NO: 108763 - RNA, 20 nt, Artificial Sequence
  MKO10108763_B_Plcxd2
  gRNA
aagcugucauacgccuugcc

SEQ ID NO: 108764 - RNA, 20 nt, Artificial Sequence
  MKO10108764_B_Plcxd3
  gRNA
uucgagacccucguugacuu

SEQ ID NO: 108765 - RNA, 20 nt, Artificial Sequence
  MKO10108765_B_Plcxd3
  gRNA
auauugaugccgcucucucc

SEQ ID NO: 108766 - RNA, 20 nt, Artificial Sequence
  MKO10108766_B_Plcxd3
  gRNA
ccuaccugggauggcuaaau

SEQ ID NO: 108767 - RNA, 20 nt, Artificial Sequence
  MKO10108767_B_Plcz1
  gRNA
aaugaacccauuguguacca

SEQ ID NO: 108768 - RNA, 20 nt, Artificial Sequence
  MKO10108768_B_Plcz1
  gRNA
aaguaugagcccauugaaga

SEQ ID NO: 108769 - RNA, 20 nt, Artificial Sequence
  MKO10108769_B_Plcz1
  gRNA
uguguaaccaugguacacaa

SEQ ID NO: 108770 - RNA, 20 nt, Artificial Sequence
  MKO10108770_B_Pld1
  gRNA
uucaucagaaaacgcaaucc

SEQ ID NO: 108771 - RNA, 20 nt, Artificial Sequence
  MKO10108771_B_Pld1
  gRNA
ggcaugauaguuucuguaca

SEQ ID NO: 108772 - RNA, 20 nt, Artificial Sequence
  MKO10108772_B_Pld1
  gRNA
gacagccagagagguagguc

SEQ ID NO: 108773 - RNA, 20 nt, Artificial Sequence
  MKO10108773_B_Pld2
  gRNA
ggcaccgaaagauacaccag

SEQ ID NO: 108774 - RNA, 20 nt, Artificial Sequence
  MKO10108774_B_Pld2
  gRNA
uauucuguucgcuugacgca

SEQ ID NO: 108775 - RNA, 20 nt, Artificial Sequence
  MKO10108775_B_Pld2
  gRNA
gaagaaguuccgacacuuuc

SEQ ID NO: 108776 - RNA, 20 nt, Artificial Sequence
  MKO10108776_B_Pld3
  gRNA
uacggggacuuacaucuauu

SEQ ID NO: 108777 - RNA, 20 nt, Artificial Sequence
  MKO10108777_B_Pld3
  gRNA
aguagaaggaugcgaugucc

SEQ ID NO: 108778 - RNA, 20 nt, Artificial Sequence
  MKO10108778_B_Pld3
  gRNA
ugcugugagcaccggcaagg

SEQ ID NO: 108779 - RNA, 20 nt, Artificial Sequence
  MKO10108779_B_Pld4
  gRNA
ccacuucuuucaccagucau

SEQ ID NO: 108780 - RNA, 20 nt, Artificial Sequence
  MKO10108780_B_Pld4
  gRNA
acuggggaugcuagcuguac

SEQ ID NO: 108781 - RNA, 20 nt, Artificial Sequence
  MKO10108781_B_Pld4
  gRNA
guggaugucuuggccaaugu

SEQ ID NO: 108782 - RNA, 20 nt, Artificial Sequence
  MKO10108782_B_Pld5
  gRNA
gaacaugaccgccuacaaca

SEQ ID NO: 108783 - RNA, 20 nt, Artificial Sequence
  MKO10108783_B_Pld5
  gRNA
ggccuuacccuuuaacuuca

SEQ ID NO: 108784 - RNA, 20 nt, Artificial Sequence
  MKO10108784_B_Pld5
  gRNA
ccucuuaccgacauuuauuu

SEQ ID NO: 108785 - RNA, 20 nt, Artificial Sequence
  MKO10108785_B_Pld6
  gRNA
aagaagagcaccucgcgccu

SEQ ID NO: 108786 - RNA, 20 nt, Artificial Sequence
  MKO10108786_B_Pld6
  gRNA
ccgccaacucgagcgcccca

SEQ ID NO: 108787 - RNA, 20 nt, Artificial Sequence
  MKO10108787_B_Pld6
  gRNA
ccgccugcugcgcgcgcugu

SEQ ID NO: 108788 - RNA, 20 nt, Artificial Sequence
  MKO10108788_B_Plec
  gRNA
cuguacgaagaccuccguga

SEQ ID NO: 108789 - RNA, 20 nt, Artificial Sequence
  MKO10108789_B_Plec
  gRNA
agccaccuaccuggaagugc

SEQ ID NO: 108790 - RNA, 20 nt, Artificial Sequence
  MKO10108790_B_Plec
  gRNA
aagguguuuguugacccacu

SEQ ID NO: 108791 - RNA, 20 nt, Artificial Sequence
  MKO10108791_B_Plek2
  gRNA
aauccggccaagccccaaca

SEQ ID NO: 108792 - RNA, 20 nt, Artificial Sequence
  MKO10108792_B_Plek2
  gRNA
auaacaggggcuauccaugc

SEQ ID NO: 108793 - RNA, 20 nt, Artificial Sequence
  MKO10108793_B_Plek2
  gRNA
gucucucuccucucgagaac

SEQ ID NO: 108794 - RNA, 20 nt, Artificial Sequence
  MKO10108794_B_Plekha1
  gRNA
gacagugcaguuaucaaagc

SEQ ID NO: 108795 - RNA, 20 nt, Artificial Sequence
  MKO10108795_B_Plekha1
  gRNA
guauugugugaagcaaggag

SEQ ID NO: 108796 - RNA, 20 nt, Artificial Sequence
  MKO10108796_B_Plekha1
  gRNA
caauuggaugaaaacacaau

SEQ ID NO: 108797 - RNA, 20 nt, Artificial Sequence
  MKO10108797_B_Plekha2
  gRNA
gucuuucagaaccuggccgu

SEQ ID NO: 108798 - RNA, 20 nt, Artificial Sequence
  MKO10108798_B_Plekha2
  gRNA
cacccuagagaagaagccgc

SEQ ID NO: 108799 - RNA, 20 nt, Artificial Sequence
  MKO10108799_B_Plekha2
  gRNA
uauacauacagugaucuugc

SEQ ID NO: 108800 - RNA, 20 nt, Artificial Sequence
  MKO10108800_B_Plekha3
  gRNA
aagcguguuugaccgacacg

SEQ ID NO: 108801 - RNA, 20 nt, Artificial Sequence
  MKO10108801_B_Plekha3
  gRNA
auggcggucugugagauuaa

SEQ ID NO: 108802 - RNA, 20 nt, Artificial Sequence
  MKO10108802_B_Plekha3
  gRNA
gaaguuccaaccaucugaac

SEQ ID NO: 108803 - RNA, 20 nt, Artificial Sequence
  MKO10108803_B_Plekha4
  gRNA
gagagguuggcuucgagcac

SEQ ID NO: 108804 - RNA, 20 nt, Artificial Sequence
  MKO10108804_B_Plekha4
  gRNA
ucgacgagaccccaacuugc

SEQ ID NO: 108805 - RNA, 20 nt, Artificial Sequence
  MKO10108805_B_Plekha4
  gRNA
cgaggggcuccgggcccauc

SEQ ID NO: 108806 - RNA, 20 nt, Artificial Sequence
  MKO10108806_B_Plekha5
  gRNA
cccggucaccggcgaggccg

SEQ ID NO: 108807 - RNA, 20 nt, Artificial Sequence
  MKO10108807_B_Plekha5
  gRNA
cuucuugucuucggacguca

SEQ ID NO: 108808 - RNA, 20 nt, Artificial Sequence
  MKO10108808_B_Plekha5
  gRNA
caugacguccgaagacaaga

SEQ ID NO: 108809 - RNA, 20 nt, Artificial Sequence
  MKO10108809_B_Plekha6
  gRNA
cgacauagccaaccacaaca

SEQ ID NO: 108810 - RNA, 20 nt, Artificial Sequence
  MKO10108810_B_Plekha6
  gRNA
ugaagcaguggaauaagcgu

SEQ ID NO: 108811 - RNA, 20 nt, Artificial Sequence
  MKO10108811_B_Plekha6
  gRNA
uuccccgacagaugagaagc

SEQ ID NO: 108812 - RNA, 20 nt, Artificial Sequence
  MKO10108812_B_Plekha7
  gRNA
accagguagaucgacaaaca

SEQ ID NO: 108813 - RNA, 20 nt, Artificial Sequence
  MKO10108813_B_Plekha7
  gRNA
cgacccugcucggugaacuc

SEQ ID NO: 108814 - RNA, 20 nt, Artificial Sequence
  MKO10108814_B_Plekha7
  gRNA
cagcgacuacaaguacgcac

SEQ ID NO: 108815 - RNA, 20 nt, Artificial Sequence
  MKO10108815_B_Plekha8
  gRNA
cgcauggaccucaucauccc

SEQ ID NO: 108816 - RNA, 20 nt, Artificial Sequence
  MKO10108816_B_Plekha8
  gRNA
cuugccccaaguucauuccg

SEQ ID NO: 108817 - RNA, 20 nt, Artificial Sequence
  MKO10108817_B_Plekha8
  gRNA
uaccucagagucagugacac

SEQ ID NO: 108818 - RNA, 20 nt, Artificial Sequence
  MKO10108818_B_Plekhb1
  gRNA
ggguggaauuugccuccauc

SEQ ID NO: 108819 - RNA, 20 nt, Artificial Sequence
  MKO10108819_B_Plekhb1
  gRNA
cugcuuacauggcaucaucc

SEQ ID NO: 108820 - RNA, 20 nt, Artificial Sequence
  MKO10108820_B_Plekhb1
  gRNA
acagccagccgccccucacc

SEQ ID NO: 108821 - RNA, 20 nt, Artificial Sequence
  MKO10108821_B_Plekhb2
  gRNA
acugcaucaauauccgcacg

SEQ ID NO: 108822 - RNA, 20 nt, Artificial Sequence
  MKO10108822_B_Plekhb2
  gRNA
ggcauggaaguuuacacugc

SEQ ID NO: 108823 - RNA, 20 nt, Artificial Sequence
  MKO10108823_B_Plekhb2
  gRNA
cuaugcuacaccaaccccug

SEQ ID NO: 108824 - RNA, 20 nt, Artificial Sequence
  MKO10108824_B_Plekhd1
  gRNA
ggaagcuaugaucaaaagcc

SEQ ID NO: 108825 - RNA, 20 nt, Artificial Sequence
  MKO10108825_B_Plekhd1
  gRNA
ucuucagggugucauuccac

SEQ ID NO: 108826 - RNA, 20 nt, Artificial Sequence
  MKO10108826_B_Plekhd1
  gRNA
cuggcaggggaaugucuugu

SEQ ID NO: 108827 - RNA, 20 nt, Artificial Sequence
  MKO10108827_B_Plekhf1
  gRNA
cgcgcuucuccgcacucacc

SEQ ID NO: 108828 - RNA, 20 nt, Artificial Sequence
  MKO10108828_B_Plekhf1
  gRNA
ggccuucuugcggcacuccu

SEQ ID NO: 108829 - RNA, 20 nt, Artificial Sequence
  MKO10108829_B_Plekhf1
  gRNA
gcacaauacugccauacacc

SEQ ID NO: 108830 - RNA, 20 nt, Artificial Sequence
  MKO10108830_B_Plekhf2
  gRNA
ucuccaauaagcacucgccc

SEQ ID NO: 108831 - RNA, 20 nt, Artificial Sequence
  MKO10108831_B_Plekhf2
  gRNA
gacagcagcaugcucguugc

SEQ ID NO: 108832 - RNA, 20 nt, Artificial Sequence
  MKO10108832_B_Plekhf2
  gRNA
cagaagucacaaauccgcac

SEQ ID NO: 108833 - RNA, 20 nt, Artificial Sequence
  MKO10108833_B_Plekhg1
  gRNA
caagccauaccuuggguaau

SEQ ID NO: 108834 - RNA, 20 nt, Artificial Sequence
  MKO10108834_B_Plekhg1
  gRNA
aguauugcaccaauuaccca

SEQ ID NO: 108835 - RNA, 20 nt, Artificial Sequence
  MKO10108835_B_Plekhg1
  gRNA
cauuaacuuaccuauugaag

SEQ ID NO: 108836 - RNA, 20 nt, Artificial Sequence
  MKO10108836_B_Plekhg2
  gRNA
gccacacccgagccuaaggc

SEQ ID NO: 108837 - RNA, 20 nt, Artificial Sequence
  MKO10108837_B_Plekhg2
  gRNA
cacucuuugcacgaagcacu

SEQ ID NO: 108838 - RNA, 20 nt, Artificial Sequence
  MKO10108838_B_Plekhg2
  gRNA
cacacuguuugccaacaucg

SEQ ID NO: 108839 - RNA, 20 nt, Artificial Sequence
  MKO10108839_B_Plekhg3
  gRNA
uacccuuuccacgaagcagc

SEQ ID NO: 108840 - RNA, 20 nt, Artificial Sequence
  MKO10108840_B_Plekhg3
  gRNA
uggccagcugcuucguggaa

SEQ ID NO: 108841 - RNA, 20 nt, Artificial Sequence
  MKO10108841_B_Plekhg3
  gRNA
ugucuugcaugcacucugug

SEQ ID NO: 108842 - RNA, 20 nt, Artificial Sequence
  MKO10108842_B_Plekhg4
  gRNA
cuaaccuggggaugccucgc

SEQ ID NO: 108843 - RNA, 20 nt, Artificial Sequence
  MKO10108843_B_Plekhg4
  gRNA
uccuagcucgagaccucgcc

SEQ ID NO: 108844 - RNA, 20 nt, Artificial Sequence
  MKO10108844_B_Plekhg4
  gRNA
accguuuaggccugaagugc

SEQ ID NO: 108845 - RNA, 20 nt, Artificial Sequence
  MKO10108845_B_Plekhg5
  gRNA
cacagcacccugcacuacga

SEQ ID NO: 108846 - RNA, 20 nt, Artificial Sequence
  MKO10108846_B_Plekhg5
  gRNA
guccucucaggacccgagca

SEQ ID NO: 108847 - RNA, 20 nt, Artificial Sequence
  MKO10108847_B_Plekhg5
  gRNA
aggaccggguggaaacauuc

SEQ ID NO: 108848 - RNA, 20 nt, Artificial Sequence
  MKO10108848_B_Plekhg6
  gRNA
ccgccagcuuugccaccagc

SEQ ID NO: 108849 - RNA, 20 nt, Artificial Sequence
  MKO10108849_B_Plekhg6
  gRNA
gaugccccgccugccaccag

SEQ ID NO: 108850 - RNA, 20 nt, Artificial Sequence
  MKO10108850_B_Plekhg6
  gRNA
ucugcugaauuugcagcggg

SEQ ID NO: 108851 - RNA, 20 nt, Artificial Sequence
  MKO10108851_B_Plekhh1
  gRNA
ggugacaguaaaguuagcag

SEQ ID NO: 108852 - RNA, 20 nt, Artificial Sequence
  MKO10108852_B_Plekhh1
  gRNA
ggcccuucaggaugcucuug

SEQ ID NO: 108853 - RNA, 20 nt, Artificial Sequence
  MKO10108853_B_Plekhh1
  gRNA
gcccgaacagaugcaggagc

SEQ ID NO: 108854 - RNA, 20 nt, Artificial Sequence
  MKO10108854_B_Plekhh2
  gRNA
gcgauacaguccaaguugca

SEQ ID NO: 108855 - RNA, 20 nt, Artificial Sequence
  MKO10108855_B_Plekhh2
  gRNA
gacaaguuaucgaugcagag

SEQ ID NO: 108856 - RNA, 20 nt, Artificial Sequence
  MKO10108856_B_Plekhh2
  gRNA
ccaccuacagaugcaacagu

SEQ ID NO: 108857 - RNA, 20 nt, Artificial Sequence
  MKO10108857_B_Plekhh3
  gRNA
ggcaaggcgacucggaagcc

SEQ ID NO: 108858 - RNA, 20 nt, Artificial Sequence
  MKO10108858_B_Plekhh3
  gRNA
ccgccucugcucuccgcgcc

SEQ ID NO: 108859 - RNA, 20 nt, Artificial Sequence
  MKO10108859_B_Plekhh3
  gRNA
aggggucuccagcggagcuu

SEQ ID NO: 108860 - RNA, 20 nt, Artificial Sequence
  MKO10108860_B_Plekhj1
  gRNA
uuacugauggagaagccgcc

SEQ ID NO: 108861 - RNA, 20 nt, Artificial Sequence
  MKO10108861_B_Plekhj1
  gRNA
gccccucggagcccuguugc

SEQ ID NO: 108862 - RNA, 20 nt, Artificial Sequence
  MKO10108862_B_Plekhj1
  gRNA
gacagagccucaucuucuac

SEQ ID NO: 108863 - RNA, 20 nt, Artificial Sequence
  MKO10108863_B_Plekhm1
  gRNA
ugcacacucaccggacucgu

SEQ ID NO: 108864 - RNA, 20 nt, Artificial Sequence
  MKO10108864_B_Plekhm1
  gRNA
cgcggaugugcuuggcaugc

SEQ ID NO: 108865 - RNA, 20 nt, Artificial Sequence
  MKO10108865_B_Plekhm1
  gRNA
cagagucggaccgaagcuug

SEQ ID NO: 108866 - RNA, 20 nt, Artificial Sequence
  MKO10108866_B_Plekhm2
  gRNA
uagcaccucaauuugccuga

SEQ ID NO: 108867 - RNA, 20 nt, Artificial Sequence
  MKO10108867_B_Plekhm2
  gRNA
ugacauaguacuucuguagc

SEQ ID NO: 108868 - RNA, 20 nt, Artificial Sequence
  MKO10108868_B_Plekhm2
  gRNA
acagcauguagccaccaacc

SEQ ID NO: 108869 - RNA, 20 nt, Artificial Sequence
  MKO10108869_B_Plekhm3
  gRNA
guuuguucuuccgcagcucg

SEQ ID NO: 108870 - RNA, 20 nt, Artificial Sequence
  MKO10108870_B_Plekhm3
  gRNA
uccgggcugagacccgacag

SEQ ID NO: 108871 - RNA, 20 nt, Artificial Sequence
  MKO10108871_B_Plekhm3
  gRNA
cagcacgcauaguucacaac

SEQ ID NO: 108872 - RNA, 20 nt, Artificial Sequence
  MKO10108872_B_Plekhn1
  gRNA
ucaccgucccagggauguag

SEQ ID NO: 108873 - RNA, 20 nt, Artificial Sequence
  MKO10108873_B_Plekhn1
  gRNA
caagguuguucacuacucca

SEQ ID NO: 108874 - RNA, 20 nt, Artificial Sequence
  MKO10108874_B_Plekhn1
  gRNA
uucugagggacuuacauucc

SEQ ID NO: 108875 - RNA, 20 nt, Artificial Sequence
  MKO10108875_B_Plekho1
  gRNA
ccagcucuacgucuccgaga

SEQ ID NO: 108876 - RNA, 20 nt, Artificial Sequence
  MKO10108876_B_Plekho1
  gRNA
cagagcuaaaaaccguaucu

SEQ ID NO: 108877 - RNA, 20 nt, Artificial Sequence
  MKO10108877_B_Plekho1
  gRNA
acucccgccguccuccaacc

SEQ ID NO: 108878 - RNA, 20 nt, Artificial Sequence
  MKO10108878_B_Plekho2
  gRNA
uuguugguggccgccgccgc

SEQ ID NO: 108879 - RNA, 20 nt, Artificial Sequence
  MKO10108879_B_Plekho2
  gRNA
uuuauccugcugcgaucccc

SEQ ID NO: 108880 - RNA, 20 nt, Artificial Sequence
  MKO10108880_B_Plekho2
  gRNA
gcgagaagccucguggagca

SEQ ID NO: 108881 - RNA, 20 nt, Artificial Sequence
  MKO10108881_B_Plekhs1
  gRNA
gugcugauggucuuuguaau

SEQ ID NO: 108882 - RNA, 20 nt, Artificial Sequence
  MKO10108882_B_Plekhs1
  gRNA
guucaagugccacccagaug

SEQ ID NO: 108883 - RNA, 20 nt, Artificial Sequence
  MKO10108883_B_Plekhs1
  gRNA
auggaagccagaccuccaaa

SEQ ID NO: 108884 - RNA, 20 nt, Artificial Sequence
  MKO10108884_B_Plek
  gRNA
ucuaugaaagaccccgagaa

SEQ ID NO: 108885 - RNA, 20 nt, Artificial Sequence
  MKO10108885_B_Plek
  gRNA
uaccccaagucaauugucuc

SEQ ID NO: 108886 - RNA, 20 nt, Artificial Sequence
  MKO10108886_B_Plek
  gRNA
cagguaguggugucauugac

SEQ ID NO: 108887 - RNA, 20 nt, Artificial Sequence
  MKO10108887_B_Plet1
  gRNA
cuggacaguuccuacuuccg

SEQ ID NO: 108888 - RNA, 20 nt, Artificial Sequence
  MKO10108888_B_Plet1
  gRNA
cacaguuggagucguguuua

SEQ ID NO: 108889 - RNA, 20 nt, Artificial Sequence
  MKO10108889_B_Plet1
  gRNA
ugccgagagugcggauggcc

SEQ ID NO: 108890 - RNA, 20 nt, Artificial Sequence
  MKO10108890_B_Plgrkt
  gRNA
acuauaggaacgagaaaggc

SEQ ID NO: 108891 - RNA, 20 nt, Artificial Sequence
  MKO10108891_B_Plgrkt
  gRNA
cuucaccuaccaguaugacc

SEQ ID NO: 108892 - RNA, 20 nt, Artificial Sequence
  MKO10108892_B_Plgrkt
  gRNA
ucaaaggugaucaguccuuu

SEQ ID NO: 108893 - RNA, 20 nt, Artificial Sequence
  MKO10108893_B_Plg
  gRNA
gucaucuuauucgaaaagag

SEQ ID NO: 108894 - RNA, 20 nt, Artificial Sequence
  MKO10108894_B_Plg
  gRNA
ugcaggacaaggggacucgc

SEQ ID NO: 108895 - RNA, 20 nt, Artificial Sequence
  MKO10108895_B_Plg
  gRNA
auaagaugacgucucucauc

SEQ ID NO: 108896 - RNA, 20 nt, Artificial Sequence
  MKO10108896_B_Plin1
  gRNA
gaucccggguguggcacccc

SEQ ID NO: 108897 - RNA, 20 nt, Artificial Sequence
  MKO10108897_B_Plin1
  gRNA
cacacuggguggacagccga

SEQ ID NO: 108898 - RNA, 20 nt, Artificial Sequence
  MKO10108898_B_Plin1
  gRNA
gccucugcaggccaacucau

SEQ ID NO: 108899 - RNA, 20 nt, Artificial Sequence
  MKO10108899_B_Plin2
  gRNA
uccagccguucauaguugcu

SEQ ID NO: 108900 - RNA, 20 nt, Artificial Sequence
  MKO10108900_B_Plin2
  gRNA
agaagccgagcaacuaugaa

SEQ ID NO: 108901 - RNA, 20 nt, Artificial Sequence
  MKO10108901_B_Plin2
  gRNA
cacggucuucacgcccuucu

SEQ ID NO: 108902 - RNA, 20 nt, Artificial Sequence
  MKO10108902_B_Plin3
  gRNA
cuugccgagggaguguucau

SEQ ID NO: 108903 - RNA, 20 nt, Artificial Sequence
  MKO10108903_B_Plin3
  gRNA
uagcucagugucuagugcga

SEQ ID NO: 108904 - RNA, 20 nt, Artificial Sequence
  MKO10108904_B_Plin3
  gRNA
agcgguggaugugacccucg

SEQ ID NO: 108905 - RNA, 20 nt, Artificial Sequence
  MKO10108905_B_Plin4
  gRNA
acuccugcccccucaucuaa

SEQ ID NO: 108906 - RNA, 20 nt, Artificial Sequence
  MKO10108906_B_Plin4
  gRNA
uuccgggcagagcugaagcc

SEQ ID NO: 108907 - RNA, 20 nt, Artificial Sequence
  MKO10108907_B_Plin4
  gRNA
gcugcuccaaccuucugaac

SEQ ID NO: 108908 - RNA, 20 nt, Artificial Sequence
  MKO10108908_B_Plin5
  gRNA
caaggacaggcacccgcugc

SEQ ID NO: 108909 - RNA, 20 nt, Artificial Sequence
  MKO10108909_B_Plin5
  gRNA
ucagcuccccacuccaacgc

SEQ ID NO: 108910 - RNA, 20 nt, Artificial Sequence
  MKO10108910_B_Plin5
  gRNA
caccaugccugugacacuuu

SEQ ID NO: 108911 - RNA, 20 nt, Artificial Sequence
  MKO10108911_B_Plk1s1
  gRNA
gaggaugcgccuccugucaa

SEQ ID NO: 108912 - RNA, 20 nt, Artificial Sequence
  MKO10108912_B_Plk1s1
  gRNA
ucaaguguucaacauacguc

SEQ ID NO: 108913 - RNA, 20 nt, Artificial Sequence
  MKO10108913_B_Plk1s1
  gRNA
acaauaaaucugauaagugc

SEQ ID NO: 108914 - RNA, 20 nt, Artificial Sequence
  MKO10108914_B_Plk1
  gRNA
gagcgauugaaaaccuuggu

SEQ ID NO: 108915 - RNA, 20 nt, Artificial Sequence
  MKO10108915_B_Plk1
  gRNA
aacuuacaugaugcacccaa

SEQ ID NO: 108916 - RNA, 20 nt, Artificial Sequence
  MKO10108916_B_Plk1
  gRNA
ccccagguauaccuugcuag

SEQ ID NO: 108917 - RNA, 20 nt, Artificial Sequence
  MKO10108917_B_Plk2
  gRNA
gaguagcuaaaccucaucag

SEQ ID NO: 108918 - RNA, 20 nt, Artificial Sequence
  MKO10108918_B_Plk2
  gRNA
gaaggugggagacuuugguu

SEQ ID NO: 108919 - RNA, 20 nt, Artificial Sequence
  MKO10108919_B_Plk2
  gRNA
caccuccuucuguguuccag

SEQ ID NO: 108920 - RNA, 20 nt, Artificial Sequence
  MKO10108920_B_Plk3
  gRNA
cgcagguaguagcgaaccuc

SEQ ID NO: 108921 - RNA, 20 nt, Artificial Sequence
  MKO10108921_B_Plk3
  gRNA
uaccugcgccagauccuuuc

SEQ ID NO: 108922 - RNA, 20 nt, Artificial Sequence
  MKO10108922_B_Plk3
  gRNA
ccuuucggcuacagagcucc

SEQ ID NO: 108923 - RNA, 20 nt, Artificial Sequence
  MKO10108923_B_Plk4
  gRNA
agagcugaguccauacacac

SEQ ID NO: 108924 - RNA, 20 nt, Artificial Sequence
  MKO10108924_B_Plk4
  gRNA
guaucuuaccuccaagacag

SEQ ID NO: 108925 - RNA, 20 nt, Artificial Sequence
  MKO10108925_B_Plk4
  gRNA
agauaacaauuaugucuacc

SEQ ID NO: 108926 - RNA, 20 nt, Artificial Sequence
  MKO10108926_B_Plk5
  gRNA
cugaagugcgcuauuaccuu

SEQ ID NO: 108927 - RNA, 20 nt, Artificial Sequence
  MKO10108927_B_Plk5
  gRNA
ugugucucaccuucccgcgc

SEQ ID NO: 108928 - RNA, 20 nt, Artificial Sequence
  MKO10108928_B_Plk5
  gRNA
cuuaagagcgaacacagcgc

SEQ ID NO: 108929 - RNA, 20 nt, Artificial Sequence
  MKO10108929_B_Pllp
  gRNA
cggucgaucugacaucccug

SEQ ID NO: 108930 - RNA, 20 nt, Artificial Sequence
  MKO10108930_B_Pllp
  gRNA
cagaucgaccgccgcugcac

SEQ ID NO: 108931 - RNA, 20 nt, Artificial Sequence
  MKO10108931_B_Pllp
  gRNA
gcccccagccaucugacucg

SEQ ID NO: 108932 - RNA, 20 nt, Artificial Sequence
  MKO10108932_B_Pln
  gRNA
gcagcagacauaucaagaug

SEQ ID NO: 108933 - RNA, 20 nt, Artificial Sequence
  MKO10108933_B_Pln
  gRNA
agauucugacgugcuugcug

SEQ ID NO: 108934 - RNA, 20 nt, Artificial Sequence
  MKO10108934_B_Plod1
  gRNA
guucuucaacuacaagaucc

SEQ ID NO: 108935 - RNA, 20 nt, Artificial Sequence
  MKO10108935_B_Plod1
  gRNA
ugucaacgaagagaauaacc

SEQ ID NO: 108936 - RNA, 20 nt, Artificial Sequence
  MKO10108936_B_Plod1
  gRNA
uaccaagaucuucuugaacc

SEQ ID NO: 108937 - RNA, 20 nt, Artificial Sequence
  MKO10108937_B_Plod2
  gRNA
cucaccugcagggaugcgcc

SEQ ID NO: 108938 - RNA, 20 nt, Artificial Sequence
  MKO10108938_B_Plod2
  gRNA
guauuucaauuacacuguga

SEQ ID NO: 108939 - RNA, 20 nt, Artificial Sequence
  MKO10108939_B_Plod2
  gRNA
cuacgccagucaggaagauc

SEQ ID NO: 108940 - RNA, 20 nt, Artificial Sequence
  MKO10108940_B_Plod3
  gRNA
ggcuaugacagacaaauugc

SEQ ID NO: 108941 - RNA, 20 nt, Artificial Sequence
  MKO10108941_B_Plod3
  gRNA
ccgcagacugcagaaaacgc

SEQ ID NO: 108942 - RNA, 20 nt, Artificial Sequence
  MKO10108942_B_Plod3
  gRNA
gccacucaccaccagaguug

SEQ ID NO: 108943 - RNA, 20 nt, Artificial Sequence
  MKO10108943_B_Plp1
  gRNA
ccauacaacagucagggcau

SEQ ID NO: 108944 - RNA, 20 nt, Artificial Sequence
  MKO10108944_B_Plp1
  gRNA
agaguguugugcuagauguc

SEQ ID NO: 108945 - RNA, 20 nt, Artificial Sequence
  MKO10108945_B_Plp1
  gRNA
uaaugagauacucauagucc

SEQ ID NO: 108946 - RNA, 20 nt, Artificial Sequence
  MKO10108946_B_Plp2
  gRNA
ugaagcaaaucaagaucacc

SEQ ID NO: 108947 - RNA, 20 nt, Artificial Sequence
  MKO10108947_B_Plp2
  gRNA
ccuccugcagaccccacuga

SEQ ID NO: 108948 - RNA, 20 nt, Artificial Sequence
  MKO10108948_B_Plp2
  gRNA
agacgaucacgggccaucag

SEQ ID NO: 108949 - RNA, 20 nt, Artificial Sequence
  MKO10108949_B_Plrg1
  gRNA
uguuacuuaccggguccugc

SEQ ID NO: 108950 - RNA, 20 nt, Artificial Sequence
  MKO10108950_B_Plrg1
  gRNA
ggcacccauccauacccagc

SEQ ID NO: 108951 - RNA, 20 nt, Artificial Sequence
  MKO10108951_B_Plrg1
  gRNA
uaauggaaaacccgugccuu

SEQ ID NO: 108952 - RNA, 20 nt, Artificial Sequence
  MKO10108952_B_Pls1
  gRNA
aucucgcgcaccuuguaccc

SEQ ID NO: 108953 - RNA, 20 nt, Artificial Sequence
  MKO10108953_B_Pls1
  gRNA
gaagggaucacugccaucgg

SEQ ID NO: 108954 - RNA, 20 nt, Artificial Sequence
  MKO10108954_B_Pls1
  gRNA
guacucaccgacaccgugaa

SEQ ID NO: 108955 - RNA, 20 nt, Artificial Sequence
  MKO10108955_B_Pls3
  gRNA
gauuaccugaauaggaaugc

SEQ ID NO: 108956 - RNA, 20 nt, Artificial Sequence
  MKO10108956_B_Pls3
  gRNA
gaugaccuguucaaagcagu

SEQ ID NO: 108957 - RNA, 20 nt, Artificial Sequence
  MKO10108957_B_Pls3
  gRNA
ucaucaguauuuggguucau

SEQ ID NO: 108958 - RNA, 20 nt, Artificial Sequence
  MKO10108958_B_Plscr1
  gRNA
uagacgccccacagcaguuu

SEQ ID NO: 108959 - RNA, 20 nt, Artificial Sequence
  MKO10108959_B_Plscr1
  gRNA
ugcuguacccgaaacugcug

SEQ ID NO: 108960 - RNA, 20 nt, Artificial Sequence
  MKO10108960_B_Plscr1
  gRNA
cagccagcauauaaucaucc

SEQ ID NO: 108961 - RNA, 20 nt, Artificial Sequence
  MKO10108961_B_Plscr2
  gRNA
caacauaaaccaucugcccg

SEQ ID NO: 108962 - RNA, 20 nt, Artificial Sequence
  MKO10108962_B_Plscr2
  gRNA
gcagaugguuuauguugcag

SEQ ID NO: 108963 - RNA, 20 nt, Artificial Sequence
  MKO10108963_B_Plscr2
  gRNA
ucguucugaagagugagcuu

SEQ ID NO: 108964 - RNA, 20 nt, Artificial Sequence
  MKO10108964_B_Plscr3
  gRNA
caaccuguucuacgaguugu

SEQ ID NO: 108965 - RNA, 20 nt, Artificial Sequence
  MKO10108965_B_Plscr3
  gRNA
cuacaacucguagaacaggu

SEQ ID NO: 108966 - RNA, 20 nt, Artificial Sequence
  MKO10108966_B_Plscr3
  gRNA
ucaccugcacuaggaauucg

SEQ ID NO: 108967 - RNA, 20 nt, Artificial Sequence
  MKO10108967_B_Plscr4
  gRNA
gccauccacauuaugggagc

SEQ ID NO: 108968 - RNA, 20 nt, Artificial Sequence
  MKO10108968_B_Plscr4
  gRNA
gcaaaaugagaauuguaguc

SEQ ID NO: 108969 - RNA, 20 nt, Artificial Sequence
  MKO10108969_B_Plscr4
  gRNA
ucuucagcauguugagccuc

SEQ ID NO: 108970 - RNA, 20 nt, Artificial Sequence
  MKO10108970_B_Plscr5
  gRNA
acauaaccaacuauaguacc

SEQ ID NO: 108971 - RNA, 20 nt, Artificial Sequence
  MKO10108971_B_Plscr5
  gRNA
cacaucgccaaaacagccac

SEQ ID NO: 108972 - RNA, 20 nt, Artificial Sequence
  MKO10108972_B_Plscr5
  gRNA
uggcuuaaauacucuagacc

SEQ ID NO: 108973 - RNA, 20 nt, Artificial Sequence
  MKO10108973_B_Pltp
  gRNA
cccuuugcgccguacacguc

SEQ ID NO: 108974 - RNA, 20 nt, Artificial Sequence
  MKO10108974_B_Pltp
  gRNA
ucaccugaagguucccccga

SEQ ID NO: 108975 - RNA, 20 nt, Artificial Sequence
  MKO10108975_B_Pltp
  gRNA
gugcagccccaaggaugcgu

SEQ ID NO: 108976 - RNA, 20 nt, Artificial Sequence
  MKO10108976_B_Plvap
  gRNA
cuucucgcucaggaugauag

SEQ ID NO: 108977 - RNA, 20 nt, Artificial Sequence
  MKO10108977_B_Plvap
  gRNA
gaggucaacaagaccugcga

SEQ ID NO: 108978 - RNA, 20 nt, Artificial Sequence
  MKO10108978_B_Plvap
  gRNA
uguuacucaccaaugggugg

SEQ ID NO: 108979 - RNA, 20 nt, Artificial Sequence
  MKO10108979_B_Plxdc1
  gRNA
accacccgaguccuguuguc

SEQ ID NO: 108980 - RNA, 20 nt, Artificial Sequence
  MKO10108980_B_Plxdc1
  gRNA
guccuuaccuccgguugcua

SEQ ID NO: 108981 - RNA, 20 nt, Artificial Sequence
  MKO10108981_B_Plxdc1
  gRNA
cguccuaccugcggguguug

SEQ ID NO: 108982 - RNA, 20 nt, Artificial Sequence
  MKO10108982_B_Plxdc2
  gRNA
ccuguccgucauccaguagc

SEQ ID NO: 108983 - RNA, 20 nt, Artificial Sequence
  MKO10108983_B_Plxdc2
  gRNA
ggaucaaaauuugccauuaa

SEQ ID NO: 108984 - RNA, 20 nt, Artificial Sequence
  MKO10108984_B_Plxdc2
  gRNA
auuguagguuucauauauac

SEQ ID NO: 108985 - RNA, 20 nt, Artificial Sequence
  MKO10108985_B_Plxna1
  gRNA
agugggggucccgagacccc

SEQ ID NO: 108986 - RNA, 20 nt, Artificial Sequence
  MKO10108986_B_Plxna1
  gRNA
gcgagugccagcaaaaacca

SEQ ID NO: 108987 - RNA, 20 nt, Artificial Sequence
  MKO10108987_B_Plxna1
  gRNA
gggcucuucugcccgcucac

SEQ ID NO: 108988 - RNA, 20 nt, Artificial Sequence
  MKO10108988_B_Plxna2
  gRNA
uggugggguccaguaugaga

SEQ ID NO: 108989 - RNA, 20 nt, Artificial Sequence
  MKO10108989_B_Plxna2
  gRNA
cacaaacuuacauguugugc

SEQ ID NO: 108990 - RNA, 20 nt, Artificial Sequence
  MKO10108990_B_Plxna2
  gRNA
guaccucaaggcucaugcac

SEQ ID NO: 108991 - RNA, 20 nt, Artificial Sequence
  MKO10108991_B_Plxna3
  gRNA
acgcagcgguaauuugaaga

SEQ ID NO: 108992 - RNA, 20 nt, Artificial Sequence
  MKO10108992_B_Plxna3
  gRNA
cagagaccguuucauauagc

SEQ ID NO: 108993 - RNA, 20 nt, Artificial Sequence
  MKO10108993_B_Plxna3
  gRNA
agguagaugugucggugguc

SEQ ID NO: 108994 - RNA, 20 nt, Artificial Sequence
  MKO10108994_B_Plxna4
  gRNA
ucucugcagauccggguuga

SEQ ID NO: 108995 - RNA, 20 nt, Artificial Sequence
  MKO10108995_B_Plxna4
  gRNA
ccuggauaugaaugcuccuc

SEQ ID NO: 108996 - RNA, 20 nt, Artificial Sequence
  MKO10108996_B_Plxna4
  gRNA
caagacacucgccacagcuc

SEQ ID NO: 108997 - RNA, 20 nt, Artificial Sequence
  MKO10108997_B_Plxnb1
  gRNA
uucuucuuagguguagucgc

SEQ ID NO: 108998 - RNA, 20 nt, Artificial Sequence
  MKO10108998_B_Plxnb1
  gRNA
uuuggaagccacgccaauuc

SEQ ID NO: 108999 - RNA, 20 nt, Artificial Sequence
  MKO10108999_B_Plxnb1
  gRNA
uugcggauggugugugcucc

SEQ ID NO: 109000 - RNA, 20 nt, Artificial Sequence
  MKO10109000_B_Plxnb2
  gRNA
ugcccaggaacgcaacagug

SEQ ID NO: 109001 - RNA, 20 nt, Artificial Sequence
  MKO10109001_B_Plxnb2
  gRNA
gcaccucuccuugggcccgc

SEQ ID NO: 109002 - RNA, 20 nt, Artificial Sequence
  MKO10109002_B_Plxnb2
  gRNA
uuccucggcccgugagcacu

SEQ ID NO: 109003 - RNA, 20 nt, Artificial Sequence
  MKO10109003_B_Plxnb3
  gRNA
ucccccgagucauaccccug

SEQ ID NO: 109004 - RNA, 20 nt, Artificial Sequence
  MKO10109004_B_Plxnb3
  gRNA
cagggguuggcggccugcga

SEQ ID NO: 109005 - RNA, 20 nt, Artificial Sequence
  MKO10109005_B_Plxnb3
  gRNA
gacaggcugccacaaguauc

SEQ ID NO: 109006 - RNA, 20 nt, Artificial Sequence
  MKO10109006_B_Plxnc1
  gRNA
ggaacgagcuuguagaacac

SEQ ID NO: 109007 - RNA, 20 nt, Artificial Sequence
  MKO10109007_B_Plxnc1
  gRNA
cggagauggccaguuacuga

SEQ ID NO: 109008 - RNA, 20 nt, Artificial Sequence
  MKO10109008_B_Plxnc1
  gRNA
aucuacaucuaccuaacagc

SEQ ID NO: 109009 - RNA, 20 nt, Artificial Sequence
  MKO10109009_B_Plxnd1
  gRNA
cgucaugcaguuugacccca

SEQ ID NO: 109010 - RNA, 20 nt, Artificial Sequence
  MKO10109010_B_Plxnd1
  gRNA
ggugcggccgaugccuacug

SEQ ID NO: 109011 - RNA, 20 nt, Artificial Sequence
  MKO10109011_B_Plxnd1
  gRNA
ccuacagauggcccgaguga

SEQ ID NO: 109012 - RNA, 20 nt, Artificial Sequence
  MKO10109012_B_Pm20d1
  gRNA
ggcuguaguuucugaucaac

SEQ ID NO: 109013 - RNA, 20 nt, Artificial Sequence
  MKO10109013_B_Pm20d1
  gRNA
gaagaucucagcacucuuac

SEQ ID NO: 109014 - RNA, 20 nt, Artificial Sequence
  MKO10109014_B_Pm20d1
  gRNA
ggcggcuuaccuccucauca

SEQ ID NO: 109015 - RNA, 20 nt, Artificial Sequence
  MKO10109015_B_Pm20d2
  gRNA
cucacgcugccgcuuacccu

SEQ ID NO: 109016 - RNA, 20 nt, Artificial Sequence
  MKO10109016_B_Pm20d2
  gRNA
cacucgugcucggccacauc

SEQ ID NO: 109017 - RNA, 20 nt, Artificial Sequence
  MKO10109017_B_Pm20d2
  gRNA
gcuucaaguucugaccaaaa

SEQ ID NO: 109018 - RNA, 20 nt, Artificial Sequence
  MKO10109018_B_Pmaip1
  gRNA
aggacgagugugcucaacuc

SEQ ID NO: 109019 - RNA, 20 nt, Artificial Sequence
  MKO10109019_B_Pmaip1
  gRNA
accggacauaacugugguuc

SEQ ID NO: 109020 - RNA, 20 nt, Artificial Sequence
  MKO10109020_B_Pmaip1
  gRNA
gguuacuaaauugaagagcu

SEQ ID NO: 109021 - RNA, 20 nt, Artificial Sequence
  MKO10109021_B_Pmch
  gRNA
caauacaaaaacgacgagag

SEQ ID NO: 109022 - RNA, 20 nt, Artificial Sequence
  MKO10109022_B_Pmch
  gRNA
aaaccuuaccucgcucugaa

SEQ ID NO: 109023 - RNA, 20 nt, Artificial Sequence
  MKO10109023_B_Pmch
  gRNA
agguaucagacuugccaaca

SEQ ID NO: 109024 - RNA, 20 nt, Artificial Sequence
  MKO10109024_B_Pmel
  gRNA
cauuaaugaugggccuacac

SEQ ID NO: 109025 - RNA, 20 nt, Artificial Sequence
  MKO10109025_B_Pmel
  gRNA
acaggcagcuguaccccgag

SEQ ID NO: 109026 - RNA, 20 nt, Artificial Sequence
  MKO10109026_B_Pmel
  gRNA
guccaggcugagcauugcua

SEQ ID NO: 109027 - RNA, 20 nt, Artificial Sequence
  MKO10109027_B_Pmepa1
  gRNA
gcgcuggcaguugcacgcgc

SEQ ID NO: 109028 - RNA, 20 nt, Artificial Sequence
  MKO10109028_B_Pmepa1
  gRNA
gcagggcaauuucgugcugc

SEQ ID NO: 109029 - RNA, 20 nt, Artificial Sequence
  MKO10109029_B_Pmepa1
  gRNA
cccucagagaguacgguguc

SEQ ID NO: 109030 - RNA, 20 nt, Artificial Sequence
  MKO10109030_B_Pmf1
  gRNA
cuuccaccaguugaacccug

SEQ ID NO: 109031 - RNA, 20 nt, Artificial Sequence
  MKO10109031_B_Pmf1
  gRNA
cuucuucuaugaucuuaucc

SEQ ID NO: 109032 - RNA, 20 nt, Artificial Sequence
  MKO10109032_B_Pmf1
  gRNA
agaagcuguccugaacuccc

SEQ ID NO: 109033 - RNA, 20 nt, Artificial Sequence
  MKO10109033_B_Pmfbp1
  gRNA
cuaacaggucauucucuacg

SEQ ID NO: 109034 - RNA, 20 nt, Artificial Sequence
  MKO10109034_B_Pmfbp1
  gRNA
gaaguguagauucgaaccuu

SEQ ID NO: 109035 - RNA, 20 nt, Artificial Sequence
  MKO10109035_B_Pmfbp1
  gRNA
gaugguauugcuuauugacc

SEQ ID NO: 109036 - RNA, 20 nt, Artificial Sequence
  MKO10109036_B_Pml
  gRNA
uggaucucccugucgacaac

SEQ ID NO: 109037 - RNA, 20 nt, Artificial Sequence
  MKO10109037_B_Pml
  gRNA
agcugcucacugaauugucg

SEQ ID NO: 109038 - RNA, 20 nt, Artificial Sequence
  MKO10109038_B_Pml
  gRNA
ggcagaguccuguugucgac

SEQ ID NO: 109039 - RNA, 20 nt, Artificial Sequence
  MKO10109039_B_Pmm1
  gRNA
uccugcagaagcuacgaagc

SEQ ID NO: 109040 - RNA, 20 nt, Artificial Sequence
  MKO10109040_B_Pmm1
  gRNA
agaaguugaucaaguccugc

SEQ ID NO: 109041 - RNA, 20 nt, Artificial Sequence
  MKO10109041_B_Pmm1
  gRNA
cagugcaguauaaacacgga

SEQ ID NO: 109042 - RNA, 20 nt, Artificial Sequence
  MKO10109042_B_Pmm2
  gRNA
cccaccuaccacuccaauuu

SEQ ID NO: 109043 - RNA, 20 nt, Artificial Sequence
  MKO10109043_B_Pmm2
  gRNA
acacauucaacaugccauuu

SEQ ID NO: 109044 - RNA, 20 nt, Artificial Sequence
  MKO10109044_B_Pmm2
  gRNA
auggcuuucuacaaaaauug

SEQ ID NO: 109045 - RNA, 20 nt, Artificial Sequence
  MKO10109045_B_Pmp22
  gRNA
gaacuguaccacauccgccu

SEQ ID NO: 109046 - RNA, 20 nt, Artificial Sequence
  MKO10109046_B_Pmp22
  gRNA
cgccucauucgcguuuccgc

SEQ ID NO: 109047 - RNA, 20 nt, Artificial Sequence
  MKO10109047_B_Pmp22
  gRNA
auggacacacgacugaucuc

SEQ ID NO: 109048 - RNA, 20 nt, Artificial Sequence
  MKO10109048_B_Pmp2
  gRNA
guagucaucgaagugcucac

SEQ ID NO: 109049 - RNA, 20 nt, Artificial Sequence
  MKO10109049_B_Pmp2
  gRNA
uuuguagagcaucgugacac

SEQ ID NO: 109050 - RNA, 20 nt, Artificial Sequence
  MKO10109050_B_Pmp2
  gRNA
acaaugagcaacaaauuccu

SEQ ID NO: 109051 - RNA, 20 nt, Artificial Sequence
  MKO10109051_B_Pmpca
  gRNA
uaugaagcgaaauaucuuag

SEQ ID NO: 109052 - RNA, 20 nt, Artificial Sequence
  MKO10109052_B_Pmpca
  gRNA
ccaucaacuguugcaaaaau

SEQ ID NO: 109053 - RNA, 20 nt, Artificial Sequence
  MKO10109053_B_Pmpca
  gRNA
ugaaaccaaaguuaccacuc

SEQ ID NO: 109054 - RNA, 20 nt, Artificial Sequence
  MKO10109054_B_Pmpcb
  gRNA
uucucgagagauuugcccag

SEQ ID NO: 109055 - RNA, 20 nt, Artificial Sequence
  MKO10109055_B_Pmpcb
  gRNA
gccuaucaaaauacugcacu

SEQ ID NO: 109056 - RNA, 20 nt, Artificial Sequence
  MKO10109056_B_Pmpcb
  gRNA
aaaaacaacuucuugcaagu

SEQ ID NO: 109057 - RNA, 20 nt, Artificial Sequence
  MKO10109057_B_Pms1
  gRNA
uaguacuucacugccauuac

SEQ ID NO: 109058 - RNA, 20 nt, Artificial Sequence
  MKO10109058_B_Pms1
  gRNA
auggcucuaaugucgguucu

SEQ ID NO: 109059 - RNA, 20 nt, Artificial Sequence
  MKO10109059_B_Pms1
  gRNA
acaaaaguaauccucacauc

SEQ ID NO: 109060 - RNA, 20 nt, Artificial Sequence
  MKO10109060_B_Pms2
  gRNA
caaaaguuucaaccugcgug

SEQ ID NO: 109061 - RNA, 20 nt, Artificial Sequence
  MKO10109061_B_Pms2
  gRNA
caguuuaagcaccgcuguga

SEQ ID NO: 109062 - RNA, 20 nt, Artificial Sequence
  MKO10109062_B_Pms2
  gRNA
cuucccaucaauaggcuuga

SEQ ID NO: 109063 - RNA, 20 nt, Artificial Sequence
  MKO10109063_B_Pmvk
  gRNA
gauacagacaguccgaguag

SEQ ID NO: 109064 - RNA, 20 nt, Artificial Sequence
  MKO10109064_B_Pmvk
  gRNA
cggagcagagucgacagcaa

SEQ ID NO: 109065 - RNA, 20 nt, Artificial Sequence
  MKO10109065_B_Pmvk
  gRNA
ccacggagaugagcagugcc

SEQ ID NO: 109066 - RNA, 20 nt, Artificial Sequence
  MKO10109066_B_Pnck
  gRNA
ccucaaaagguguggcauag

SEQ ID NO: 109067 - RNA, 20 nt, Artificial Sequence
  MKO10109067_B_Pnck
  gRNA
ccgcgaucucauucuccacc

SEQ ID NO: 109068 - RNA, 20 nt, Artificial Sequence
  MKO10109068_B_Pnck
  gRNA
auacaagcuggcaacaugcu

SEQ ID NO: 109069 - RNA, 20 nt, Artificial Sequence
  MKO10109069_B_Pnkd
  gRNA
ugcgcgucaugaggaggccg

SEQ ID NO: 109070 - RNA, 20 nt, Artificial Sequence
  MKO10109070_B_Pnkd
  gRNA
aacucaccaggcuagcccca

SEQ ID NO: 109071 - RNA, 20 nt, Artificial Sequence
  MKO10109071_B_Pnkd
  gRNA
ucauucacagggauccucuc

SEQ ID NO: 109072 - RNA, 20 nt, Artificial Sequence
  MKO10109072_B_Pnkp
  gRNA
ugcugagcucuucccaacgc

SEQ ID NO: 109073 - RNA, 20 nt, Artificial Sequence
  MKO10109073_B_Pnkp
  gRNA
gcuggcugcugaaggcuaca

SEQ ID NO: 109074 - RNA, 20 nt, Artificial Sequence
  MKO10109074_B_Pnkp
  gRNA
ugauugcagacccugaaagc

SEQ ID NO: 109075 - RNA, 20 nt, Artificial Sequence
  MKO10109075_B_Pnldc1
  gRNA
uaaacugcugaacacucugc

SEQ ID NO: 109076 - RNA, 20 nt, Artificial Sequence
  MKO10109076_B_Pnldc1
  gRNA
guaauuaguaccugaucugu

SEQ ID NO: 109077 - RNA, 20 nt, Artificial Sequence
  MKO10109077_B_Pnldc1
  gRNA
gucuucagauaccacucaga

SEQ ID NO: 109078 - RNA, 20 nt, Artificial Sequence
  MKO10109078_B_Pnliprp1
  gRNA
uucugacccaucgaccauug

SEQ ID NO: 109079 - RNA, 20 nt, Artificial Sequence
  MKO10109079_B_Pnliprp1
  gRNA
ggccccuaaaacuucucccu

SEQ ID NO: 109080 - RNA, 20 nt, Artificial Sequence
  MKO10109080_B_Pnliprp1
  gRNA
gaagcaggaagucggacucc

SEQ ID NO: 109081 - RNA, 20 nt, Artificial Sequence
  MKO10109081_B_Pnliprp2
  gRNA
ccagagaacgugcaccucau

SEQ ID NO: 109082 - RNA, 20 nt, Artificial Sequence
  MKO10109082_B_Pnliprp2
  gRNA
gggcgcugagauugccuucu

SEQ ID NO: 109083 - RNA, 20 nt, Artificial Sequence
  MKO10109083_B_Pnliprp2
  gRNA
gcccacgacccgaguguugu

SEQ ID NO: 109084 - RNA, 20 nt, Artificial Sequence
  MKO10109084_B_Pnlip
  gRNA
cucccuugucgaugaagccg

SEQ ID NO: 109085 - RNA, 20 nt, Artificial Sequence
  MKO10109085_B_Pnlip
  gRNA
cuuaacaauguccaccugau

SEQ ID NO: 109086 - RNA, 20 nt, Artificial Sequence
  MKO10109086_B_Pnlip
  gRNA
cgagaauccagacaacuacc

SEQ ID NO: 109087 - RNA, 20 nt, Artificial Sequence
  MKO10109087_B_Pnma1
  gRNA
uagcugcaagagggcggccu

SEQ ID NO: 109088 - RNA, 20 nt, Artificial Sequence
  MKO10109088_B_Pnma1
  gRNA
caagauguugcucgugugcu

SEQ ID NO: 109089 - RNA, 20 nt, Artificial Sequence
  MKO10109089_B_Pnma1
  gRNA
ccuccaagcugcgaugcccc

SEQ ID NO: 109090 - RNA, 20 nt, Artificial Sequence
  MKO10109090_B_Pnma2
  gRNA
ucuuacaccacuccuccagc

SEQ ID NO: 109091 - RNA, 20 nt, Artificial Sequence
  MKO10109091_B_Pnma2
  gRNA
guugacauuccgguggacug

SEQ ID NO: 109092 - RNA, 20 nt, Artificial Sequence
  MKO10109092_B_Pnma2
  gRNA
aaaucucagccuacgugcuc

SEQ ID NO: 109093 - RNA, 20 nt, Artificial Sequence
  MKO10109093_B_Pnma3
  gRNA
caauaacccugggauugaua

SEQ ID NO: 109094 - RNA, 20 nt, Artificial Sequence
  MKO10109094_B_Pnma3
  gRNA
ccccaccuaaaauucguuuc

SEQ ID NO: 109095 - RNA, 20 nt, Artificial Sequence
  MKO10109095_B_Pnma3
  gRNA
acgugcaaguuccaccaaaa

SEQ ID NO: 109096 - RNA, 20 nt, Artificial Sequence
  MKO10109096_B_Pnma5
  gRNA
ucucaagcacgucuuaucuc

SEQ ID NO: 109097 - RNA, 20 nt, Artificial Sequence
  MKO10109097_B_Pnma5
  gRNA
ccguggcucuauuagaugac

SEQ ID NO: 109098 - RNA, 20 nt, Artificial Sequence
  MKO10109098_B_Pnma5
  gRNA
ucaagcacugcuccacgguu

SEQ ID NO: 109099 - RNA, 20 nt, Artificial Sequence
  MKO10109099_B_Pnmal1
  gRNA
cgcagaccgaggaagaucgc

SEQ ID NO: 109100 - RNA, 20 nt, Artificial Sequence
  MKO10109100_B_Pnmal1
  gRNA
cuggagguaagauucgcucc

SEQ ID NO: 109101 - RNA, 20 nt, Artificial Sequence
  MKO10109101_B_Pnmal1
  gRNA
uugcuucuucaucccgacua

SEQ ID NO: 109102 - RNA, 20 nt, Artificial Sequence
  MKO10109102_B_Pnmal2
  gRNA
gacagcgaagaguccgaacc

SEQ ID NO: 109103 - RNA, 20 nt, Artificial Sequence
  MKO10109103_B_Pnmal2
  gRNA
uccugauuuagucgcgcuac

SEQ ID NO: 109104 - RNA, 20 nt, Artificial Sequence
  MKO10109104_B_Pnmal2
  gRNA
ucuccucuaugacgauaccc

SEQ ID NO: 109105 - RNA, 20 nt, Artificial Sequence
  MKO10109105_B_Pnmt
  gRNA
cacucccuguagcgugcuuc

SEQ ID NO: 109106 - RNA, 20 nt, Artificial Sequence
  MKO10109106_B_Pnmt
  gRNA
acuauacacacuccagucaa

SEQ ID NO: 109107 - RNA, 20 nt, Artificial Sequence
  MKO10109107_B_Pnmt
  gRNA
gauguccucaaagugggcac

SEQ ID NO: 109108 - RNA, 20 nt, Artificial Sequence
  MKO10109108_B_Pnn
  gRNA
accagaaagggccagcaauc

SEQ ID NO: 109109 - RNA, 20 nt, Artificial Sequence
  MKO10109109_B_Pnn
  gRNA
aggcguggauucucagauag

SEQ ID NO: 109110 - RNA, 20 nt, Artificial Sequence
  MKO10109110_B_Pnn
  gRNA
cuaggcuggguggggagcgu

SEQ ID NO: 109111 - RNA, 20 nt, Artificial Sequence
  MKO10109111_B_Pno1
  gRNA
uacuccgauuguagaacauu

SEQ ID NO: 109112 - RNA, 20 nt, Artificial Sequence
  MKO10109112_B_Pno1
  gRNA
gaccaccugucaagggcaau

SEQ ID NO: 109113 - RNA, 20 nt, Artificial Sequence
  MKO10109113_B_Pno1
  gRNA
ugucagugcccugacaaaag

SEQ ID NO: 109114 - RNA, 20 nt, Artificial Sequence
  MKO10109114_B_Pnoc
  gRNA
gggacagcugcugaacacgc

SEQ ID NO: 109115 - RNA, 20 nt, Artificial Sequence
  MKO10109115_B_Pnoc
  gRNA
uaaacucacugaaccgcuuc

SEQ ID NO: 109116 - RNA, 20 nt, Artificial Sequence
  MKO10109116_B_Pnoc
  gRNA
ugaguuuaugaggcaguacc

SEQ ID NO: 109117 - RNA, 20 nt, Artificial Sequence
  MKO10109117_B_Pnp2
  gRNA
ccagccaguaccugugcuuu

SEQ ID NO: 109118 - RNA, 20 nt, Artificial Sequence
  MKO10109118_B_Pnp2
  gRNA
auuaugagaccacugccaag

SEQ ID NO: 109119 - RNA, 20 nt, Artificial Sequence
  MKO10109119_B_Pnp2
  gRNA
agauguguaccuuucaucgu

SEQ ID NO: 109120 - RNA, 20 nt, Artificial Sequence
  MKO10109120_B_Pnpla1
  gRNA
cguucucuccguccgugacu

SEQ ID NO: 109121 - RNA, 20 nt, Artificial Sequence
  MKO10109121_B_Pnpla1
  gRNA
gguacucacucagucuccgc

SEQ ID NO: 109122 - RNA, 20 nt, Artificial Sequence
  MKO10109122_B_Pnpla1
  gRNA
ucccugcagagauacaucga

SEQ ID NO: 109123 - RNA, 20 nt, Artificial Sequence
  MKO10109123_B_Pnpla2
  gRNA
cuccgucugaaacacgaguc

SEQ ID NO: 109124 - RNA, 20 nt, Artificial Sequence
  MKO10109124_B_Pnpla2
  gRNA
uuccucggggucuaccacau

SEQ ID NO: 109125 - RNA, 20 nt, Artificial Sequence
  MKO10109125_B_Pnpla2
  gRNA
caaucucuaccgccucucga

SEQ ID NO: 109126 - RNA, 20 nt, Artificial Sequence
  MKO10109126_B_Pnpla3
  gRNA
uccccacagcgguacgugga

SEQ ID NO: 109127 - RNA, 20 nt, Artificial Sequence
  MKO10109127_B_Pnpla3
  gRNA
aacacuuaccucgccucgga

SEQ ID NO: 109128 - RNA, 20 nt, Artificial Sequence
  MKO10109128_B_Pnpla3
  gRNA
ccuggacgccuuccgguucc

SEQ ID NO: 109129 - RNA, 20 nt, Artificial Sequence
  MKO10109129_B_Pnpla5
  gRNA
gugauccccccggcauucag

SEQ ID NO: 109130 - RNA, 20 nt, Artificial Sequence
  MKO10109130_B_Pnpla5
  gRNA
cuggaugaauucaucccgag

SEQ ID NO: 109131 - RNA, 20 nt, Artificial Sequence
  MKO10109131_B_Pnpla5
  gRNA
auuaccgucucuccuuucaa

SEQ ID NO: 109132 - RNA, 20 nt, Artificial Sequence
  MKO10109132_B_Pnpla6
  gRNA
gacuccgacccuacaacgga

SEQ ID NO: 109133 - RNA, 20 nt, Artificial Sequence
  MKO10109133_B_Pnpla6
  gRNA
caggugcugggcgugaugau

SEQ ID NO: 109134 - RNA, 20 nt, Artificial Sequence
  MKO10109134_B_Pnpla6
  gRNA
gcagccuucgcaccaccaag

SEQ ID NO: 109135 - RNA, 20 nt, Artificial Sequence
  MKO10109135_B_Pnpla7
  gRNA
uagggauuaccaugguggac

SEQ ID NO: 109136 - RNA, 20 nt, Artificial Sequence
  MKO10109136_B_Pnpla7
  gRNA
ugcagagguauucccaacca

SEQ ID NO: 109137 - RNA, 20 nt, Artificial Sequence
  MKO10109137_B_Pnpla7
  gRNA
gaccacacucccccauaccu

SEQ ID NO: 109138 - RNA, 20 nt, Artificial Sequence
  MKO10109138_B_Pnpla8
  gRNA
acccuaguaauacagagcuu

SEQ ID NO: 109139 - RNA, 20 nt, Artificial Sequence
  MKO10109139_B_Pnpla8
  gRNA
caugccgcuggaugaaugug

SEQ ID NO: 109140 - RNA, 20 nt, Artificial Sequence
  MKO10109140_B_Pnpla8
  gRNA
cagaacucgagccuuaguuc

SEQ ID NO: 109141 - RNA, 20 nt, Artificial Sequence
  MKO10109141_B_Pnpo
  gRNA
cugaacagccucgucaaacc

SEQ ID NO: 109142 - RNA, 20 nt, Artificial Sequence
  MKO10109142_B_Pnpo
  gRNA
ucucguaguuagugaagaag

SEQ ID NO: 109143 - RNA, 20 nt, Artificial Sequence
  MKO10109143_B_Pnpo
  gRNA
gacugaccacagccccaauc

SEQ ID NO: 109144 - RNA, 20 nt, Artificial Sequence
  MKO10109144_B_Pnpt1
  gRNA
cucccuucuaagguaguuug

SEQ ID NO: 109145 - RNA, 20 nt, Artificial Sequence
  MKO10109145_B_Pnpt1
  gRNA
auucgcccucucuuuccagc

SEQ ID NO: 109146 - RNA, 20 nt, Artificial Sequence
  MKO10109146_B_Pnpt1
  gRNA
cugaguaucauaaaaauagc

SEQ ID NO: 109147 - RNA, 20 nt, Artificial Sequence
  MKO10109147_B_Pnp
  gRNA
ccagccaguaccugugcuuu

SEQ ID NO: 109148 - RNA, 20 nt, Artificial Sequence
  MKO10109148_B_Pnp
  gRNA
auuaugagaccacugccaag

SEQ ID NO: 109149 - RNA, 20 nt, Artificial Sequence
  MKO10109149_B_Pnp
  gRNA
agauguguaccuuucaucgu

SEQ ID NO: 109150 - RNA, 20 nt, Artificial Sequence
  MKO10109150_B_Pnrc1
  gRNA
ucccaaagccuccgagucac

SEQ ID NO: 109151 - RNA, 20 nt, Artificial Sequence
  MKO10109151_B_Pnrc1
  gRNA
ggaacccgagcggcgcuaag

SEQ ID NO: 109152 - RNA, 20 nt, Artificial Sequence
  MKO10109152_B_Pnrc1
  gRNA
gccggggccaaucgucgcgc

SEQ ID NO: 109153 - RNA, 20 nt, Artificial Sequence
  MKO10109153_B_Pnrc2
  gRNA
caagcuagucagaacuaugc

SEQ ID NO: 109154 - RNA, 20 nt, Artificial Sequence
  MKO10109154_B_Pnrc2
  gRNA
uuacuagcauuucuagauug

SEQ ID NO: 109155 - RNA, 20 nt, Artificial Sequence
  MKO10109155_B_Pnrc2
  gRNA
uuauaccuguaccuuaagua

SEQ ID NO: 109156 - RNA, 20 nt, Artificial Sequence
  MKO10109156_B_Poc1a
  gRNA
gagacaagacuguucgcauc

SEQ ID NO: 109157 - RNA, 20 nt, Artificial Sequence
  MKO10109157_B_Poc1a
  gRNA
aguguccacuucugcagcga

SEQ ID NO: 109158 - RNA, 20 nt, Artificial Sequence
  MKO10109158_B_Poc1a
  gRNA
cccaguugaugugcuggguc

SEQ ID NO: 109159 - RNA, 20 nt, Artificial Sequence
  MKO10109159_B_Poc1b
  gRNA
cccagugugugugucgauac

SEQ ID NO: 109160 - RNA, 20 nt, Artificial Sequence
  MKO10109160_B_Poc1b
  gRNA
gaaaaguccacacuccgaac

SEQ ID NO: 109161 - RNA, 20 nt, Artificial Sequence
  MKO10109161_B_Poc1b
  gRNA
gaggcuaauagguuuccuug

SEQ ID NO: 109162 - RNA, 20 nt, Artificial Sequence
  MKO10109162_B_Poc5
  gRNA
ugaggcauaccagcuagcgu

SEQ ID NO: 109163 - RNA, 20 nt, Artificial Sequence
  MKO10109163_B_Poc5
  gRNA
cccuguaagagacacugaac

SEQ ID NO: 109164 - RNA, 20 nt, Artificial Sequence
  MKO10109164_B_Poc5
  gRNA
gagcugaaaaaguccaugac

SEQ ID NO: 109165 - RNA, 20 nt, Artificial Sequence
  MKO10109165_B_Podnl1
  gRNA
uguaggggagcucccgaagc

SEQ ID NO: 109166 - RNA, 20 nt, Artificial Sequence
  MKO10109166_B_Podnl1
  gRNA
cuaacgaccacuuuagcauc

SEQ ID NO: 109167 - RNA, 20 nt, Artificial Sequence
  MKO10109167_B_Podnl1
  gRNA
ccacauagaaguucucuagc

SEQ ID NO: 109168 - RNA, 20 nt, Artificial Sequence
  MKO10109168_B_Podn
  gRNA
cugcuagcuuguuguuaugc

SEQ ID NO: 109169 - RNA, 20 nt, Artificial Sequence
  MKO10109169_B_Podn
  gRNA
cugccggaccacauguucaa

SEQ ID NO: 109170 - RNA, 20 nt, Artificial Sequence
  MKO10109170_B_Podn
  gRNA
uagccucaauuaccuguacc

SEQ ID NO: 109171 - RNA, 20 nt, Artificial Sequence
  MKO10109171_B_Podxl2
  gRNA
gugggagcagcugacuucga

SEQ ID NO: 109172 - RNA, 20 nt, Artificial Sequence
  MKO10109172_B_Podxl2
  gRNA
gggacuacggcuccuagcuc

SEQ ID NO: 109173 - RNA, 20 nt, Artificial Sequence
  MKO10109173_B_Podxl2
  gRNA
ucucgcacaggugaucugca

SEQ ID NO: 109174 - RNA, 20 nt, Artificial Sequence
  MKO10109174_B_Podxl
  gRNA
cgggagucccauuagagaug

SEQ ID NO: 109175 - RNA, 20 nt, Artificial Sequence
  MKO10109175_B_Podxl
  gRNA
agaauaaggaguuccucauc

SEQ ID NO: 109176 - RNA, 20 nt, Artificial Sequence
  MKO10109176_B_Podxl
  gRNA
uaaacugugaaccucccaua

SEQ ID NO: 109177 - RNA, 20 nt, Artificial Sequence
  MKO10109177_B_Pof1b
  gRNA
cauaguacaaaacccugaac

SEQ ID NO: 109178 - RNA, 20 nt, Artificial Sequence
  MKO10109178_B_Pof1b
  gRNA
aauugacuuccucuuaggaa

SEQ ID NO: 109179 - RNA, 20 nt, Artificial Sequence
  MKO10109179_B_Pof1b
  gRNA
ccauugucuccuuuccuaag

SEQ ID NO: 109180 - RNA, 20 nt, Artificial Sequence
  MKO10109180_B_Pofuu1
  gRNA
gcgaguggcauacugcuuug

SEQ ID NO: 109181 - RNA, 20 nt, Artificial Sequence
  MKO10109181_B_Pofuu1
  gRNA
gaagcugcugaaccgcaccu

SEQ ID NO: 109182 - RNA, 20 nt, Artificial Sequence
  MKO10109182_B_Pofuu1
  gRNA
ucagcagcuucgcaaaugcc

SEQ ID NO: 109183 - RNA, 20 nt, Artificial Sequence
  MKO10109183_B_Pofuu2
  gRNA
uccgcagggaugucuauauc

SEQ ID NO: 109184 - RNA, 20 nt, Artificial Sequence
  MKO10109184_B_Pofuu2
  gRNA
gugcuaguccugcccccgug

SEQ ID NO: 109185 - RNA, 20 nt, Artificial Sequence
  MKO10109185_B_Pofuu2
  gRNA
ugucuccugccuguccgucc

SEQ ID NO: 109186 - RNA, 20 nt, Artificial Sequence
  MKO10109186_B_Pogk
  gRNA
ccaagccagauaugaucaau

SEQ ID NO: 109187 - RNA, 20 nt, Artificial Sequence
  MKO10109187_B_Pogk
  gRNA
gguaccagcucuauuugaug

SEQ ID NO: 109188 - RNA, 20 nt, Artificial Sequence
  MKO10109188_B_Pogk
  gRNA
ucaaauucagaggguaggcc

SEQ ID NO: 109189 - RNA, 20 nt, Artificial Sequence
  MKO10109189_B_Pogluu1
  gRNA
cauccaucgccucccugaca

SEQ ID NO: 109190 - RNA, 20 nt, Artificial Sequence
  MKO10109190_B_Pogluu1
  gRNA
accugacuccuuuccgaggu

SEQ ID NO: 109191 - RNA, 20 nt, Artificial Sequence
  MKO10109191_B_Pogluu1
  gRNA
ucuccaaagcccuguuaauu

SEQ ID NO: 109192 - RNA, 20 nt, Artificial Sequence
  MKO10109192_B_Pogz
  gRNA
aucccacuuaccauuguugu

SEQ ID NO: 109193 - RNA, 20 nt, Artificial Sequence
  MKO10109193_B_Pogz
  gRNA
auugugcugaacguacagca

SEQ ID NO: 109194 - RNA, 20 nt, Artificial Sequence
  MKO10109194_B_Pogz
  gRNA
cccacuguuacuaacaguag

SEQ ID NO: 109195 - RNA, 20 nt, Artificial Sequence
  MKO10109195_B_Pola1
  gRNA
uucagaugggauaggcuaug

SEQ ID NO: 109196 - RNA, 20 nt, Artificial Sequence
  MKO10109196_B_Pola1
  gRNA
ugucaagugcaucauccuca

SEQ ID NO: 109197 - RNA, 20 nt, Artificial Sequence
  MKO10109197_B_Pola1
  gRNA
uuuccagcugugucagauuc

SEQ ID NO: 109198 - RNA, 20 nt, Artificial Sequence
  MKO10109198_B_Pola2
  gRNA
gggacucacguuucuccaac

SEQ ID NO: 109199 - RNA, 20 nt, Artificial Sequence
  MKO10109199_B_Pola2
  gRNA
cauguucaccuuagagggug

SEQ ID NO: 109200 - RNA, 20 nt, Artificial Sequence
  MKO10109200_B_Pola2
  gRNA
uccugcaugcccacugucuu

SEQ ID NO: 109201 - RNA, 20 nt, Artificial Sequence
  MKO10109201_B_Polb
  gRNA
aauuuccugacucgaguuac

SEQ ID NO: 109202 - RNA, 20 nt, Artificial Sequence
  MKO10109202_B_Polb
  gRNA
aaaauugcguaaacuggaaa

SEQ ID NO: 109203 - RNA, 20 nt, Artificial Sequence
  MKO10109203_B_Polb
  gRNA
uacccacacaaaaucaagag

SEQ ID NO: 109204 - RNA, 20 nt, Artificial Sequence
  MKO10109204_B_Pold1
  gRNA
gccuuuggggucaccgauga

SEQ ID NO: 109205 - RNA, 20 nt, Artificial Sequence
  MKO10109205_B_Pold1
  gRNA
agagcuccuucccaccgcgc

SEQ ID NO: 109206 - RNA, 20 nt, Artificial Sequence
  MKO10109206_B_Pold1
  gRNA
agggggcaaagcccuguaug

SEQ ID NO: 109207 - RNA, 20 nt, Artificial Sequence
  MKO10109207_B_Pold2
  gRNA
ccuccucgcugaucucccgc

SEQ ID NO: 109208 - RNA, 20 nt, Artificial Sequence
  MKO10109208_B_Pold2
  gRNA
ccuuuccccaggaacggucu

SEQ ID NO: 109209 - RNA, 20 nt, Artificial Sequence
  MKO10109209_B_Pold2
  gRNA
uccggacugggccugggcgg

SEQ ID NO: 109210 - RNA, 20 nt, Artificial Sequence
  MKO10109210_B_Pold3
  gRNA
aaugaacuuacuguuuggcc

SEQ ID NO: 109211 - RNA, 20 nt, Artificial Sequence
  MKO10109211_B_Pold3
  gRNA
cucucacuacugcaaccuug

SEQ ID NO: 109212 - RNA, 20 nt, Artificial Sequence
  MKO10109212_B_Pold3
  gRNA
aguagugagagaagauaaac

SEQ ID NO: 109213 - RNA, 20 nt, Artificial Sequence
  MKO10109213_B_Pold4
  gRNA
uuugaccuggccuggcagua

SEQ ID NO: 109214 - RNA, 20 nt, Artificial Sequence
  MKO10109214_B_Pold4
  gRNA
ccugaccugcauuggaagug

SEQ ID NO: 109215 - RNA, 20 nt, Artificial Sequence
  MKO10109215_B_Pold4
  gRNA
aagacccucacuuccaaugc

SEQ ID NO: 109216 - RNA, 20 nt, Artificial Sequence
  MKO10109216_B_Poldip2
  gRNA
cucgguagccaaaaacacua

SEQ ID NO: 109217 - RNA, 20 nt, Artificial Sequence
  MKO10109217_B_Poldip2
  gRNA
gaggggucguccuguuuccc

SEQ ID NO: 109218 - RNA, 20 nt, Artificial Sequence
  MKO10109218_B_Poldip2
  gRNA
uuacuauaugugggcaguca

SEQ ID NO: 109219 - RNA, 20 nt, Artificial Sequence
  MKO10109219_B_Poldip3
  gRNA
cucucagaacuuguaugacc

SEQ ID NO: 109220 - RNA, 20 nt, Artificial Sequence
  MKO10109220_B_Poldip3
  gRNA
caauguugucaauaaccacc

SEQ ID NO: 109221 - RNA, 20 nt, Artificial Sequence
  MKO10109221_B_Poldip3
  gRNA
ggcauaccauguggugaaca

SEQ ID NO: 109222 - RNA, 20 nt, Artificial Sequence
  MKO10109222_B_Pole2
  gRNA
auagcguucaagauacagcu

SEQ ID NO: 109223 - RNA, 20 nt, Artificial Sequence
  MKO10109223_B_Pole2
  gRNA
cugcaucgaugaucuuuccu

SEQ ID NO: 109224 - RNA, 20 nt, Artificial Sequence
  MKO10109224_B_Pole2
  gRNA
gcuccaauucagugacagac

SEQ ID NO: 109225 - RNA, 20 nt, Artificial Sequence
  MKO10109225_B_Pole3
  gRNA
cgaggacgaccagaacgaag

SEQ ID NO: 109226 - RNA, 20 nt, Artificial Sequence
  MKO10109226_B_Pole3
  gRNA
cuuccuuacagcguacaggc

SEQ ID NO: 109227 - RNA, 20 nt, Artificial Sequence
  MKO10109227_B_Pole3
  gRNA
ccauugaaagaagcucuaga

SEQ ID NO: 109228 - RNA, 20 nt, Artificial Sequence
  MKO10109228_B_Pole4
  gRNA
cucuacccaaaucucuccuc

SEQ ID NO: 109229 - RNA, 20 nt, Artificial Sequence
  MKO10109229_B_Pole4
  gRNA
agauaaugcaauagaagcug

SEQ ID NO: 109230 - RNA, 20 nt, Artificial Sequence
  MKO10109230_B_Pole4
  gRNA
caagccccgacgagugcacc

SEQ ID NO: 109231 - RNA, 20 nt, Artificial Sequence
  MKO10109231_B_Pole
  gRNA
uuucuacauugcagcgagaa

SEQ ID NO: 109232 - RNA, 20 nt, Artificial Sequence
  MKO10109232_B_Pole
  gRNA
uaccaaguccagaucuucuu

SEQ ID NO: 109233 - RNA, 20 nt, Artificial Sequence
  MKO10109233_B_Pole
  gRNA
uacuacuucauucaagauga

SEQ ID NO: 109234 - RNA, 20 nt, Artificial Sequence
  MKO10109234_B_Polg2
  gRNA
ggagcacuauguuaauugcc

SEQ ID NO: 109235 - RNA, 20 nt, Artificial Sequence
  MKO10109235_B_Polg2
  gRNA
cuucagcagcgcugauuguc

SEQ ID NO: 109236 - RNA, 20 nt, Artificial Sequence
  MKO10109236_B_Polg2
  gRNA
uguaucguagacacauuucc

SEQ ID NO: 109237 - RNA, 20 nt, Artificial Sequence
  MKO10109237_B_Polg
  gRNA
aguacugcgcccgugaugug

SEQ ID NO: 109238 - RNA, 20 nt, Artificial Sequence
  MKO10109238_B_Polg
  gRNA
uaguaucgagaaaacgcauc

SEQ ID NO: 109239 - RNA, 20 nt, Artificial Sequence
  MKO10109239_B_Polg
  gRNA
ccuuugacgaacagcucccg

SEQ ID NO: 109240 - RNA, 20 nt, Artificial Sequence
  MKO10109240_B_Polh
  gRNA
guuauguccagaucuucucc

SEQ ID NO: 109241 - RNA, 20 nt, Artificial Sequence
  MKO10109241_B_Polh
  gRNA
ugaacgugccagcaucgaug

SEQ ID NO: 109242 - RNA, 20 nt, Artificial Sequence
  MKO10109242_B_Polh
  gRNA
uaagcccaaccgccaaaccc

SEQ ID NO: 109243 - RNA, 20 nt, Artificial Sequence
  MKO10109243_B_Poli
  gRNA
gcucacaggcugcgccggag

SEQ ID NO: 109244 - RNA, 20 nt, Artificial Sequence
  MKO10109244_B_Poli
  gRNA
acugacggaaccuccucacu

SEQ ID NO: 109245 - RNA, 20 nt, Artificial Sequence
  MKO10109245_B_Poli
  gRNA
guuccgucagugacuguguu

SEQ ID NO: 109246 - RNA, 20 nt, Artificial Sequence
  MKO10109246_B_Polk
  gRNA
gugcuguguuauauucaagu

SEQ ID NO: 109247 - RNA, 20 nt, Artificial Sequence
  MKO10109247_B_Polk
  gRNA
uaccauaguucauguugaca

SEQ ID NO: 109248 - RNA, 20 nt, Artificial Sequence
  MKO10109248_B_Polk
  gRNA
auggguuuauccuucaguuc

SEQ ID NO: 109249 - RNA, 20 nt, Artificial Sequence
  MKO10109249_B_Poll
  gRNA
gggguagugcccagugauca

SEQ ID NO: 109250 - RNA, 20 nt, Artificial Sequence
  MKO10109250_B_Poll
  gRNA
ugaccugaugguaccacauc

SEQ ID NO: 109251 - RNA, 20 nt, Artificial Sequence
  MKO10109251_B_Poll
  gRNA
gcagaucugcugagcuaacc

SEQ ID NO: 109252 - RNA, 20 nt, Artificial Sequence
  MKO10109252_B_Polm
  gRNA
aacaaguccguugcucagaa

SEQ ID NO: 109253 - RNA, 20 nt, Artificial Sequence
  MKO10109253_B_Polm
  gRNA
caucacgcaccuucaugguc

SEQ ID NO: 109254 - RNA, 20 nt, Artificial Sequence
  MKO10109254_B_Polm
  gRNA
gauggaagggaccucagcca

SEQ ID NO: 109255 - RNA, 20 nt, Artificial Sequence
  MKO10109255_B_Poln
  gRNA
gacucaaucacuaggaacaa

SEQ ID NO: 109256 - RNA, 20 nt, Artificial Sequence
  MKO10109256_B_Poln
  gRNA
aagcacauagucuauuuguc

SEQ ID NO: 109257 - RNA, 20 nt, Artificial Sequence
  MKO10109257_B_Poln
  gRNA
gcuuuaacuuguacuguuaa

SEQ ID NO: 109258 - RNA, 20 nt, Artificial Sequence
  MKO10109258_B_Polq
  gRNA
ccaagacgugaccaagcaaa

SEQ ID NO: 109259 - RNA, 20 nt, Artificial Sequence
  MKO10109259_B_Polq
  gRNA
ggagaacugucccguuggug

SEQ ID NO: 109260 - RNA, 20 nt, Artificial Sequence
  MKO10109260_B_Polq
  gRNA
guguaagaaagauguucgaa

SEQ ID NO: 109261 - RNA, 20 nt, Artificial Sequence
  MKO10109261_B_Polr1a
  gRNA
gcaaacuugucgcucaguuc

SEQ ID NO: 109262 - RNA, 20 nt, Artificial Sequence
  MKO10109262_B_Polr1a
  gRNA
agcuugagcgaauucucagc

SEQ ID NO: 109263 - RNA, 20 nt, Artificial Sequence
  MKO10109263_B_Polr1a
  gRNA
uaacucuucuugaauuucga

SEQ ID NO: 109264 - RNA, 20 nt, Artificial Sequence
  MKO10109264_B_Polr1b
  gRNA
auuuccccaucgccauggua

SEQ ID NO: 109265 - RNA, 20 nt, Artificial Sequence
  MKO10109265_B_Polr1b
  gRNA
guuuauccagcugagugucg

SEQ ID NO: 109266 - RNA, 20 nt, Artificial Sequence
  MKO10109266_B_Polr1b
  gRNA
ccauuuaggcugauaucagc

SEQ ID NO: 109267 - RNA, 20 nt, Artificial Sequence
  MKO10109267_B_Polr1c
  gRNA
uaacaacacguccauagucc

SEQ ID NO: 109268 - RNA, 20 nt, Artificial Sequence
  MKO10109268_B_Polr1c
  gRNA
acgccgguuaugaugaugcc

SEQ ID NO: 109269 - RNA, 20 nt, Artificial Sequence
  MKO10109269_B_Polr1c
  gRNA
auccucgucucuuugaauau

SEQ ID NO: 109270 - RNA, 20 nt, Artificial Sequence
  MKO10109270_B_Polr1d
  gRNA
aggaugaaguguccucuugc

SEQ ID NO: 109271 - RNA, 20 nt, Artificial Sequence
  MKO10109271_B_Polr1d
  gRNA
ucccgcgauggaagacgauc

SEQ ID NO: 109272 - RNA, 20 nt, Artificial Sequence
  MKO10109272_B_Polr1d
  gRNA
cggccccauugucuccgcuc

SEQ ID NO: 109273 - RNA, 20 nt, Artificial Sequence
  MKO10109273_B_Polr1e
  gRNA
uauugagcgagagccuccuc

SEQ ID NO: 109274 - RNA, 20 nt, Artificial Sequence
  MKO10109274_B_Polr1e
  gRNA
uccuaugucggaaacaauuu

SEQ ID NO: 109275 - RNA, 20 nt, Artificial Sequence
  MKO10109275_B_Polr1e
  gRNA
cggaaccuaccagcaaacag

SEQ ID NO: 109276 - RNA, 20 nt, Artificial Sequence
  MKO10109276_B_Polr2a
  gRNA
ccaauucgauguggccaaag

SEQ ID NO: 109277 - RNA, 20 nt, Artificial Sequence
  MKO10109277_B_Polr2a
  gRNA
cgaccucccuccguuguuuc

SEQ ID NO: 109278 - RNA, 20 nt, Artificial Sequence
  MKO10109278_B_Polr2a
  gRNA
ccacuuuggccacaucgaau

SEQ ID NO: 109279 - RNA, 20 nt, Artificial Sequence
  MKO10109279_B_Polr2b
  gRNA
ugcaccaccgauugaccuac

SEQ ID NO: 109280 - RNA, 20 nt, Artificial Sequence
  MKO10109280_B_Polr2b
  gRNA
ucauuuggcaucauuggcga

SEQ ID NO: 109281 - RNA, 20 nt, Artificial Sequence
  MKO10109281_B_Polr2b
  gRNA
uuacgugagauuucuuaacc

SEQ ID NO: 109282 - RNA, 20 nt, Artificial Sequence
  MKO10109282_B_Polr2c
  gRNA
gcgcgaugaauucaucauga

SEQ ID NO: 109283 - RNA, 20 nt, Artificial Sequence
  MKO10109283_B_Polr2c
  gRNA
gucaaucugaacccagucga

SEQ ID NO: 109284 - RNA, 20 nt, Artificial Sequence
  MKO10109284_B_Polr2c
  gRNA
ccacaaugucaucacuagug

SEQ ID NO: 109285 - RNA, 20 nt, Artificial Sequence
  MKO10109285_B_Polr2d
  gRNA
agcagucuccgggcaaagau

SEQ ID NO: 109286 - RNA, 20 nt, Artificial Sequence
  MKO10109286_B_Polr2d
  gRNA
cuguuuagccaaucuuugcc

SEQ ID NO: 109287 - RNA, 20 nt, Artificial Sequence
  MKO10109287_B_Polr2d
  gRNA
ucccagcuuaucuuucccaa

SEQ ID NO: 109288 - RNA, 20 nt, Artificial Sequence
  MKO10109288_B_Polr2e
  gRNA
cauggccccgaaguaugugc

SEQ ID NO: 109289 - RNA, 20 nt, Artificial Sequence
  MKO10109289_B_Polr2e
  gRNA
cugcagcugugucaugaccg

SEQ ID NO: 109290 - RNA, 20 nt, Artificial Sequence
  MKO10109290_B_Polr2e
  gRNA
gacccaguggcacgguacuu

SEQ ID NO: 109291 - RNA, 20 nt, Artificial Sequence
  MKO10109291_B_Polr2f
  gRNA
caguccucauagcugccguc

SEQ ID NO: 109292 - RNA, 20 nt, Artificial Sequence
  MKO10109292_B_Polr2f
  gRNA
cacccgggcccgcucauacu

SEQ ID NO: 109293 - RNA, 20 nt, Artificial Sequence
  MKO10109293_B_Polr2f
  gRNA
cgacgacuuugaugacguug

SEQ ID NO: 109294 - RNA, 20 nt, Artificial Sequence
  MKO10109294_B_Polr2g
  gRNA
uucaccguguugagcaaguu

SEQ ID NO: 109295 - RNA, 20 nt, Artificial Sequence
  MKO10109295_B_Polr2g
  gRNA
ucguccauggucuuauagca

SEQ ID NO: 109296 - RNA, 20 nt, Artificial Sequence
  MKO10109296_B_Polr2g
  gRNA
accagcaccaauauugucga

SEQ ID NO: 109297 - RNA, 20 nt, Artificial Sequence
  MKO10109297_B_Polr2h
  gRNA
ucuauucaggugacaaguuc

SEQ ID NO: 109298 - RNA, 20 nt, Artificial Sequence
  MKO10109298_B_Polr2h
  gRNA
caggcguguggcugcuucag

SEQ ID NO: 109299 - RNA, 20 nt, Artificial Sequence
  MKO10109299_B_Polr2h
  gRNA
gaaaguguacaggaucgaag

SEQ ID NO: 109300 - RNA, 20 nt, Artificial Sequence
  MKO10109300_B_Polr2i
  gRNA
ccugcugguaaucgcaauuc

SEQ ID NO: 109301 - RNA, 20 nt, Artificial Sequence
  MKO10109301_B_Polr2i
  gRNA
aaaucgcauucugcuguacg

SEQ ID NO: 109302 - RNA, 20 nt, Artificial Sequence
  MKO10109302_B_Polr2i
  gRNA
gucacacagugcccgagcug

SEQ ID NO: 109303 - RNA, 20 nt, Artificial Sequence
  MKO10109303_B_Polr2j
  gRNA
uuuguugauggugaacaagc

SEQ ID NO: 109304 - RNA, 20 nt, Artificial Sequence
  MKO10109304_B_Polr2j
  gRNA
uuccagaaucaccauuaaca

SEQ ID NO: 109305 - RNA, 20 nt, Artificial Sequence
  MKO10109305_B_Polr2j
  gRNA
caccccagacuacagucccc

SEQ ID NO: 109306 - RNA, 20 nt, Artificial Sequence
  MKO10109306_B_Polr2k
  gRNA
cagccaaugauauauauuug

SEQ ID NO: 109307 - RNA, 20 nt, Artificial Sequence
  MKO10109307_B_Polr2k
  gRNA
uccacauucucugcaucuga

SEQ ID NO: 109308 - RNA, 20 nt, Artificial Sequence
  MKO10109308_B_Polr2k
  gRNA
ccgaaaaugagauaaagucc

SEQ ID NO: 109309 - RNA, 20 nt, Artificial Sequence
  MKO10109309_B_Polr2l
  gRNA
gcuccagcggucacuucucu

SEQ ID NO: 109310 - RNA, 20 nt, Artificial Sequence
  MKO10109310_B_Polr2l
  gRNA
uucaccugcgggaagaucgu

SEQ ID NO: 109311 - RNA, 20 nt, Artificial Sequence
  MKO10109311_B_Polr2l
  gRNA
guugccgacgaucuucccgc

SEQ ID NO: 109312 - RNA, 20 nt, Artificial Sequence
  MKO10109312_B_Polr2m
  gRNA
cagcugcccacauccgagcc

SEQ ID NO: 109313 - RNA, 20 nt, Artificial Sequence
  MKO10109313_B_Polr2m
  gRNA
gagcugggggcucgaagccg

SEQ ID NO: 109314 - RNA, 20 nt, Artificial Sequence
  MKO10109314_B_Polr2m
  gRNA
ccucagaagagcagcgacga

SEQ ID NO: 109315 - RNA, 20 nt, Artificial Sequence
  MKO10109315_B_Polr3a
  gRNA
gaucguccuugugagaccug

SEQ ID NO: 109316 - RNA, 20 nt, Artificial Sequence
  MKO10109316_B_Polr3a
  gRNA
ggcugucauugguaucuuac

SEQ ID NO: 109317 - RNA, 20 nt, Artificial Sequence
  MKO10109317_B_Polr3a
  gRNA
cccugaggagaugcgccagc

SEQ ID NO: 109318 - RNA, 20 nt, Artificial Sequence
  MKO10109318_B_Polr3b
  gRNA
aguaccucaugaggggacac

SEQ ID NO: 109319 - RNA, 20 nt, Artificial Sequence
  MKO10109319_B_Polr3b
  gRNA
uucuuacuuuaaguaccaca

SEQ ID NO: 109320 - RNA, 20 nt, Artificial Sequence
  MKO10109320_B_Polr3b
  gRNA
cucugcuuagguuaaaggcc

SEQ ID NO: 109321 - RNA, 20 nt, Artificial Sequence
  MKO10109321_B_Polr3c
  gRNA
cgcgcuugugcacaugauag

SEQ ID NO: 109322 - RNA, 20 nt, Artificial Sequence
  MKO10109322_B_Polr3c
  gRNA
uacaccaccaaaacgcugua

SEQ ID NO: 109323 - RNA, 20 nt, Artificial Sequence
  MKO10109323_B_Polr3c
  gRNA
guucccaaacugagcuugau

SEQ ID NO: 109324 - RNA, 20 nt, Artificial Sequence
  MKO10109324_B_Polr3d
  gRNA
cggacggggacguggccgcc

SEQ ID NO: 109325 - RNA, 20 nt, Artificial Sequence
  MKO10109325_B_Polr3d
  gRNA
ucccaugucggacaugucca

SEQ ID NO: 109326 - RNA, 20 nt, Artificial Sequence
  MKO10109326_B_Polr3d
  gRNA
cauccuucuccagcaugcgc

SEQ ID NO: 109327 - RNA, 20 nt, Artificial Sequence
  MKO10109327_B_Polr3e
  gRNA
gcaguuaccuccuguaugac

SEQ ID NO: 109328 - RNA, 20 nt, Artificial Sequence
  MKO10109328_B_Polr3e
  gRNA
uucccagaucgauguguacu

SEQ ID NO: 109329 - RNA, 20 nt, Artificial Sequence
  MKO10109329_B_Polr3e
  gRNA
agaagaugacccagucauac

SEQ ID NO: 109330 - RNA, 20 nt, Artificial Sequence
  MKO10109330_B_Polr3f
  gRNA
uaucaaaucauagaggaugc

SEQ ID NO: 109331 - RNA, 20 nt, Artificial Sequence
  MKO10109331_B_Polr3f
  gRNA
aggccucuuauauagaauaa

SEQ ID NO: 109332 - RNA, 20 nt, Artificial Sequence
  MKO10109332_B_Polr3f
  gRNA
aauccuuuauucuauauaag

SEQ ID NO: 109333 - RNA, 20 nt, Artificial Sequence
  MKO10109333_B_Polr3gl
  gRNA
cccuaagagcacagacgaua

SEQ ID NO: 109334 - RNA, 20 nt, Artificial Sequence
  MKO10109334_B_Polr3gl
  gRNA
cacucgaaucuugagcucac

SEQ ID NO: 109335 - RNA, 20 nt, Artificial Sequence
  MKO10109335_B_Polr3gl
  gRNA
ccaccauuauccuucccaag

SEQ ID NO: 109336 - RNA, 20 nt, Artificial Sequence
  MKO10109336_B_Polr3g
  gRNA
gcuuugcucggcuuggauuu

SEQ ID NO: 109337 - RNA, 20 nt, Artificial Sequence
  MKO10109337_B_Polr3g
  gRNA
ucacccuagaugauauugaa

SEQ ID NO: 109338 - RNA, 20 nt, Artificial Sequence
  MKO10109338_B_Polr3g
  gRNA
uuccaagagagaugaugcca

SEQ ID NO: 109339 - RNA, 20 nt, Artificial Sequence
  MKO10109339_B_Polr3h
  gRNA
cucggcggaacuggguccug

SEQ ID NO: 109340 - RNA, 20 nt, Artificial Sequence
  MKO10109340_B_Polr3h
  gRNA
aggggugaaacaccacguag

SEQ ID NO: 109341 - RNA, 20 nt, Artificial Sequence
  MKO10109341_B_Polr3h
  gRNA
gauggagcaucccacaccaa

SEQ ID NO: 109342 - RNA, 20 nt, Artificial Sequence
  MKO10109342_B_Polr3k
  gRNA
agcauugcagcacuuauaga

SEQ ID NO: 109343 - RNA, 20 nt, Artificial Sequence
  MKO10109343_B_Polr3k
  gRNA
aagugcugcaaugcucagug

SEQ ID NO: 109344 - RNA, 20 nt, Artificial Sequence
  MKO10109344_B_Polr3k
  gRNA
guauccaaagcuaaaagaag

SEQ ID NO: 109345 - RNA, 20 nt, Artificial Sequence
  MKO10109345_B_Polrmt
  gRNA
ugccuuucguccaccgccac

SEQ ID NO: 109346 - RNA, 20 nt, Artificial Sequence
  MKO10109346_B_Polrmt
  gRNA
ccgcugggcgcaaaagcuag

SEQ ID NO: 109347 - RNA, 20 nt, Artificial Sequence
  MKO10109347_B_Polrmt
  gRNA
ucuggauggugcgaacaucc

SEQ ID NO: 109348 - RNA, 20 nt, Artificial Sequence
  MKO10109348_B_Pom121l12
  gRNA
cuugacugucaccgggcugc

SEQ ID NO: 109349 - RNA, 20 nt, Artificial Sequence
  MKO10109349_B_Pom121l12
  gRNA
ccuauaugaaacgauggauu

SEQ ID NO: 109350 - RNA, 20 nt, Artificial Sequence
  MKO10109350_B_Pom121l12
  gRNA
gcaaguauugcaacccaaac

SEQ ID NO: 109351 - RNA, 20 nt, Artificial Sequence
  MKO10109351_B_Pom121l2
  gRNA
ccaagaaagaugucuugagu

SEQ ID NO: 109352 - RNA, 20 nt, Artificial Sequence
  MKO10109352_B_Pom121l2
  gRNA
auacggaggccgaaugccuu

SEQ ID NO: 109353 - RNA, 20 nt, Artificial Sequence
  MKO10109353_B_Pom121l2
  gRNA
gcaaagcgggguccucgccg

SEQ ID NO: 109354 - RNA, 20 nt, Artificial Sequence
  MKO10109354_B_Pom121
  gRNA
cuuccaaccgucugcuggaa

SEQ ID NO: 109355 - RNA, 20 nt, Artificial Sequence
  MKO10109355_B_Pom121
  gRNA
gacuguccugaacgcccuca

SEQ ID NO: 109356 - RNA, 20 nt, Artificial Sequence
  MKO10109356_B_Pom121
  gRNA
uaucacaggcgccaugauag

SEQ ID NO: 109357 - RNA, 20 nt, Artificial Sequence
  MKO10109357_B_Pomc
  gRNA
agauucugcuacagucgcuc

SEQ ID NO: 109358 - RNA, 20 nt, Artificial Sequence
  MKO10109358_B_Pomc
  gRNA
gcagguccuggaguccgacg

SEQ ID NO: 109359 - RNA, 20 nt, Artificial Sequence
  MKO10109359_B_Pomc
  gRNA
acacgggcgucuccagcgag

SEQ ID NO: 109360 - RNA, 20 nt, Artificial Sequence
  MKO10109360_B_Pomgnt1
  gRNA
cacucggagagcaaucagcg

SEQ ID NO: 109361 - RNA, 20 nt, Artificial Sequence
  MKO10109361_B_Pomgnt1
  gRNA
aacggagcugguaccuuacc

SEQ ID NO: 109362 - RNA, 20 nt, Artificial Sequence
  MKO10109362_B_Pomgnt1
  gRNA
ccguuucuuccuagccccaa

SEQ ID NO: 109363 - RNA, 20 nt, Artificial Sequence
  MKO10109363_B_Pomgnt2
  gRNA
ucaugaagcgcgugaacugc

SEQ ID NO: 109364 - RNA, 20 nt, Artificial Sequence
  MKO10109364_B_Pomgnt2
  gRNA
gggcguugaauacggcagag

SEQ ID NO: 109365 - RNA, 20 nt, Artificial Sequence
  MKO10109365_B_Pomgnt2
  gRNA
ggguccgcuguauauuuaac

SEQ ID NO: 109366 - RNA, 20 nt, Artificial Sequence
  MKO10109366_B_Pomk
  gRNA
ucuggcucuugcacgccuua

SEQ ID NO: 109367 - RNA, 20 nt, Artificial Sequence
  MKO10109367_B_Pomk
  gRNA
gguagagcgccacguucaua

SEQ ID NO: 109368 - RNA, 20 nt, Artificial Sequence
  MKO10109368_B_Pomk
  gRNA
gcacguggaagggagugaua

SEQ ID NO: 109369 - RNA, 20 nt, Artificial Sequence
  MKO10109369_B_Pomp
  gRNA
acccuggauguuccucagcg

SEQ ID NO: 109370 - RNA, 20 nt, Artificial Sequence
  MKO10109370_B_Pomp
  gRNA
agcucgggagaaacgggaga

SEQ ID NO: 109371 - RNA, 20 nt, Artificial Sequence
  MKO10109371_B_Pomp
  gRNA
aggggcaacgaugagaccau

SEQ ID NO: 109372 - RNA, 20 nt, Artificial Sequence
  MKO10109372_B_Pomt1
  gRNA
gauucgaugguaacuuucug

SEQ ID NO: 109373 - RNA, 20 nt, Artificial Sequence
  MKO10109373_B_Pomt1
  gRNA
gaagaugcgcuucauguaga

SEQ ID NO: 109374 - RNA, 20 nt, Artificial Sequence
  MKO10109374_B_Pomt1
  gRNA
accauuuggccacaugcuac

SEQ ID NO: 109375 - RNA, 20 nt, Artificial Sequence
  MKO10109375_B_Pomt2
  gRNA
cagaugcugaucggucuugc

SEQ ID NO: 109376 - RNA, 20 nt, Artificial Sequence
  MKO10109376_B_Pomt2
  gRNA
aguugggaugagacucacuu

SEQ ID NO: 109377 - RNA, 20 nt, Artificial Sequence
  MKO10109377_B_Pomt2
  gRNA
ggacuuggacagauccagua

SEQ ID NO: 109378 - RNA, 20 nt, Artificial Sequence
  MKO10109378_B_Pon1
  gRNA
ccuuuaacuaaauuacaguu

SEQ ID NO: 109379 - RNA, 20 nt, Artificial Sequence
  MKO10109379_B_Pon1
  gRNA
cuaaagaaaguuaguccauu

SEQ ID NO: 109380 - RNA, 20 nt, Artificial Sequence
  MKO10109380_B_Pon1
  gRNA
cuggaugguuuaccaccagu

SEQ ID NO: 109381 - RNA, 20 nt, Artificial Sequence
  MKO10109381_B_Pon2
  gRNA
uuaaacacgagcuccuucca

SEQ ID NO: 109382 - RNA, 20 nt, Artificial Sequence
  MKO10109382_B_Pon2
  gRNA
ccaaacugccaccucauuaa

SEQ ID NO: 109383 - RNA, 20 nt, Artificial Sequence
  MKO10109383_B_Pon2
  gRNA
uccacuguacucuugaauug

SEQ ID NO: 109384 - RNA, 20 nt, Artificial Sequence
  MKO10109384_B_Pon3
  gRNA
gagauaaaagccagcccgcu

SEQ ID NO: 109385 - RNA, 20 nt, Artificial Sequence
  MKO10109385_B_Pon3
  gRNA
uaguacaacucgagaaauaa

SEQ ID NO: 109386 - RNA, 20 nt, Artificial Sequence
  MKO10109386_B_Pon3
  gRNA
ugucgugaaucaccccaaca

SEQ ID NO: 109387 - RNA, 20 nt, Artificial Sequence
  MKO10109387_B_Pop1
  gRNA
gagauccccaaguauauaac

SEQ ID NO: 109388 - RNA, 20 nt, Artificial Sequence
  MKO10109388_B_Pop1
  gRNA
ccagaagucaucuaacucac

SEQ ID NO: 109389 - RNA, 20 nt, Artificial Sequence
  MKO10109389_B_Pop1
  gRNA
cuucaccauaugaaaccguu

SEQ ID NO: 109390 - RNA, 20 nt, Artificial Sequence
  MKO10109390_B_Pop4
  gRNA
uacauccgggaccugugcaa

SEQ ID NO: 109391 - RNA, 20 nt, Artificial Sequence
  MKO10109391_B_Pop4
  gRNA
agcuuggccugaaucaucug

SEQ ID NO: 109392 - RNA, 20 nt, Artificial Sequence
  MKO10109392_B_Pop4
  gRNA
uaggcagccacagaugauuc

SEQ ID NO: 109393 - RNA, 20 nt, Artificial Sequence
  MKO10109393_B_Pop5
  gRNA
caguagcacgacuccagugu

SEQ ID NO: 109394 - RNA, 20 nt, Artificial Sequence
  MKO10109394_B_Pop5
  gRNA
aguuccugauccaguacaac

SEQ ID NO: 109395 - RNA, 20 nt, Artificial Sequence
  MKO10109395_B_Pop5
  gRNA
uugcagaauugcacugacga

SEQ ID NO: 109396 - RNA, 20 nt, Artificial Sequence
  MKO10109396_B_Pop7
  gRNA
gauguugauggcccgguuga

SEQ ID NO: 109397 - RNA, 20 nt, Artificial Sequence
  MKO10109397_B_Pop7
  gRNA
aggguccagcucagccucga

SEQ ID NO: 109398 - RNA, 20 nt, Artificial Sequence
  MKO10109398_B_Pop7
  gRNA
gcccccuagugccuccgucc

SEQ ID NO: 109399 - RNA, 20 nt, Artificial Sequence
  MKO10109399_B_Popdc2
  gRNA
guggacuagacaucguccuu

SEQ ID NO: 109400 - RNA, 20 nt, Artificial Sequence
  MKO10109400_B_Popdc2
  gRNA
uggaagguccccucuucaga

SEQ ID NO: 109401 - RNA, 20 nt, Artificial Sequence
  MKO10109401_B_Popdc2
  gRNA
aggguucgagugagccaaga

SEQ ID NO: 109402 - RNA, 20 nt, Artificial Sequence
  MKO10109402_B_Popdc3
  gRNA
ugccaauuaaaaccgaaaac

SEQ ID NO: 109403 - RNA, 20 nt, Artificial Sequence
  MKO10109403_B_Popdc3
  gRNA
accuacuacaaacaagauac

SEQ ID NO: 109404 - RNA, 20 nt, Artificial Sequence
  MKO10109404_B_Popdc3
  gRNA
agaaucagagugacagucga

SEQ ID NO: 109405 - RNA, 20 nt, Artificial Sequence
  MKO10109405_B_Porcn
  gRNA
auccuuccacagcuaccuac

SEQ ID NO: 109406 - RNA, 20 nt, Artificial Sequence
  MKO10109406_B_Porcn
  gRNA
ccugaagcaugcaagcaccg

SEQ ID NO: 109407 - RNA, 20 nt, Artificial Sequence
  MKO10109407_B_Porcn
  gRNA
ucgcaucuugugccauguca

SEQ ID NO: 109408 - RNA, 20 nt, Artificial Sequence
  MKO10109408_B_Por
  gRNA
acuccuccgcgguucccguc

SEQ ID NO: 109409 - RNA, 20 nt, Artificial Sequence
  MKO10109409_B_Por
  gRNA
cuaugagcacuucaacgcca

SEQ ID NO: 109410 - RNA, 20 nt, Artificial Sequence
  MKO10109410_B_Por
  gRNA
acuucccgucgucaucacca

SEQ ID NO: 109411 - RNA, 20 nt, Artificial Sequence
  MKO10109411_B_Postn
  gRNA
uccuggcucacagccgcauc

SEQ ID NO: 109412 - RNA, 20 nt, Artificial Sequence
  MKO10109412_B_Postn
  gRNA
cugugcccuccagcaaauuc

SEQ ID NO: 109413 - RNA, 20 nt, Artificial Sequence
  MKO10109413_B_Postn
  gRNA
ccuuccauucucauauagcc

SEQ ID NO: 109414 - RNA, 20 nt, Artificial Sequence
  MKO10109414_B_Pot1a
  gRNA
ugaagacgccgagaugugcu

SEQ ID NO: 109415 - RNA, 20 nt, Artificial Sequence
  MKO10109415_B_Pot1a
  gRNA
uacaccccugaaucuacuca

SEQ ID NO: 109416 - RNA, 20 nt, Artificial Sequence
  MKO10109416_B_Pot1a
  gRNA
agugaagcuaaaaacuuugc

SEQ ID NO: 109417 - RNA, 20 nt, Artificial Sequence
  MKO10109417_B_Pot1b
  gRNA
guguauguagaaggugcuac

SEQ ID NO: 109418 - RNA, 20 nt, Artificial Sequence
  MKO10109418_B_Pot1b
  gRNA
uugcucuguugucacgauug

SEQ ID NO: 109419 - RNA, 20 nt, Artificial Sequence
  MKO10109419_B_Pot1b
  gRNA
gucuccaacuuuauaaacgc

SEQ ID NO: 109420 - RNA, 20 nt, Artificial Sequence
  MKO10109420_B_Poteg
  gRNA
ugguagccggccauagacac

SEQ ID NO: 109421 - RNA, 20 nt, Artificial Sequence
  MKO10109421_B_Poteg
  gRNA
acaucuuauagcguauauca

SEQ ID NO: 109422 - RNA, 20 nt, Artificial Sequence
  MKO10109422_B_Poteg
  gRNA
ccauaccacaccucugauga

SEQ ID NO: 109423 - RNA, 20 nt, Artificial Sequence
  MKO10109423_B_Pou1f1
  gRNA
gccauccaccuauggaguga

SEQ ID NO: 109424 - RNA, 20 nt, Artificial Sequence
  MKO10109424_B_Pou1f1
  gRNA
cuuaccugccaucacuccau

SEQ ID NO: 109425 - RNA, 20 nt, Artificial Sequence
  MKO10109425_B_Pou1f1
  gRNA
aggauacacccagacaaacg

SEQ ID NO: 109426 - RNA, 20 nt, Artificial Sequence
  MKO10109426_B_Pou2af1
  gRNA
uacuccguguagggugucca

SEQ ID NO: 109427 - RNA, 20 nt, Artificial Sequence
  MKO10109427_B_Pou2af1
  gRNA
gcuggagggucccgagcacc

SEQ ID NO: 109428 - RNA, 20 nt, Artificial Sequence
  MKO10109428_B_Pou2af1
  gRNA
agggaacauuaugugcuggc

SEQ ID NO: 109429 - RNA, 20 nt, Artificial Sequence
  MKO10109429_B_Pou2f1
  gRNA
guaaacuugucccagcuagc

SEQ ID NO: 109430 - RNA, 20 nt, Artificial Sequence
  MKO10109430_B_Pou2f1
  gRNA
uccccagacccagcuaaugc

SEQ ID NO: 109431 - RNA, 20 nt, Artificial Sequence
  MKO10109431_B_Pou2f1
  gRNA
acucuccauagaugauuuau

SEQ ID NO: 109432 - RNA, 20 nt, Artificial Sequence
  MKO10109432_B_Pou2f2
  gRNA
cuuaccuggagcccccaugc

SEQ ID NO: 109433 - RNA, 20 nt, Artificial Sequence
  MKO10109433_B_Pou2f2
  gRNA
uuuacagacaccgaaagaaa

SEQ ID NO: 109434 - RNA, 20 nt, Artificial Sequence
  MKO10109434_B_Pou2f2
  gRNA
cgcucaccugugugcucuga

SEQ ID NO: 109435 - RNA, 20 nt, Artificial Sequence
  MKO10109435_B_Pou2f3
  gRNA
gauacagacugcaaguggcc

SEQ ID NO: 109436 - RNA, 20 nt, Artificial Sequence
  MKO10109436_B_Pou2f3
  gRNA
uuaccugucuguugaaaucu

SEQ ID NO: 109437 - RNA, 20 nt, Artificial Sequence
  MKO10109437_B_Pou2f3
  gRNA
uccacuccagcagcucgugc

SEQ ID NO: 109438 - RNA, 20 nt, Artificial Sequence
  MKO10109438_B_Pou3f1
  gRNA
gcgagaacacguuaccguag

SEQ ID NO: 109439 - RNA, 20 nt, Artificial Sequence
  MKO10109439_B_Pou3f1
  gRNA
ccugcgccgcgaucuugucc

SEQ ID NO: 109440 - RNA, 20 nt, Artificial Sequence
  MKO10109440_B_Pou3f1
  gRNA
uacgcucaggcggccuaccc

SEQ ID NO: 109441 - RNA, 20 nt, Artificial Sequence
  MKO10109441_B_Pou3f2
  gRNA
cggcucggcauguacgaugg

SEQ ID NO: 109442 - RNA, 20 nt, Artificial Sequence
  MKO10109442_B_Pou3f2
  gRNA
cggauuuacucaagcagacg

SEQ ID NO: 109443 - RNA, 20 nt, Artificial Sequence
  MKO10109443_B_Pou3f2
  gRNA
gcgagaacacguugccguac

SEQ ID NO: 109444 - RNA, 20 nt, Artificial Sequence
  MKO10109444_B_Pou3f3
  gRNA
gggaagcgccgccgugaccu

SEQ ID NO: 109445 - RNA, 20 nt, Artificial Sequence
  MKO10109445_B_Pou3f3
  gRNA
gcagcgcgguaccggcgugc

SEQ ID NO: 109446 - RNA, 20 nt, Artificial Sequence
  MKO10109446_B_Pou3f3
  gRNA
cagcauauggccgccguugc

SEQ ID NO: 109447 - RNA, 20 nt, Artificial Sequence
  MKO10109447_B_Pou3f4
  gRNA
cuacgugcggcgagcgguga

SEQ ID NO: 109448 - RNA, 20 nt, Artificial Sequence
  MKO10109448_B_Pou3f4
  gRNA
gggcucgcuccccaggcguu

SEQ ID NO: 109449 - RNA, 20 nt, Artificial Sequence
  MKO10109449_B_Pou3f4
  gRNA
cucaauguguacucgcagcc

SEQ ID NO: 109450 - RNA, 20 nt, Artificial Sequence
  MKO10109450_B_Pou4f1
  gRNA
ggggcgcuuaccggcggcgu

SEQ ID NO: 109451 - RNA, 20 nt, Artificial Sequence
  MKO10109451_B_Pou4f1
  gRNA
gucgccgucgcucgcgcuca

SEQ ID NO: 109452 - RNA, 20 nt, Artificial Sequence
  MKO10109452_B_Pou4f1
  gRNA
ccgagucgcagauggacgcc

SEQ ID NO: 109453 - RNA, 20 nt, Artificial Sequence
  MKO10109453_B_Pou4f2
  gRNA
acuguguagcgccgaguacu

SEQ ID NO: 109454 - RNA, 20 nt, Artificial Sequence
  MKO10109454_B_Pou4f2
  gRNA
gcgcaagcgcacguccaucg

SEQ ID NO: 109455 - RNA, 20 nt, Artificial Sequence
  MKO10109455_B_Pou4f2
  gRNA
gaacaccaucccgugcacgu

SEQ ID NO: 109456 - RNA, 20 nt, Artificial Sequence
  MKO10109456_B_Pou4f3
  gRNA
ccgcuacguaccugcggggc

SEQ ID NO: 109457 - RNA, 20 nt, Artificial Sequence
  MKO10109457_B_Pou4f3
  gRNA
cgaacgcuuccagcucucga

SEQ ID NO: 109458 - RNA, 20 nt, Artificial Sequence
  MKO10109458_B_Pou4f3
  gRNA
caccucgcacccgcaucacg

SEQ ID NO: 109459 - RNA, 20 nt, Artificial Sequence
  MKO10109459_B_Pou5f1
  gRNA
acccaccaaagagaacgccc

SEQ ID NO: 109460 - RNA, 20 nt, Artificial Sequence
  MKO10109460_B_Pou5f1
  gRNA
uagccucauacucuucucgu

SEQ ID NO: 109461 - RNA, 20 nt, Artificial Sequence
  MKO10109461_B_Pou5f1
  gRNA
gaccaccaucugucgcuucg

SEQ ID NO: 109462 - RNA, 20 nt, Artificial Sequence
  MKO10109462_B_Pou5f2
  gRNA
uccucaccuuaugaauuccg

SEQ ID NO: 109463 - RNA, 20 nt, Artificial Sequence
  MKO10109463_B_Pou5f2
  gRNA
ucccacagcgaaucccacau

SEQ ID NO: 109464 - RNA, 20 nt, Artificial Sequence
  MKO10109464_B_Pou5f2
  gRNA
gacaaaagggcuccucguac

SEQ ID NO: 109465 - RNA, 20 nt, Artificial Sequence
  MKO10109465_B_Pou6f1
  gRNA
gggcuggugaggauuacugc

SEQ ID NO: 109466 - RNA, 20 nt, Artificial Sequence
  MKO10109466_B_Pou6f1
  gRNA
aucccguccucauccagacu

SEQ ID NO: 109467 - RNA, 20 nt, Artificial Sequence
  MKO10109467_B_Pou6f1
  gRNA
agguuauuggagcacuuccg

SEQ ID NO: 109468 - RNA, 20 nt, Artificial Sequence
  MKO10109468_B_Pou6f2
  gRNA
cgaugacgguggcaaugauu

SEQ ID NO: 109469 - RNA, 20 nt, Artificial Sequence
  MKO10109469_B_Pou6f2
  gRNA
ccacuugcugcuugacucga

SEQ ID NO: 109470 - RNA, 20 nt, Artificial Sequence
  MKO10109470_B_Pou6f2
  gRNA
uaauaauccucuagcaagcc

SEQ ID NO: 109471 - RNA, 20 nt, Artificial Sequence
  MKO10109471_B_Pp2d1
  gRNA
cauaacagugaugcugucuc

SEQ ID NO: 109472 - RNA, 20 nt, Artificial Sequence
  MKO10109472_B_Pp2d1
  gRNA
aacuguauucuucuccuuua

SEQ ID NO: 109473 - RNA, 20 nt, Artificial Sequence
  MKO10109473_B_Pp2d1
  gRNA
agcagccgcuccagcgaacc

SEQ ID NO: 109474 - RNA, 20 nt, Artificial Sequence
  MKO10109474_B_Ppa1
  gRNA
ccaaucgauguuugugaaau

SEQ ID NO: 109475 - RNA, 20 nt, Artificial Sequence
  MKO10109475_B_Ppa1
  gRNA
guggaaccucaaccaccaug

SEQ ID NO: 109476 - RNA, 20 nt, Artificial Sequence
  MKO10109476_B_Ppa1
  gRNA
uuccaaauauacccuuuaua

SEQ ID NO: 109477 - RNA, 20 nt, Artificial Sequence
  MKO10109477_B_Ppa2
  gRNA
ucgguggacaaaugccaaga

SEQ ID NO: 109478 - RNA, 20 nt, Artificial Sequence
  MKO10109478_B_Ppa2
  gRNA
uuuccacgacauuccucuga

SEQ ID NO: 109479 - RNA, 20 nt, Artificial Sequence
  MKO10109479_B_Ppa2
  gRNA
ucuuuacaguccgccuucag

SEQ ID NO: 109480 - RNA, 20 nt, Artificial Sequence
  MKO10109480_B_Ppan
  gRNA
gcccaccgugugcacguuga

SEQ ID NO: 109481 - RNA, 20 nt, Artificial Sequence
  MKO10109481_B_Ppan
  gRNA
ucgaaagaagaacucccuga

SEQ ID NO: 109482 - RNA, 20 nt, Artificial Sequence
  MKO10109482_B_Ppan
  gRNA
uaaggaagugugugaccccc

SEQ ID NO: 109483 - RNA, 20 nt, Artificial Sequence
  MKO10109483_B_Ppap2a
  gRNA
caguuugcggccgcacuucu

SEQ ID NO: 109484 - RNA, 20 nt, Artificial Sequence
  MKO10109484_B_Ppap2a
  gRNA
uuacgacccaugcuccaguu

SEQ ID NO: 109485 - RNA, 20 nt, Artificial Sequence
  MKO10109485_B_Ppap2a
  gRNA
cgucacaguuggacucauuc

SEQ ID NO: 109486 - RNA, 20 nt, Artificial Sequence
  MKO10109486_B_Ppap2b
  gRNA
gcaucauccuagcgaugucc

SEQ ID NO: 109487 - RNA, 20 nt, Artificial Sequence
  MKO10109487_B_Ppap2b
  gRNA
caggcgcccgauggacacuu

SEQ ID NO: 109488 - RNA, 20 nt, Artificial Sequence
  MKO10109488_B_Ppap2b
  gRNA
ccgugacaaucccguguaga

SEQ ID NO: 109489 - RNA, 20 nt, Artificial Sequence
  MKO10109489_B_Ppap2c
  gRNA
aaagacggucuguguacacc

SEQ ID NO: 109490 - RNA, 20 nt, Artificial Sequence
  MKO10109490_B_Ppap2c
  gRNA
auagcccacauagauugcaa

SEQ ID NO: 109491 - RNA, 20 nt, Artificial Sequence
  MKO10109491_B_Ppap2c
  gRNA
cauguauugcauguuguucc

SEQ ID NO: 109492 - RNA, 20 nt, Artificial Sequence
  MKO10109492_B_Ppapdc1a
  gRNA
uuucagucuugucuguccgc

SEQ ID NO: 109493 - RNA, 20 nt, Artificial Sequence
  MKO10109493_B_Ppapdc1a
  gRNA
auuccagagagucauccagc

SEQ ID NO: 109494 - RNA, 20 nt, Artificial Sequence
  MKO10109494_B_Ppapdc1a
  gRNA
auguugucugacugcaccaa

SEQ ID NO: 109495 - RNA, 20 nt, Artificial Sequence
  MKO10109495_B_Ppapdc1b
  gRNA
ccgugcacgucagaucagaa

SEQ ID NO: 109496 - RNA, 20 nt, Artificial Sequence
  MKO10109496_B_Ppapdc1b
  gRNA
cacuaucaguuugauuaugu

SEQ ID NO: 109497 - RNA, 20 nt, Artificial Sequence
  MKO10109497_B_Ppapdc1b
  gRNA
agccuugcccuagcucugaa

SEQ ID NO: 109498 - RNA, 20 nt, Artificial Sequence
  MKO10109498_B_Ppapdc2
  gRNA
gcgccggugcaccgggcugu

SEQ ID NO: 109499 - RNA, 20 nt, Artificial Sequence
  MKO10109499_B_Ppapdc2
  gRNA
uucccucgggccacgccacg

SEQ ID NO: 109500 - RNA, 20 nt, Artificial Sequence
  MKO10109500_B_Ppapdc2
  gRNA
cguccgacagcccggugcac

SEQ ID NO: 109501 - RNA, 20 nt, Artificial Sequence
  MKO10109501_B_Ppapdc3
  gRNA
cgcggcgcuugaugagcuuc

SEQ ID NO: 109502 - RNA, 20 nt, Artificial Sequence
  MKO10109502_B_Ppapdc3
  gRNA
cacauuacagacgucaucuc

SEQ ID NO: 109503 - RNA, 20 nt, Artificial Sequence
  MKO10109503_B_Ppapdc3
  gRNA
ccacgccagccgugccgcca

SEQ ID NO: 109504 - RNA, 20 nt, Artificial Sequence
  MKO10109504_B_Ppara
  gRNA
augcugaucgcguacggcaa

SEQ ID NO: 109505 - RNA, 20 nt, Artificial Sequence
  MKO10109505_B_Ppara
  gRNA
cucuuugucuucgacgccgu

SEQ ID NO: 109506 - RNA, 20 nt, Artificial Sequence
  MKO10109506_B_Ppara
  gRNA
ucuuucccgcgaguaugacc

SEQ ID NO: 109507 - RNA, 20 nt, Artificial Sequence
  MKO10109507_B_Ppard
  gRNA
ccuugcaccccucgcacgcg

SEQ ID NO: 109508 - RNA, 20 nt, Artificial Sequence
  MKO10109508_B_Ppard
  gRNA
cagcccgucuuuguugacga

SEQ ID NO: 109509 - RNA, 20 nt, Artificial Sequence
  MKO10109509_B_Ppard
  gRNA
cuacgggguccacgcgugcg

SEQ ID NO: 109510 - RNA, 20 nt, Artificial Sequence
  MKO10109510_B_Ppargc1a
  gRNA
agccgugaccacugacaacg

SEQ ID NO: 109511 - RNA, 20 nt, Artificial Sequence
  MKO10109511_B_Ppargc1a
  gRNA
gugaggagggucaucguuug

SEQ ID NO: 109512 - RNA, 20 nt, Artificial Sequence
  MKO10109512_B_Ppargc1a
  gRNA
ccuugagcauguugcgacug

SEQ ID NO: 109513 - RNA, 20 nt, Artificial Sequence
  MKO10109513_B_Ppargc1b
  gRNA
ugacauccccgaagacgaug

SEQ ID NO: 109514 - RNA, 20 nt, Artificial Sequence
  MKO10109514_B_Ppargc1b
  gRNA
ugcggaaauaccuugacaca

SEQ ID NO: 109515 - RNA, 20 nt, Artificial Sequence
  MKO10109515_B_Ppargc1b
  gRNA
caaagucacuggcguccagc

SEQ ID NO: 109516 - RNA, 20 nt, Artificial Sequence
  MKO10109516_B_Pparg
  gRNA
ccauugagugccgagucugu

SEQ ID NO: 109517 - RNA, 20 nt, Artificial Sequence
  MKO10109517_B_Pparg
  gRNA
uauuuguaaucagcaaccau

SEQ ID NO: 109518 - RNA, 20 nt, Artificial Sequence
  MKO10109518_B_Pparg
  gRNA
agaaccuucuaacucccuca

SEQ ID NO: 109519 - RNA, 20 nt, Artificial Sequence
  MKO10109519_B_Ppau
  gRNA
agcgcccgcagcauacuccc

SEQ ID NO: 109520 - RNA, 20 nt, Artificial Sequence
  MKO10109520_B_Ppau
  gRNA
ggagugcagugccuaaauuc

SEQ ID NO: 109521 - RNA, 20 nt, Artificial Sequence
  MKO10109521_B_Ppau
  gRNA
gguaaucauuucacuaucag

SEQ ID NO: 109522 - RNA, 20 nt, Artificial Sequence
  MKO10109522_B_Ppbp
  gRNA
gaccuacaucguccugcacc

SEQ ID NO: 109523 - RNA, 20 nt, Artificial Sequence
  MKO10109523_B_Ppbp
  gRNA
agauguacgaauaccaucuc

SEQ ID NO: 109524 - RNA, 20 nt, Artificial Sequence
  MKO10109524_B_Ppbp
  gRNA
gagaaucgucaugaaaaucu

SEQ ID NO: 109525 - RNA, 20 nt, Artificial Sequence
  MKO10109525_B_Ppcdc
  gRNA
gcauccucucaccgcacagc

SEQ ID NO: 109526 - RNA, 20 nt, Artificial Sequence
  MKO10109526_B_Ppcdc
  gRNA
auucaucagcgucacuguag

SEQ ID NO: 109527 - RNA, 20 nt, Artificial Sequence
  MKO10109527_B_Ppcdc
  gRNA
ucuacagugacgcugaugaa

SEQ ID NO: 109528 - RNA, 20 nt, Artificial Sequence
  MKO10109528_B_Ppcs
  gRNA
agcccagucuuugaccagag

SEQ ID NO: 109529 - RNA, 20 nt, Artificial Sequence
  MKO10109529_B_Ppcs
  gRNA
auagaaaucugacacugccg

SEQ ID NO: 109530 - RNA, 20 nt, Artificial Sequence
  MKO10109530_B_Ppcs
  gRNA
gcagugggccaccagaugag

SEQ ID NO: 109531 - RNA, 20 nt, Artificial Sequence
  MKO10109531_B_Ppdpf
  gRNA
aggucuucccaaagccgacc

SEQ ID NO: 109532 - RNA, 20 nt, Artificial Sequence
  MKO10109532_B_Ppdpf
  gRNA
auggcagccaucccuuccag

SEQ ID NO: 109533 - RNA, 20 nt, Artificial Sequence
  MKO10109533_B_Ppdpf
  gRNA
uccucguccagcagcagcuc

SEQ ID NO: 109534 - RNA, 20 nt, Artificial Sequence
  MKO10109534_B_Ppef1
  gRNA
uggaugucaguaaacgucag

SEQ ID NO: 109535 - RNA, 20 nt, Artificial Sequence
  MKO10109535_B_Ppef1
  gRNA
cugcagccgaggaccaucau

SEQ ID NO: 109536 - RNA, 20 nt, Artificial Sequence
  MKO10109536_B_Ppef1
  gRNA
gccaaagagauaacaauaug

SEQ ID NO: 109537 - RNA, 20 nt, Artificial Sequence
  MKO10109537_B_Ppef2
  gRNA
aucucucuucggugaacaug

SEQ ID NO: 109538 - RNA, 20 nt, Artificial Sequence
  MKO10109538_B_Ppef2
  gRNA
cucgguugauguugggcagc

SEQ ID NO: 109539 - RNA, 20 nt, Artificial Sequence
  MKO10109539_B_Ppef2
  gRNA
cccugauccagagaugguac

SEQ ID NO: 109540 - RNA, 20 nt, Artificial Sequence
  MKO10109540_B_Ppfia1
  gRNA
gcucaauacugcacuuccac

SEQ ID NO: 109541 - RNA, 20 nt, Artificial Sequence
  MKO10109541_B_Ppfia1
  gRNA
caggggaaguugcaugaagu

SEQ ID NO: 109542 - RNA, 20 nt, Artificial Sequence
  MKO10109542_B_Ppfia1
  gRNA
gguguucaaacagugacuuc

SEQ ID NO: 109543 - RNA, 20 nt, Artificial Sequence
  MKO10109543_B_Ppfia2
  gRNA
ggaacuagcugcagcuaauc

SEQ ID NO: 109544 - RNA, 20 nt, Artificial Sequence
  MKO10109544_B_Ppfia2
  gRNA
ucuagguaagggagcgacug

SEQ ID NO: 109545 - RNA, 20 nt, Artificial Sequence
  MKO10109545_B_Ppfia2
  gRNA
aaccagucagcccuccuguu

SEQ ID NO: 109546 - RNA, 20 nt, Artificial Sequence
  MKO10109546_B_Ppfia3
  gRNA
cugaccgccuucuagauagc

SEQ ID NO: 109547 - RNA, 20 nt, Artificial Sequence
  MKO10109547_B_Ppfia3
  gRNA
cuuaugucgggaacagcuuc

SEQ ID NO: 109548 - RNA, 20 nt, Artificial Sequence
  MKO10109548_B_Ppfia3
  gRNA
ggaguuugcggcucugacga

SEQ ID NO: 109549 - RNA, 20 nt, Artificial Sequence
  MKO10109549_B_Ppfia4
  gRNA
cccacuuuccacaggcguuu

SEQ ID NO: 109550 - RNA, 20 nt, Artificial Sequence
  MKO10109550_B_Ppfia4
  gRNA
gcuuagcucccgaguuaaag

SEQ ID NO: 109551 - RNA, 20 nt, Artificial Sequence
  MKO10109551_B_Ppfia4
  gRNA
uaacgcgcucuagagcugcc

SEQ ID NO: 109552 - RNA, 20 nt, Artificial Sequence
  MKO10109552_B_Ppfibp1
  gRNA
guccaucugcuccagcgccg

SEQ ID NO: 109553 - RNA, 20 nt, Artificial Sequence
  MKO10109553_B_Ppfibp1
  gRNA
uaccacuugccugaagaacg

SEQ ID NO: 109554 - RNA, 20 nt, Artificial Sequence
  MKO10109554_B_Ppfibp1
  gRNA
gagugacgcuagugacaugc

SEQ ID NO: 109555 - RNA, 20 nt, Artificial Sequence
  MKO10109555_B_Ppfibp2
  gRNA
augacuagcgucagaaguca

SEQ ID NO: 109556 - RNA, 20 nt, Artificial Sequence
  MKO10109556_B_Ppfibp2
  gRNA
uagcuguugggccagggacc

SEQ ID NO: 109557 - RNA, 20 nt, Artificial Sequence
  MKO10109557_B_Ppfibp2
  gRNA
gagcguccucacagaucaag

SEQ ID NO: 109558 - RNA, 20 nt, Artificial Sequence
  MKO10109558_B_Pphln1
  gRNA
gacuuacacugggauggcuc

SEQ ID NO: 109559 - RNA, 20 nt, Artificial Sequence
  MKO10109559_B_Pphln1
  gRNA
cuuaccuguagucaggcugc

SEQ ID NO: 109560 - RNA, 20 nt, Artificial Sequence
  MKO10109560_B_Pphln1
  gRNA
gcuauucuccagagcgaagc

SEQ ID NO: 109561 - RNA, 20 nt, Artificial Sequence
  MKO10109561_B_Ppia
  gRNA
caggcuggauggcaagcaug

SEQ ID NO: 109562 - RNA, 20 nt, Artificial Sequence
  MKO10109562_B_Ppia
  gRNA
gacaaaguuccaaagacagc

SEQ ID NO: 109563 - RNA, 20 nt, Artificial Sequence
  MKO10109563_B_Ppia
  gRNA
aacuuucgagcucugagcac

SEQ ID NO: 109564 - RNA, 20 nt, Artificial Sequence
  MKO10109564_B_Ppib
  gRNA
uuucuccacuucgaucuugc

SEQ ID NO: 109565 - RNA, 20 nt, Artificial Sequence
  MKO10109565_B_Ppib
  gRNA
ugaaguccuugaugacacga

SEQ ID NO: 109566 - RNA, 20 nt, Artificial Sequence
  MKO10109566_B_Ppib
  gRNA
caaguuccaucgugucauca

SEQ ID NO: 109567 - RNA, 20 nt, Artificial Sequence
  MKO10109567_B_Ppic
  gRNA
cgccauuucugucaccaauc

SEQ ID NO: 109568 - RNA, 20 nt, Artificial Sequence
  MKO10109568_B_Ppic
  gRNA
caucucuuuagaaaggcuac

SEQ ID NO: 109569 - RNA, 20 nt, Artificial Sequence
  MKO10109569_B_Ppic
  gRNA
gauggcaaacacguuguauu

SEQ ID NO: 109570 - RNA, 20 nt, Artificial Sequence
  MKO10109570_B_Ppid
  gRNA
cagucauccagacuucccug

SEQ ID NO: 109571 - RNA, 20 nt, Artificial Sequence
  MKO10109571_B_Ppid
  gRNA
caaacaauucuaaaacaauu

SEQ ID NO: 109572 - RNA, 20 nt, Artificial Sequence
  MKO10109572_B_Ppid
  gRNA
aucuuccccaaagauggcuc

SEQ ID NO: 109573 - RNA, 20 nt, Artificial Sequence
  MKO10109573_B_Ppie
  gRNA
gagcccucuuuaauucucau

SEQ ID NO: 109574 - RNA, 20 nt, Artificial Sequence
  MKO10109574_B_Ppie
  gRNA
ccaccuguuucauaguccag

SEQ ID NO: 109575 - RNA, 20 nt, Artificial Sequence
  MKO10109575_B_Ppie
  gRNA
acucaacaaaagcaaacccu

SEQ ID NO: 109576 - RNA, 20 nt, Artificial Sequence
  MKO10109576_B_Ppif
  gRNA
ucugcacgauaaagacagac

SEQ ID NO: 109577 - RNA, 20 nt, Artificial Sequence
  MKO10109577_B_Ppif
  gRNA
cuucagugugaaguucucgu

SEQ ID NO: 109578 - RNA, 20 nt, Artificial Sequence
  MKO10109578_B_Ppif
  gRNA
aacuucagagcccuaugcac

SEQ ID NO: 109579 - RNA, 20 nt, Artificial Sequence
  MKO10109579_B_Ppig
  gRNA
aacuuucgcugccuuugcac

SEQ ID NO: 109580 - RNA, 20 nt, Artificial Sequence
  MKO10109580_B_Ppig
  gRNA
ucauaacuagggaauggaag

SEQ ID NO: 109581 - RNA, 20 nt, Artificial Sequence
  MKO10109581_B_Ppig
  gRNA
auuuguauccuucccucugu

SEQ ID NO: 109582 - RNA, 20 nt, Artificial Sequence
  MKO10109582_B_Ppih
  gRNA
cugacaucgaagaagaccac

SEQ ID NO: 109583 - RNA, 20 nt, Artificial Sequence
  MKO10109583_B_Ppih
  gRNA
aaucgagcucuuugcagacg

SEQ ID NO: 109584 - RNA, 20 nt, Artificial Sequence
  MKO10109584_B_Ppih
  gRNA
cuaaaguucucugccgucuu

SEQ ID NO: 109585 - RNA, 20 nt, Artificial Sequence
  MKO10109585_B_Ppil1
  gRNA
auccaaggcggcgacccgac

SEQ ID NO: 109586 - RNA, 20 nt, Artificial Sequence
  MKO10109586_B_Ppil1
  gRNA
gcucggcggggcuacuacaa

SEQ ID NO: 109587 - RNA, 20 nt, Artificial Sequence
  MKO10109587_B_Ppil1
  gRNA
cggcgauucccccagacacc

SEQ ID NO: 109588 - RNA, 20 nt, Artificial Sequence
  MKO10109588_B_Ppil2
  gRNA
uaugggacgaaucccagcac

SEQ ID NO: 109589 - RNA, 20 nt, Artificial Sequence
  MKO10109589_B_Ppil2
  gRNA
gcugaguacacucauuucua

SEQ ID NO: 109590 - RNA, 20 nt, Artificial Sequence
  MKO10109590_B_Ppil2
  gRNA
ucucaccugcaguggucaaa

SEQ ID NO: 109591 - RNA, 20 nt, Artificial Sequence
  MKO10109591_B_Ppil3
  gRNA
ugaauacagugaauaucuga

SEQ ID NO: 109592 - RNA, 20 nt, Artificial Sequence
  MKO10109592_B_Ppil3
  gRNA
gauacucaccucacauguuu

SEQ ID NO: 109593 - RNA, 20 nt, Artificial Sequence
  MKO10109593_B_Ppil3
  gRNA
gagaacacccaaaacaugug

SEQ ID NO: 109594 - RNA, 20 nt, Artificial Sequence
  MKO10109594_B_Ppil4
  gRNA
caaauauagacucuccuccg

SEQ ID NO: 109595 - RNA, 20 nt, Artificial Sequence
  MKO10109595_B_Ppil4
  gRNA
uccugaccugagacccgugc

SEQ ID NO: 109596 - RNA, 20 nt, Artificial Sequence
  MKO10109596_B_Ppil4
  gRNA
uugaagcagaaaaaguacca

SEQ ID NO: 109597 - RNA, 20 nt, Artificial Sequence
  MKO10109597_B_Ppil6
  gRNA
agucagcgccucauacagag

SEQ ID NO: 109598 - RNA, 20 nt, Artificial Sequence
  MKO10109598_B_Ppil6
  gRNA
uuucaucgaguaguucagaa

SEQ ID NO: 109599 - RNA, 20 nt, Artificial Sequence
  MKO10109599_B_Ppil6
  gRNA
ucaaaaaucagucuuccaau

SEQ ID NO: 109600 - RNA, 20 nt, Artificial Sequence
  MKO10109600_B_Ppip5k1
  gRNA
ugcaguauuacauccaagau

SEQ ID NO: 109601 - RNA, 20 nt, Artificial Sequence
  MKO10109601_B_Ppip5k1
  gRNA
ugcagagucgcucuagaauu

SEQ ID NO: 109602 - RNA, 20 nt, Artificial Sequence
  MKO10109602_B_Ppip5k1
  gRNA
augauaggagggagguguac

SEQ ID NO: 109603 - RNA, 20 nt, Artificial Sequence
  MKO10109603_B_Ppip5k2
  gRNA
cucugaccuuucggguuauu

SEQ ID NO: 109604 - RNA, 20 nt, Artificial Sequence
  MKO10109604_B_Ppip5k2
  gRNA
ugcaguaucucauacaagau

SEQ ID NO: 109605 - RNA, 20 nt, Artificial Sequence
  MKO10109605_B_Ppip5k2
  gRNA
caguugccuaugcaaaacuc

SEQ ID NO: 109606 - RNA, 20 nt, Artificial Sequence
  MKO10109606_B_Ppl
  gRNA
aaggaacauuguggacaccg

SEQ ID NO: 109607 - RNA, 20 nt, Artificial Sequence
  MKO10109607_B_Ppl
  gRNA
cugagucagacacguucugc

SEQ ID NO: 109608 - RNA, 20 nt, Artificial Sequence
  MKO10109608_B_Ppl
  gRNA
ggcacucacgcucugcaucu

SEQ ID NO: 109609 - RNA, 20 nt, Artificial Sequence
  MKO10109609_B_Ppm1a
  gRNA
cgcaucacguggacuaaguc

SEQ ID NO: 109610 - RNA, 20 nt, Artificial Sequence
  MKO10109610_B_Ppm1a
  gRNA
uccaagugcacccaaagucu

SEQ ID NO: 109611 - RNA, 20 nt, Artificial Sequence
  MKO10109611_B_Ppm1a
  gRNA
gaggcuggggauguucucac

SEQ ID NO: 109612 - RNA, 20 nt, Artificial Sequence
  MKO10109612_B_Ppm1b
  gRNA
cgugaagagagauucagagu

SEQ ID NO: 109613 - RNA, 20 nt, Artificial Sequence
  MKO10109613_B_Ppm1b
  gRNA
acucucgagcuguucugugu

SEQ ID NO: 109614 - RNA, 20 nt, Artificial Sequence
  MKO10109614_B_Ppm1b
  gRNA
accccaucauugucuuugug

SEQ ID NO: 109615 - RNA, 20 nt, Artificial Sequence
  MKO10109615_B_Ppm1d
  gRNA
auaauauacuugugcuuccg

SEQ ID NO: 109616 - RNA, 20 nt, Artificial Sequence
  MKO10109616_B_Ppm1d
  gRNA
guguccacacucuugacccc

SEQ ID NO: 109617 - RNA, 20 nt, Artificial Sequence
  MKO10109617_B_Ppm1d
  gRNA
ucuagugugaugaacaaguc

SEQ ID NO: 109618 - RNA, 20 nt, Artificial Sequence
  MKO10109618_B_Ppm1e
  gRNA
ggcgcacuaaguuaacgugu

SEQ ID NO: 109619 - RNA, 20 nt, Artificial Sequence
  MKO10109619_B_Ppm1e
  gRNA
caacaugcuccacguggcau

SEQ ID NO: 109620 - RNA, 20 nt, Artificial Sequence
  MKO10109620_B_Ppm1e
  gRNA
augccaucaagaacaugcga

SEQ ID NO: 109621 - RNA, 20 nt, Artificial Sequence
  MKO10109621_B_Ppm1f
  gRNA
cuacccguccuugcuguacc

SEQ ID NO: 109622 - RNA, 20 nt, Artificial Sequence
  MKO10109622_B_Ppm1f
  gRNA
guggaacuuacaggucacga

SEQ ID NO: 109623 - RNA, 20 nt, Artificial Sequence
  MKO10109623_B_Ppm1f
  gRNA
gaaacaucucaucggugagc

SEQ ID NO: 109624 - RNA, 20 nt, Artificial Sequence
  MKO10109624_B_Ppm1g
  gRNA
aaggaacuggcccagauugc

SEQ ID NO: 109625 - RNA, 20 nt, Artificial Sequence
  MKO10109625_B_Ppm1g
  gRNA
cuuggcaucaauagccaaga

SEQ ID NO: 109626 - RNA, 20 nt, Artificial Sequence
  MKO10109626_B_Ppm1g
  gRNA
uucugaucuuugauaauauc

SEQ ID NO: 109627 - RNA, 20 nt, Artificial Sequence
  MKO10109627_B_Ppm1h
  gRNA
acccgcgcggccucacugcg

SEQ ID NO: 109628 - RNA, 20 nt, Artificial Sequence
  MKO10109628_B_Ppm1h
  gRNA
ccgaugaccagacacucgug

SEQ ID NO: 109629 - RNA, 20 nt, Artificial Sequence
  MKO10109629_B_Ppm1h
  gRNA
uccucucgcguucgauuuga

SEQ ID NO: 109630 - RNA, 20 nt, Artificial Sequence
  MKO10109630_B_Ppm1j
  gRNA
ggccuguuugaugggcacgc

SEQ ID NO: 109631 - RNA, 20 nt, Artificial Sequence
  MKO10109631_B_Ppm1j
  gRNA
agggccaucauuguccgaaa

SEQ ID NO: 109632 - RNA, 20 nt, Artificial Sequence
  MKO10109632_B_Ppm1j
  gRNA
aguauuaccugguuauggcu

SEQ ID NO: 109633 - RNA, 20 nt, Artificial Sequence
  MKO10109633_B_Ppm1k
  gRNA
accuuaauccuuguugucuc

SEQ ID NO: 109634 - RNA, 20 nt, Artificial Sequence
  MKO10109634_B_Ppm1k
  gRNA
ccaggaaacugucgucagca

SEQ ID NO: 109635 - RNA, 20 nt, Artificial Sequence
  MKO10109635_B_Ppm1k
  gRNA
cucacuuaccaucugcagac

SEQ ID NO: 109636 - RNA, 20 nt, Artificial Sequence
  MKO10109636_B_Ppm1l
  gRNA
uguaaaaucucgacucccag

SEQ ID NO: 109637 - RNA, 20 nt, Artificial Sequence
  MKO10109637_B_Ppm1l
  gRNA
uccccgagagucaccaacgu

SEQ ID NO: 109638 - RNA, 20 nt, Artificial Sequence
  MKO10109638_B_Ppm1l
  gRNA
gucucccagggaucgagaca

SEQ ID NO: 109639 - RNA, 20 nt, Artificial Sequence
  MKO10109639_B_Ppm1m
  gRNA
cgaucccaaacucacaucgc

SEQ ID NO: 109640 - RNA, 20 nt, Artificial Sequence
  MKO10109640_B_Ppm1m
  gRNA
auccgcugccgcucuguuuc

SEQ ID NO: 109641 - RNA, 20 nt, Artificial Sequence
  MKO10109641_B_Ppm1m
  gRNA
ggguggcuguacagcccugg

SEQ ID NO: 109642 - RNA, 20 nt, Artificial Sequence
  MKO10109642_B_Ppm1n
  gRNA
ccugcucaccagcaacuuug

SEQ ID NO: 109643 - RNA, 20 nt, Artificial Sequence
  MKO10109643_B_Ppm1n
  gRNA
uugcuguguagcccuccucc

SEQ ID NO: 109644 - RNA, 20 nt, Artificial Sequence
  MKO10109644_B_Ppm1n
  gRNA
ucuaagcugcaucagacccc

SEQ ID NO: 109645 - RNA, 20 nt, Artificial Sequence
  MKO10109645_B_Ppme1
  gRNA
acuuaccgugaacacugccc

SEQ ID NO: 109646 - RNA, 20 nt, Artificial Sequence
  MKO10109646_B_Ppme1
  gRNA
auuguggcucuggaucugcg

SEQ ID NO: 109647 - RNA, 20 nt, Artificial Sequence
  MKO10109647_B_Ppme1
  gRNA
ucaucaguagaguacagugu

SEQ ID NO: 109648 - RNA, 20 nt, Artificial Sequence
  MKO10109648_B_Ppox
  gRNA
gcaggguaccgccuacauac

SEQ ID NO: 109649 - RNA, 20 nt, Artificial Sequence
  MKO10109649_B_Ppox
  gRNA
gagguguuaccugaggccgg

SEQ ID NO: 109650 - RNA, 20 nt, Artificial Sequence
  MKO10109650_B_Ppox
  gRNA
cgcucaauccgaggaucaga

SEQ ID NO: 109651 - RNA, 20 nt, Artificial Sequence
  MKO10109651_B_Ppp1ca
  gRNA
gaggcgccccucaagaucug

SEQ ID NO: 109652 - RNA, 20 nt, Artificial Sequence
  MKO10109652_B_Ppp1ca
  gRNA
ggcuggggcgagaaugaccg

SEQ ID NO: 109653 - RNA, 20 nt, Artificial Sequence
  MKO10109653_B_Ppp1ca
  gRNA
cuucuacggcuguuugagua

SEQ ID NO: 109654 - RNA, 20 nt, Artificial Sequence
  MKO10109654_B_Ppp1cb
  gRNA
gcuagcaucaaucgcauuua

SEQ ID NO: 109655 - RNA, 20 nt, Artificial Sequence
  MKO10109655_B_Ppp1cb
  gRNA
augacugaagcagaaguccg

SEQ ID NO: 109656 - RNA, 20 nt, Artificial Sequence
  MKO10109656_B_Ppp1cb
  gRNA
gagaaaaucuucuguuguca

SEQ ID NO: 109657 - RNA, 20 nt, Artificial Sequence
  MKO10109657_B_Ppp1cc
  gRNA
uccguagauccuauugaugc

SEQ ID NO: 109658 - RNA, 20 nt, Artificial Sequence
  MKO10109658_B_Ppp1cc
  gRNA
gaauaucuucucguccacga

SEQ ID NO: 109659 - RNA, 20 nt, Artificial Sequence
  MKO10109659_B_Ppp1cc
  gRNA
gaagauacaacauuaagcug

SEQ ID NO: 109660 - RNA, 20 nt, Artificial Sequence
  MKO10109660_B_Ppp1r10
  gRNA
gcagcaccucccgcucacug

SEQ ID NO: 109661 - RNA, 20 nt, Artificial Sequence
  MKO10109661_B_Ppp1r10
  gRNA
cucuccuagucuaaugaagg

SEQ ID NO: 109662 - RNA, 20 nt, Artificial Sequence
  MKO10109662_B_Ppp1r10
  gRNA
gcagcucagcaagucaagug

SEQ ID NO: 109663 - RNA, 20 nt, Artificial Sequence
  MKO10109663_B_Ppp1r11
  gRNA
gagcucucgccaaaggcccg

SEQ ID NO: 109664 - RNA, 20 nt, Artificial Sequence
  MKO10109664_B_Ppp1r11
  gRNA
guuuccgaaguuucauaguu

SEQ ID NO: 109665 - RNA, 20 nt, Artificial Sequence
  MKO10109665_B_Ppp1r11
  gRNA
cacuguggacaaugagcaua

SEQ ID NO: 109666 - RNA, 20 nt, Artificial Sequence
  MKO10109666_B_Ppp1r12a
  gRNA
gguauccagccuucauuguc

SEQ ID NO: 109667 - RNA, 20 nt, Artificial Sequence
  MKO10109667_B_Ppp1r12a
  gRNA
cacaccuuuagauauugcag

SEQ ID NO: 109668 - RNA, 20 nt, Artificial Sequence
  MKO10109668_B_Ppp1r12a
  gRNA
ggaagagcuacuucaaaaug

SEQ ID NO: 109669 - RNA, 20 nt, Artificial Sequence
  MKO10109669_B_Ppp1r12b
  gRNA
cacucugugacauggauauc

SEQ ID NO: 109670 - RNA, 20 nt, Artificial Sequence
  MKO10109670_B_Ppp1r12b
  gRNA
ugcuauguugagauaaccac

SEQ ID NO: 109671 - RNA, 20 nt, Artificial Sequence
  MKO10109671_B_Ppp1r12b
  gRNA
ugucacagagugcuucugcc

SEQ ID NO: 109672 - RNA, 20 nt, Artificial Sequence
  MKO10109672_B_Ppp1r12c
  gRNA
gaaugggggugcuaugccag

SEQ ID NO: 109673 - RNA, 20 nt, Artificial Sequence
  MKO10109673_B_Ppp1r12c
  gRNA
aguagguugcuacuccaagc

SEQ ID NO: 109674 - RNA, 20 nt, Artificial Sequence
  MKO10109674_B_Ppp1r12c
  gRNA
guccgggggugccuggccuc

SEQ ID NO: 109675 - RNA, 20 nt, Artificial Sequence
  MKO10109675_B_Ppp1r13b
  gRNA
gcaggugcucauacaucaug

SEQ ID NO: 109676 - RNA, 20 nt, Artificial Sequence
  MKO10109676_B_Ppp1r13b
  gRNA
ggagaaaagcgcacugaaaa

SEQ ID NO: 109677 - RNA, 20 nt, Artificial Sequence
  MKO10109677_B_Ppp1r13b
  gRNA
uguaugagcaccugcagaag

SEQ ID NO: 109678 - RNA, 20 nt, Artificial Sequence
  MKO10109678_B_Ppp1r13l
  gRNA
ccaagcaguuagagucguug

SEQ ID NO: 109679 - RNA, 20 nt, Artificial Sequence
  MKO10109679_B_Ppp1r13l
  gRNA
auccaagucagacucguucc

SEQ ID NO: 109680 - RNA, 20 nt, Artificial Sequence
  MKO10109680_B_Ppp1r13l
  gRNA
uucguccacuuuggcggcag

SEQ ID NO: 109681 - RNA, 20 nt, Artificial Sequence
  MKO10109681_B_Ppp1r14a
  gRNA
ucaucgauguugaccucguc

SEQ ID NO: 109682 - RNA, 20 nt, Artificial Sequence
  MKO10109682_B_Ppp1r14a
  gRNA
cccgguccuggcgggggcuc

SEQ ID NO: 109683 - RNA, 20 nt, Artificial Sequence
  MKO10109683_B_Ppp1r14a
  gRNA
cugucuguaggacuucgucc

SEQ ID NO: 109684 - RNA, 20 nt, Artificial Sequence
  MKO10109684_B_Ppp1r14b
  gRNA
agcacaccccagaagaaaug

SEQ ID NO: 109685 - RNA, 20 nt, Artificial Sequence
  MKO10109685_B_Ppp1r14b
  gRNA
guucuaaaauccacuccucc

SEQ ID NO: 109686 - RNA, 20 nt, Artificial Sequence
  MKO10109686_B_Ppp1r14b
  gRNA
gcggccgccauggcggacag

SEQ ID NO: 109687 - RNA, 20 nt, Artificial Sequence
  MKO10109687_B_Ppp1r14c
  gRNA
agcucuuuccuccucgcugu

SEQ ID NO: 109688 - RNA, 20 nt, Artificial Sequence
  MKO10109688_B_Ppp1r14c
  gRNA
agacugcuauaaaccaacag

SEQ ID NO: 109689 - RNA, 20 nt, Artificial Sequence
  MKO10109689_B_Ppp1r14c
  gRNA
gcuuccucaugccucuuauc

SEQ ID NO: 109690 - RNA, 20 nt, Artificial Sequence
  MKO10109690_B_Ppp1r14d
  gRNA
uucugagccagagauugauc

SEQ ID NO: 109691 - RNA, 20 nt, Artificial Sequence
  MKO10109691_B_Ppp1r14d
  gRNA
ucagucaacucaagagacuu

SEQ ID NO: 109692 - RNA, 20 nt, Artificial Sequence
  MKO10109692_B_Ppp1r14d
  gRNA
gccauucuccaagacugccc

SEQ ID NO: 109693 - RNA, 20 nt, Artificial Sequence
  MKO10109693_B_Ppp1r15a
  gRNA
cucucuagaguaguacuccc

SEQ ID NO: 109694 - RNA, 20 nt, Artificial Sequence
  MKO10109694_B_Ppp1r15a
  gRNA
ccucgacgggcagcuugggc

SEQ ID NO: 109695 - RNA, 20 nt, Artificial Sequence
  MKO10109695_B_Ppp1r15a
  gRNA
ucucuccugguagacaacgc

SEQ ID NO: 109696 - RNA, 20 nt, Artificial Sequence
  MKO10109696_B_Ppp1r15b
  gRNA
augaggaucgcaaaggacca

SEQ ID NO: 109697 - RNA, 20 nt, Artificial Sequence
  MKO10109697_B_Ppp1r15b
  gRNA
cggcgggaacuccgaagagc

SEQ ID NO: 109698 - RNA, 20 nt, Artificial Sequence
  MKO10109698_B_Ppp1r15b
  gRNA
cagagaugucggcaaccgcc

SEQ ID NO: 109699 - RNA, 20 nt, Artificial Sequence
  MKO10109699_B_Ppp1r16a
  gRNA
uaugcccuacgaccugugug

SEQ ID NO: 109700 - RNA, 20 nt, Artificial Sequence
  MKO10109700_B_Ppp1r16a
  gRNA
cauugacgacuuccaagaga

SEQ ID NO: 109701 - RNA, 20 nt, Artificial Sequence
  MKO10109701_B_Ppp1r16a
  gRNA
ugcagucaagccaucuucau

SEQ ID NO: 109702 - RNA, 20 nt, Artificial Sequence
  MKO10109702_B_Ppp1r16b
  gRNA
uugcacgcggcagccaccug

SEQ ID NO: 109703 - RNA, 20 nt, Artificial Sequence
  MKO10109703_B_Ppp1r16b
  gRNA
caugccauaugaccucugcg

SEQ ID NO: 109704 - RNA, 20 nt, Artificial Sequence
  MKO10109704_B_Ppp1r16b
  gRNA
uagcccugauuugugcaaug

SEQ ID NO: 109705 - RNA, 20 nt, Artificial Sequence
  MKO10109705_B_Ppp1r17
  gRNA
ccuuucagaccaguucauua

SEQ ID NO: 109706 - RNA, 20 nt, Artificial Sequence
  MKO10109706_B_Ppp1r17
  gRNA
gagugcaggagugauucuag

SEQ ID NO: 109707 - RNA, 20 nt, Artificial Sequence
  MKO10109707_B_Ppp1r17
  gRNA
cgccccuuaccugggaugaa

SEQ ID NO: 109708 - RNA, 20 nt, Artificial Sequence
  MKO10109708_B_Ppp1r18
  gRNA
cagccgcuuacccacgauua

SEQ ID NO: 109709 - RNA, 20 nt, Artificial Sequence
  MKO10109709_B_Ppp1r18
  gRNA
cuuagcaacccagccugacg

SEQ ID NO: 109710 - RNA, 20 nt, Artificial Sequence
  MKO10109710_B_Ppp1r18
  gRNA
uuccugcagaugaguccugc

SEQ ID NO: 109711 - RNA, 20 nt, Artificial Sequence
  MKO10109711_B_Ppp1r1a
  gRNA
ggaugccaaaccuuucaugg

SEQ ID NO: 109712 - RNA, 20 nt, Artificial Sequence
  MKO10109712_B_Ppp1r1a
  gRNA
accuggggaggacugaucac

SEQ ID NO: 109713 - RNA, 20 nt, Artificial Sequence
  MKO10109713_B_Ppp1r1a
  gRNA
gcucaccuugagaagugagu

SEQ ID NO: 109714 - RNA, 20 nt, Artificial Sequence
  MKO10109714_B_Ppp1r1b
  gRNA
gcauggcagggguuggucuc

SEQ ID NO: 109715 - RNA, 20 nt, Artificial Sequence
  MKO10109715_B_Ppp1r1b
  gRNA
guucucacucaaguugcuaa

SEQ ID NO: 109716 - RNA, 20 nt, Artificial Sequence
  MKO10109716_B_Ppp1r1b
  gRNA
ucgggagcuuggguacccac

SEQ ID NO: 109717 - RNA, 20 nt, Artificial Sequence
  MKO10109717_B_Ppp1r1c
  gRNA
uauguucauugagaaucaca

SEQ ID NO: 109718 - RNA, 20 nt, Artificial Sequence
  MKO10109718_B_Ppp1r1c
  gRNA
cuugcacuuucuucuucuuc

SEQ ID NO: 109719 - RNA, 20 nt, Artificial Sequence
  MKO10109719_B_Ppp1r1c
  gRNA
aagcaucugaaagaccagaa

SEQ ID NO: 109720 - RNA, 20 nt, Artificial Sequence
  MKO10109720_B_Ppp1r21
  gRNA
cagcaccaagcugugaucga

SEQ ID NO: 109721 - RNA, 20 nt, Artificial Sequence
  MKO10109721_B_Ppp1r21
  gRNA
ucagcuucgagcucagaauc

SEQ ID NO: 109722 - RNA, 20 nt, Artificial Sequence
  MKO10109722_B_Ppp1r21
  gRNA
uuagugcuagcucaucuuga

SEQ ID NO: 109723 - RNA, 20 nt, Artificial Sequence
  MKO10109723_B_Ppp1r26
  gRNA
ccagggcuuccgugagcgcc

SEQ ID NO: 109724 - RNA, 20 nt, Artificial Sequence
  MKO10109724_B_Ppp1r26
  gRNA
ugcaguuugccacgagacca

SEQ ID NO: 109725 - RNA, 20 nt, Artificial Sequence
  MKO10109725_B_Ppp1r26
  gRNA
ccaaagcaucuccgccaagc

SEQ ID NO: 109726 - RNA, 20 nt, Artificial Sequence
  MKO10109726_B_Ppp1r27
  gRNA
auucaccagcgggaugagac

SEQ ID NO: 109727 - RNA, 20 nt, Artificial Sequence
  MKO10109727_B_Ppp1r27
  gRNA
uccagccugucucaucccgc

SEQ ID NO: 109728 - RNA, 20 nt, Artificial Sequence
  MKO10109728_B_Ppp1r27
  gRNA
gggcagaucgccaucaucau

SEQ ID NO: 109729 - RNA, 20 nt, Artificial Sequence
  MKO10109729_B_Ppp1r2
  gRNA
uacuucuuagcuaagauauc

SEQ ID NO: 109730 - RNA, 20 nt, Artificial Sequence
  MKO10109730_B_Ppp1r2
  gRNA
ucaguaagaagucucagaag

SEQ ID NO: 109731 - RNA, 20 nt, Artificial Sequence
  MKO10109731_B_Ppp1r2
  gRNA
agcgacaguuugaaaugaaa

SEQ ID NO: 109732 - RNA, 20 nt, Artificial Sequence
  MKO10109732_B_Ppp1r32
  gRNA
ggucuccuaccaaccgcacc

SEQ ID NO: 109733 - RNA, 20 nt, Artificial Sequence
  MKO10109733_B_Ppp1r32
  gRNA
guuuaccaucgggcacuucu

SEQ ID NO: 109734 - RNA, 20 nt, Artificial Sequence
  MKO10109734_B_Ppp1r32
  gRNA
caggcuacaaauccaacuau

SEQ ID NO: 109735 - RNA, 20 nt, Artificial Sequence
  MKO10109735_B_Ppp1r35
  gRNA
accgggcgacgaucaugagc

SEQ ID NO: 109736 - RNA, 20 nt, Artificial Sequence
  MKO10109736_B_Ppp1r35
  gRNA
uaagcgacucuaccgagacc

SEQ ID NO: 109737 - RNA, 20 nt, Artificial Sequence
  MKO10109737_B_Ppp1r35
  gRNA
cgcguucaguaccugcuccu

SEQ ID NO: 109738 - RNA, 20 nt, Artificial Sequence
  MKO10109738_B_Ppp1r36
  gRNA
uccgcugcauuucagugucc

SEQ ID NO: 109739 - RNA, 20 nt, Artificial Sequence
  MKO10109739_B_Ppp1r36
  gRNA
uuuggagaaacgaagucagc

SEQ ID NO: 109740 - RNA, 20 nt, Artificial Sequence
  MKO10109740_B_Ppp1r36
  gRNA
uucuccuugaguucuauugc

SEQ ID NO: 109741 - RNA, 20 nt, Artificial Sequence
  MKO10109741_B_Ppp1r37
  gRNA
ccucguccaccgucacauuc

SEQ ID NO: 109742 - RNA, 20 nt, Artificial Sequence
  MKO10109742_B_Ppp1r37
  gRNA
gacacauaccuuucaggucc

SEQ ID NO: 109743 - RNA, 20 nt, Artificial Sequence
  MKO10109743_B_Ppp1r37
  gRNA
ggugaucagugccuacagac

SEQ ID NO: 109744 - RNA, 20 nt, Artificial Sequence
  MKO10109744_B_Ppp1r3a
  gRNA
ccagaaagcgcgucugcuag

SEQ ID NO: 109745 - RNA, 20 nt, Artificial Sequence
  MKO10109745_B_Ppp1r3a
  gRNA
uuguugauaucgucuacauu

SEQ ID NO: 109746 - RNA, 20 nt, Artificial Sequence
  MKO10109746_B_Ppp1r3a
  gRNA
aacaaucauuuguucucacg

SEQ ID NO: 109747 - RNA, 20 nt, Artificial Sequence
  MKO10109747_B_Ppp1r3b
  gRNA
cagccccugguugucggcga

SEQ ID NO: 109748 - RNA, 20 nt, Artificial Sequence
  MKO10109748_B_Ppp1r3b
  gRNA
ggaaagauugagccguacaa

SEQ ID NO: 109749 - RNA, 20 nt, Artificial Sequence
  MKO10109749_B_Ppp1r3b
  gRNA
uuguacggcucaaucuuucc

SEQ ID NO: 109750 - RNA, 20 nt, Artificial Sequence
  MKO10109750_B_Ppp1r3c
  gRNA
caaccgacuacuuaaguuuc

SEQ ID NO: 109751 - RNA, 20 nt, Artificial Sequence
  MKO10109751_B_Ppp1r3c
  gRNA
ggcaugacggaacuugucaa

SEQ ID NO: 109752 - RNA, 20 nt, Artificial Sequence
  MKO10109752_B_Ppp1r3c
  gRNA
ugcauuucuuaucacgcuaa

SEQ ID NO: 109753 - RNA, 20 nt, Artificial Sequence
  MKO10109753_B_Ppp1r3d
  gRNA
accgaggacaucuucgccuu

SEQ ID NO: 109754 - RNA, 20 nt, Artificial Sequence
  MKO10109754_B_Ppp1r3d
  gRNA
uucgaugggcggcgagaagu

SEQ ID NO: 109755 - RNA, 20 nt, Artificial Sequence
  MKO10109755_B_Ppp1r3d
  gRNA
ucgccgcccaucgaaacccc

SEQ ID NO: 109756 - RNA, 20 nt, Artificial Sequence
  MKO10109756_B_Ppp1r3e
  gRNA
gcugcgguaguacgcccgcu

SEQ ID NO: 109757 - RNA, 20 nt, Artificial Sequence
  MKO10109757_B_Ppp1r3e
  gRNA
cccgagcauccugccggugc

SEQ ID NO: 109758 - RNA, 20 nt, Artificial Sequence
  MKO10109758_B_Ppp1r3e
  gRNA
cacgcucacgcgcuucucgu

SEQ ID NO: 109759 - RNA, 20 nt, Artificial Sequence
  MKO10109759_B_Ppp1r3f
  gRNA
uggggcgcgccucgacuucg

SEQ ID NO: 109760 - RNA, 20 nt, Artificial Sequence
  MKO10109760_B_Ppp1r3f
  gRNA
ccuagugacucucgaacauc

SEQ ID NO: 109761 - RNA, 20 nt, Artificial Sequence
  MKO10109761_B_Ppp1r3f
  gRNA
cggcagccccuacgagaacc

SEQ ID NO: 109762 - RNA, 20 nt, Artificial Sequence
  MKO10109762_B_Ppp1r3g
  gRNA
cgugcaguucgccgacuccc

SEQ ID NO: 109763 - RNA, 20 nt, Artificial Sequence
  MKO10109763_B_Ppp1r3g
  gRNA
cggccccugucgccgcagaa

SEQ ID NO: 109764 - RNA, 20 nt, Artificial Sequence
  MKO10109764_B_Ppp1r3g
  gRNA
cugccccuuucugcggcgac

SEQ ID NO: 109765 - RNA, 20 nt, Artificial Sequence
  MKO10109765_B_Ppp1r42
  gRNA
aauuacauugcggucauaga

SEQ ID NO: 109766 - RNA, 20 nt, Artificial Sequence
  MKO10109766_B_Ppp1r42
  gRNA
aagaacucuucguucucuag

SEQ ID NO: 109767 - RNA, 20 nt, Artificial Sequence
  MKO10109767_B_Ppp1r42
  gRNA
aucaguuugucccuguauuu

SEQ ID NO: 109768 - RNA, 20 nt, Artificial Sequence
  MKO10109768_B_Ppp1r7
  gRNA
uguggguucaguugacaggc

SEQ ID NO: 109769 - RNA, 20 nt, Artificial Sequence
  MKO10109769_B_Ppp1r7
  gRNA
gcagcauuaccucugcaucu

SEQ ID NO: 109770 - RNA, 20 nt, Artificial Sequence
  MKO10109770_B_Ppp1r7
  gRNA
agauauggaaaccaucaacc

SEQ ID NO: 109771 - RNA, 20 nt, Artificial Sequence
  MKO10109771_B_Ppp1r8
  gRNA
cucucgaguccacgcagcgc

SEQ ID NO: 109772 - RNA, 20 nt, Artificial Sequence
  MKO10109772_B_Ppp1r8
  gRNA
gaucucgucauccucacuga

SEQ ID NO: 109773 - RNA, 20 nt, Artificial Sequence
  MKO10109773_B_Ppp1r8
  gRNA
gguuccccuccucaauagug

SEQ ID NO: 109774 - RNA, 20 nt, Artificial Sequence
  MKO10109774_B_Ppp1r9a
  gRNA
gauuuaccugacguugcccu

SEQ ID NO: 109775 - RNA, 20 nt, Artificial Sequence
  MKO10109775_B_Ppp1r9a
  gRNA
agcaucauuggaaugggcgu

SEQ ID NO: 109776 - RNA, 20 nt, Artificial Sequence
  MKO10109776_B_Ppp1r9a
  gRNA
ucaagucaaugaccagauug

SEQ ID NO: 109777 - RNA, 20 nt, Artificial Sequence
  MKO10109777_B_Ppp1r9b
  gRNA
agcaucauuggcaugggcgc

SEQ ID NO: 109778 - RNA, 20 nt, Artificial Sequence
  MKO10109778_B_Ppp1r9b
  gRNA
cucuagcucauauuccgcag

SEQ ID NO: 109779 - RNA, 20 nt, Artificial Sequence
  MKO10109779_B_Ppp1r9b
  gRNA
cucucaccgcacucggccuu

SEQ ID NO: 109780 - RNA, 20 nt, Artificial Sequence
  MKO10109780_B_Ppp2ca
  gRNA
gagcgcaucaccauacuccg

SEQ ID NO: 109781 - RNA, 20 nt, Artificial Sequence
  MKO10109781_B_Ppp2ca
  gRNA
gguucuacgacgaguguuua

SEQ ID NO: 109782 - RNA, 20 nt, Artificial Sequence
  MKO10109782_B_Ppp2ca
  gRNA
aagguauaaccagcuccccg

SEQ ID NO: 109783 - RNA, 20 nt, Artificial Sequence
  MKO10109783_B_Ppp2cb
  gRNA
agacaccagugugagaccgu

SEQ ID NO: 109784 - RNA, 20 nt, Artificial Sequence
  MKO10109784_B_Ppp2cb
  gRNA
ggcauuucuccacguggugc

SEQ ID NO: 109785 - RNA, 20 nt, Artificial Sequence
  MKO10109785_B_Ppp2cb
  gRNA
cuacauagucccccaugaau

SEQ ID NO: 109786 - RNA, 20 nt, Artificial Sequence
  MKO10109786_B_Ppp2r1a
  gRNA
accuucacaacuuugguggg

SEQ ID NO: 109787 - RNA, 20 nt, Artificial Sequence
  MKO10109787_B_Ppp2r1a
  gRNA
gcgggccgcugccuccaagc

SEQ ID NO: 109788 - RNA, 20 nt, Artificial Sequence
  MKO10109788_B_Ppp2r1a
  gRNA
cccucccaccaaaguuguga

SEQ ID NO: 109789 - RNA, 20 nt, Artificial Sequence
  MKO10109789_B_Ppp2r1b
  gRNA
guuagcucucgccgagcagc

SEQ ID NO: 109790 - RNA, 20 nt, Artificial Sequence
  MKO10109790_B_Ppp2r1b
  gRNA
agcgccuggcaagcggggac

SEQ ID NO: 109791 - RNA, 20 nt, Artificial Sequence
  MKO10109791_B_Ppp2r1b
  gRNA
aauuucacugguuugguggg

SEQ ID NO: 109792 - RNA, 20 nt, Artificial Sequence
  MKO10109792_B_Ppp2r2a
  gRNA
aagagaagaucaacaaaauu

SEQ ID NO: 109793 - RNA, 20 nt, Artificial Sequence
  MKO10109793_B_Ppp2r2a
  gRNA
cagauaaaacaauaaaauua

SEQ ID NO: 109794 - RNA, 20 nt, Artificial Sequence
  MKO10109794_B_Ppp2r2a
  gRNA
acaguagaguuuaaucauuc

SEQ ID NO: 109795 - RNA, 20 nt, Artificial Sequence
  MKO10109795_B_Ppp2r2b
  gRNA
auucaccccuacgaugaacc

SEQ ID NO: 109796 - RNA, 20 nt, Artificial Sequence
  MKO10109796_B_Ppp2r2b
  gRNA
gcauuggcaaacacucuucg

SEQ ID NO: 109797 - RNA, 20 nt, Artificial Sequence
  MKO10109797_B_Ppp2r2b
  gRNA
acucacccgcaggguuguga

SEQ ID NO: 109798 - RNA, 20 nt, Artificial Sequence
  MKO10109798_B_Ppp2r2c
  gRNA
acugucgaguucaaccacac

SEQ ID NO: 109799 - RNA, 20 nt, Artificial Sequence
  MKO10109799_B_Ppp2r2c
  gRNA
agauuaccgaacgagacaag

SEQ ID NO: 109800 - RNA, 20 nt, Artificial Sequence
  MKO10109800_B_Ppp2r2c
  gRNA
uguauacaucguacucaccc

SEQ ID NO: 109801 - RNA, 20 nt, Artificial Sequence
  MKO10109801_B_Ppp2r2d
  gRNA
ucgagacccauuuagaauua

SEQ ID NO: 109802 - RNA, 20 nt, Artificial Sequence
  MKO10109802_B_Ppp2r2d
  gRNA
cacugaccucuuguucccgc

SEQ ID NO: 109803 - RNA, 20 nt, Artificial Sequence
  MKO10109803_B_Ppp2r2d
  gRNA
acucuccccuagagugagcg

SEQ ID NO: 109804 - RNA, 20 nt, Artificial Sequence
  MKO10109804_B_Ppp2r3a
  gRNA
gcccccauguucagggcugc

SEQ ID NO: 109805 - RNA, 20 nt, Artificial Sequence
  MKO10109805_B_Ppp2r3a
  gRNA
uuguucuagauagcugcagc

SEQ ID NO: 109806 - RNA, 20 nt, Artificial Sequence
  MKO10109806_B_Ppp2r3a
  gRNA
ccuuccaaguaguccccagc

SEQ ID NO: 109807 - RNA, 20 nt, Artificial Sequence
  MKO10109807_B_Ppp2r3c
  gRNA
aguucuauaagaccauaccc

SEQ ID NO: 109808 - RNA, 20 nt, Artificial Sequence
  MKO10109808_B_Ppp2r3c
  gRNA
guaguuaaagaacugcauga

SEQ ID NO: 109809 - RNA, 20 nt, Artificial Sequence
  MKO10109809_B_Ppp2r3c
  gRNA
cacuuacccuguaauaaaac

SEQ ID NO: 109810 - RNA, 20 nt, Artificial Sequence
  MKO10109810_B_Ppp2r3d
  gRNA
gagaucuauggggucggacc

SEQ ID NO: 109811 - RNA, 20 nt, Artificial Sequence
  MKO10109811_B_Ppp2r3d
  gRNA
cgcacaguagggcgucacag

SEQ ID NO: 109812 - RNA, 20 nt, Artificial Sequence
  MKO10109812_B_Ppp2r3d
  gRNA
caggggugacaucgggggcu

SEQ ID NO: 109813 - RNA, 20 nt, Artificial Sequence
  MKO10109813_B_Ppp2r4
  gRNA
cgcuuccauuugcccauauc

SEQ ID NO: 109814 - RNA, 20 nt, Artificial Sequence
  MKO10109814_B_Ppp2r4
  gRNA
gauugaugaaaccccgccag

SEQ ID NO: 109815 - RNA, 20 nt, Artificial Sequence
  MKO10109815_B_Ppp2r4
  gRNA
aacuccacacgaauugacua

SEQ ID NO: 109816 - RNA, 20 nt, Artificial Sequence
  MKO10109816_B_Ppp2r5a
  gRNA
guauucugauauaguaaaaa

SEQ ID NO: 109817 - RNA, 20 nt, Artificial Sequence
  MKO10109817_B_Ppp2r5a
  gRNA
ugaauucuucuugagauucu

SEQ ID NO: 109818 - RNA, 20 nt, Artificial Sequence
  MKO10109818_B_Ppp2r5a
  gRNA
aagagcgacgcugaaugaac

SEQ ID NO: 109819 - RNA, 20 nt, Artificial Sequence
  MKO10109819_B_Ppp2r5b
  gRNA
cuggacucuccaagaaacgc

SEQ ID NO: 109820 - RNA, 20 nt, Artificial Sequence
  MKO10109820_B_Ppp2r5b
  gRNA
ccucgcugucaaauagcucc

SEQ ID NO: 109821 - RNA, 20 nt, Artificial Sequence
  MKO10109821_B_Ppp2r5b
  gRNA
gucaaacucaggguucucgc

SEQ ID NO: 109822 - RNA, 20 nt, Artificial Sequence
  MKO10109822_B_Ppp2r5c
  gRNA
cacgggcuggaaaggcccgu

SEQ ID NO: 109823 - RNA, 20 nt, Artificial Sequence
  MKO10109823_B_Ppp2r5c
  gRNA
agcagaauucgacccagaag

SEQ ID NO: 109824 - RNA, 20 nt, Artificial Sequence
  MKO10109824_B_Ppp2r5c
  gRNA
aacguugguucauccucuuc

SEQ ID NO: 109825 - RNA, 20 nt, Artificial Sequence
  MKO10109825_B_Ppp2r5d
  gRNA
guagcucccgguucuuguug

SEQ ID NO: 109826 - RNA, 20 nt, Artificial Sequence
  MKO10109826_B_Ppp2r5d
  gRNA
gcuccugugggauucgauga

SEQ ID NO: 109827 - RNA, 20 nt, Artificial Sequence
  MKO10109827_B_Ppp2r5d
  gRNA
ggucugacacgaagucaaag

SEQ ID NO: 109828 - RNA, 20 nt, Artificial Sequence
  MKO10109828_B_Ppp2r5e
  gRNA
guccaccaguucauuaagag

SEQ ID NO: 109829 - RNA, 20 nt, Artificial Sequence
  MKO10109829_B_Ppp2r5e
  gRNA
ucgaauucauugcugucacu

SEQ ID NO: 109830 - RNA, 20 nt, Artificial Sequence
  MKO10109830_B_Ppp2r5e
  gRNA
aguugaaguaccuguaagug

SEQ ID NO: 109831 - RNA, 20 nt, Artificial Sequence
  MKO10109831_B_Ppp3ca
  gRNA
uaaacgugaaauacucugug

SEQ ID NO: 109832 - RNA, 20 nt, Artificial Sequence
  MKO10109832_B_Ppp3ca
  gRNA
gcgaaguaaaaacaguguuu

SEQ ID NO: 109833 - RNA, 20 nt, Artificial Sequence
  MKO10109833_B_Ppp3ca
  gRNA
aacacucgcuaccucuucuu

SEQ ID NO: 109834 - RNA, 20 nt, Artificial Sequence
  MKO10109834_B_Ppp3cb
  gRNA
guacuuacauuccugcuuaa

SEQ ID NO: 109835 - RNA, 20 nt, Artificial Sequence
  MKO10109835_B_Ppp3cb
  gRNA
agcacauuauuccuucugag

SEQ ID NO: 109836 - RNA, 20 nt, Artificial Sequence
  MKO10109836_B_Ppp3cb
  gRNA
guuucaucagaucaaaaaau

SEQ ID NO: 109837 - RNA, 20 nt, Artificial Sequence
  MKO10109837_B_Ppp3cc
  gRNA
aagagguagcgaguauuacu

SEQ ID NO: 109838 - RNA, 20 nt, Artificial Sequence
  MKO10109838_B_Ppp3cc
  gRNA
ucggaucaaguauucagaga

SEQ ID NO: 109839 - RNA, 20 nt, Artificial Sequence
  MKO10109839_B_Ppp3cc
  gRNA
uccugaaauuacuuguuuag

SEQ ID NO: 109840 - RNA, 20 nt, Artificial Sequence
  MKO10109840_B_Ppp3r1
  gRNA
agauggaagaauauccuuug

SEQ ID NO: 109841 - RNA, 20 nt, Artificial Sequence
  MKO10109841_B_Ppp3r1
  gRNA
gugucucaguucagugucaa

SEQ ID NO: 109842 - RNA, 20 nt, Artificial Sequence
  MKO10109842_B_Ppp3r1
  gRNA
auccuuaucugcauuuauua

SEQ ID NO: 109843 - RNA, 20 nt, Artificial Sequence
  MKO10109843_B_Ppp3r2
  gRNA
aggugcccacgaugaacucg

SEQ ID NO: 109844 - RNA, 20 nt, Artificial Sequence
  MKO10109844_B_Ppp3r2
  gRNA
caucacccuugacgcugaac

SEQ ID NO: 109845 - RNA, 20 nt, Artificial Sequence
  MKO10109845_B_Ppp3r2
  gRNA
aucgacaucuucgacacaga

SEQ ID NO: 109846 - RNA, 20 nt, Artificial Sequence
  MKO10109846_B_Ppp4c
  gRNA
ugagaccaacuaccucuuca

SEQ ID NO: 109847 - RNA, 20 nt, Artificial Sequence
  MKO10109847_B_Ppp4c
  gRNA
cagguaugcggugacaucca

SEQ ID NO: 109848 - RNA, 20 nt, Artificial Sequence
  MKO10109848_B_Ppp4c
  gRNA
uagaagagagcaacgugcag

SEQ ID NO: 109849 - RNA, 20 nt, Artificial Sequence
  MKO10109849_B_Ppp4r1
  gRNA
uaccggagucaucagcuaau

SEQ ID NO: 109850 - RNA, 20 nt, Artificial Sequence
  MKO10109850_B_Ppp4r1
  gRNA
caagugagaacguauuuaac

SEQ ID NO: 109851 - RNA, 20 nt, Artificial Sequence
  MKO10109851_B_Ppp4r1
  gRNA
caucuugugagacgaagucc

SEQ ID NO: 109852 - RNA, 20 nt, Artificial Sequence
  MKO10109852_B_Ppp4r2
  gRNA
aaaggaaguuuguccuguac

SEQ ID NO: 109853 - RNA, 20 nt, Artificial Sequence
  MKO10109853_B_Ppp4r2
  gRNA
ucuuuccuucauuucaucaa

SEQ ID NO: 109854 - RNA, 20 nt, Artificial Sequence
  MKO10109854_B_Ppp4r2
  gRNA
auucaguggucccaauuuaa

SEQ ID NO: 109855 - RNA, 20 nt, Artificial Sequence
  MKO10109855_B_Ppp4r4
  gRNA
agugcuggucaagaugucca

SEQ ID NO: 109856 - RNA, 20 nt, Artificial Sequence
  MKO10109856_B_Ppp4r4
  gRNA
acucuccgaagugucucagu

SEQ ID NO: 109857 - RNA, 20 nt, Artificial Sequence
  MKO10109857_B_Ppp4r4
  gRNA
aaaguauuaccucaugccuc

SEQ ID NO: 109858 - RNA, 20 nt, Artificial Sequence
  MKO10109858_B_Ppp5c
  gRNA
cgagcacagacgcucugucg

SEQ ID NO: 109859 - RNA, 20 nt, Artificial Sequence
  MKO10109859_B_Ppp5c
  gRNA
uuaccugguaggcgcacuuc

SEQ ID NO: 109860 - RNA, 20 nt, Artificial Sequence
  MKO10109860_B_Ppp5c
  gRNA
gauccuuguaccacugcaug

SEQ ID NO: 109861 - RNA, 20 nt, Artificial Sequence
  MKO10109861_B_Ppp6c
  gRNA
cuuugugaacuguucagaac

SEQ ID NO: 109862 - RNA, 20 nt, Artificial Sequence
  MKO10109862_B_Ppp6c
  gRNA
ugugagcauaucaaaaacuu

SEQ ID NO: 109863 - RNA, 20 nt, Artificial Sequence
  MKO10109863_B_Ppp6c
  gRNA
ugagaguagacagauaacac

SEQ ID NO: 109864 - RNA, 20 nt, Artificial Sequence
  MKO10109864_B_Ppp6r1
  gRNA
gaaucugcucaauuagccgc

SEQ ID NO: 109865 - RNA, 20 nt, Artificial Sequence
  MKO10109865_B_Ppp6r1
  gRNA
uaccaaugugccgcagcaac

SEQ ID NO: 109866 - RNA, 20 nt, Artificial Sequence
  MKO10109866_B_Ppp6r1
  gRNA
ggccuuggaucaucugcucg

SEQ ID NO: 109867 - RNA, 20 nt, Artificial Sequence
  MKO10109867_B_Ppp6r2
  gRNA
ccuagucugucgcugaucug

SEQ ID NO: 109868 - RNA, 20 nt, Artificial Sequence
  MKO10109868_B_Ppp6r2
  gRNA
ucacauguaggaccuccugc

SEQ ID NO: 109869 - RNA, 20 nt, Artificial Sequence
  MKO10109869_B_Ppp6r2
  gRNA
ggaucaaugccacaauucuc

SEQ ID NO: 109870 - RNA, 20 nt, Artificial Sequence
  MKO10109870_B_Ppp6r3
  gRNA
cucccagaugaaugauagac

SEQ ID NO: 109871 - RNA, 20 nt, Artificial Sequence
  MKO10109871_B_Ppp6r3
  gRNA
gaacuauuuccacaagccuc

SEQ ID NO: 109872 - RNA, 20 nt, Artificial Sequence
  MKO10109872_B_Ppp6r3
  gRNA
ggaugaggaggauguucuac

SEQ ID NO: 109873 - RNA, 20 nt, Artificial Sequence
  MKO10109873_B_Pprc1
  gRNA
gacacgagcagcucugaauc

SEQ ID NO: 109874 - RNA, 20 nt, Artificial Sequence
  MKO10109874_B_Pprc1
  gRNA
ugagcagcgacauuucauuc

SEQ ID NO: 109875 - RNA, 20 nt, Artificial Sequence
  MKO10109875_B_Pprc1
  gRNA
cuuugucagucuuucucgac

SEQ ID NO: 109876 - RNA, 20 nt, Artificial Sequence
  MKO10109876_B_Ppt1
  gRNA
ucugacacaccauguugacu

SEQ ID NO: 109877 - RNA, 20 nt, Artificial Sequence
  MKO10109877_B_Ppt1
  gRNA
guuguccuccaacugagauc

SEQ ID NO: 109878 - RNA, 20 nt, Artificial Sequence
  MKO10109878_B_Ppt1
  gRNA
uuguaucccugcugcaacuu

SEQ ID NO: 109879 - RNA, 20 nt, Artificial Sequence
  MKO10109879_B_Ppt2
  gRNA
acagugcuugaucucuucga

SEQ ID NO: 109880 - RNA, 20 nt, Artificial Sequence
  MKO10109880_B_Ppt2
  gRNA
acagguacaaggguuccgag

SEQ ID NO: 109881 - RNA, 20 nt, Artificial Sequence
  MKO10109881_B_Ppt2
  gRNA
ccuccauacuggcccaucug

SEQ ID NO: 109882 - RNA, 20 nt, Artificial Sequence
  MKO10109882_B_Ppuc7
  gRNA
ucuguccagcaccacgaugc

SEQ ID NO: 109883 - RNA, 20 nt, Artificial Sequence
  MKO10109883_B_Ppuc7
  gRNA
cuuuaaugcgaacaugcgag

SEQ ID NO: 109884 - RNA, 20 nt, Artificial Sequence
  MKO10109884_B_Ppuc7
  gRNA
cagcaacucacaguagcucg

SEQ ID NO: 109885 - RNA, 20 nt, Artificial Sequence
  MKO10109885_B_Ppwd1
  gRNA
cauguaacugcgcucauaca

SEQ ID NO: 109886 - RNA, 20 nt, Artificial Sequence
  MKO10109886_B_Ppwd1
  gRNA
uuuaacauguccaucaugac

SEQ ID NO: 109887 - RNA, 20 nt, Artificial Sequence
  MKO10109887_B_Ppwd1
  gRNA
augaucaacaugcugaagcu

SEQ ID NO: 109888 - RNA, 20 nt, Artificial Sequence
  MKO10109888_B_Ppy
  gRNA
cagggggagagcugcacucc

SEQ ID NO: 109889 - RNA, 20 nt, Artificial Sequence
  MKO10109889_B_Ppy
  gRNA
ggagaggcagcaguaugcga

SEQ ID NO: 109890 - RNA, 20 nt, Artificial Sequence
  MKO10109890_B_Ppy
  gRNA
cuaugcgacaccugagcaga

SEQ ID NO: 109891 - RNA, 20 nt, Artificial Sequence
  MKO10109891_B_Pqbp1
  gRNA
acagcggacucccuuacuau

SEQ ID NO: 109892 - RNA, 20 nt, Artificial Sequence
  MKO10109892_B_Pqbp1
  gRNA
ccgacgccaccaucgcagag

SEQ ID NO: 109893 - RNA, 20 nt, Artificial Sequence
  MKO10109893_B_Pqbp1
  gRNA
ugaugauccuguugacuaug

SEQ ID NO: 109894 - RNA, 20 nt, Artificial Sequence
  MKO10109894_B_Pqlc1
  gRNA
cggaggacucagaaugccga

SEQ ID NO: 109895 - RNA, 20 nt, Artificial Sequence
  MKO10109895_B_Pqlc1
  gRNA
uacuaccccuccgaagacca

SEQ ID NO: 109896 - RNA, 20 nt, Artificial Sequence
  MKO10109896_B_Pqlc1
  gRNA
aucaagcgccgcuccuuugc

SEQ ID NO: 109897 - RNA, 20 nt, Artificial Sequence
  MKO10109897_B_Pqlc2
  gRNA
uggaccaggcccuaucacug

SEQ ID NO: 109898 - RNA, 20 nt, Artificial Sequence
  MKO10109898_B_Pqlc2
  gRNA
cagacaggaguguccgcccc

SEQ ID NO: 109899 - RNA, 20 nt, Artificial Sequence
  MKO10109899_B_Pqlc2
  gRNA
cuccaccgauccagcccagc

SEQ ID NO: 109900 - RNA, 20 nt, Artificial Sequence
  MKO10109900_B_Pqlc3
  gRNA
gaauggaggccggacugcua

SEQ ID NO: 109901 - RNA, 20 nt, Artificial Sequence
  MKO10109901_B_Pqlc3
  gRNA
gccagcugcgcguaaaucug

SEQ ID NO: 109902 - RNA, 20 nt, Artificial Sequence
  MKO10109902_B_Pqlc3
  gRNA
ugaaaugaaagacgaagagc

SEQ ID NO: 109903 - RNA, 20 nt, Artificial Sequence
  MKO10109903_B_Pradc1
  gRNA
uugagcuacugcaaccuccg

SEQ ID NO: 109904 - RNA, 20 nt, Artificial Sequence
  MKO10109904_B_Pradc1
  gRNA
gccguugcugaguuccccgc

SEQ ID NO: 109905 - RNA, 20 nt, Artificial Sequence
  MKO10109905_B_Pradc1
  gRNA
cccuuuccaccagagcgauc

SEQ ID NO: 109906 - RNA, 20 nt, Artificial Sequence
  MKO10109906_B_Praf2
  gRNA
aggcagcaggguggcugcga

SEQ ID NO: 109907 - RNA, 20 nt, Artificial Sequence
  MKO10109907_B_Praf2
  gRNA
gccucuagaagcaaucccau

SEQ ID NO: 109908 - RNA, 20 nt, Artificial Sequence
  MKO10109908_B_Praf2
  gRNA
gagaacaagaucgagagcau

SEQ ID NO: 109909 - RNA, 20 nt, Artificial Sequence
  MKO10109909_B_Pram1
  gRNA
uccacagcgguacugaagac

SEQ ID NO: 109910 - RNA, 20 nt, Artificial Sequence
  MKO10109910_B_Pram1
  gRNA
gcugauacuagagucaucug

SEQ ID NO: 109911 - RNA, 20 nt, Artificial Sequence
  MKO10109911_B_Pram1
  gRNA
acucacugugcaauauguug

SEQ ID NO: 109912 - RNA, 20 nt, Artificial Sequence
  MKO10109912_B_Pramef12
  gRNA
caagcuuaaauaguucagcc

SEQ ID NO: 109913 - RNA, 20 nt, Artificial Sequence
  MKO10109913_B_Pramef12
  gRNA
uugaccuuugaggaagucga

SEQ ID NO: 109914 - RNA, 20 nt, Artificial Sequence
  MKO10109914_B_Pramef12
  gRNA
acaaacgacuuaacauccug

SEQ ID NO: 109915 - RNA, 20 nt, Artificial Sequence
  MKO10109915_B_Pramef17
  gRNA
gcugauagauaaaaccaacu

SEQ ID NO: 109916 - RNA, 20 nt, Artificial Sequence
  MKO10109916_B_Pramef17
  gRNA
uaugccugagaagcaagaag

SEQ ID NO: 109917 - RNA, 20 nt, Artificial Sequence
  MKO10109917_B_Pramef17
  gRNA
cccacccacacuccugcagc

SEQ ID NO: 109918 - RNA, 20 nt, Artificial Sequence
  MKO10109918_B_Pramef25
  gRNA
aauugccuauucacacuguc

SEQ ID NO: 109919 - RNA, 20 nt, Artificial Sequence
  MKO10109919_B_Pramef25
  gRNA
ucaucucaaacacuugcauu

SEQ ID NO: 109920 - RNA, 20 nt, Artificial Sequence
  MKO10109920_B_Pramef25
  gRNA
aaugcaaguguuugagauga

SEQ ID NO: 109921 - RNA, 20 nt, Artificial Sequence
  MKO10109921_B_Pramef6
  gRNA
ucuccagggucagcuuugug

SEQ ID NO: 109922 - RNA, 20 nt, Artificial Sequence
  MKO10109922_B_Pramef6
  gRNA
uuccccugccagcucauucu

SEQ ID NO: 109923 - RNA, 20 nt, Artificial Sequence
  MKO10109923_B_Pramef6
  gRNA
uccaggcaccaagaaugagc

SEQ ID NO: 109924 - RNA, 20 nt, Artificial Sequence
  MKO10109924_B_Pramef8
  gRNA
agacaaaacuuugucguugu

SEQ ID NO: 109925 - RNA, 20 nt, Artificial Sequence
  MKO10109925_B_Pramef8
  gRNA
gagcagugggaaaagcgccc

SEQ ID NO: 109926 - RNA, 20 nt, Artificial Sequence
  MKO10109926_B_Pramef8
  gRNA
ccugaugaagacuccccacc

SEQ ID NO: 109927 - RNA, 20 nt, Artificial Sequence
  MKO10109927_B_Pramel1
  gRNA
cuacugaucauggcccccag

SEQ ID NO: 109928 - RNA, 20 nt, Artificial Sequence
  MKO10109928_B_Pramel1
  gRNA
uaaagcguaucuuugacugu

SEQ ID NO: 109929 - RNA, 20 nt, Artificial Sequence
  MKO10109929_B_Pramel1
  gRNA
uuugacagcccuccaaaucc

SEQ ID NO: 109930 - RNA, 20 nt, Artificial Sequence
  MKO10109930_B_Pramel3
  gRNA
cuuaccuaguagcugaguuc

SEQ ID NO: 109931 - RNA, 20 nt, Artificial Sequence
  MKO10109931_B_Pramel3
  gRNA
caguuucaagaugaucugug

SEQ ID NO: 109932 - RNA, 20 nt, Artificial Sequence
  MKO10109932_B_Pramel3
  gRNA
aaugccaccucccauagcaa

SEQ ID NO: 109933 - RNA, 20 nt, Artificial Sequence
  MKO10109933_B_Pramel4
  gRNA
uccuuucuuaccugagcauu

SEQ ID NO: 109934 - RNA, 20 nt, Artificial Sequence
  MKO10109934_B_Pramel4
  gRNA
ugauuugcgagaugcccacc

SEQ ID NO: 109935 - RNA, 20 nt, Artificial Sequence
  MKO10109935_B_Pramel4
  gRNA
ccacgaccucuccuucuuaa

SEQ ID NO: 109936 - RNA, 20 nt, Artificial Sequence
  MKO10109936_B_Pramel5
  gRNA
cacggauuuggaaguccgug

SEQ ID NO: 109937 - RNA, 20 nt, Artificial Sequence
  MKO10109937_B_Pramel5
  gRNA
ucugggugggauugaucacc

SEQ ID NO: 109938 - RNA, 20 nt, Artificial Sequence
  MKO10109938_B_Pramel5
  gRNA
aucccacccagagcucccac

SEQ ID NO: 109939 - RNA, 20 nt, Artificial Sequence
  MKO10109939_B_Pramel6
  gRNA
aggcagacaccauugcaauc

SEQ ID NO: 109940 - RNA, 20 nt, Artificial Sequence
  MKO10109940_B_Pramel6
  gRNA
aaugaaccuucccuguuacc

SEQ ID NO: 109941 - RNA, 20 nt, Artificial Sequence
  MKO10109941_B_Pramel6
  gRNA
uuugaagaccuugucaauua

SEQ ID NO: 109942 - RNA, 20 nt, Artificial Sequence
  MKO10109942_B_Pramel7
  gRNA
aguauugaccgucucugaug

SEQ ID NO: 109943 - RNA, 20 nt, Artificial Sequence
  MKO10109943_B_Pramel7
  gRNA
gugggaagaauucccuuauu

SEQ ID NO: 109944 - RNA, 20 nt, Artificial Sequence
  MKO10109944_B_Pramel7
  gRNA
cuuaaacaucuaugcuugag

SEQ ID NO: 109945 - RNA, 20 nt, Artificial Sequence
  MKO10109945_B_Prame
  gRNA
uauagccagauccaaaagcg

SEQ ID NO: 109946 - RNA, 20 nt, Artificial Sequence
  MKO10109946_B_Prame
  gRNA
uuaguaacaacccaauguau

SEQ ID NO: 109947 - RNA, 20 nt, Artificial Sequence
  MKO10109947_B_Prame
  gRNA
agaguauggcaucuguuaaa

SEQ ID NO: 109948 - RNA, 20 nt, Artificial Sequence
  MKO10109948_B_Prap1
  gRNA
ucuugaaaaggacaaccagc

SEQ ID NO: 109949 - RNA, 20 nt, Artificial Sequence
  MKO10109949_B_Prap1
  gRNA
guuucuccuggccaccuguu

SEQ ID NO: 109950 - RNA, 20 nt, Artificial Sequence
  MKO10109950_B_Prap1
  gRNA
caaacauguguucccugaac

SEQ ID NO: 109951 - RNA, 20 nt, Artificial Sequence
  MKO10109951_B_Prb1
  gRNA
cuugucucugagcugagcuc

SEQ ID NO: 109952 - RNA, 20 nt, Artificial Sequence
  MKO10109952_B_Prb1
  gRNA
gacucaaauucucagcuccu

SEQ ID NO: 109953 - RNA, 20 nt, Artificial Sequence
  MKO10109953_B_Prb1
  gRNA
cugagaauuugagucuucgu

SEQ ID NO: 109954 - RNA, 20 nt, Artificial Sequence
  MKO10109954_B_Prc1
  gRNA
gcaggaacugaagcuacuuc

SEQ ID NO: 109955 - RNA, 20 nt, Artificial Sequence
  MKO10109955_B_Prc1
  gRNA
gcagaggcuacaaagaaccg

SEQ ID NO: 109956 - RNA, 20 nt, Artificial Sequence
  MKO10109956_B_Prc1
  gRNA
uacaagcuuugaaagagaug

SEQ ID NO: 109957 - RNA, 20 nt, Artificial Sequence
  MKO10109957_B_Prcc
  gRNA
uggcuauaggauuacuacag

SEQ ID NO: 109958 - RNA, 20 nt, Artificial Sequence
  MKO10109958_B_Prcc
  gRNA
aggacaacuuucuucuucgc

SEQ ID NO: 109959 - RNA, 20 nt, Artificial Sequence
  MKO10109959_B_Prcc
  gRNA
gaagaagaaaguuguccugc

SEQ ID NO: 109960 - RNA, 20 nt, Artificial Sequence
  MKO10109960_B_Prcp
  gRNA
accuagucgcugauaaacac

SEQ ID NO: 109961 - RNA, 20 nt, Artificial Sequence
  MKO10109961_B_Prcp
  gRNA
auaccaucaagcugccagau

SEQ ID NO: 109962 - RNA, 20 nt, Artificial Sequence
  MKO10109962_B_Prcp
  gRNA
agauuguaacuaacgauuuc

SEQ ID NO: 109963 - RNA, 20 nt, Artificial Sequence
  MKO10109963_B_Prdm10
  gRNA
accguccacugacguguagg

SEQ ID NO: 109964 - RNA, 20 nt, Artificial Sequence
  MKO10109964_B_Prdm10
  gRNA
cugcuguauacaccaccugc

SEQ ID NO: 109965 - RNA, 20 nt, Artificial Sequence
  MKO10109965_B_Prdm10
  gRNA
ccuguuggacauaagcuacc

SEQ ID NO: 109966 - RNA, 20 nt, Artificial Sequence
  MKO10109966_B_Prdm11
  gRNA
acagcgagcgcaucuacuuc

SEQ ID NO: 109967 - RNA, 20 nt, Artificial Sequence
  MKO10109967_B_Prdm11
  gRNA
auggugagggcugcccgauc

SEQ ID NO: 109968 - RNA, 20 nt, Artificial Sequence
  MKO10109968_B_Prdm11
  gRNA
ccggagcagcucucggagac

SEQ ID NO: 109969 - RNA, 20 nt, Artificial Sequence
  MKO10109969_B_Prdm12
  gRNA
ucauaccuagguauucaacg

SEQ ID NO: 109970 - RNA, 20 nt, Artificial Sequence
  MKO10109970_B_Prdm12
  gRNA
aggcacgagcaucuucuaca

SEQ ID NO: 109971 - RNA, 20 nt, Artificial Sequence
  MKO10109971_B_Prdm12
  gRNA
ggcaaugacgcggccaguga

SEQ ID NO: 109972 - RNA, 20 nt, Artificial Sequence
  MKO10109972_B_Prdm13
  gRNA
gcauuguugccaccgccgcc

SEQ ID NO: 109973 - RNA, 20 nt, Artificial Sequence
  MKO10109973_B_Prdm13
  gRNA
gcauugcgagacguccagcc

SEQ ID NO: 109974 - RNA, 20 nt, Artificial Sequence
  MKO10109974_B_Prdm13
  gRNA
acuccaacgcaugaugagaa

SEQ ID NO: 109975 - RNA, 20 nt, Artificial Sequence
  MKO10109975_B_Prdm14
  gRNA
gcagccuaccuuccggaagc

SEQ ID NO: 109976 - RNA, 20 nt, Artificial Sequence
  MKO10109976_B_Prdm14
  gRNA
ugccucaugcagaccucauu

SEQ ID NO: 109977 - RNA, 20 nt, Artificial Sequence
  MKO10109977_B_Prdm14
  gRNA
gaaccgagcacaguugacau

SEQ ID NO: 109978 - RNA, 20 nt, Artificial Sequence
  MKO10109978_B_Prdm15
  gRNA
ccaguugcagucauccucau

SEQ ID NO: 109979 - RNA, 20 nt, Artificial Sequence
  MKO10109979_B_Prdm15
  gRNA
cugcagccaguaccaugacu

SEQ ID NO: 109980 - RNA, 20 nt, Artificial Sequence
  MKO10109980_B_Prdm15
  gRNA
aggacuccuuugugcugagc

SEQ ID NO: 109981 - RNA, 20 nt, Artificial Sequence
  MKO10109981_B_Prdm16
  gRNA
gcugccagaccccgccugau

SEQ ID NO: 109982 - RNA, 20 nt, Artificial Sequence
  MKO10109982_B_Prdm16
  gRNA
caugugucagaucaacgaac

SEQ ID NO: 109983 - RNA, 20 nt, Artificial Sequence
  MKO10109983_B_Prdm16
  gRNA
uagcuuccucgcccucgccu

SEQ ID NO: 109984 - RNA, 20 nt, Artificial Sequence
  MKO10109984_B_Prdm1
  gRNA
acauagugaacgaccacccc

SEQ ID NO: 109985 - RNA, 20 nt, Artificial Sequence
  MKO10109985_B_Prdm1
  gRNA
gauguucaucccguucugac

SEQ ID NO: 109986 - RNA, 20 nt, Artificial Sequence
  MKO10109986_B_Prdm1
  gRNA
ccgaguucccugccuaccga

SEQ ID NO: 109987 - RNA, 20 nt, Artificial Sequence
  MKO10109987_B_Prdm2
  gRNA
agcuccucgccaggcgcgau

SEQ ID NO: 109988 - RNA, 20 nt, Artificial Sequence
  MKO10109988_B_Prdm2
  gRNA
cuagguguacuacccaaauu

SEQ ID NO: 109989 - RNA, 20 nt, Artificial Sequence
  MKO10109989_B_Prdm2
  gRNA
acuggcuccgcuaugugaac

SEQ ID NO: 109990 - RNA, 20 nt, Artificial Sequence
  MKO10109990_B_Prdm4
  gRNA
gagugccacgcuuacagagu

SEQ ID NO: 109991 - RNA, 20 nt, Artificial Sequence
  MKO10109991_B_Prdm4
  gRNA
cuccagaccauucccgugaa

SEQ ID NO: 109992 - RNA, 20 nt, Artificial Sequence
  MKO10109992_B_Prdm4
  gRNA
ccccccuuuaggacuuccag

SEQ ID NO: 109993 - RNA, 20 nt, Artificial Sequence
  MKO10109993_B_Prdm5
  gRNA
gugaacaaagcgaagccagu

SEQ ID NO: 109994 - RNA, 20 nt, Artificial Sequence
  MKO10109994_B_Prdm5
  gRNA
gaguucaaaugcgagaacug

SEQ ID NO: 109995 - RNA, 20 nt, Artificial Sequence
  MKO10109995_B_Prdm5
  gRNA
ugaccacucuaagggacagu

SEQ ID NO: 109996 - RNA, 20 nt, Artificial Sequence
  MKO10109996_B_Prdm6
  gRNA
cacagguugcgauaugugcg

SEQ ID NO: 109997 - RNA, 20 nt, Artificial Sequence
  MKO10109997_B_Prdm6
  gRNA
cacggagcgcugcuggcccg

SEQ ID NO: 109998 - RNA, 20 nt, Artificial Sequence
  MKO10109998_B_Prdm6
  gRNA
gaacgucccuuccaccguaa

SEQ ID NO: 109999 - RNA, 20 nt, Artificial Sequence
  MKO10109999_B_Prdm8
  gRNA
gguccaaucagcccgagaua

SEQ ID NO: 110000 - RNA, 20 nt, Artificial Sequence
  MKO10110000_B_Prdm8
  gRNA
uguucuaccgcucucuccgc

SEQ ID NO: 110001 - RNA, 20 nt, Artificial Sequence
  MKO10110001_B_Prdm8
  gRNA
gaacaguaccuuacaucuuc

SEQ ID NO: 110002 - RNA, 20 nt, Artificial Sequence
  MKO10110002_B_Prdm9
  gRNA
uucgcuauagaaaugugaaa

SEQ ID NO: 110003 - RNA, 20 nt, Artificial Sequence
  MKO10110003_B_Prdm9
  gRNA
gcuguuuacugugcuucacc

SEQ ID NO: 110004 - RNA, 20 nt, Artificial Sequence
  MKO10110004_B_Prdm9
  gRNA
accccaaauaaaugacagug

SEQ ID NO: 110005 - RNA, 20 nt, Artificial Sequence
  MKO10110005_B_Prdx1
  gRNA
guugaguuucuuaaauucau

SEQ ID NO: 110006 - RNA, 20 nt, Artificial Sequence
  MKO10110006_B_Prdx1
  gRNA
gacuccauaauccugagcaa

SEQ ID NO: 110007 - RNA, 20 nt, Artificial Sequence
  MKO10110007_B_Prdx1
  gRNA
auuaacacacccaagaaaca

SEQ ID NO: 110008 - RNA, 20 nt, Artificial Sequence
  MKO10110008_B_Prdx2
  gRNA
uuccuugcugucauccacau

SEQ ID NO: 110009 - RNA, 20 nt, Artificial Sequence
  MKO10110009_B_Prdx2
  gRNA
cugccgggcuuccagccagc

SEQ ID NO: 110010 - RNA, 20 nt, Artificial Sequence
  MKO10110010_B_Prdx2
  gRNA
cccaagccucccuccuuccg

SEQ ID NO: 110011 - RNA, 20 nt, Artificial Sequence
  MKO10110011_B_Prdx3
  gRNA
ccacaguaugucugucaaac

SEQ ID NO: 110012 - RNA, 20 nt, Artificial Sequence
  MKO10110012_B_Prdx3
  gRNA
aagcagauaucccgagacua

SEQ ID NO: 110013 - RNA, 20 nt, Artificial Sequence
  MKO10110013_B_Prdx3
  gRNA
gcgcgugcugggugacagca

SEQ ID NO: 110014 - RNA, 20 nt, Artificial Sequence
  MKO10110014_B_Prdx4
  gRNA
auuaauaccccucgaagaca

SEQ ID NO: 110015 - RNA, 20 nt, Artificial Sequence
  MKO10110015_B_Prdx4
  gRNA
ucuccaagccagcaccuuau

SEQ ID NO: 110016 - RNA, 20 nt, Artificial Sequence
  MKO10110016_B_Prdx4
  gRNA
cucaaacugacugacuaucg

SEQ ID NO: 110017 - RNA, 20 nt, Artificial Sequence
  MKO10110017_B_Prdx5
  gRNA
cugaccccacuggagccuuu

SEQ ID NO: 110018 - RNA, 20 nt, Artificial Sequence
  MKO10110018_B_Prdx5
  gRNA
auuuacaccuggcuguucua

SEQ ID NO: 110019 - RNA, 20 nt, Artificial Sequence
  MKO10110019_B_Prdx5
  gRNA
agucucaccuuagaacagcc

SEQ ID NO: 110020 - RNA, 20 nt, Artificial Sequence
  MKO10110020_B_Prdx6b
  gRNA
ccuucccgaccuccccgaag

SEQ ID NO: 110021 - RNA, 20 nt, Artificial Sequence
  MKO10110021_B_Prdx6b
  gRNA
guggaagcggauacggccga

SEQ ID NO: 110022 - RNA, 20 nt, Artificial Sequence
  MKO10110022_B_Prdx6b
  gRNA
ugguauuggccucaaagucg

SEQ ID NO: 110023 - RNA, 20 nt, Artificial Sequence
  MKO10110023_B_Prdx6
  gRNA
uucaccaaagagcucccguc

SEQ ID NO: 110024 - RNA, 20 nt, Artificial Sequence
  MKO10110024_B_Prdx6
  gRNA
ugccaccccaguugacugga

SEQ ID NO: 110025 - RNA, 20 nt, Artificial Sequence
  MKO10110025_B_Prdx6
  gRNA
cacacugggguaaagucccg

SEQ ID NO: 110026 - RNA, 20 nt, Artificial Sequence
  MKO10110026_B_Preb
  gRNA
cugauggucauguucguguc

SEQ ID NO: 110027 - RNA, 20 nt, Artificial Sequence
  MKO10110027_B_Preb
  gRNA
gcgguaugguguauuagaag

SEQ ID NO: 110028 - RNA, 20 nt, Artificial Sequence
  MKO10110028_B_Preb
  gRNA
gacacgggccaccaugaauu

SEQ ID NO: 110029 - RNA, 20 nt, Artificial Sequence
  MKO10110029_B_Prelid1
  gRNA
gccaggaauuuggucuugcc

SEQ ID NO: 110030 - RNA, 20 nt, Artificial Sequence
  MKO10110030_B_Prelid1
  gRNA
uggcgucuccagagcugucc

SEQ ID NO: 110031 - RNA, 20 nt, Artificial Sequence
  MKO10110031_B_Prelid1
  gRNA
agggcccucaccuuguagcu

SEQ ID NO: 110032 - RNA, 20 nt, Artificial Sequence
  MKO10110032_B_Prelid2
  gRNA
aaagcguagaaaauccaaau

SEQ ID NO: 110033 - RNA, 20 nt, Artificial Sequence
  MKO10110033_B_Prelid2
  gRNA
augcauacuguguccacgug

SEQ ID NO: 110034 - RNA, 20 nt, Artificial Sequence
  MKO10110034_B_Prelid2
  gRNA
ugucaucucuguaaaaacug

SEQ ID NO: 110035 - RNA, 20 nt, Artificial Sequence
  MKO10110035_B_Prelp
  gRNA
gaaaauuuccauccagccgc

SEQ ID NO: 110036 - RNA, 20 nt, Artificial Sequence
  MKO10110036_B_Prelp
  gRNA
gugacagccgaaaccugcga

SEQ ID NO: 110037 - RNA, 20 nt, Artificial Sequence
  MKO10110037_B_Prelp
  gRNA
uuaggcguaaacccaagccg

SEQ ID NO: 110038 - RNA, 20 nt, Artificial Sequence
  MKO10110038_B_Prepl
  gRNA
acgacuucguacucuuccug

SEQ ID NO: 110039 - RNA, 20 nt, Artificial Sequence
  MKO10110039_B_Prepl
  gRNA
acgacgcuuccauuacaggc

SEQ ID NO: 110040 - RNA, 20 nt, Artificial Sequence
  MKO10110040_B_Prepl
  gRNA
guacgaagucgucaaugcag

SEQ ID NO: 110041 - RNA, 20 nt, Artificial Sequence
  MKO10110041_B_Prep
  gRNA
gaacuugaucgucacccagu

SEQ ID NO: 110042 - RNA, 20 nt, Artificial Sequence
  MKO10110042_B_Prep
  gRNA
gaugguacaguggcacuccg

SEQ ID NO: 110043 - RNA, 20 nt, Artificial Sequence
  MKO10110043_B_Prep
  gRNA
accuuagucugcucgcuguc

SEQ ID NO: 110044 - RNA, 20 nt, Artificial Sequence
  MKO10110044_B_Prex1
  gRNA
cgggguguaagcaguacucc

SEQ ID NO: 110045 - RNA, 20 nt, Artificial Sequence
  MKO10110045_B_Prex1
  gRNA
gcagaauguggccgacucug

SEQ ID NO: 110046 - RNA, 20 nt, Artificial Sequence
  MKO10110046_B_Prex1
  gRNA
uuuguagagcugcaugcuuc

SEQ ID NO: 110047 - RNA, 20 nt, Artificial Sequence
  MKO10110047_B_Prex2
  gRNA
gauguuauucuccaauaucg

SEQ ID NO: 110048 - RNA, 20 nt, Artificial Sequence
  MKO10110048_B_Prex2
  gRNA
caaccuuugcugcugcacau

SEQ ID NO: 110049 - RNA, 20 nt, Artificial Sequence
  MKO10110049_B_Prex2
  gRNA
auauugcagcaaccaugaaa

SEQ ID NO: 110050 - RNA, 20 nt, Artificial Sequence
  MKO10110050_B_Prf1
  gRNA
caguagagugucgcauguac

SEQ ID NO: 110051 - RNA, 20 nt, Artificial Sequence
  MKO10110051_B_Prf1
  gRNA
cccgaagagcagaucaugcg

SEQ ID NO: 110052 - RNA, 20 nt, Artificial Sequence
  MKO10110052_B_Prf1
  gRNA
guacuucgacgugacgcuca

SEQ ID NO: 110053 - RNA, 20 nt, Artificial Sequence
  MKO10110053_B_Prg2
  gRNA
cagccucaccuugaguacac

SEQ ID NO: 110054 - RNA, 20 nt, Artificial Sequence
  MKO10110054_B_Prg2
  gRNA
cacagugagauagacgccag

SEQ ID NO: 110055 - RNA, 20 nt, Artificial Sequence
  MKO10110055_B_Prg2
  gRNA
cguggaccuucagugcccca

SEQ ID NO: 110056 - RNA, 20 nt, Artificial Sequence
  MKO10110056_B_Prg3
  gRNA
ugcaugaagcucuucgccaa

SEQ ID NO: 110057 - RNA, 20 nt, Artificial Sequence
  MKO10110057_B_Prg3
  gRNA
gauggacugauugaucuucc

SEQ ID NO: 110058 - RNA, 20 nt, Artificial Sequence
  MKO10110058_B_Prg3
  gRNA
gaugggagcugcugggauuu

SEQ ID NO: 110059 - RNA, 20 nt, Artificial Sequence
  MKO10110059_B_Prg4
  gRNA
gugcagacucucuugaaauc

SEQ ID NO: 110060 - RNA, 20 nt, Artificial Sequence
  MKO10110060_B_Prg4
  gRNA
uccuguugucuugauucaac

SEQ ID NO: 110061 - RNA, 20 nt, Artificial Sequence
  MKO10110061_B_Prg4
  gRNA
aaugccuugauugagucucc

SEQ ID NO: 110062 - RNA, 20 nt, Artificial Sequence
  MKO10110062_B_Prh1
  gRNA
gcuggugguccuguuuacag

SEQ ID NO: 110063 - RNA, 20 nt, Artificial Sequence
  MKO10110063_B_Prh1
  gRNA
ggugggccuugagugggacu

SEQ ID NO: 110064 - RNA, 20 nt, Artificial Sequence
  MKO10110064_B_Prh1
  gRNA
ggugggccuugaguaggucu

SEQ ID NO: 110065 - RNA, 20 nt, Artificial Sequence
  MKO10110065_B_Prickle1
  gRNA
cuucacguguaaugaacuac

SEQ ID NO: 110066 - RNA, 20 nt, Artificial Sequence
  MKO10110066_B_Prickle1
  gRNA
gaugcacgccgugugugagc

SEQ ID NO: 110067 - RNA, 20 nt, Artificial Sequence
  MKO10110067_B_Prickle1
  gRNA
ucucuucuucgcucaaagac

SEQ ID NO: 110068 - RNA, 20 nt, Artificial Sequence
  MKO10110068_B_Prickle2
  gRNA
gcugccgccccaugacaaug

SEQ ID NO: 110069 - RNA, 20 nt, Artificial Sequence
  MKO10110069_B_Prickle2
  gRNA
gguucgguauugcaacuccc

SEQ ID NO: 110070 - RNA, 20 nt, Artificial Sequence
  MKO10110070_B_Prickle2
  gRNA
ccuuuccccgucaccaugac

SEQ ID NO: 110071 - RNA, 20 nt, Artificial Sequence
  MKO10110071_B_Prickle3
  gRNA
gcuacccccacacgacagug

SEQ ID NO: 110072 - RNA, 20 nt, Artificial Sequence
  MKO10110072_B_Prickle3
  gRNA
cuccucaccucacugucgug

SEQ ID NO: 110073 - RNA, 20 nt, Artificial Sequence
  MKO10110073_B_Prickle3
  gRNA
cacaaaccucaucacacgcu

SEQ ID NO: 110074 - RNA, 20 nt, Artificial Sequence
  MKO10110074_B_Prim1
  gRNA
uggccaugcgcaucauagac

SEQ ID NO: 110075 - RNA, 20 nt, Artificial Sequence
  MKO10110075_B_Prim1
  gRNA
ggaguacuugagucuuguaa

SEQ ID NO: 110076 - RNA, 20 nt, Artificial Sequence
  MKO10110076_B_Prim1
  gRNA
gacacauacccuucaaugcc

SEQ ID NO: 110077 - RNA, 20 nt, Artificial Sequence
  MKO10110077_B_Prim2
  gRNA
ucugcuguagaucagugacg

SEQ ID NO: 110078 - RNA, 20 nt, Artificial Sequence
  MKO10110078_B_Prim2
  gRNA
aaacuugagcuuucgaaucu

SEQ ID NO: 110079 - RNA, 20 nt, Artificial Sequence
  MKO10110079_B_Prim2
  gRNA
cuuucacauagcucacaccg

SEQ ID NO: 110080 - RNA, 20 nt, Artificial Sequence
  MKO10110080_B_Prima1
  gRNA
cguucacauccaccccuuug

SEQ ID NO: 110081 - RNA, 20 nt, Artificial Sequence
  MKO10110081_B_Prima1
  gRNA
agcagccauggcgcagcacc

SEQ ID NO: 110082 - RNA, 20 nt, Artificial Sequence
  MKO10110082_B_Prima1
  gRNA
cccagacuacucuccgcccc

SEQ ID NO: 110083 - RNA, 20 nt, Artificial Sequence
  MKO10110083_B_Primpol
  gRNA
aauauuucagcuccacaaug

SEQ ID NO: 110084 - RNA, 20 nt, Artificial Sequence
  MKO10110084_B_Primpol
  gRNA
gagcguucacguauuugcuu

SEQ ID NO: 110085 - RNA, 20 nt, Artificial Sequence
  MKO10110085_B_Primpol
  gRNA
uuuaaagauaacaggcaugc

SEQ ID NO: 110086 - RNA, 20 nt, Artificial Sequence
  MKO10110086_B_Prkaa1
  gRNA
aaugcaaagauagccgacuu

SEQ ID NO: 110087 - RNA, 20 nt, Artificial Sequence
  MKO10110087_B_Prkaa1
  gRNA
cauucaugugugcaucaagc

SEQ ID NO: 110088 - RNA, 20 nt, Artificial Sequence
  MKO10110088_B_Prkaa1
  gRNA
uaccuuccugaaaugacuuc

SEQ ID NO: 110089 - RNA, 20 nt, Artificial Sequence
  MKO10110089_B_Prkaa2
  gRNA
acaggcauaugguuguccau

SEQ ID NO: 110090 - RNA, 20 nt, Artificial Sequence
  MKO10110090_B_Prkaa2
  gRNA
auucgcaguuuagauguugu

SEQ ID NO: 110091 - RNA, 20 nt, Artificial Sequence
  MKO10110091_B_Prkaa2
  gRNA
gccaaauuaugcagcaccug

SEQ ID NO: 110092 - RNA, 20 nt, Artificial Sequence
  MKO10110092_B_Prkab1
  gRNA
caaaagugcuccgauguguc

SEQ ID NO: 110093 - RNA, 20 nt, Artificial Sequence
  MKO10110093_B_Prkab1
  gRNA
gagcuguccagcucgccccc

SEQ ID NO: 110094 - RNA, 20 nt, Artificial Sequence
  MKO10110094_B_Prkab1
  gRNA
guggacccaugauccuucug

SEQ ID NO: 110095 - RNA, 20 nt, Artificial Sequence
  MKO10110095_B_Prkab2
  gRNA
guggguucaugauccgucag

SEQ ID NO: 110096 - RNA, 20 nt, Artificial Sequence
  MKO10110096_B_Prkab2
  gRNA
uucugugaagcccgcccagc

SEQ ID NO: 110097 - RNA, 20 nt, Artificial Sequence
  MKO10110097_B_Prkab2
  gRNA
caaaaucagauuucuugacg

SEQ ID NO: 110098 - RNA, 20 nt, Artificial Sequence
  MKO10110098_B_Prkaca
  gRNA
ggacaacucaaaccuguaca

SEQ ID NO: 110099 - RNA, 20 nt, Artificial Sequence
  MKO10110099_B_Prkaca
  gRNA
caccagcaucacucgcccaa

SEQ ID NO: 110100 - RNA, 20 nt, Artificial Sequence
  MKO10110100_B_Prkaca
  gRNA
acgggaaguugacggccugc

SEQ ID NO: 110101 - RNA, 20 nt, Artificial Sequence
  MKO10110101_B_Prkacb
  gRNA
caccaacaugacucuuccaa

SEQ ID NO: 110102 - RNA, 20 nt, Artificial Sequence
  MKO10110102_B_Prkacb
  gRNA
ggauaauucuaauuuauaca

SEQ ID NO: 110103 - RNA, 20 nt, Artificial Sequence
  MKO10110103_B_Prkacb
  gRNA
ugugagaacaucucuccccc

SEQ ID NO: 110104 - RNA, 20 nt, Artificial Sequence
  MKO10110104_B_Prkag1
  gRNA
agugucaaauaccaccaacu

SEQ ID NO: 110105 - RNA, 20 nt, Artificial Sequence
  MKO10110105_B_Prkag1
  gRNA
ccagggcugacuuauaguau

SEQ ID NO: 110106 - RNA, 20 nt, Artificial Sequence
  MKO10110106_B_Prkag1
  gRNA
aauguugaugaagucgguga

SEQ ID NO: 110107 - RNA, 20 nt, Artificial Sequence
  MKO10110107_B_Prkag2
  gRNA
cagauacuauaaaucaccca

SEQ ID NO: 110108 - RNA, 20 nt, Artificial Sequence
  MKO10110108_B_Prkag2
  gRNA
agccggcaugcuggagaagc

SEQ ID NO: 110109 - RNA, 20 nt, Artificial Sequence
  MKO10110109_B_Prkag2
  gRNA
gugauuuauaguaucugugu

SEQ ID NO: 110110 - RNA, 20 nt, Artificial Sequence
  MKO10110110_B_Prkag3
  gRNA
ccccacuucucggccugagu

SEQ ID NO: 110111 - RNA, 20 nt, Artificial Sequence
  MKO10110111_B_Prkag3
  gRNA
ccucacaccguuggccacca

SEQ ID NO: 110112 - RNA, 20 nt, Artificial Sequence
  MKO10110112_B_Prkag3
  gRNA
aguggggguccagagaguca

SEQ ID NO: 110113 - RNA, 20 nt, Artificial Sequence
  MKO10110113_B_Prkar1a
  gRNA
accuucucucguuaucauca

SEQ ID NO: 110114 - RNA, 20 nt, Artificial Sequence
  MKO10110114_B_Prkar1a
  gRNA
uuuccagucuccuuuauugc

SEQ ID NO: 110115 - RNA, 20 nt, Artificial Sequence
  MKO10110115_B_Prkar1a
  gRNA
aaccgucucuccagcaauaa

SEQ ID NO: 110116 - RNA, 20 nt, Artificial Sequence
  MKO10110116_B_Prkar1b
  gRNA
accuucucucguugucgucc

SEQ ID NO: 110117 - RNA, 20 nt, Artificial Sequence
  MKO10110117_B_Prkar1b
  gRNA
uccccaccgaugugagugac

SEQ ID NO: 110118 - RNA, 20 nt, Artificial Sequence
  MKO10110118_B_Prkar1b
  gRNA
aauuucuaugugauugacca

SEQ ID NO: 110119 - RNA, 20 nt, Artificial Sequence
  MKO10110119_B_Prkar2a
  gRNA
gacgagcaugucauugacca

SEQ ID NO: 110120 - RNA, 20 nt, Artificial Sequence
  MKO10110120_B_Prkar2a
  gRNA
guuuaacccugaugaagaag

SEQ ID NO: 110121 - RNA, 20 nt, Artificial Sequence
  MKO10110121_B_Prkar2a
  gRNA
cuuuacaagcuuccugaagc

SEQ ID NO: 110122 - RNA, 20 nt, Artificial Sequence
  MKO10110122_B_Prkar2b
  gRNA
gauccagguucuuaaacagc

SEQ ID NO: 110123 - RNA, 20 nt, Artificial Sequence
  MKO10110123_B_Prkar2b
  gRNA
agcuuauaauccugaugaag

SEQ ID NO: 110124 - RNA, 20 nt, Artificial Sequence
  MKO10110124_B_Prkar2b
  gRNA
caaucuguuucucugaucau

SEQ ID NO: 110125 - RNA, 20 nt, Artificial Sequence
  MKO10110125_B_Prkca
  gRNA
agauuacuuacgucaguguc

SEQ ID NO: 110126 - RNA, 20 nt, Artificial Sequence
  MKO10110126_B_Prkca
  gRNA
cucuauggacuuauccacca

SEQ ID NO: 110127 - RNA, 20 nt, Artificial Sequence
  MKO10110127_B_Prkca
  gRNA
uccaggggguuugggaaaca

SEQ ID NO: 110128 - RNA, 20 nt, Artificial Sequence
  MKO10110128_B_Prkcb
  gRNA
agguaggacuggaguacgug

SEQ ID NO: 110129 - RNA, 20 nt, Artificial Sequence
  MKO10110129_B_Prkcb
  gRNA
gcccuuguccgcaccggggc

SEQ ID NO: 110130 - RNA, 20 nt, Artificial Sequence
  MKO10110130_B_Prkcb
  gRNA
uuacaggggcuucgggaagc

SEQ ID NO: 110131 - RNA, 20 nt, Artificial Sequence
  MKO10110131_B_Prkcdbp
  gRNA
ccagucaagccgccacgcgu

SEQ ID NO: 110132 - RNA, 20 nt, Artificial Sequence
  MKO10110132_B_Prkcdbp
  gRNA
ccugugccugagacgcccgc

SEQ ID NO: 110133 - RNA, 20 nt, Artificial Sequence
  MKO10110133_B_Prkcdbp
  gRNA
cucgcacgccgacgcagccc

SEQ ID NO: 110134 - RNA, 20 nt, Artificial Sequence
  MKO10110134_B_Prkcd
  gRNA
uuuccaaccaugaaccgucg

SEQ ID NO: 110135 - RNA, 20 nt, Artificial Sequence
  MKO10110135_B_Prkcd
  gRNA
gggucuuacccccauccucc

SEQ ID NO: 110136 - RNA, 20 nt, Artificial Sequence
  MKO10110136_B_Prkcd
  gRNA
uucaggggccucaacaagca

SEQ ID NO: 110137 - RNA, 20 nt, Artificial Sequence
  MKO10110137_B_Prkce
  gRNA
guagguggguugccgcaagu

SEQ ID NO: 110138 - RNA, 20 nt, Artificial Sequence
  MKO10110138_B_Prkce
  gRNA
acaaugaagaacgaguguuc

SEQ ID NO: 110139 - RNA, 20 nt, Artificial Sequence
  MKO10110139_B_Prkce
  gRNA
cuuccuuucaggggugucau

SEQ ID NO: 110140 - RNA, 20 nt, Artificial Sequence
  MKO10110140_B_Prkcg
  gRNA
cugugugguccacaccgcaa

SEQ ID NO: 110141 - RNA, 20 nt, Artificial Sequence
  MKO10110141_B_Prkcg
  gRNA
ccuuuacgggcuggugcacc

SEQ ID NO: 110142 - RNA, 20 nt, Artificial Sequence
  MKO10110142_B_Prkcg
  gRNA
agcucuuaccuugacauugc

SEQ ID NO: 110143 - RNA, 20 nt, Artificial Sequence
  MKO10110143_B_Prkch
  gRNA
uuugugguaauaacccuaac

SEQ ID NO: 110144 - RNA, 20 nt, Artificial Sequence
  MKO10110144_B_Prkch
  gRNA
aggcuguaacaauuagauga

SEQ ID NO: 110145 - RNA, 20 nt, Artificial Sequence
  MKO10110145_B_Prkch
  gRNA
cuucagugaaacucccuguu

SEQ ID NO: 110146 - RNA, 20 nt, Artificial Sequence
  MKO10110146_B_Prkci
  gRNA
agcagccguucaccaugaaa

SEQ ID NO: 110147 - RNA, 20 nt, Artificial Sequence
  MKO10110147_B_Prkci
  gRNA
caaggcauuccaggacgcuc

SEQ ID NO: 110148 - RNA, 20 nt, Artificial Sequence
  MKO10110148_B_Prkci
  gRNA
caggcuguacgagcugaaca

SEQ ID NO: 110149 - RNA, 20 nt, Artificial Sequence
  MKO10110149_B_Prkcq
  gRNA
ugucaagugucacgaguuca

SEQ ID NO: 110150 - RNA, 20 nt, Artificial Sequence
  MKO10110150_B_Prkcq
  gRNA
uuacaggggccugaacaagc

SEQ ID NO: 110151 - RNA, 20 nt, Artificial Sequence
  MKO10110151_B_Prkcq
  gRNA
aucuugcauucauuagcauu

SEQ ID NO: 110152 - RNA, 20 nt, Artificial Sequence
  MKO10110152_B_Prkcsh
  gRNA
ccccagagagaagggucgca

SEQ ID NO: 110153 - RNA, 20 nt, Artificial Sequence
  MKO10110153_B_Prkcsh
  gRNA
ggcacagcugcuugucccaa

SEQ ID NO: 110154 - RNA, 20 nt, Artificial Sequence
  MKO10110154_B_Prkcsh
  gRNA
cacauaccccaucauugacc

SEQ ID NO: 110155 - RNA, 20 nt, Artificial Sequence
  MKO10110155_B_Prkcz
  gRNA
ccaguagaugacaagaacga

SEQ ID NO: 110156 - RNA, 20 nt, Artificial Sequence
  MKO10110156_B_Prkcz
  gRNA
uugcuuauauuucuucaucu

SEQ ID NO: 110157 - RNA, 20 nt, Artificial Sequence
  MKO10110157_B_Prkcz
  gRNA
uaauaucaaagaugauucug

SEQ ID NO: 110158 - RNA, 20 nt, Artificial Sequence
  MKO10110158_B_Prkd1
  gRNA
ccggaucuggaagucuucga

SEQ ID NO: 110159 - RNA, 20 nt, Artificial Sequence
  MKO10110159_B_Prkd1
  gRNA
cugugggggcuggugcguca

SEQ ID NO: 110160 - RNA, 20 nt, Artificial Sequence
  MKO10110160_B_Prkd1
  gRNA
ugucccugaugagccuuuac

SEQ ID NO: 110161 - RNA, 20 nt, Artificial Sequence
  MKO10110161_B_Prkd2
  gRNA
ccgccugucauccacgucuc

SEQ ID NO: 110162 - RNA, 20 nt, Artificial Sequence
  MKO10110162_B_Prkd2
  gRNA
gcgaucagcugcagauaucc

SEQ ID NO: 110163 - RNA, 20 nt, Artificial Sequence
  MKO10110163_B_Prkd2
  gRNA
gccguguguagcuauguaua

SEQ ID NO: 110164 - RNA, 20 nt, Artificial Sequence
  MKO10110164_B_Prkd3
  gRNA
cugacaggacaacuucuacc

SEQ ID NO: 110165 - RNA, 20 nt, Artificial Sequence
  MKO10110165_B_Prkd3
  gRNA
gaauguacauagagagcgug

SEQ ID NO: 110166 - RNA, 20 nt, Artificial Sequence
  MKO10110166_B_Prkd3
  gRNA
cugguagaaguuguccuguc

SEQ ID NO: 110167 - RNA, 20 nt, Artificial Sequence
  MKO10110167_B_Prkdc
  gRNA
gagaguaaugcauaaccuuc

SEQ ID NO: 110168 - RNA, 20 nt, Artificial Sequence
  MKO10110168_B_Prkdc
  gRNA
agccuuagaccuucugauua

SEQ ID NO: 110169 - RNA, 20 nt, Artificial Sequence
  MKO10110169_B_Prkdc
  gRNA
gcauuacucucuugauauua

SEQ ID NO: 110170 - RNA, 20 nt, Artificial Sequence
  MKO10110170_B_Prkg1
  gRNA
uguauguaccccguggaaua

SEQ ID NO: 110171 - RNA, 20 nt, Artificial Sequence
  MKO10110171_B_Prkg1
  gRNA
caucaagcauaccgaguaca

SEQ ID NO: 110172 - RNA, 20 nt, Artificial Sequence
  MKO10110172_B_Prkg1
  gRNA
cuauacuuuacaacuguacc

SEQ ID NO: 110173 - RNA, 20 nt, Artificial Sequence
  MKO10110173_B_Prkg2
  gRNA
ugcuaucauccaucccaaug

SEQ ID NO: 110174 - RNA, 20 nt, Artificial Sequence
  MKO10110174_B_Prkg2
  gRNA
aacagcccaagcccgggaug

SEQ ID NO: 110175 - RNA, 20 nt, Artificial Sequence
  MKO10110175_B_Prkg2
  gRNA
cgauuaccaauguuaaaacu

SEQ ID NO: 110176 - RNA, 20 nt, Artificial Sequence
  MKO10110176_B_Prkra
  gRNA
cagcugguucuucggcuguu

SEQ ID NO: 110177 - RNA, 20 nt, Artificial Sequence
  MKO10110177_B_Prkra
  gRNA
ugauucaagccugcagaucg

SEQ ID NO: 110178 - RNA, 20 nt, Artificial Sequence
  MKO10110178_B_Prkra
  gRNA
ggaucaggcauuaagggguc

SEQ ID NO: 110179 - RNA, 20 nt, Artificial Sequence
  MKO10110179_B_Prkrip1
  gRNA
acaaauucuggaggcgcucg

SEQ ID NO: 110180 - RNA, 20 nt, Artificial Sequence
  MKO10110180_B_Prkrip1
  gRNA
agaauuuguccgagauguca

SEQ ID NO: 110181 - RNA, 20 nt, Artificial Sequence
  MKO10110181_B_Prkrip1
  gRNA
aaagaauaaaauugcugcag

SEQ ID NO: 110182 - RNA, 20 nt, Artificial Sequence
  MKO10110182_B_Prkrir
  gRNA
uacaauucucaacccacuuc

SEQ ID NO: 110183 - RNA, 20 nt, Artificial Sequence
  MKO10110183_B_Prkrir
  gRNA
uacaguucuacaaaucauag

SEQ ID NO: 110184 - RNA, 20 nt, Artificial Sequence
  MKO10110184_B_Prkrir
  gRNA
uuuagagugaagaugaaauc

SEQ ID NO: 110185 - RNA, 20 nt, Artificial Sequence
  MKO10110185_B_Prkx
  gRNA
agaugucauccgccugaaac

SEQ ID NO: 110186 - RNA, 20 nt, Artificial Sequence
  MKO10110186_B_Prkx
  gRNA
ugggauacucauaaucuuca

SEQ ID NO: 110187 - RNA, 20 nt, Artificial Sequence
  MKO10110187_B_Prkx
  gRNA
agaggugaaauccaauuguc

SEQ ID NO: 110188 - RNA, 20 nt, Artificial Sequence
  MKO10110188_B_Prl2a1
  gRNA
ucucucgaccuuccaaaacc

SEQ ID NO: 110189 - RNA, 20 nt, Artificial Sequence
  MKO10110189_B_Prl2a1
  gRNA
uccauuccuuacugagcaua

SEQ ID NO: 110190 - RNA, 20 nt, Artificial Sequence
  MKO10110190_B_Prl2a1
  gRNA
ugcugcccauaugcucagua

SEQ ID NO: 110191 - RNA, 20 nt, Artificial Sequence
  MKO10110191_B_Prl2b1
  gRNA
gccagaaacacuauugacau

SEQ ID NO: 110192 - RNA, 20 nt, Artificial Sequence
  MKO10110192_B_Prl2b1
  gRNA
ucagaauaaucaguaugccc

SEQ ID NO: 110193 - RNA, 20 nt, Artificial Sequence
  MKO10110193_B_Prl2b1
  gRNA
caaagaugccaguccagacc

SEQ ID NO: 110194 - RNA, 20 nt, Artificial Sequence
  MKO10110194_B_Prl2c1
  gRNA
ucgcucacuagaucauccag

SEQ ID NO: 110195 - RNA, 20 nt, Artificial Sequence
  MKO10110195_B_Prl2c1
  gRNA
auucuuccacaauaacaagu

SEQ ID NO: 110196 - RNA, 20 nt, Artificial Sequence
  MKO10110196_B_Prl2c1
  gRNA
gaaagaaguauggcaucucg

SEQ ID NO: 110197 - RNA, 20 nt, Artificial Sequence
  MKO10110197_B_Prl2c2
  gRNA
aaacauuauucuaacguguc

SEQ ID NO: 110198 - RNA, 20 nt, Artificial Sequence
  MKO10110198_B_Prl2c2
  gRNA
caaacucacgugugugagcc

SEQ ID NO: 110199 - RNA, 20 nt, Artificial Sequence
  MKO10110199_B_Prl2c2
  gRNA
uacucaccauggugcucaug

SEQ ID NO: 110200 - RNA, 20 nt, Artificial Sequence
  MKO10110200_B_Prl2c3
  gRNA
caaacucacgugugugagcc

SEQ ID NO: 110201 - RNA, 20 nt, Artificial Sequence
  MKO10110201_B_Prl2c3
  gRNA
uaugcagcucuucugaaauc

SEQ ID NO: 110202 - RNA, 20 nt, Artificial Sequence
  MKO10110202_B_Prl2c3
  gRNA
uacucaccauggugcucaug

SEQ ID NO: 110203 - RNA, 20 nt, Artificial Sequence
  MKO10110203_B_Prl2c4
  gRNA
caaacucacgugugugagcc

SEQ ID NO: 110204 - RNA, 20 nt, Artificial Sequence
  MKO10110204_B_Prl2c4
  gRNA
uaugcagcucuucugaaauc

SEQ ID NO: 110205 - RNA, 20 nt, Artificial Sequence
  MKO10110205_B_Prl2c4
  gRNA
uacucaccauggugcucaug

SEQ ID NO: 110206 - RNA, 20 nt, Artificial Sequence
  MKO10110206_B_Prl2c5
  gRNA
aagaucaacgcaguccagaa

SEQ ID NO: 110207 - RNA, 20 nt, Artificial Sequence
  MKO10110207_B_Prl2c5
  gRNA
aucauuccucauugcacaca

SEQ ID NO: 110208 - RNA, 20 nt, Artificial Sequence
  MKO10110208_B_Prl2c5
  gRNA
cauugcccaugugugcaaug

SEQ ID NO: 110209 - RNA, 20 nt, Artificial Sequence
  MKO10110209_B_Prl3a1
  gRNA
caugcccaugugcuuugaca

SEQ ID NO: 110210 - RNA, 20 nt, Artificial Sequence
  MKO10110210_B_Prl3a1
  gRNA
ccucaccacacaaaugucug

SEQ ID NO: 110211 - RNA, 20 nt, Artificial Sequence
  MKO10110211_B_Prl3a1
  gRNA
cuugagagcuucaagauaag

SEQ ID NO: 110212 - RNA, 20 nt, Artificial Sequence
  MKO10110212_B_Prl3b1
  gRNA
uaugaacaucacgacacuuc

SEQ ID NO: 110213 - RNA, 20 nt, Artificial Sequence
  MKO10110213_B_Prl3b1
  gRNA
guucuugacagcagaguauc

SEQ ID NO: 110214 - RNA, 20 nt, Artificial Sequence
  MKO10110214_B_Prl3b1
  gRNA
uguggcaggggcuuaacauc

SEQ ID NO: 110215 - RNA, 20 nt, Artificial Sequence
  MKO10110215_B_Prl3c1
  gRNA
agagcuguagagcuuaacua

SEQ ID NO: 110216 - RNA, 20 nt, Artificial Sequence
  MKO10110216_B_Prl3c1
  gRNA
uggaggaccucaauucucuu

SEQ ID NO: 110217 - RNA, 20 nt, Artificial Sequence
  MKO10110217_B_Prl3c1
  gRNA
gagcaaaagcuuuacuuagu

SEQ ID NO: 110218 - RNA, 20 nt, Artificial Sequence
  MKO10110218_B_Prl3d1
  gRNA
gaagucccuccagaauuaca

SEQ ID NO: 110219 - RNA, 20 nt, Artificial Sequence
  MKO10110219_B_Prl3d1
  gRNA
aucuaugccgcugcauuaaa

SEQ ID NO: 110220 - RNA, 20 nt, Artificial Sequence
  MKO10110220_B_Prl3d1
  gRNA
aaauucccuauacacaucug

SEQ ID NO: 110221 - RNA, 20 nt, Artificial Sequence
  MKO10110221_B_Prl3d2
  gRNA
gaaaaccuacuuuaauuuca

SEQ ID NO: 110222 - RNA, 20 nt, Artificial Sequence
  MKO10110222_B_Prl3d2
  gRNA
ccucucgauucucuggagua

SEQ ID NO: 110223 - RNA, 20 nt, Artificial Sequence
  MKO10110223_B_Prl3d2
  gRNA
gaagucccuccagaauuaua

SEQ ID NO: 110224 - RNA, 20 nt, Artificial Sequence
  MKO10110224_B_Prl3d3
  gRNA
ccucucgauucucuggagua

SEQ ID NO: 110225 - RNA, 20 nt, Artificial Sequence
  MKO10110225_B_Prl3d3
  gRNA
gaagucccuccagaauuaua

SEQ ID NO: 110226 - RNA, 20 nt, Artificial Sequence
  MKO10110226_B_Prl3d3
  gRNA
ugaucaauguuucaauuucc

SEQ ID NO: 110227 - RNA, 20 nt, Artificial Sequence
  MKO10110227_B_Prl4a1
  gRNA
cugauuccacguguucccaa

SEQ ID NO: 110228 - RNA, 20 nt, Artificial Sequence
  MKO10110228_B_Prl4a1
  gRNA
gaaaaaagacucgagucaug

SEQ ID NO: 110229 - RNA, 20 nt, Artificial Sequence
  MKO10110229_B_Prl4a1
  gRNA
caagaguuccaauucagacc

SEQ ID NO: 110230 - RNA, 20 nt, Artificial Sequence
  MKO10110230_B_Prl5a1
  gRNA
gucacauucagaagcaccac

SEQ ID NO: 110231 - RNA, 20 nt, Artificial Sequence
  MKO10110231_B_Prl5a1
  gRNA
cuugaacaaugaugcacaga

SEQ ID NO: 110232 - RNA, 20 nt, Artificial Sequence
  MKO10110232_B_Prl5a1
  gRNA
aaaaugaagacuacccugcc

SEQ ID NO: 110233 - RNA, 20 nt, Artificial Sequence
  MKO10110233_B_Prl6a1
  gRNA
guaagauugacucuaguauc

SEQ ID NO: 110234 - RNA, 20 nt, Artificial Sequence
  MKO10110234_B_Prl6a1
  gRNA
ugaucaguauguugacagcu

SEQ ID NO: 110235 - RNA, 20 nt, Artificial Sequence
  MKO10110235_B_Prl6a1
  gRNA
guacuuauagaagcucuuag

SEQ ID NO: 110236 - RNA, 20 nt, Artificial Sequence
  MKO10110236_B_Prl7a1
  gRNA
uuuagcugacaucucacuga

SEQ ID NO: 110237 - RNA, 20 nt, Artificial Sequence
  MKO10110237_B_Prl7a1
  gRNA
caugguugagugaaagacag

SEQ ID NO: 110238 - RNA, 20 nt, Artificial Sequence
  MKO10110238_B_Prl7a1
  gRNA
gaauaucacugaccucaaca

SEQ ID NO: 110239 - RNA, 20 nt, Artificial Sequence
  MKO10110239_B_Prl7a2
  gRNA
ucuugcgcaguuccauguug

SEQ ID NO: 110240 - RNA, 20 nt, Artificial Sequence
  MKO10110240_B_Prl7a2
  gRNA
auuagcaggggcacuucugc

SEQ ID NO: 110241 - RNA, 20 nt, Artificial Sequence
  MKO10110241_B_Prl7a2
  gRNA
acagaugcuugacuuuauug

SEQ ID NO: 110242 - RNA, 20 nt, Artificial Sequence
  MKO10110242_B_Prl7b1
  gRNA
ucuucaugaugcgauccaga

SEQ ID NO: 110243 - RNA, 20 nt, Artificial Sequence
  MKO10110243_B_Prl7b1
  gRNA
caugaugaauuuguugucaa

SEQ ID NO: 110244 - RNA, 20 nt, Artificial Sequence
  MKO10110244_B_Prl7b1
  gRNA
caugucugaugagaaauuau

SEQ ID NO: 110245 - RNA, 20 nt, Artificial Sequence
  MKO10110245_B_Prl7c1
  gRNA
ccucaguguuccagaaaccu

SEQ ID NO: 110246 - RNA, 20 nt, Artificial Sequence
  MKO10110246_B_Prl7c1
  gRNA
ccaagguuucuggaacacug

SEQ ID NO: 110247 - RNA, 20 nt, Artificial Sequence
  MKO10110247_B_Prl7c1
  gRNA
uuacccugcugaguaucauc

SEQ ID NO: 110248 - RNA, 20 nt, Artificial Sequence
  MKO10110248_B_Prl7d1
  gRNA
ccuuugauaggauccuauaa

SEQ ID NO: 110249 - RNA, 20 nt, Artificial Sequence
  MKO10110249_B_Prl7d1
  gRNA
gauaaugccacuguacuuuc

SEQ ID NO: 110250 - RNA, 20 nt, Artificial Sequence
  MKO10110250_B_Prl7d1
  gRNA
ugcacccauaaaugccagug

SEQ ID NO: 110251 - RNA, 20 nt, Artificial Sequence
  MKO10110251_B_Prl8a1
  gRNA
ugcaggcacauuccuacugu

SEQ ID NO: 110252 - RNA, 20 nt, Artificial Sequence
  MKO10110252_B_Prl8a1
  gRNA
cauuguuaaauguuucuaca

SEQ ID NO: 110253 - RNA, 20 nt, Artificial Sequence
  MKO10110253_B_Prl8a1
  gRNA
uacaaagugugugaaguguc

SEQ ID NO: 110254 - RNA, 20 nt, Artificial Sequence
  MKO10110254_B_Prl8a2
  gRNA
ugaugacuucagcucgcuga

SEQ ID NO: 110255 - RNA, 20 nt, Artificial Sequence
  MKO10110255_B_Prl8a2
  gRNA
guggguuugugacauuagag

SEQ ID NO: 110256 - RNA, 20 nt, Artificial Sequence
  MKO10110256_B_Prl8a2
  gRNA
uaccacaacccauucucagc

SEQ ID NO: 110257 - RNA, 20 nt, Artificial Sequence
  MKO10110257_B_Prl8a6
  gRNA
ugguugcuggaacccacuuu

SEQ ID NO: 110258 - RNA, 20 nt, Artificial Sequence
  MKO10110258_B_Prl8a6
  gRNA
uggugucaaauuugcuguug

SEQ ID NO: 110259 - RNA, 20 nt, Artificial Sequence
  MKO10110259_B_Prl8a6
  gRNA
guuguucucuucgaucuccu

SEQ ID NO: 110260 - RNA, 20 nt, Artificial Sequence
  MKO10110260_B_Prl8a8
  gRNA
auguauugaauucccuuauu

SEQ ID NO: 110261 - RNA, 20 nt, Artificial Sequence
  MKO10110261_B_Prl8a8
  gRNA
aguuugacaacaguagcagc

SEQ ID NO: 110262 - RNA, 20 nt, Artificial Sequence
  MKO10110262_B_Prl8a8
  gRNA
ccucagugauuauccaccua

SEQ ID NO: 110263 - RNA, 20 nt, Artificial Sequence
  MKO10110263_B_Prl8a9
  gRNA
cuguuaaauguuuccacgag

SEQ ID NO: 110264 - RNA, 20 nt, Artificial Sequence
  MKO10110264_B_Prl8a9
  gRNA
cauucaguucaauuacuaca

SEQ ID NO: 110265 - RNA, 20 nt, Artificial Sequence
  MKO10110265_B_Prl8a9
  gRNA
aaaaacuuugaucaacuaug

SEQ ID NO: 110266 - RNA, 20 nt, Artificial Sequence
  MKO10110266_B_Prlhr
  gRNA
gccaacgccagaucuacgcc

SEQ ID NO: 110267 - RNA, 20 nt, Artificial Sequence
  MKO10110267_B_Prlhr
  gRNA
gcgcgaucaccagcacaagc

SEQ ID NO: 110268 - RNA, 20 nt, Artificial Sequence
  MKO10110268_B_Prlhr
  gRNA
uuucaaccuauugcgagacc

SEQ ID NO: 110269 - RNA, 20 nt, Artificial Sequence
  MKO10110269_B_Prlh
  gRNA
ccgagcccaccagcacucca

SEQ ID NO: 110270 - RNA, 20 nt, Artificial Sequence
  MKO10110270_B_Prlh
  gRNA
augucaccggaccuggccug

SEQ ID NO: 110271 - RNA, 20 nt, Artificial Sequence
  MKO10110271_B_Prlh
  gRNA
ccccugacaucaauccugcc

SEQ ID NO: 110272 - RNA, 20 nt, Artificial Sequence
  MKO10110272_B_Prlr
  gRNA
caaaugucguuccccugaca

SEQ ID NO: 110273 - RNA, 20 nt, Artificial Sequence
  MKO10110273_B_Prlr
  gRNA
guuguuucacuucuaaaguc

SEQ ID NO: 110274 - RNA, 20 nt, Artificial Sequence
  MKO10110274_B_Prlr
  gRNA
caguugaaccagagccuccu

SEQ ID NO: 110275 - RNA, 20 nt, Artificial Sequence
  MKO10110275_B_Prl
  gRNA
guugcgcaaagacaagauuu

SEQ ID NO: 110276 - RNA, 20 nt, Artificial Sequence
  MKO10110276_B_Prl
  gRNA
ccuugucuucagguguagcc

SEQ ID NO: 110277 - RNA, 20 nt, Artificial Sequence
  MKO10110277_B_Prl
  gRNA
cucuugauaggauguauucg

SEQ ID NO: 110278 - RNA, 20 nt, Artificial Sequence
  MKO10110278_B_Prm1
  gRNA
ggaggcgaugcugccggcgg

SEQ ID NO: 110279 - RNA, 20 nt, Artificial Sequence
  MKO10110279_B_Prm1
  gRNA
acuuacuucgccuccuccgc

SEQ ID NO: 110280 - RNA, 20 nt, Artificial Sequence
  MKO10110280_B_Prm1
  gRNA
gaugcugccgcagcaaaagc

SEQ ID NO: 110281 - RNA, 20 nt, Artificial Sequence
  MKO10110281_B_Prm2
  gRNA
accugcaucuccuccuccuu

SEQ ID NO: 110282 - RNA, 20 nt, Artificial Sequence
  MKO10110282_B_Prm2
  gRNA
ccccagugaggguccgcacc

SEQ ID NO: 110283 - RNA, 20 nt, Artificial Sequence
  MKO10110283_B_Prm2
  gRNA
gccccugcuccucgcguuca

SEQ ID NO: 110284 - RNA, 20 nt, Artificial Sequence
  MKO10110284_B_Prm3
  gRNA
gcuucuucauggaggacucg

SEQ ID NO: 110285 - RNA, 20 nt, Artificial Sequence
  MKO10110285_B_Prm3
  gRNA
cacggcugugaccaguguuc

SEQ ID NO: 110286 - RNA, 20 nt, Artificial Sequence
  MKO10110286_B_Prm3
  gRNA
cuuccucgcccucugaugac

SEQ ID NO: 110287 - RNA, 20 nt, Artificial Sequence
  MKO10110287_B_Prmt10
  gRNA
ugaacucgccugugauguag

SEQ ID NO: 110288 - RNA, 20 nt, Artificial Sequence
  MKO10110288_B_Prmt10
  gRNA
guaacagaaacugucgaugc

SEQ ID NO: 110289 - RNA, 20 nt, Artificial Sequence
  MKO10110289_B_Prmt10
  gRNA
aaccaaguaagucuuguauu

SEQ ID NO: 110290 - RNA, 20 nt, Artificial Sequence
  MKO10110290_B_Prmt1
  gRNA
uagugagaagcccaacgcug

SEQ ID NO: 110291 - RNA, 20 nt, Artificial Sequence
  MKO10110291_B_Prmt1
  gRNA
gacuuaccccaauaaccuug

SEQ ID NO: 110292 - RNA, 20 nt, Artificial Sequence
  MKO10110292_B_Prmt1
  gRNA
ggagucaaaguaguagucuu

SEQ ID NO: 110293 - RNA, 20 nt, Artificial Sequence
  MKO10110293_B_Prmt2
  gRNA
gcaauggccacgaacuccuc

SEQ ID NO: 110294 - RNA, 20 nt, Artificial Sequence
  MKO10110294_B_Prmt2
  gRNA
ucuucugcgcacaccaugcc

SEQ ID NO: 110295 - RNA, 20 nt, Artificial Sequence
  MKO10110295_B_Prmt2
  gRNA
acacacucaccgccuugggc

SEQ ID NO: 110296 - RNA, 20 nt, Artificial Sequence
  MKO10110296_B_Prmt3
  gRNA
ccauauauaacccugugccu

SEQ ID NO: 110297 - RNA, 20 nt, Artificial Sequence
  MKO10110297_B_Prmt3
  gRNA
ucaauuuaauauugauagua

SEQ ID NO: 110298 - RNA, 20 nt, Artificial Sequence
  MKO10110298_B_Prmt3
  gRNA
ugaaaacguuuccucagcag

SEQ ID NO: 110299 - RNA, 20 nt, Artificial Sequence
  MKO10110299_B_Prmt5
  gRNA
uuaccgcuucagaguuccuu

SEQ ID NO: 110300 - RNA, 20 nt, Artificial Sequence
  MKO10110300_B_Prmt5
  gRNA
uuuccuauugccccuuaauc

SEQ ID NO: 110301 - RNA, 20 nt, Artificial Sequence
  MKO10110301_B_Prmt5
  gRNA
uguguuucaggcuauguuac

SEQ ID NO: 110302 - RNA, 20 nt, Artificial Sequence
  MKO10110302_B_Prmt6
  gRNA
cucuacaugguuucgccguc

SEQ ID NO: 110303 - RNA, 20 nt, Artificial Sequence
  MKO10110303_B_Prmt6
  gRNA
aagaacugggccgcgcugcg

SEQ ID NO: 110304 - RNA, 20 nt, Artificial Sequence
  MKO10110304_B_Prmt6
  gRNA
ggaccgcgugcacguccugc

SEQ ID NO: 110305 - RNA, 20 nt, Artificial Sequence
  MKO10110305_B_Prmt7
  gRNA
gucuuugucauguagcaugu

SEQ ID NO: 110306 - RNA, 20 nt, Artificial Sequence
  MKO10110306_B_Prmt7
  gRNA
ucgugcuaacauucugauca

SEQ ID NO: 110307 - RNA, 20 nt, Artificial Sequence
  MKO10110307_B_Prmt7
  gRNA
cauuaacaagcacuccacug

SEQ ID NO: 110308 - RNA, 20 nt, Artificial Sequence
  MKO10110308_B_Prmt8
  gRNA
cuccgaguagucagaaauac

SEQ ID NO: 110309 - RNA, 20 nt, Artificial Sequence
  MKO10110309_B_Prmt8
  gRNA
uucgacucauacgcucacuu

SEQ ID NO: 110310 - RNA, 20 nt, Artificial Sequence
  MKO10110310_B_Prmt8
  gRNA
guccaagcugcugaaccccg

SEQ ID NO: 110311 - RNA, 20 nt, Artificial Sequence
  MKO10110311_B_Prnd
  gRNA
cggaagcuggacaucgacuu

SEQ ID NO: 110312 - RNA, 20 nt, Artificial Sequence
  MKO10110312_B_Prnd
  gRNA
cagcugcgucaacgccaccc

SEQ ID NO: 110313 - RNA, 20 nt, Artificial Sequence
  MKO10110313_B_Prnd
  gRNA
ccuucguaguagaucccauc

SEQ ID NO: 110314 - RNA, 20 nt, Artificial Sequence
  MKO10110314_B_Prnp
  gRNA
acccuaaccaaguguacuac

SEQ ID NO: 110315 - RNA, 20 nt, Artificial Sequence
  MKO10110315_B_Prnp
  gRNA
uggaagccgguaucccgggc

SEQ ID NO: 110316 - RNA, 20 nt, Artificial Sequence
  MKO10110316_B_Prnp
  gRNA
agucccaggccuauuacgac

SEQ ID NO: 110317 - RNA, 20 nt, Artificial Sequence
  MKO10110317_B_Prn
  gRNA
ugcgacgcagcgcccagaau

SEQ ID NO: 110318 - RNA, 20 nt, Artificial Sequence
  MKO10110318_B_Prn
  gRNA
ucugcugauccgacaacgcg

SEQ ID NO: 110319 - RNA, 20 nt, Artificial Sequence
  MKO10110319_B_Prn
  gRNA
augcuucagcucgguugaaa

SEQ ID NO: 110320 - RNA, 20 nt, Artificial Sequence
  MKO10110320_B_Prob1
  gRNA
ucuguucaaccgcuccgacg

SEQ ID NO: 110321 - RNA, 20 nt, Artificial Sequence
  MKO10110321_B_Prob1
  gRNA
cgcacuugagucgcccgccc

SEQ ID NO: 110322 - RNA, 20 nt, Artificial Sequence
  MKO10110322_B_Prob1
  gRNA
ucuguguccggcccaacguc

SEQ ID NO: 110323 - RNA, 20 nt, Artificial Sequence
  MKO10110323_B_Proca1
  gRNA
accuagauucacagucgcau

SEQ ID NO: 110324 - RNA, 20 nt, Artificial Sequence
  MKO10110324_B_Proca1
  gRNA
guauaugacagaugacgauc

SEQ ID NO: 110325 - RNA, 20 nt, Artificial Sequence
  MKO10110325_B_Proca1
  gRNA
agagcgaguacaguugugaa

SEQ ID NO: 110326 - RNA, 20 nt, Artificial Sequence
  MKO10110326_B_Procr
  gRNA
cgcgauauaccagcuucacc

SEQ ID NO: 110327 - RNA, 20 nt, Artificial Sequence
  MKO10110327_B_Procr
  gRNA
ccugcaguucauaccgaguc

SEQ ID NO: 110328 - RNA, 20 nt, Artificial Sequence
  MKO10110328_B_Procr
  gRNA
augggcuguuucauaaucgc

SEQ ID NO: 110329 - RNA, 20 nt, Artificial Sequence
  MKO10110329_B_Proc
  gRNA
cuucagcugcagcugcgaua

SEQ ID NO: 110330 - RNA, 20 nt, Artificial Sequence
  MKO10110330_B_Proc
  gRNA
cacgucugacccgaagcacc

SEQ ID NO: 110331 - RNA, 20 nt, Artificial Sequence
  MKO10110331_B_Proc
  gRNA
cagcagcgagcaugcccacc

SEQ ID NO: 110332 - RNA, 20 nt, Artificial Sequence
  MKO10110332_B_Prodh2
  gRNA
ccuuacccgacccgagucca

SEQ ID NO: 110333 - RNA, 20 nt, Artificial Sequence
  MKO10110333_B_Prodh2
  gRNA
ccucgguggguacugccaac

SEQ ID NO: 110334 - RNA, 20 nt, Artificial Sequence
  MKO10110334_B_Prodh2
  gRNA
gaagaagugcgccugagagc

SEQ ID NO: 110335 - RNA, 20 nt, Artificial Sequence
  MKO10110335_B_Prodh
  gRNA
ucuuugcgcuccgccuccuc

SEQ ID NO: 110336 - RNA, 20 nt, Artificial Sequence
  MKO10110336_B_Prodh
  gRNA
gaacuuacugcagugcauca

SEQ ID NO: 110337 - RNA, 20 nt, Artificial Sequence
  MKO10110337_B_Prodh
  gRNA
ccccagugcagugagcuuaa

SEQ ID NO: 110338 - RNA, 20 nt, Artificial Sequence
  MKO10110338_B_Prok1
  gRNA
ccugcgguuguguaccccac

SEQ ID NO: 110339 - RNA, 20 nt, Artificial Sequence
  MKO10110339_B_Prok1
  gRNA
cccugugaugaccgcacagu

SEQ ID NO: 110340 - RNA, 20 nt, Artificial Sequence
  MKO10110340_B_Prok1
  gRNA
acggcagguaccgcugcuuc

SEQ ID NO: 110341 - RNA, 20 nt, Artificial Sequence
  MKO10110341_B_Prok2
  gRNA
uccgggccaagcaaauaaac

SEQ ID NO: 110342 - RNA, 20 nt, Artificial Sequence
  MKO10110342_B_Prok2
  gRNA
guccuuaaacacgccaagcc

SEQ ID NO: 110343 - RNA, 20 nt, Artificial Sequence
  MKO10110343_B_Prok2
  gRNA
gguggcagcugucgcccacu

SEQ ID NO: 110344 - RNA, 20 nt, Artificial Sequence
  MKO10110344_B_Prokr1
  gRNA
caaccugcuuaucgccaacc

SEQ ID NO: 110345 - RNA, 20 nt, Artificial Sequence
  MKO10110345_B_Prokr1
  gRNA
cacgggaauaccugccaccg

SEQ ID NO: 110346 - RNA, 20 nt, Artificial Sequence
  MKO10110346_B_Prokr1
  gRNA
uugugcacccgcugagaccg

SEQ ID NO: 110347 - RNA, 20 nt, Artificial Sequence
  MKO10110347_B_Prokr2
  gRNA
aagcacgugaccaugcgccc

SEQ ID NO: 110348 - RNA, 20 nt, Artificial Sequence
  MKO10110348_B_Prokr2
  gRNA
aaugcacuccacgacguaga

SEQ ID NO: 110349 - RNA, 20 nt, Artificial Sequence
  MKO10110349_B_Prokr2
  gRNA
agacggagcaaauccgcaag

SEQ ID NO: 110350 - RNA, 20 nt, Artificial Sequence
  MKO10110350_B_Prol1
  gRNA
aauaugaaguaagagccaac

SEQ ID NO: 110351 - RNA, 20 nt, Artificial Sequence
  MKO10110351_B_Prol1
  gRNA
gacuugugaugacuuucacc

SEQ ID NO: 110352 - RNA, 20 nt, Artificial Sequence
  MKO10110352_B_Prol1
  gRNA
aucagcauuaagguaguucc

SEQ ID NO: 110353 - RNA, 20 nt, Artificial Sequence
  MKO10110353_B_Prom1
  gRNA
cagccgaaugacuucccucu

SEQ ID NO: 110354 - RNA, 20 nt, Artificial Sequence
  MKO10110354_B_Prom1
  gRNA
uacagccuuggcauuauaua

SEQ ID NO: 110355 - RNA, 20 nt, Artificial Sequence
  MKO10110355_B_Prom1
  gRNA
uuguggcuaaccagcagacc

SEQ ID NO: 110356 - RNA, 20 nt, Artificial Sequence
  MKO10110356_B_Prom2
  gRNA
cuccuauuggugcccaucac

SEQ ID NO: 110357 - RNA, 20 nt, Artificial Sequence
  MKO10110357_B_Prom2
  gRNA
gagacccugcucagccuaag

SEQ ID NO: 110358 - RNA, 20 nt, Artificial Sequence
  MKO10110358_B_Prom2
  gRNA
cuuaggcugagcagggucuc

SEQ ID NO: 110359 - RNA, 20 nt, Artificial Sequence
  MKO10110359_B_Prop1
  gRNA
ccaucaggaaaagcaaacga

SEQ ID NO: 110360 - RNA, 20 nt, Artificial Sequence
  MKO10110360_B_Prop1
  gRNA
ggaaccaguauccugacauc

SEQ ID NO: 110361 - RNA, 20 nt, Artificial Sequence
  MKO10110361_B_Prop1
  gRNA
cucguggcucaggcagggau

SEQ ID NO: 110362 - RNA, 20 nt, Artificial Sequence
  MKO10110362_B_Prorsd1
  gRNA
uaaaacuacaguuccucuuu

SEQ ID NO: 110363 - RNA, 20 nt, Artificial Sequence
  MKO10110363_B_Prorsd1
  gRNA
ugcgggcugaguuagaacag

SEQ ID NO: 110364 - RNA, 20 nt, Artificial Sequence
  MKO10110364_B_Prorsd1
  gRNA
agaggggaaaauggcaggcu

SEQ ID NO: 110365 - RNA, 20 nt, Artificial Sequence
  MKO10110365_B_Pros1
  gRNA
uagcugacugccucgcagca

SEQ ID NO: 110366 - RNA, 20 nt, Artificial Sequence
  MKO10110366_B_Pros1
  gRNA
ccuauaccaugcaaugaaga

SEQ ID NO: 110367 - RNA, 20 nt, Artificial Sequence
  MKO10110367_B_Pros1
  gRNA
agggucacauuggucugaga

SEQ ID NO: 110368 - RNA, 20 nt, Artificial Sequence
  MKO10110368_B_Prosc
  gRNA
gccgccgcgccacacucugc

SEQ ID NO: 110369 - RNA, 20 nt, Artificial Sequence
  MKO10110369_B_Prosc
  gRNA
ugccagcuucaccgagucua

SEQ ID NO: 110370 - RNA, 20 nt, Artificial Sequence
  MKO10110370_B_Prosc
  gRNA
aaccguagacucggugaagc

SEQ ID NO: 110371 - RNA, 20 nt, Artificial Sequence
  MKO10110371_B_Proser1
  gRNA
cgaggccaagagcuccagag

SEQ ID NO: 110372 - RNA, 20 nt, Artificial Sequence
  MKO10110372_B_Proser1
  gRNA
aaagcaauugaguauguuca

SEQ ID NO: 110373 - RNA, 20 nt, Artificial Sequence
  MKO10110373_B_Proser1
  gRNA
gauucugaauaaaucuucaa

SEQ ID NO: 110374 - RNA, 20 nt, Artificial Sequence
  MKO10110374_B_Proser2
  gRNA
gugcagcccgcaccugcguc

SEQ ID NO: 110375 - RNA, 20 nt, Artificial Sequence
  MKO10110375_B_Proser2
  gRNA
caagucgcugagcccgcagc

SEQ ID NO: 110376 - RNA, 20 nt, Artificial Sequence
  MKO10110376_B_Proser2
  gRNA
agagccggugcagcaguucg

SEQ ID NO: 110377 - RNA, 20 nt, Artificial Sequence
  MKO10110377_B_Prox1
  gRNA
acgugaucugcgcaacuucc

SEQ ID NO: 110378 - RNA, 20 nt, Artificial Sequence
  MKO10110378_B_Prox1
  gRNA
gacgcgcauacuucuccauc

SEQ ID NO: 110379 - RNA, 20 nt, Artificial Sequence
  MKO10110379_B_Prox1
  gRNA
uaccuucacguccgagaagu

SEQ ID NO: 110380 - RNA, 20 nt, Artificial Sequence
  MKO10110380_B_Prox2
  gRNA
uguuaacucgggaacagucc

SEQ ID NO: 110381 - RNA, 20 nt, Artificial Sequence
  MKO10110381_B_Prox2
  gRNA
gcccggcaagcacuuucaga

SEQ ID NO: 110382 - RNA, 20 nt, Artificial Sequence
  MKO10110382_B_Prox2
  gRNA
gauugccgcccugacacuga

SEQ ID NO: 110383 - RNA, 20 nt, Artificial Sequence
  MKO10110383_B_Proz
  gRNA
cgcagaacguuguuugccuu

SEQ ID NO: 110384 - RNA, 20 nt, Artificial Sequence
  MKO10110384_B_Proz
  gRNA
ggcauccauccguccucucu

SEQ ID NO: 110385 - RNA, 20 nt, Artificial Sequence
  MKO10110385_B_Proz
  gRNA
ggcaaggaccagaaaucaug

SEQ ID NO: 110386 - RNA, 20 nt, Artificial Sequence
  MKO10110386_B_Prp2
  gRNA
gcuggugguccuguuuacag

SEQ ID NO: 110387 - RNA, 20 nt, Artificial Sequence
  MKO10110387_B_Prp2
  gRNA
cugccuuguggugggccuug

SEQ ID NO: 110388 - RNA, 20 nt, Artificial Sequence
  MKO10110388_B_Prp2
  gRNA
ccacaccugagacccacuca

SEQ ID NO: 110389 - RNA, 20 nt, Artificial Sequence
  MKO10110389_B_Prpf18
  gRNA
uugacgauguuagugguuuc

SEQ ID NO: 110390 - RNA, 20 nt, Artificial Sequence
  MKO10110390_B_Prpf18
  gRNA
uuacgaaagauguggcuaca

SEQ ID NO: 110391 - RNA, 20 nt, Artificial Sequence
  MKO10110391_B_Prpf18
  gRNA
gcaguacuugaaugagauug

SEQ ID NO: 110392 - RNA, 20 nt, Artificial Sequence
  MKO10110392_B_Prpf19
  gRNA
acucacccacucauccugca

SEQ ID NO: 110393 - RNA, 20 nt, Artificial Sequence
  MKO10110393_B_Prpf19
  gRNA
cgggugcucuggcacuucau

SEQ ID NO: 110394 - RNA, 20 nt, Artificial Sequence
  MKO10110394_B_Prpf19
  gRNA
aagcucacagcccaguguug

SEQ ID NO: 110395 - RNA, 20 nt, Artificial Sequence
  MKO10110395_B_Prpf31
  gRNA
cagcaagcaagccaacgugu

SEQ ID NO: 110396 - RNA, 20 nt, Artificial Sequence
  MKO10110396_B_Prpf31
  gRNA
uccuguacauccucaauugc

SEQ ID NO: 110397 - RNA, 20 nt, Artificial Sequence
  MKO10110397_B_Prpf31
  gRNA
ucaagagcauugccaagcua

SEQ ID NO: 110398 - RNA, 20 nt, Artificial Sequence
  MKO10110398_B_Prpf38a
  gRNA
uugucucauaccuguagccg

SEQ ID NO: 110399 - RNA, 20 nt, Artificial Sequence
  MKO10110399_B_Prpf38a
  gRNA
gcuucagauucaaccugaga

SEQ ID NO: 110400 - RNA, 20 nt, Artificial Sequence
  MKO10110400_B_Prpf38a
  gRNA
ucgaguuagugcccuagaag

SEQ ID NO: 110401 - RNA, 20 nt, Artificial Sequence
  MKO10110401_B_Prpf38b
  gRNA
ccuuuaaagguucgaggugu

SEQ ID NO: 110402 - RNA, 20 nt, Artificial Sequence
  MKO10110402_B_Prpf38b
  gRNA
aggacucaaaccagucccac

SEQ ID NO: 110403 - RNA, 20 nt, Artificial Sequence
  MKO10110403_B_Prpf38b
  gRNA
cuugcuuucgaguuaacuuc

SEQ ID NO: 110404 - RNA, 20 nt, Artificial Sequence
  MKO10110404_B_Prpf39
  gRNA
agacauaacugauccagcaa

SEQ ID NO: 110405 - RNA, 20 nt, Artificial Sequence
  MKO10110405_B_Prpf39
  gRNA
uuccaguaaccauagcaaua

SEQ ID NO: 110406 - RNA, 20 nt, Artificial Sequence
  MKO10110406_B_Prpf39
  gRNA
ccuggugaugaccuuccauc

SEQ ID NO: 110407 - RNA, 20 nt, Artificial Sequence
  MKO10110407_B_Prpf3
  gRNA
ugauuccacucuccgauuug

SEQ ID NO: 110408 - RNA, 20 nt, Artificial Sequence
  MKO10110408_B_Prpf3
  gRNA
aaucaucggggguaaagaag

SEQ ID NO: 110409 - RNA, 20 nt, Artificial Sequence
  MKO10110409_B_Prpf3
  gRNA
uggagcuuuguuagcaugcc

SEQ ID NO: 110410 - RNA, 20 nt, Artificial Sequence
  MKO10110410_B_Prpf40a
  gRNA
uuccaugcaaccugccuuac

SEQ ID NO: 110411 - RNA, 20 nt, Artificial Sequence
  MKO10110411_B_Prpf40a
  gRNA
gcagccuggaguaaauagua

SEQ ID NO: 110412 - RNA, 20 nt, Artificial Sequence
  MKO10110412_B_Prpf40a
  gRNA
acauccauacuauuuacucc

SEQ ID NO: 110413 - RNA, 20 nt, Artificial Sequence
  MKO10110413_B_Prpf40b
  gRNA
gcccccauugguggaagcau

SEQ ID NO: 110414 - RNA, 20 nt, Artificial Sequence
  MKO10110414_B_Prpf40b
  gRNA
aucauuggagggaccauucc

SEQ ID NO: 110415 - RNA, 20 nt, Artificial Sequence
  MKO10110415_B_Prpf40b
  gRNA
gugcuuaccgcugcagugac

SEQ ID NO: 110416 - RNA, 20 nt, Artificial Sequence
  MKO10110416_B_Prpf4b
  gRNA
aucgaggcuuccgacaaaga

SEQ ID NO: 110417 - RNA, 20 nt, Artificial Sequence
  MKO10110417_B_Prpf4b
  gRNA
caaauagagauaggagccga

SEQ ID NO: 110418 - RNA, 20 nt, Artificial Sequence
  MKO10110418_B_Prpf4b
  gRNA
ggagacgacuuucuucuccg

SEQ ID NO: 110419 - RNA, 20 nt, Artificial Sequence
  MKO10110419_B_Prpf4
  gRNA
auaauuagcaauccacaauc

SEQ ID NO: 110420 - RNA, 20 nt, Artificial Sequence
  MKO10110420_B_Prpf4
  gRNA
caaggcuugccuucgagccu

SEQ ID NO: 110421 - RNA, 20 nt, Artificial Sequence
  MKO10110421_B_Prpf4
  gRNA
aagcuuccauaguagaugug

SEQ ID NO: 110422 - RNA, 20 nt, Artificial Sequence
  MKO10110422_B_Prpf6
  gRNA
ggagucagcuucucauaacg

SEQ ID NO: 110423 - RNA, 20 nt, Artificial Sequence
  MKO10110423_B_Prpf6
  gRNA
ucuuaguuuaauggcuaugc

SEQ ID NO: 110424 - RNA, 20 nt, Artificial Sequence
  MKO10110424_B_Prpf6
  gRNA
agagauugagaaauaccgaa

SEQ ID NO: 110425 - RNA, 20 nt, Artificial Sequence
  MKO10110425_B_Prpf8
  gRNA
gauguccacacucuaccgac

SEQ ID NO: 110426 - RNA, 20 nt, Artificial Sequence
  MKO10110426_B_Prpf8
  gRNA
acgucccggaucugcuccca

SEQ ID NO: 110427 - RNA, 20 nt, Artificial Sequence
  MKO10110427_B_Prpf8
  gRNA
ccuuuguuaacgagauuccc

SEQ ID NO: 110428 - RNA, 20 nt, Artificial Sequence
  MKO10110428_B_Prph2
  gRNA
gcgucgucacacuucucguc

SEQ ID NO: 110429 - RNA, 20 nt, Artificial Sequence
  MKO10110429_B_Prph2
  gRNA
ccgcuaccuccacacagcgc

SEQ ID NO: 110430 - RNA, 20 nt, Artificial Sequence
  MKO10110430_B_Prph2
  gRNA
agaagagcgugcccgagacc

SEQ ID NO: 110431 - RNA, 20 nt, Artificial Sequence
  MKO10110431_B_Prph
  gRNA
guaggaacuucgagaccugc

SEQ ID NO: 110432 - RNA, 20 nt, Artificial Sequence
  MKO10110432_B_Prph
  gRNA
ugcacaguacgagaacaucg

SEQ ID NO: 110433 - RNA, 20 nt, Artificial Sequence
  MKO10110433_B_Prph
  gRNA
caaccuggugcucuuccgua

SEQ ID NO: 110434 - RNA, 20 nt, Artificial Sequence
  MKO10110434_B_Prpmp5
  gRNA
cuugucucugagcugagcuc

SEQ ID NO: 110435 - RNA, 20 nt, Artificial Sequence
  MKO10110435_B_Prpmp5
  gRNA
gacucaaauucucagcuccu

SEQ ID NO: 110436 - RNA, 20 nt, Artificial Sequence
  MKO10110436_B_Prpmp5
  gRNA
cugagaauuugagucuucgu

SEQ ID NO: 110437 - RNA, 20 nt, Artificial Sequence
  MKO10110437_B_Prps1l1
  gRNA
ucauggcgaugucaaucacc

SEQ ID NO: 110438 - RNA, 20 nt, Artificial Sequence
  MKO10110438_B_Prps1l1
  gRNA
acucucaccaauuuccacgc

SEQ ID NO: 110439 - RNA, 20 nt, Artificial Sequence
  MKO10110439_B_Prps1l1
  gRNA
caagagggucacuuccaucg

SEQ ID NO: 110440 - RNA, 20 nt, Artificial Sequence
  MKO10110440_B_Prps1l3
  gRNA
caucuccuacuaguaccaug

SEQ ID NO: 110441 - RNA, 20 nt, Artificial Sequence
  MKO10110441_B_Prps1l3
  gRNA
ugcaauggaggucacucucu

SEQ ID NO: 110442 - RNA, 20 nt, Artificial Sequence
  MKO10110442_B_Prps1l3
  gRNA
gaaauuggagaaagcguucg

SEQ ID NO: 110443 - RNA, 20 nt, Artificial Sequence
  MKO10110443_B_Prps1
  gRNA
caucucccacaaguaccaug

SEQ ID NO: 110444 - RNA, 20 nt, Artificial Sequence
  MKO10110444_B_Prps1
  gRNA
ccaggguuucuuugauaucc

SEQ ID NO: 110445 - RNA, 20 nt, Artificial Sequence
  MKO10110445_B_Prps1
  gRNA
ugcagaucauauuaucacca

SEQ ID NO: 110446 - RNA, 20 nt, Artificial Sequence
  MKO10110446_B_Prps2
  gRNA
cccagcaacugacagcauau

SEQ ID NO: 110447 - RNA, 20 nt, Artificial Sequence
  MKO10110447_B_Prps2
  gRNA
gcaagauugcguccucaucc

SEQ ID NO: 110448 - RNA, 20 nt, Artificial Sequence
  MKO10110448_B_Prps2
  gRNA
uucgggagaacaucacugaa

SEQ ID NO: 110449 - RNA, 20 nt, Artificial Sequence
  MKO10110449_B_Prpsap1
  gRNA
gaugacgccaaugauauucc

SEQ ID NO: 110450 - RNA, 20 nt, Artificial Sequence
  MKO10110450_B_Prpsap1
  gRNA
gaaaucaaagaaucuguucg

SEQ ID NO: 110451 - RNA, 20 nt, Artificial Sequence
  MKO10110451_B_Prpsap1
  gRNA
ucauuauacagacaauaccc

SEQ ID NO: 110452 - RNA, 20 nt, Artificial Sequence
  MKO10110452_B_Prpsap2
  gRNA
cuucucuaggcggcuggggg

SEQ ID NO: 110453 - RNA, 20 nt, Artificial Sequence
  MKO10110453_B_Prpsap2
  gRNA
agaaacaagaguucaaaucc

SEQ ID NO: 110454 - RNA, 20 nt, Artificial Sequence
  MKO10110454_B_Prpsap2
  gRNA
ggacgugaacaccaccauca

SEQ ID NO: 110455 - RNA, 20 nt, Artificial Sequence
  MKO10110455_B_Prr11
  gRNA
caagcuccgagaaaaccuga

SEQ ID NO: 110456 - RNA, 20 nt, Artificial Sequence
  MKO10110456_B_Prr11
  gRNA
gucuuagccaguuucugcuu

SEQ ID NO: 110457 - RNA, 20 nt, Artificial Sequence
  MKO10110457_B_Prr11
  gRNA
gaguguugacgaaagaaaga

SEQ ID NO: 110458 - RNA, 20 nt, Artificial Sequence
  MKO10110458_B_Prr12
  gRNA
uccgguguggacguguccuu

SEQ ID NO: 110459 - RNA, 20 nt, Artificial Sequence
  MKO10110459_B_Prr12
  gRNA
cucuucguccagccgcuugc

SEQ ID NO: 110460 - RNA, 20 nt, Artificial Sequence
  MKO10110460_B_Prr12
  gRNA
aaccgacaucuugcaucgcc

SEQ ID NO: 110461 - RNA, 20 nt, Artificial Sequence
  MKO10110461_B_Prr13
  gRNA
cguucagucagagucacugc

SEQ ID NO: 110462 - RNA, 20 nt, Artificial Sequence
  MKO10110462_B_Prr13
  gRNA
gguugguauccuggacaccc

SEQ ID NO: 110463 - RNA, 20 nt, Artificial Sequence
  MKO10110463_B_Prr13
  gRNA
caugugccccgugaauccuc

SEQ ID NO: 110464 - RNA, 20 nt, Artificial Sequence
  MKO10110464_B_Prr14l
  gRNA
cucccgagacaauccagcaa

SEQ ID NO: 110465 - RNA, 20 nt, Artificial Sequence
  MKO10110465_B_Prr14l
  gRNA
aagaggcacauuugguaugg

SEQ ID NO: 110466 - RNA, 20 nt, Artificial Sequence
  MKO10110466_B_Prr14l
  gRNA
gugugggcagcucccaugcc

SEQ ID NO: 110467 - RNA, 20 nt, Artificial Sequence
  MKO10110467_B_Prr14
  gRNA
accugcuuuaccaucccaac

SEQ ID NO: 110468 - RNA, 20 nt, Artificial Sequence
  MKO10110468_B_Prr14
  gRNA
accuguugggaugguaaagc

SEQ ID NO: 110469 - RNA, 20 nt, Artificial Sequence
  MKO10110469_B_Prr14
  gRNA
guucucugcacaaaugcagu

SEQ ID NO: 110470 - RNA, 20 nt, Artificial Sequence
  MKO10110470_B_Prr15l
  gRNA
gggaccgccaugacugaagu

SEQ ID NO: 110471 - RNA, 20 nt, Artificial Sequence
  MKO10110471_B_Prr15l
  gRNA
gagcccccaggaccugacgc

SEQ ID NO: 110472 - RNA, 20 nt, Artificial Sequence
  MKO10110472_B_Prr15l
  gRNA
caaagugcucuacgaaaucc

SEQ ID NO: 110473 - RNA, 20 nt, Artificial Sequence
  MKO10110473_B_Prr15
  gRNA
uccgggguccccaaggauau

SEQ ID NO: 110474 - RNA, 20 nt, Artificial Sequence
  MKO10110474_B_Prr15
  gRNA
caggucagauaaguugugug

SEQ ID NO: 110475 - RNA, 20 nt, Artificial Sequence
  MKO10110475_B_Prr15
  gRNA
ccucagguucggccagagac

SEQ ID NO: 110476 - RNA, 20 nt, Artificial Sequence
  MKO10110476_B_Prr16
  gRNA
agccuuguccaaguuacugu

SEQ ID NO: 110477 - RNA, 20 nt, Artificial Sequence
  MKO10110477_B_Prr16
  gRNA
ggagcagaucaagaucauag

SEQ ID NO: 110478 - RNA, 20 nt, Artificial Sequence
  MKO10110478_B_Prr16
  gRNA
ggacgaggagggguuccccu

SEQ ID NO: 110479 - RNA, 20 nt, Artificial Sequence
  MKO10110479_B_Prr18
  gRNA
caguguccccaacgcgccuc

SEQ ID NO: 110480 - RNA, 20 nt, Artificial Sequence
  MKO10110480_B_Prr18
  gRNA
cgaagcccugguccggggac

SEQ ID NO: 110481 - RNA, 20 nt, Artificial Sequence
  MKO10110481_B_Prr18
  gRNA
acguggucgaggucccccca

SEQ ID NO: 110482 - RNA, 20 nt, Artificial Sequence
  MKO10110482_B_Prr19
  gRNA
ggugaccuggagguugcacc

SEQ ID NO: 110483 - RNA, 20 nt, Artificial Sequence
  MKO10110483_B_Prr19
  gRNA
gaucacacauggaucccgac

SEQ ID NO: 110484 - RNA, 20 nt, Artificial Sequence
  MKO10110484_B_Prr19
  gRNA
guggcccggcugcuuaacag

SEQ ID NO: 110485 - RNA, 20 nt, Artificial Sequence
  MKO10110485_B_Prr22
  gRNA
aagcacauccugguccgagc

SEQ ID NO: 110486 - RNA, 20 nt, Artificial Sequence
  MKO10110486_B_Prr22
  gRNA
aaccugcacuaucagacccc

SEQ ID NO: 110487 - RNA, 20 nt, Artificial Sequence
  MKO10110487_B_Prr22
  gRNA
ccagaaccccuucccaccgu

SEQ ID NO: 110488 - RNA, 20 nt, Artificial Sequence
  MKO10110488_B_Prr23a
  gRNA
gcgccaaccccgcgcccugc

SEQ ID NO: 110489 - RNA, 20 nt, Artificial Sequence
  MKO10110489_B_Prr23a
  gRNA
ggguugugucaugaguccuu

SEQ ID NO: 110490 - RNA, 20 nt, Artificial Sequence
  MKO10110490_B_Prr23a
  gRNA
acuuggaauugcuggaaccc

SEQ ID NO: 110491 - RNA, 20 nt, Artificial Sequence
  MKO10110491_B_Prr24
  gRNA
gguucccacgcggccgccug

SEQ ID NO: 110492 - RNA, 20 nt, Artificial Sequence
  MKO10110492_B_Prr24
  gRNA
cgacuguggcggcgacuccg

SEQ ID NO: 110493 - RNA, 20 nt, Artificial Sequence
  MKO10110493_B_Prr24
  gRNA
ucgcucagccccguaccacc

SEQ ID NO: 110494 - RNA, 20 nt, Artificial Sequence
  MKO10110494_B_Prr3
  gRNA
aacaucucgcacugucugag

SEQ ID NO: 110495 - RNA, 20 nt, Artificial Sequence
  MKO10110495_B_Prr3
  gRNA
aagccuggugaucccaaguc

SEQ ID NO: 110496 - RNA, 20 nt, Artificial Sequence
  MKO10110496_B_Prr3
  gRNA
caaucccucaccuuaacugu

SEQ ID NO: 110497 - RNA, 20 nt, Artificial Sequence
  MKO10110497_B_Prr5l
  gRNA
auucauuacugacuauuucc

SEQ ID NO: 110498 - RNA, 20 nt, Artificial Sequence
  MKO10110498_B_Prr5l
  gRNA
gagaagaucaagcuguguga

SEQ ID NO: 110499 - RNA, 20 nt, Artificial Sequence
  MKO10110499_B_Prr5l
  gRNA
cagaaccagcuucuugcaaa

SEQ ID NO: 110500 - RNA, 20 nt, Artificial Sequence
  MKO10110500_B_Prr5
  gRNA
ucagaaccagcugcucacga

SEQ ID NO: 110501 - RNA, 20 nt, Artificial Sequence
  MKO10110501_B_Prr5
  gRNA
ugaugugcugccaacccugc

SEQ ID NO: 110502 - RNA, 20 nt, Artificial Sequence
  MKO10110502_B_Prr5
  gRNA
cuucuucacugaguaccugc

SEQ ID NO: 110503 - RNA, 20 nt, Artificial Sequence
  MKO10110503_B_Prr7
  gRNA
accuuggcgcggauagcucc

SEQ ID NO: 110504 - RNA, 20 nt, Artificial Sequence
  MKO10110504_B_Prr7
  gRNA
gcacggagcuuggcgucugc

SEQ ID NO: 110505 - RNA, 20 nt, Artificial Sequence
  MKO10110505_B_Prr7
  gRNA
ucuccauccccuuguucggg

SEQ ID NO: 110506 - RNA, 20 nt, Artificial Sequence
  MKO10110506_B_Prr9
  gRNA
caaggaaacugcccacaaca

SEQ ID NO: 110507 - RNA, 20 nt, Artificial Sequence
  MKO10110507_B_Prr9
  gRNA
cuuguugugggcaguuuccu

SEQ ID NO: 110508 - RNA, 20 nt, Artificial Sequence
  MKO10110508_B_Prr9
  gRNA
gcuagcacaaacaaaaugug

SEQ ID NO: 110509 - RNA, 20 nt, Artificial Sequence
  MKO10110509_B_Prrc1
  gRNA
cccuauggugaaaucugucc

SEQ ID NO: 110510 - RNA, 20 nt, Artificial Sequence
  MKO10110510_B_Prrc1
  gRNA
gcaagccagcaugacgucuc

SEQ ID NO: 110511 - RNA, 20 nt, Artificial Sequence
  MKO10110511_B_Prrc1
  gRNA
aaaccccagaucccgccagc

SEQ ID NO: 110512 - RNA, 20 nt, Artificial Sequence
  MKO10110512_B_Prrc2a
  gRNA
uuuaccccgcuuggaaccga

SEQ ID NO: 110513 - RNA, 20 nt, Artificial Sequence
  MKO10110513_B_Prrc2a
  gRNA
gggucguuucggcugguugg

SEQ ID NO: 110514 - RNA, 20 nt, Artificial Sequence
  MKO10110514_B_Prrc2a
  gRNA
gucucacuagugccgaaaga

SEQ ID NO: 110515 - RNA, 20 nt, Artificial Sequence
  MKO10110515_B_Prrc2b
  gRNA
caucgcaauguccgaucguu

SEQ ID NO: 110516 - RNA, 20 nt, Artificial Sequence
  MKO10110516_B_Prrc2b
  gRNA
ggcccauccugucccguccu

SEQ ID NO: 110517 - RNA, 20 nt, Artificial Sequence
  MKO10110517_B_Prrc2b
  gRNA
ucgggaaaguugccacagcc

SEQ ID NO: 110518 - RNA, 20 nt, Artificial Sequence
  MKO10110518_B_Prrc2c
  gRNA
cuauacugagaagcaagugc

SEQ ID NO: 110519 - RNA, 20 nt, Artificial Sequence
  MKO10110519_B_Prrc2c
  gRNA
uugggagcaggugcuacuuc

SEQ ID NO: 110520 - RNA, 20 nt, Artificial Sequence
  MKO10110520_B_Prrc2c
  gRNA
uagcaccugcucccaaauca

SEQ ID NO: 110521 - RNA, 20 nt, Artificial Sequence
  MKO10110521_B_Prrg1
  gRNA
aaacgcuacccaagagccaa

SEQ ID NO: 110522 - RNA, 20 nt, Artificial Sequence
  MKO10110522_B_Prrg1
  gRNA
ccggccaggugaaccugaga

SEQ ID NO: 110523 - RNA, 20 nt, Artificial Sequence
  MKO10110523_B_Prrg1
  gRNA
uugacuauguccucauauuc

SEQ ID NO: 110524 - RNA, 20 nt, Artificial Sequence
  MKO10110524_B_Prrg2
  gRNA
aagcuauacguacaauggca

SEQ ID NO: 110525 - RNA, 20 nt, Artificial Sequence
  MKO10110525_B_Prrg2
  gRNA
ccgccucauaccuggaguaa

SEQ ID NO: 110526 - RNA, 20 nt, Artificial Sequence
  MKO10110526_B_Prrg2
  gRNA
uuugguaucugcauuaucga

SEQ ID NO: 110527 - RNA, 20 nt, Artificial Sequence
  MKO10110527_B_Prrg3
  gRNA
uuccaugcacucccgcucaa

SEQ ID NO: 110528 - RNA, 20 nt, Artificial Sequence
  MKO10110528_B_Prrg3
  gRNA
cgaacugaguagacugcguu

SEQ ID NO: 110529 - RNA, 20 nt, Artificial Sequence
  MKO10110529_B_Prrg3
  gRNA
uacgucagggcaccauugag

SEQ ID NO: 110530 - RNA, 20 nt, Artificial Sequence
  MKO10110530_B_Prrg4
  gRNA
cagugcuacugccuguucau

SEQ ID NO: 110531 - RNA, 20 nt, Artificial Sequence
  MKO10110531_B_Prrg4
  gRNA
gauguuaugagccuucugac

SEQ ID NO: 110532 - RNA, 20 nt, Artificial Sequence
  MKO10110532_B_Prrg4
  gRNA
cuucuuccuagaucaaauuu

SEQ ID NO: 110533 - RNA, 20 nt, Artificial Sequence
  MKO10110533_B_Prrt1
  gRNA
ccgguaggugcgcacggcuu

SEQ ID NO: 110534 - RNA, 20 nt, Artificial Sequence
  MKO10110534_B_Prrt1
  gRNA
uugccacagcccuacgcagg

SEQ ID NO: 110535 - RNA, 20 nt, Artificial Sequence
  MKO10110535_B_Prrt1
  gRNA
gcgaugggcauguagucgug

SEQ ID NO: 110536 - RNA, 20 nt, Artificial Sequence
  MKO10110536_B_Prrt2
  gRNA
cguggauggggcucaacguc

SEQ ID NO: 110537 - RNA, 20 nt, Artificial Sequence
  MKO10110537_B_Prrt2
  gRNA
ucucccacaguguauaagug

SEQ ID NO: 110538 - RNA, 20 nt, Artificial Sequence
  MKO10110538_B_Prrt2
  gRNA
ggccuucgcuuaugccguca

SEQ ID NO: 110539 - RNA, 20 nt, Artificial Sequence
  MKO10110539_B_Prrt3
  gRNA
ucagcaguauccucgcugaa

SEQ ID NO: 110540 - RNA, 20 nt, Artificial Sequence
  MKO10110540_B_Prrt3
  gRNA
gagccgaccccagggacuac

SEQ ID NO: 110541 - RNA, 20 nt, Artificial Sequence
  MKO10110541_B_Prrt3
  gRNA
gccuggagcccagcucgacc

SEQ ID NO: 110542 - RNA, 20 nt, Artificial Sequence
  MKO10110542_B_Prrt4
  gRNA
uaacgaccgaugaccaagag

SEQ ID NO: 110543 - RNA, 20 nt, Artificial Sequence
  MKO10110543_B_Prrt4
  gRNA
gcaugcucaccuuguugcac

SEQ ID NO: 110544 - RNA, 20 nt, Artificial Sequence
  MKO10110544_B_Prrt4
  gRNA
gucgcguccuccaccccucc

SEQ ID NO: 110545 - RNA, 20 nt, Artificial Sequence
  MKO10110545_B_Prrx1
  gRNA
gcacguucuggagcggcaac

SEQ ID NO: 110546 - RNA, 20 nt, Artificial Sequence
  MKO10110546_B_Prrx1
  gRNA
cccaagauguuguuuacacg

SEQ ID NO: 110547 - RNA, 20 nt, Artificial Sequence
  MKO10110547_B_Prrx1
  gRNA
cccucguguaaacaacaucu

SEQ ID NO: 110548 - RNA, 20 nt, Artificial Sequence
  MKO10110548_B_Prrx2
  gRNA
accgccgugccaaguuucgc

SEQ ID NO: 110549 - RNA, 20 nt, Artificial Sequence
  MKO10110549_B_Prrx2
  gRNA
gcucaucgugguaggucggg

SEQ ID NO: 110550 - RNA, 20 nt, Artificial Sequence
  MKO10110550_B_Prrx2
  gRNA
acuugaaccuccggggcuau

SEQ ID NO: 110551 - RNA, 20 nt, Artificial Sequence
  MKO10110551_B_Prrxl1
  gRNA
gggcauacguggcuguguuc

SEQ ID NO: 110552 - RNA, 20 nt, Artificial Sequence
  MKO10110552_B_Prrxl1
  gRNA
ccuccuucuugcuccggguc

SEQ ID NO: 110553 - RNA, 20 nt, Artificial Sequence
  MKO10110553_B_Prrxl1
  gRNA
uagggcccacugugcguccc

SEQ ID NO: 110554 - RNA, 20 nt, Artificial Sequence
  MKO10110554_B_Prss12
  gRNA
agccuauguccaucgcuguc

SEQ ID NO: 110555 - RNA, 20 nt, Artificial Sequence
  MKO10110555_B_Prss12
  gRNA
gccccuuguaguagaccucc

SEQ ID NO: 110556 - RNA, 20 nt, Artificial Sequence
  MKO10110556_B_Prss12
  gRNA
cucaauugacagcucguuuc

SEQ ID NO: 110557 - RNA, 20 nt, Artificial Sequence
  MKO10110557_B_Prss16
  gRNA
ugacagacgaaccuuccugc

SEQ ID NO: 110558 - RNA, 20 nt, Artificial Sequence
  MKO10110558_B_Prss16
  gRNA
gcucuccacagggcauccug

SEQ ID NO: 110559 - RNA, 20 nt, Artificial Sequence
  MKO10110559_B_Prss16
  gRNA
guaccaguauuucugcacau

SEQ ID NO: 110560 - RNA, 20 nt, Artificial Sequence
  MKO10110560_B_Prss1
  gRNA
gagcugcagacaccacccac

SEQ ID NO: 110561 - RNA, 20 nt, Artificial Sequence
  MKO10110561_B_Prss1
  gRNA
uauucaaguugcuuucccug

SEQ ID NO: 110562 - RNA, 20 nt, Artificial Sequence
  MKO10110562_B_Prss1
  gRNA
aggaauccuugccucccucu

SEQ ID NO: 110563 - RNA, 20 nt, Artificial Sequence
  MKO10110563_B_Prss21
  gRNA
caggaacccgaccuauuguc

SEQ ID NO: 110564 - RNA, 20 nt, Artificial Sequence
  MKO10110564_B_Prss21
  gRNA
ucgguucucaaacuuguacg

SEQ ID NO: 110565 - RNA, 20 nt, Artificial Sequence
  MKO10110565_B_Prss21
  gRNA
caccuuaccugacaauaggu

SEQ ID NO: 110566 - RNA, 20 nt, Artificial Sequence
  MKO10110566_B_Prss22
  gRNA
aacucugcaaaagcuuguac

SEQ ID NO: 110567 - RNA, 20 nt, Artificial Sequence
  MKO10110567_B_Prss22
  gRNA
uggaguguuccaggcgcacc

SEQ ID NO: 110568 - RNA, 20 nt, Artificial Sequence
  MKO10110568_B_Prss22
  gRNA
ucccucccaagaccgacugc

SEQ ID NO: 110569 - RNA, 20 nt, Artificial Sequence
  MKO10110569_B_Prss23
  gRNA
auaauccaugccgaugucau

SEQ ID NO: 110570 - RNA, 20 nt, Artificial Sequence
  MKO10110570_B_Prss23
  gRNA
cgggcugggcgucacacugc

SEQ ID NO: 110571 - RNA, 20 nt, Artificial Sequence
  MKO10110571_B_Prss23
  gRNA
gcugcccacugcauacacga

SEQ ID NO: 110572 - RNA, 20 nt, Artificial Sequence
  MKO10110572_B_Prss27
  gRNA
caggucagcauccagcgcaa

SEQ ID NO: 110573 - RNA, 20 nt, Artificial Sequence
  MKO10110573_B_Prss27
  gRNA
gcacuugggcgugucaauga

SEQ ID NO: 110574 - RNA, 20 nt, Artificial Sequence
  MKO10110574_B_Prss27
  gRNA
cagaccgacuacccaaccca

SEQ ID NO: 110575 - RNA, 20 nt, Artificial Sequence
  MKO10110575_B_Prss28
  gRNA
gggggucaauguaccccacc

SEQ ID NO: 110576 - RNA, 20 nt, Artificial Sequence
  MKO10110576_B_Prss28
  gRNA
auccgacgagcacaaagcug

SEQ ID NO: 110577 - RNA, 20 nt, Artificial Sequence
  MKO10110577_B_Prss28
  gRNA
gccucccuaucaacugcaug

SEQ ID NO: 110578 - RNA, 20 nt, Artificial Sequence
  MKO10110578_B_Prss29
  gRNA
cacccagacuuuguccacgc

SEQ ID NO: 110579 - RNA, 20 nt, Artificial Sequence
  MKO10110579_B_Prss29
  gRNA
ucaguuucuggccacgauug

SEQ ID NO: 110580 - RNA, 20 nt, Artificial Sequence
  MKO10110580_B_Prss29
  gRNA
cugcacauaacauguccuuu

SEQ ID NO: 110581 - RNA, 20 nt, Artificial Sequence
  MKO10110581_B_Prss2
  gRNA
augaauuauaauuggggugc

SEQ ID NO: 110582 - RNA, 20 nt, Artificial Sequence
  MKO10110582_B_Prss2
  gRNA
gcacuggggcaucaacacac

SEQ ID NO: 110583 - RNA, 20 nt, Artificial Sequence
  MKO10110583_B_Prss2
  gRNA
auacaccaggagcaucuggc

SEQ ID NO: 110584 - RNA, 20 nt, Artificial Sequence
  MKO10110584_B_Prss30
  gRNA
ucacuaaccugcggaagcag

SEQ ID NO: 110585 - RNA, 20 nt, Artificial Sequence
  MKO10110585_B_Prss30
  gRNA
cgcuagacgcaucugcccag

SEQ ID NO: 110586 - RNA, 20 nt, Artificial Sequence
  MKO10110586_B_Prss30
  gRNA
cguggagauauauugcccuc

SEQ ID NO: 110587 - RNA, 20 nt, Artificial Sequence
  MKO10110587_B_Prss32
  gRNA
ugcucguccgcugaauagcu

SEQ ID NO: 110588 - RNA, 20 nt, Artificial Sequence
  MKO10110588_B_Prss32
  gRNA
ccagucugccucccgaaacc

SEQ ID NO: 110589 - RNA, 20 nt, Artificial Sequence
  MKO10110589_B_Prss32
  gRNA
cuccugguaguagguauugc

SEQ ID NO: 110590 - RNA, 20 nt, Artificial Sequence
  MKO10110590_B_Prss33
  gRNA
gaccugccgucaacacccac

SEQ ID NO: 110591 - RNA, 20 nt, Artificial Sequence
  MKO10110591_B_Prss33
  gRNA
gccucguccucagaguaguc

SEQ ID NO: 110592 - RNA, 20 nt, Artificial Sequence
  MKO10110592_B_Prss33
  gRNA
gagcacugagucuggacguc

SEQ ID NO: 110593 - RNA, 20 nt, Artificial Sequence
  MKO10110593_B_Prss34
  gRNA
caugucgucuuugaugaucc

SEQ ID NO: 110594 - RNA, 20 nt, Artificial Sequence
  MKO10110594_B_Prss34
  gRNA
ucccguggcaggucagcuug

SEQ ID NO: 110595 - RNA, 20 nt, Artificial Sequence
  MKO10110595_B_Prss34
  gRNA
ucuugaccacuuucaucagc

SEQ ID NO: 110596 - RNA, 20 nt, Artificial Sequence
  MKO10110596_B_Prss35
  gRNA
acucggaacagcagcguaaa

SEQ ID NO: 110597 - RNA, 20 nt, Artificial Sequence
  MKO10110597_B_Prss35
  gRNA
cguagucguaguccaaggcc

SEQ ID NO: 110598 - RNA, 20 nt, Artificial Sequence
  MKO10110598_B_Prss35
  gRNA
cagcaucgcaauacugauac

SEQ ID NO: 110599 - RNA, 20 nt, Artificial Sequence
  MKO10110599_B_Prss36
  gRNA
ugagcccucuucccgcauug

SEQ ID NO: 110600 - RNA, 20 nt, Artificial Sequence
  MKO10110600_B_Prss36
  gRNA
cuaggucuucaaauucuccu

SEQ ID NO: 110601 - RNA, 20 nt, Artificial Sequence
  MKO10110601_B_Prss36
  gRNA
cuaguggucaguccuaccca

SEQ ID NO: 110602 - RNA, 20 nt, Artificial Sequence
  MKO10110602_B_Prss37
  gRNA
gucuaacuucaaucccugcg

SEQ ID NO: 110603 - RNA, 20 nt, Artificial Sequence
  MKO10110603_B_Prss37
  gRNA
cagucuuuguccgucaucac

SEQ ID NO: 110604 - RNA, 20 nt, Artificial Sequence
  MKO10110604_B_Prss37
  gRNA
cacgguaaauagcagugaga

SEQ ID NO: 110605 - RNA, 20 nt, Artificial Sequence
  MKO10110605_B_Prss38
  gRNA
accuagggauuaguggcaac

SEQ ID NO: 110606 - RNA, 20 nt, Artificial Sequence
  MKO10110606_B_Prss38
  gRNA
uggggaaugaucucgccaca

SEQ ID NO: 110607 - RNA, 20 nt, Artificial Sequence
  MKO10110607_B_Prss38
  gRNA
ugcagauuggaauagugagc

SEQ ID NO: 110608 - RNA, 20 nt, Artificial Sequence
  MKO10110608_B_Prss39
  gRNA
cccuccuccugcaaucgauu

SEQ ID NO: 110609 - RNA, 20 nt, Artificial Sequence
  MKO10110609_B_Prss39
  gRNA
gagaccuccgcguccagcag

SEQ ID NO: 110610 - RNA, 20 nt, Artificial Sequence
  MKO10110610_B_Prss39
  gRNA
ccugccacgaaagaucagac

SEQ ID NO: 110611 - RNA, 20 nt, Artificial Sequence
  MKO10110611_B_Prss3
  gRNA
cacucuaguugccuuccccg

SEQ ID NO: 110612 - RNA, 20 nt, Artificial Sequence
  MKO10110612_B_Prss3
  gRNA
cagccgcauccaagugagau

SEQ ID NO: 110613 - RNA, 20 nt, Artificial Sequence
  MKO10110613_B_Prss3
  gRNA
augagacacugagugccagc

SEQ ID NO: 110614 - RNA, 20 nt, Artificial Sequence
  MKO10110614_B_Prss40
  gRNA
acgugguagggcuaaccagc

SEQ ID NO: 110615 - RNA, 20 nt, Artificial Sequence
  MKO10110615_B_Prss40
  gRNA
cgguguagccuagcaugaca

SEQ ID NO: 110616 - RNA, 20 nt, Artificial Sequence
  MKO10110616_B_Prss40
  gRNA
ugacaucguccugcuguacc

SEQ ID NO: 110617 - RNA, 20 nt, Artificial Sequence
  MKO10110617_B_Prss41
  gRNA
uacccuguaccguccagaau

SEQ ID NO: 110618 - RNA, 20 nt, Artificial Sequence
  MKO10110618_B_Prss41
  gRNA
agggucacgugaagaaagcc

SEQ ID NO: 110619 - RNA, 20 nt, Artificial Sequence
  MKO10110619_B_Prss41
  gRNA
ccacggccagcgcccuugca

SEQ ID NO: 110620 - RNA, 20 nt, Artificial Sequence
  MKO10110620_B_Prss42
  gRNA
ggcaucagcuguggucgcaa

SEQ ID NO: 110621 - RNA, 20 nt, Artificial Sequence
  MKO10110621_B_Prss42
  gRNA
uguuccgacagaaauccucc

SEQ ID NO: 110622 - RNA, 20 nt, Artificial Sequence
  MKO10110622_B_Prss42
  gRNA
aggauuucugucggaacauc

SEQ ID NO: 110623 - RNA, 20 nt, Artificial Sequence
  MKO10110623_B_Prss43
  gRNA
acagcguguuacagugcuuc

SEQ ID NO: 110624 - RNA, 20 nt, Artificial Sequence
  MKO10110624_B_Prss43
  gRNA
aagauuccggagugaugcac

SEQ ID NO: 110625 - RNA, 20 nt, Artificial Sequence
  MKO10110625_B_Prss43
  gRNA
uugcggccauagaauuacag

SEQ ID NO: 110626 - RNA, 20 nt, Artificial Sequence
  MKO10110626_B_Prss44
  gRNA
ggucuuggcuguggccgaau

SEQ ID NO: 110627 - RNA, 20 nt, Artificial Sequence
  MKO10110627_B_Prss44
  gRNA
guggaaggccugcgccagcg

SEQ ID NO: 110628 - RNA, 20 nt, Artificial Sequence
  MKO10110628_B_Prss44
  gRNA
ccaggacaucaucguucacc

SEQ ID NO: 110629 - RNA, 20 nt, Artificial Sequence
  MKO10110629_B_Prss45
  gRNA
gcacaaguccuccccauaau

SEQ ID NO: 110630 - RNA, 20 nt, Artificial Sequence
  MKO10110630_B_Prss45
  gRNA
acguacuuguugaaagugac

SEQ ID NO: 110631 - RNA, 20 nt, Artificial Sequence
  MKO10110631_B_Prss45
  gRNA
cccugcagcccaguugacac

SEQ ID NO: 110632 - RNA, 20 nt, Artificial Sequence
  MKO10110632_B_Prss46
  gRNA
cagccaugcugguaaacuuc

SEQ ID NO: 110633 - RNA, 20 nt, Artificial Sequence
  MKO10110633_B_Prss46
  gRNA
acaaugaaaucugcaaucau

SEQ ID NO: 110634 - RNA, 20 nt, Artificial Sequence
  MKO10110634_B_Prss46
  gRNA
cgcugcagauguacauuccc

SEQ ID NO: 110635 - RNA, 20 nt, Artificial Sequence
  MKO10110635_B_Prss48
  gRNA
uugaugacccgcuccagauc

SEQ ID NO: 110636 - RNA, 20 nt, Artificial Sequence
  MKO10110636_B_Prss48
  gRNA
gucgaggaaggauagcugca

SEQ ID NO: 110637 - RNA, 20 nt, Artificial Sequence
  MKO10110637_B_Prss48
  gRNA
ggguggccaagaugcugcuu

SEQ ID NO: 110638 - RNA, 20 nt, Artificial Sequence
  MKO10110638_B_Prss50
  gRNA
guugaugauccgaaccagag

SEQ ID NO: 110639 - RNA, 20 nt, Artificial Sequence
  MKO10110639_B_Prss50
  gRNA
caccgccgagucauggcuuc

SEQ ID NO: 110640 - RNA, 20 nt, Artificial Sequence
  MKO10110640_B_Prss50
  gRNA
agccugcacgcugaccaucc

SEQ ID NO: 110641 - RNA, 20 nt, Artificial Sequence
  MKO10110641_B_Prss51
  gRNA
gacucggagacucuuucaag

SEQ ID NO: 110642 - RNA, 20 nt, Artificial Sequence
  MKO10110642_B_Prss51
  gRNA
gaguaccuggcacuugccgu

SEQ ID NO: 110643 - RNA, 20 nt, Artificial Sequence
  MKO10110643_B_Prss51
  gRNA
uuggcguggcaaguaggagc

SEQ ID NO: 110644 - RNA, 20 nt, Artificial Sequence
  MKO10110644_B_Prss52
  gRNA
accaggugggcauugucagc

SEQ ID NO: 110645 - RNA, 20 nt, Artificial Sequence
  MKO10110645_B_Prss52
  gRNA
gcccggcaagagagcaccaa

SEQ ID NO: 110646 - RNA, 20 nt, Artificial Sequence
  MKO10110646_B_Prss52
  gRNA
aguccaacccacaauucugc

SEQ ID NO: 110647 - RNA, 20 nt, Artificial Sequence
  MKO10110647_B_Prss53
  gRNA
ggucuucaagcagcucagcg

SEQ ID NO: 110648 - RNA, 20 nt, Artificial Sequence
  MKO10110648_B_Prss53
  gRNA
acuuaccaucacugguguuc

SEQ ID NO: 110649 - RNA, 20 nt, Artificial Sequence
  MKO10110649_B_Prss53
  gRNA
cuggguuggacagcaaccuc

SEQ ID NO: 110650 - RNA, 20 nt, Artificial Sequence
  MKO10110650_B_Prss54
  gRNA
ggaaaccagcgggccuucga

SEQ ID NO: 110651 - RNA, 20 nt, Artificial Sequence
  MKO10110651_B_Prss54
  gRNA
gaacuuugacaacgucucaa

SEQ ID NO: 110652 - RNA, 20 nt, Artificial Sequence
  MKO10110652_B_Prss54
  gRNA
ggaacucggugcugcucacg

SEQ ID NO: 110653 - RNA, 20 nt, Artificial Sequence
  MKO10110653_B_Prss55
  gRNA
agugaccaccauuucugcgg

SEQ ID NO: 110654 - RNA, 20 nt, Artificial Sequence
  MKO10110654_B_Prss55
  gRNA
uagaggucaccaccauaauc

SEQ ID NO: 110655 - RNA, 20 nt, Artificial Sequence
  MKO10110655_B_Prss55
  gRNA
cccagggauauauacuguau

SEQ ID NO: 110656 - RNA, 20 nt, Artificial Sequence
  MKO10110656_B_Prss56
  gRNA
ggccauaaagcgcguguuga

SEQ ID NO: 110657 - RNA, 20 nt, Artificial Sequence
  MKO10110657_B_Prss56
  gRNA
uuaguuucaccuggcuccgg

SEQ ID NO: 110658 - RNA, 20 nt, Artificial Sequence
  MKO10110658_B_Prss56
  gRNA
aguccacagaagcucauucg

SEQ ID NO: 110659 - RNA, 20 nt, Artificial Sequence
  MKO10110659_B_Prss57
  gRNA
augagguaacgccacauucc

SEQ ID NO: 110660 - RNA, 20 nt, Artificial Sequence
  MKO10110660_B_Prss57
  gRNA
acagagcguccaguagaacc

SEQ ID NO: 110661 - RNA, 20 nt, Artificial Sequence
  MKO10110661_B_Prss57
  gRNA
gcccgucuuccacagaccaa

SEQ ID NO: 110662 - RNA, 20 nt, Artificial Sequence
  MKO10110662_B_Prss58
  gRNA
ggaaucuugucuuaugcaga

SEQ ID NO: 110663 - RNA, 20 nt, Artificial Sequence
  MKO10110663_B_Prss58
  gRNA
ccaugugcuccgugucuacc

SEQ ID NO: 110664 - RNA, 20 nt, Artificial Sequence
  MKO10110664_B_Prss58
  gRNA
agacuucagguagaccaagu

SEQ ID NO: 110665 - RNA, 20 nt, Artificial Sequence
  MKO10110665_B_Prss8
  gRNA
ucgagguaccacucaucagc

SEQ ID NO: 110666 - RNA, 20 nt, Artificial Sequence
  MKO10110666_B_Prss8
  gRNA
ggaugagcgcgauguccccc

SEQ ID NO: 110667 - RNA, 20 nt, Artificial Sequence
  MKO10110667_B_Prss8
  gRNA
ccacucaagcuaccgagaag

SEQ ID NO: 110668 - RNA, 20 nt, Artificial Sequence
  MKO10110668_B_Prug
  gRNA
gcuucgcuaaccauaguugc

SEQ ID NO: 110669 - RNA, 20 nt, Artificial Sequence
  MKO10110669_B_Prug
  gRNA
guguugcagaucuacgacgu

SEQ ID NO: 110670 - RNA, 20 nt, Artificial Sequence
  MKO10110670_B_Prug
  gRNA
gagagccguuagauagaacc

SEQ ID NO: 110671 - RNA, 20 nt, Artificial Sequence
  MKO10110671_B_Prtn3
  gRNA
gccccacucucggccuuaug

SEQ ID NO: 110672 - RNA, 20 nt, Artificial Sequence
  MKO10110672_B_Prtn3
  gRNA
ccucgggguuguaauuguuc

SEQ ID NO: 110673 - RNA, 20 nt, Artificial Sequence
  MKO10110673_B_Prtn3
  gRNA
gcgugcacacguuguguucc

SEQ ID NO: 110674 - RNA, 20 nt, Artificial Sequence
  MKO10110674_B_Prune2
  gRNA
ugaguucuggagccucacgc

SEQ ID NO: 110675 - RNA, 20 nt, Artificial Sequence
  MKO10110675_B_Prune2
  gRNA
cugcaucagcugaacgauga

SEQ ID NO: 110676 - RNA, 20 nt, Artificial Sequence
  MKO10110676_B_Prune2
  gRNA
aguuucccaaccucccuccg

SEQ ID NO: 110677 - RNA, 20 nt, Artificial Sequence
  MKO10110677_B_Prune
  gRNA
aagacauuguccccgcgcag

SEQ ID NO: 110678 - RNA, 20 nt, Artificial Sequence
  MKO10110678_B_Prune
  gRNA
ccuuauaggaaccaucaucc

SEQ ID NO: 110679 - RNA, 20 nt, Artificial Sequence
  MKO10110679_B_Prune
  gRNA
ugauuccuuaccaugcagua

SEQ ID NO: 110680 - RNA, 20 nt, Artificial Sequence
  MKO10110680_B_Prx
  gRNA
cuuuguccgugagcugcgag

SEQ ID NO: 110681 - RNA, 20 nt, Artificial Sequence
  MKO10110681_B_Prx
  gRNA
cucguauccagacaccgucc

SEQ ID NO: 110682 - RNA, 20 nt, Artificial Sequence
  MKO10110682_B_Prx
  gRNA
agggcucugcgcauugcagc

SEQ ID NO: 110683 - RNA, 20 nt, Artificial Sequence
  MKO10110683_B_Psapl1
  gRNA
aguccaacagugcaucaccc

SEQ ID NO: 110684 - RNA, 20 nt, Artificial Sequence
  MKO10110684_B_Psapl1
  gRNA
aacacugccagcgccucgug

SEQ ID NO: 110685 - RNA, 20 nt, Artificial Sequence
  MKO10110685_B_Psapl1
  gRNA
aucugcaacucauucguccu

SEQ ID NO: 110686 - RNA, 20 nt, Artificial Sequence
  MKO10110686_B_Psap
  gRNA
aaaacuguugucaccgaagc

SEQ ID NO: 110687 - RNA, 20 nt, Artificial Sequence
  MKO10110687_B_Psap
  gRNA
guccaccuccgggaucuugu

SEQ ID NO: 110688 - RNA, 20 nt, Artificial Sequence
  MKO10110688_B_Psap
  gRNA
uggcugcgggggugauccug

SEQ ID NO: 110689 - RNA, 20 nt, Artificial Sequence
  MKO10110689_B_Psau1
  gRNA
ggcguccggguugagguucc

SEQ ID NO: 110690 - RNA, 20 nt, Artificial Sequence
  MKO10110690_B_Psau1
  gRNA
cucuguauugccaauaaucu

SEQ ID NO: 110691 - RNA, 20 nt, Artificial Sequence
  MKO10110691_B_Psau1
  gRNA
uguccucaaacuucuuaucc

SEQ ID NO: 110692 - RNA, 20 nt, Artificial Sequence
  MKO10110692_B_Psca
  gRNA
cugaagcuuaccuggaugca

SEQ ID NO: 110693 - RNA, 20 nt, Artificial Sequence
  MKO10110693_B_Psca
  gRNA
accuacuuagcccugcaucc

SEQ ID NO: 110694 - RNA, 20 nt, Artificial Sequence
  MKO10110694_B_Psca
  gRNA
gaauguacagaacugcagcc

SEQ ID NO: 110695 - RNA, 20 nt, Artificial Sequence
  MKO10110695_B_Psd2
  gRNA
cugaagccaucacguacauc

SEQ ID NO: 110696 - RNA, 20 nt, Artificial Sequence
  MKO10110696_B_Psd2
  gRNA
ccagacgacagcacaucaga

SEQ ID NO: 110697 - RNA, 20 nt, Artificial Sequence
  MKO10110697_B_Psd2
  gRNA
ggcaguaccggcgagagaag

SEQ ID NO: 110698 - RNA, 20 nt, Artificial Sequence
  MKO10110698_B_Psd3
  gRNA
gucuugaguuuaaacacguu

SEQ ID NO: 110699 - RNA, 20 nt, Artificial Sequence
  MKO10110699_B_Psd3
  gRNA
aaccguucuuuacuuacaga

SEQ ID NO: 110700 - RNA, 20 nt, Artificial Sequence
  MKO10110700_B_Psd3
  gRNA
ucaagaacgagaagcuugaa

SEQ ID NO: 110701 - RNA, 20 nt, Artificial Sequence
  MKO10110701_B_Psd4
  gRNA
ggagcccguguucugcacuu

SEQ ID NO: 110702 - RNA, 20 nt, Artificial Sequence
  MKO10110702_B_Psd4
  gRNA
gagccucuacccucagauuc

SEQ ID NO: 110703 - RNA, 20 nt, Artificial Sequence
  MKO10110703_B_Psd4
  gRNA
caacacauccuguacagccu

SEQ ID NO: 110704 - RNA, 20 nt, Artificial Sequence
  MKO10110704_B_Psd
  gRNA
uccuuggacgcccccagcuc

SEQ ID NO: 110705 - RNA, 20 nt, Artificial Sequence
  MKO10110705_B_Psd
  gRNA
cacucaccgggcccccuccg

SEQ ID NO: 110706 - RNA, 20 nt, Artificial Sequence
  MKO10110706_B_Psd
  gRNA
uauaggaggugcccuuggcc

SEQ ID NO: 110707 - RNA, 20 nt, Artificial Sequence
  MKO10110707_B_Psen1
  gRNA
cgcccauuagauauuggcuc

SEQ ID NO: 110708 - RNA, 20 nt, Artificial Sequence
  MKO10110708_B_Psen1
  gRNA
ccgcauucaggaucgagugc

SEQ ID NO: 110709 - RNA, 20 nt, Artificial Sequence
  MKO10110709_B_Psen1
  gRNA
ucuucuaggucauccacgcc

SEQ ID NO: 110710 - RNA, 20 nt, Artificial Sequence
  MKO10110710_B_Psen2
  gRNA
cgagggcguguccuccguga

SEQ ID NO: 110711 - RNA, 20 nt, Artificial Sequence
  MKO10110711_B_Psen2
  gRNA
uauugugaucagcgcacuca

SEQ ID NO: 110712 - RNA, 20 nt, Artificial Sequence
  MKO10110712_B_Psen2
  gRNA
cgaccuaccguacacagaga

SEQ ID NO: 110713 - RNA, 20 nt, Artificial Sequence
  MKO10110713_B_Psenen
  gRNA
gcgcaacuaugaacuuggag

SEQ ID NO: 110714 - RNA, 20 nt, Artificial Sequence
  MKO10110714_B_Psenen
  gRNA
gcucuguguaggcuggggcg

SEQ ID NO: 110715 - RNA, 20 nt, Artificial Sequence
  MKO10110715_B_Psenen
  gRNA
gaaguuguuagggagugccc

SEQ ID NO: 110716 - RNA, 20 nt, Artificial Sequence
  MKO10110716_B_Psg16
  gRNA
aaagcccucgaagcuuaucc

SEQ ID NO: 110717 - RNA, 20 nt, Artificial Sequence
  MKO10110717_B_Psg16
  gRNA
uccccuucugcagcauaccg

SEQ ID NO: 110718 - RNA, 20 nt, Artificial Sequence
  MKO10110718_B_Psg16
  gRNA
ugggagacuggauuucgagc

SEQ ID NO: 110719 - RNA, 20 nt, Artificial Sequence
  MKO10110719_B_Psg17
  gRNA
caguucuccacguugacuua

SEQ ID NO: 110720 - RNA, 20 nt, Artificial Sequence
  MKO10110720_B_Psg17
  gRNA
aguaucuuauaucacuuacc

SEQ ID NO: 110721 - RNA, 20 nt, Artificial Sequence
  MKO10110721_B_Psg17
  gRNA
ggcacuaauucaauaguggg

SEQ ID NO: 110722 - RNA, 20 nt, Artificial Sequence
  MKO10110722_B_Psg18
  gRNA
acuuacgauggauguugacu

SEQ ID NO: 110723 - RNA, 20 nt, Artificial Sequence
  MKO10110723_B_Psg18
  gRNA
uuaccaccccaaguguauga

SEQ ID NO: 110724 - RNA, 20 nt, Artificial Sequence
  MKO10110724_B_Psg18
  gRNA
gaaccugguccggcccacag

SEQ ID NO: 110725 - RNA, 20 nt, Artificial Sequence
  MKO10110725_B_Psg19
  gRNA
gugacagagucuaucaucag

SEQ ID NO: 110726 - RNA, 20 nt, Artificial Sequence
  MKO10110726_B_Psg19
  gRNA
guagaauccgauguccuucc

SEQ ID NO: 110727 - RNA, 20 nt, Artificial Sequence
  MKO10110727_B_Psg19
  gRNA
uguggauccaaagugccacc

SEQ ID NO: 110728 - RNA, 20 nt, Artificial Sequence
  MKO10110728_B_Psg20
  gRNA
aggggagguaggacgcccac

SEQ ID NO: 110729 - RNA, 20 nt, Artificial Sequence
  MKO10110729_B_Psg20
  gRNA
gcacuguuucaacuuucaca

SEQ ID NO: 110730 - RNA, 20 nt, Artificial Sequence
  MKO10110730_B_Psg20
  gRNA
gugugcguagccacugaaaa

SEQ ID NO: 110731 - RNA, 20 nt, Artificial Sequence
  MKO10110731_B_Psg21
  gRNA
aauucuugaguguucugugc

SEQ ID NO: 110732 - RNA, 20 nt, Artificial Sequence
  MKO10110732_B_Psg21
  gRNA
cucuugacucugcccaacuc

SEQ ID NO: 110733 - RNA, 20 nt, Artificial Sequence
  MKO10110733_B_Psg21
  gRNA
agucuuucucagugacaucc

SEQ ID NO: 110734 - RNA, 20 nt, Artificial Sequence
  MKO10110734_B_Psg22
  gRNA
gugacagagucucucaucaa

SEQ ID NO: 110735 - RNA, 20 nt, Artificial Sequence
  MKO10110735_B_Psg22
  gRNA
aguucgaauacagggcucag

SEQ ID NO: 110736 - RNA, 20 nt, Artificial Sequence
  MKO10110736_B_Psg22
  gRNA
agaaucuucgagucuuuguc

SEQ ID NO: 110737 - RNA, 20 nt, Artificial Sequence
  MKO10110737_B_Psg23
  gRNA
aauaucgauucacaguuugu

SEQ ID NO: 110738 - RNA, 20 nt, Artificial Sequence
  MKO10110738_B_Psg23
  gRNA
uacaaacugugaaucgauau

SEQ ID NO: 110739 - RNA, 20 nt, Artificial Sequence
  MKO10110739_B_Psg23
  gRNA
ucaccacaacacguaguuga

SEQ ID NO: 110740 - RNA, 20 nt, Artificial Sequence
  MKO10110740_B_Psg25
  gRNA
auuuagcaacccucuguacc

SEQ ID NO: 110741 - RNA, 20 nt, Artificial Sequence
  MKO10110741_B_Psg25
  gRNA
agcaucuucaaucgcuauuc

SEQ ID NO: 110742 - RNA, 20 nt, Artificial Sequence
  MKO10110742_B_Psg25
  gRNA
aaaggugugcauaacacuca

SEQ ID NO: 110743 - RNA, 20 nt, Artificial Sequence
  MKO10110743_B_Psg26
  gRNA
cagguccauaaucugccaga

SEQ ID NO: 110744 - RNA, 20 nt, Artificial Sequence
  MKO10110744_B_Psg26
  gRNA
ugaauccuuaccaccccaag

SEQ ID NO: 110745 - RNA, 20 nt, Artificial Sequence
  MKO10110745_B_Psg26
  gRNA
agaguuugcagcucacagag

SEQ ID NO: 110746 - RNA, 20 nt, Artificial Sequence
  MKO10110746_B_Psg27
  gRNA
ucaguagcaugccgagucac

SEQ ID NO: 110747 - RNA, 20 nt, Artificial Sequence
  MKO10110747_B_Psg27
  gRNA
gauaucgauucagaguuugu

SEQ ID NO: 110748 - RNA, 20 nt, Artificial Sequence
  MKO10110748_B_Psg27
  gRNA
gaccagucuuccagucaacc

SEQ ID NO: 110749 - RNA, 20 nt, Artificial Sequence
  MKO10110749_B_Psg28
  gRNA
accagguucccuugauuucu

SEQ ID NO: 110750 - RNA, 20 nt, Artificial Sequence
  MKO10110750_B_Psg28
  gRNA
aguggugggcaggugccagc

SEQ ID NO: 110751 - RNA, 20 nt, Artificial Sequence
  MKO10110751_B_Psg28
  gRNA
cuucuggcagauuauagacc

SEQ ID NO: 110752 - RNA, 20 nt, Artificial Sequence
  MKO10110752_B_Psg29
  gRNA
ucaaagggaugaccgugcac

SEQ ID NO: 110753 - RNA, 20 nt, Artificial Sequence
  MKO10110753_B_Psg29
  gRNA
acacuguccccuacgaagug

SEQ ID NO: 110754 - RNA, 20 nt, Artificial Sequence
  MKO10110754_B_Psg29
  gRNA
ucccuggcagauuauugaca

SEQ ID NO: 110755 - RNA, 20 nt, Artificial Sequence
  MKO10110755_B_Psip1
  gRNA
uuaaaaccuuuccguuuauu

SEQ ID NO: 110756 - RNA, 20 nt, Artificial Sequence
  MKO10110756_B_Psip1
  gRNA
cagguagaugaaguuccuga

SEQ ID NO: 110757 - RNA, 20 nt, Artificial Sequence
  MKO10110757_B_Psip1
  gRNA
cuuucucuuucuuccucgcc

SEQ ID NO: 110758 - RNA, 20 nt, Artificial Sequence
  MKO10110758_B_Pskh1
  gRNA
ggugcuccacacguaccacu

SEQ ID NO: 110759 - RNA, 20 nt, Artificial Sequence
  MKO10110759_B_Pskh1
  gRNA
ccaacaagucacgccguguu

SEQ ID NO: 110760 - RNA, 20 nt, Artificial Sequence
  MKO10110760_B_Pskh1
  gRNA
uaaagcugccucgcccaauu

SEQ ID NO: 110761 - RNA, 20 nt, Artificial Sequence
  MKO10110761_B_Psma1
  gRNA
ccgcaauugagauaccaaua

SEQ ID NO: 110762 - RNA, 20 nt, Artificial Sequence
  MKO10110762_B_Psma1
  gRNA
aagcaagguucagcaacagu

SEQ ID NO: 110763 - RNA, 20 nt, Artificial Sequence
  MKO10110763_B_Psma1
  gRNA
ucucgucuugugucucuaau

SEQ ID NO: 110764 - RNA, 20 nt, Artificial Sequence
  MKO10110764_B_Psma2
  gRNA
cguguacuccugcaucacag

SEQ ID NO: 110765 - RNA, 20 nt, Artificial Sequence
  MKO10110765_B_Psma2
  gRNA
gaauggguucuugguaaaca

SEQ ID NO: 110766 - RNA, 20 nt, Artificial Sequence
  MKO10110766_B_Psma2
  gRNA
agcuggaggggccccgucag

SEQ ID NO: 110767 - RNA, 20 nt, Artificial Sequence
  MKO10110767_B_Psma3
  gRNA
ccagcaucuugcagacagag

SEQ ID NO: 110768 - RNA, 20 nt, Artificial Sequence
  MKO10110768_B_Psma3
  gRNA
gccucuacguucucuccuga

SEQ ID NO: 110769 - RNA, 20 nt, Artificial Sequence
  MKO10110769_B_Psma3
  gRNA
acuuggaaaacucuuccauc

SEQ ID NO: 110770 - RNA, 20 nt, Artificial Sequence
  MKO10110770_B_Psma4
  gRNA
uguaggucgcuuauaccaag

SEQ ID NO: 110771 - RNA, 20 nt, Artificial Sequence
  MKO10110771_B_Psma4
  gRNA
uagggacauggcuugcagcg

SEQ ID NO: 110772 - RNA, 20 nt, Artificial Sequence
  MKO10110772_B_Psma4
  gRNA
agucucgaagauaugacucc

SEQ ID NO: 110773 - RNA, 20 nt, Artificial Sequence
  MKO10110773_B_Psma5
  gRNA
aacuaacucaccauagcacc

SEQ ID NO: 110774 - RNA, 20 nt, Artificial Sequence
  MKO10110774_B_Psma5
  gRNA
uagcuugguucuacagccau

SEQ ID NO: 110775 - RNA, 20 nt, Artificial Sequence
  MKO10110775_B_Psma5
  gRNA
acuugaaauaaucuuccuuc

SEQ ID NO: 110776 - RNA, 20 nt, Artificial Sequence
  MKO10110776_B_Psma6
  gRNA
cacgcuaugaggcagcuaau

SEQ ID NO: 110777 - RNA, 20 nt, Artificial Sequence
  MKO10110777_B_Psma6
  gRNA
uguucuuuaggacaaacuac

SEQ ID NO: 110778 - RNA, 20 nt, Artificial Sequence
  MKO10110778_B_Psma6
  gRNA
gacucacuuguucaagauaa

SEQ ID NO: 110779 - RNA, 20 nt, Artificial Sequence
  MKO10110779_B_Psma7
  gRNA
caggucucaccgcugaugca

SEQ ID NO: 110780 - RNA, 20 nt, Artificial Sequence
  MKO10110780_B_Psma7
  gRNA
gcuucagacucgcaauguag

SEQ ID NO: 110781 - RNA, 20 nt, Artificial Sequence
  MKO10110781_B_Psma7
  gRNA
gcgcaggccauuugguaucu

SEQ ID NO: 110782 - RNA, 20 nt, Artificial Sequence
  MKO10110782_B_Psma8
  gRNA
ucuuuauagguuggaauucg

SEQ ID NO: 110783 - RNA, 20 nt, Artificial Sequence
  MKO10110783_B_Psma8
  gRNA
aaggccuucguccauugcuc

SEQ ID NO: 110784 - RNA, 20 nt, Artificial Sequence
  MKO10110784_B_Psma8
  gRNA
gaguggugaucagcagagcg

SEQ ID NO: 110785 - RNA, 20 nt, Artificial Sequence
  MKO10110785_B_Psmb10
  gRNA
ucggaacacaagccccgcga

SEQ ID NO: 110786 - RNA, 20 nt, Artificial Sequence
  MKO10110786_B_Psmb10
  gRNA
uugcucaccggaaaagcguc

SEQ ID NO: 110787 - RNA, 20 nt, Artificial Sequence
  MKO10110787_B_Psmb10
  gRNA
gaacggaccucagcucuacg

SEQ ID NO: 110788 - RNA, 20 nt, Artificial Sequence
  MKO10110788_B_Psmb11
  gRNA
cgugacgaaagcgaaaagcc

SEQ ID NO: 110789 - RNA, 20 nt, Artificial Sequence
  MKO10110789_B_Psmb11
  gRNA
gccacgaucaagcacaccau

SEQ ID NO: 110790 - RNA, 20 nt, Artificial Sequence
  MKO10110790_B_Psmb11
  gRNA
caguggaccucuuccacguu

SEQ ID NO: 110791 - RNA, 20 nt, Artificial Sequence
  MKO10110791_B_Psmb1
  gRNA
ucgagugucugaagcgacga

SEQ ID NO: 110792 - RNA, 20 nt, Artificial Sequence
  MKO10110792_B_Psmb1
  gRNA
ucagacacucgauugaguga

SEQ ID NO: 110793 - RNA, 20 nt, Artificial Sequence
  MKO10110793_B_Psmb1
  gRNA
gaagcgccgugaguacagga

SEQ ID NO: 110794 - RNA, 20 nt, Artificial Sequence
  MKO10110794_B_Psmb2
  gRNA
ccuuuacuacauggacuacc

SEQ ID NO: 110795 - RNA, 20 nt, Artificial Sequence
  MKO10110795_B_Psmb2
  gRNA
acgugcaacuuuauaaaaug

SEQ ID NO: 110796 - RNA, 20 nt, Artificial Sequence
  MKO10110796_B_Psmb2
  gRNA
ggaaccuggcugacugucuu

SEQ ID NO: 110797 - RNA, 20 nt, Artificial Sequence
  MKO10110797_B_Psmb3
  gRNA
ucagcucauacaaguucagu

SEQ ID NO: 110798 - RNA, 20 nt, Artificial Sequence
  MKO10110798_B_Psmb3
  gRNA
acacaucccauacauuuguu

SEQ ID NO: 110799 - RNA, 20 nt, Artificial Sequence
  MKO10110799_B_Psmb3
  gRNA
uacacagagccugucauugc

SEQ ID NO: 110800 - RNA, 20 nt, Artificial Sequence
  MKO10110800_B_Psmb4
  gRNA
guacucggggugaaguucga

SEQ ID NO: 110801 - RNA, 20 nt, Artificial Sequence
  MKO10110801_B_Psmb4
  gRNA
gcccuagagcuauucauuca

SEQ ID NO: 110802 - RNA, 20 nt, Artificial Sequence
  MKO10110802_B_Psmb4
  gRNA
caagcauguccacauaaccg

SEQ ID NO: 110803 - RNA, 20 nt, Artificial Sequence
  MKO10110803_B_Psmb5
  gRNA
cgcuggcuagcguguugcag

SEQ ID NO: 110804 - RNA, 20 nt, Artificial Sequence
  MKO10110804_B_Psmb5
  gRNA
ccucuacuacguagacagcg

SEQ ID NO: 110805 - RNA, 20 nt, Artificial Sequence
  MKO10110805_B_Psmb5
  gRNA
uaagucagcuacauugucac

SEQ ID NO: 110806 - RNA, 20 nt, Artificial Sequence
  MKO10110806_B_Psmb6
  gRNA
cagaagaugugaucguggau

SEQ ID NO: 110807 - RNA, 20 nt, Artificial Sequence
  MKO10110807_B_Psmb6
  gRNA
aaacugcacagccaugaucg

SEQ ID NO: 110808 - RNA, 20 nt, Artificial Sequence
  MKO10110808_B_Psmb6
  gRNA
cugaccugcccuccuucuug

SEQ ID NO: 110809 - RNA, 20 nt, Artificial Sequence
  MKO10110809_B_Psmb7
  gRNA
uuggggggaguagauguuac

SEQ ID NO: 110810 - RNA, 20 nt, Artificial Sequence
  MKO10110810_B_Psmb7
  gRNA
gcagacacgagagcaacuga

SEQ ID NO: 110811 - RNA, 20 nt, Artificial Sequence
  MKO10110811_B_Psmb7
  gRNA
ggcggccaguggucagagag

SEQ ID NO: 110812 - RNA, 20 nt, Artificial Sequence
  MKO10110812_B_Psmb8
  gRNA
aggcgagugugguugugccg

SEQ ID NO: 110813 - RNA, 20 nt, Artificial Sequence
  MKO10110813_B_Psmb8
  gRNA
cagccacgaugacgccaugc

SEQ ID NO: 110814 - RNA, 20 nt, Artificial Sequence
  MKO10110814_B_Psmb8
  gRNA
gauggacagugguuaccggc

SEQ ID NO: 110815 - RNA, 20 nt, Artificial Sequence
  MKO10110815_B_Psmb9
  gRNA
guggacgcagcuuauaagcc

SEQ ID NO: 110816 - RNA, 20 nt, Artificial Sequence
  MKO10110816_B_Psmb9
  gRNA
cuacucaccccgcugacacc

SEQ ID NO: 110817 - RNA, 20 nt, Artificial Sequence
  MKO10110817_B_Psmb9
  gRNA
ggaguuugacgggggugucg

SEQ ID NO: 110818 - RNA, 20 nt, Artificial Sequence
  MKO10110818_B_Psmc1
  gRNA
ggaggaauucauuagaaacc

SEQ ID NO: 110819 - RNA, 20 nt, Artificial Sequence
  MKO10110819_B_Psmc1
  gRNA
uuucagggucaaagccagag

SEQ ID NO: 110820 - RNA, 20 nt, Artificial Sequence
  MKO10110820_B_Psmc1
  gRNA
gaaaaagaagaagaaaacaa

SEQ ID NO: 110821 - RNA, 20 nt, Artificial Sequence
  MKO10110821_B_Psmc2
  gRNA
agggccaaaguacuuauuca

SEQ ID NO: 110822 - RNA, 20 nt, Artificial Sequence
  MKO10110822_B_Psmc2
  gRNA
gcauaccuugccaccuguaa

SEQ ID NO: 110823 - RNA, 20 nt, Artificial Sequence
  MKO10110823_B_Psmc2
  gRNA
ucugccuugaauaaguacuu

SEQ ID NO: 110824 - RNA, 20 nt, Artificial Sequence
  MKO10110824_B_Psmc3ip
  gRNA
ccucugcuaggcgguaguga

SEQ ID NO: 110825 - RNA, 20 nt, Artificial Sequence
  MKO10110825_B_Psmc3ip
  gRNA
gaacacguccugggcgcugu

SEQ ID NO: 110826 - RNA, 20 nt, Artificial Sequence
  MKO10110826_B_Psmc3ip
  gRNA
ucucuuugaucuugccuucc

SEQ ID NO: 110827 - RNA, 20 nt, Artificial Sequence
  MKO10110827_B_Psmc3
  gRNA
ccuugucuccaaugucaucg

SEQ ID NO: 110828 - RNA, 20 nt, Artificial Sequence
  MKO10110828_B_Psmc3
  gRNA
aagagauuguccagcgcaca

SEQ ID NO: 110829 - RNA, 20 nt, Artificial Sequence
  MKO10110829_B_Psmc3
  gRNA
gcauccaccaacccaaucac

SEQ ID NO: 110830 - RNA, 20 nt, Artificial Sequence
  MKO10110830_B_Psmc4
  gRNA
gcggauccagagcauccccu

SEQ ID NO: 110831 - RNA, 20 nt, Artificial Sequence
  MKO10110831_B_Psmc4
  gRNA
cgggaggcagcacguccacc

SEQ ID NO: 110832 - RNA, 20 nt, Artificial Sequence
  MKO10110832_B_Psmc4
  gRNA
gcauccugaguaccaucgac

SEQ ID NO: 110833 - RNA, 20 nt, Artificial Sequence
  MKO10110833_B_Psmc5
  gRNA
ccucacgacuucuccaacgu

SEQ ID NO: 110834 - RNA, 20 nt, Artificial Sequence
  MKO10110834_B_Psmc5
  gRNA
caccuggaguucuucaaucu

SEQ ID NO: 110835 - RNA, 20 nt, Artificial Sequence
  MKO10110835_B_Psmc5
  gRNA
ccagaaucuccguagacugc

SEQ ID NO: 110836 - RNA, 20 nt, Artificial Sequence
  MKO10110836_B_Psmc6
  gRNA
uccaaagcaacucugguucc

SEQ ID NO: 110837 - RNA, 20 nt, Artificial Sequence
  MKO10110837_B_Psmc6
  gRNA
aaagucugaaaaugauuuga

SEQ ID NO: 110838 - RNA, 20 nt, Artificial Sequence
  MKO10110838_B_Psmc6
  gRNA
gucaucguuaaagcaacaaa

SEQ ID NO: 110839 - RNA, 20 nt, Artificial Sequence
  MKO10110839_B_Psmd10
  gRNA
uauucuucgaagcugcauaa

SEQ ID NO: 110840 - RNA, 20 nt, Artificial Sequence
  MKO10110840_B_Psmd10
  gRNA
acgucaucuuuaucauucac

SEQ ID NO: 110841 - RNA, 20 nt, Artificial Sequence
  MKO10110841_B_Psmd10
  gRNA
guugaauucuugcugcaacu

SEQ ID NO: 110842 - RNA, 20 nt, Artificial Sequence
  MKO10110842_B_Psmd11
  gRNA
aggcaccuaccuccaaugcu

SEQ ID NO: 110843 - RNA, 20 nt, Artificial Sequence
  MKO10110843_B_Psmd11
  gRNA
uacccaaaugcaaugcuucc

SEQ ID NO: 110844 - RNA, 20 nt, Artificial Sequence
  MKO10110844_B_Psmd11
  gRNA
ugacauucaagaaaaugaug

SEQ ID NO: 110845 - RNA, 20 nt, Artificial Sequence
  MKO10110845_B_Psmd12
  gRNA
uuaugcuucugucaaaacga

SEQ ID NO: 110846 - RNA, 20 nt, Artificial Sequence
  MKO10110846_B_Psmd12
  gRNA
ucacuacugcaaccaagaug

SEQ ID NO: 110847 - RNA, 20 nt, Artificial Sequence
  MKO10110847_B_Psmd12
  gRNA
gcaacuauuaaagagcaaaa

SEQ ID NO: 110848 - RNA, 20 nt, Artificial Sequence
  MKO10110848_B_Psmd13
  gRNA
uucuauucuagauccuaaug

SEQ ID NO: 110849 - RNA, 20 nt, Artificial Sequence
  MKO10110849_B_Psmd13
  gRNA
caggacccaugcuuugccca

SEQ ID NO: 110850 - RNA, 20 nt, Artificial Sequence
  MKO10110850_B_Psmd13
  gRNA
ucaucagugaguuugagcac

SEQ ID NO: 110851 - RNA, 20 nt, Artificial Sequence
  MKO10110851_B_Psmd14
  gRNA
auuagacccauaacuuccau

SEQ ID NO: 110852 - RNA, 20 nt, Artificial Sequence
  MKO10110852_B_Psmd14
  gRNA
ccuuaccuuuagcaaggcca

SEQ ID NO: 110853 - RNA, 20 nt, Artificial Sequence
  MKO10110853_B_Psmd14
  gRNA
aguguuccaagccaaaaugu

SEQ ID NO: 110854 - RNA, 20 nt, Artificial Sequence
  MKO10110854_B_Psmd1
  gRNA
aagucggcaguuugcagccc

SEQ ID NO: 110855 - RNA, 20 nt, Artificial Sequence
  MKO10110855_B_Psmd1
  gRNA
ccaauucauaccuuaagcug

SEQ ID NO: 110856 - RNA, 20 nt, Artificial Sequence
  MKO10110856_B_Psmd1
  gRNA
augcagucgugaaugacuuc

SEQ ID NO: 110857 - RNA, 20 nt, Artificial Sequence
  MKO10110857_B_Psmd2
  gRNA
ucuauccauagacaucuggc

SEQ ID NO: 110858 - RNA, 20 nt, Artificial Sequence
  MKO10110858_B_Psmd2
  gRNA
ugaugagaacgccuacgcca

SEQ ID NO: 110859 - RNA, 20 nt, Artificial Sequence
  MKO10110859_B_Psmd2
  gRNA
cccaugacgccaguucuucc

SEQ ID NO: 110860 - RNA, 20 nt, Artificial Sequence
  MKO10110860_B_Psmd3
  gRNA
acccugcggcacgaugcuga

SEQ ID NO: 110861 - RNA, 20 nt, Artificial Sequence
  MKO10110861_B_Psmd3
  gRNA
aguguuacuauuaucacgcc

SEQ ID NO: 110862 - RNA, 20 nt, Artificial Sequence
  MKO10110862_B_Psmd3
  gRNA
cugcaguuucguccucgcac

SEQ ID NO: 110863 - RNA, 20 nt, Artificial Sequence
  MKO10110863_B_Psmd4
  gRNA
caggacucacgugggccacg

SEQ ID NO: 110864 - RNA, 20 nt, Artificial Sequence
  MKO10110864_B_Psmd4
  gRNA
cccuguggaggacaacgaga

SEQ ID NO: 110865 - RNA, 20 nt, Artificial Sequence
  MKO10110865_B_Psmd4
  gRNA
ugagugacauacaauguuga

SEQ ID NO: 110866 - RNA, 20 nt, Artificial Sequence
  MKO10110866_B_Psmd5
  gRNA
uuaaacuacuguaccacaag

SEQ ID NO: 110867 - RNA, 20 nt, Artificial Sequence
  MKO10110867_B_Psmd5
  gRNA
uugagucaccaguccacuug

SEQ ID NO: 110868 - RNA, 20 nt, Artificial Sequence
  MKO10110868_B_Psmd5
  gRNA
uccauaccugcgacagagug

SEQ ID NO: 110869 - RNA, 20 nt, Artificial Sequence
  MKO10110869_B_Psmd6
  gRNA
ccuuguguaaaucccucgac

SEQ ID NO: 110870 - RNA, 20 nt, Artificial Sequence
  MKO10110870_B_Psmd6
  gRNA
ucaguaugaucgccuuagaa

SEQ ID NO: 110871 - RNA, 20 nt, Artificial Sequence
  MKO10110871_B_Psmd6
  gRNA
uauaaaagaguccgauccuu

SEQ ID NO: 110872 - RNA, 20 nt, Artificial Sequence
  MKO10110872_B_Psmd7
  gRNA
caccgaagccuacaucucag

SEQ ID NO: 110873 - RNA, 20 nt, Artificial Sequence
  MKO10110873_B_Psmd7
  gRNA
gauaucauucuugugcaguu

SEQ ID NO: 110874 - RNA, 20 nt, Artificial Sequence
  MKO10110874_B_Psmd7
  gRNA
augacaaagaugauucuguc

SEQ ID NO: 110875 - RNA, 20 nt, Artificial Sequence
  MKO10110875_B_Psmd8
  gRNA
cagggauguuccccuuagcc

SEQ ID NO: 110876 - RNA, 20 nt, Artificial Sequence
  MKO10110876_B_Psmd8
  gRNA
uguuguagcuacccuccaug

SEQ ID NO: 110877 - RNA, 20 nt, Artificial Sequence
  MKO10110877_B_Psmd8
  gRNA
gacuaaacagcaacucauuc

SEQ ID NO: 110878 - RNA, 20 nt, Artificial Sequence
  MKO10110878_B_Psmd9
  gRNA
cgaaccgcugguggacugug

SEQ ID NO: 110879 - RNA, 20 nt, Artificial Sequence
  MKO10110879_B_Psmd9
  gRNA
gguacaaguccacauccgcc

SEQ ID NO: 110880 - RNA, 20 nt, Artificial Sequence
  MKO10110880_B_Psmd9
  gRNA
caauuucgucauccacuugc

SEQ ID NO: 110881 - RNA, 20 nt, Artificial Sequence
  MKO10110881_B_Psme1
  gRNA
ucccaagaaaaucucagagu

SEQ ID NO: 110882 - RNA, 20 nt, Artificial Sequence
  MKO10110882_B_Psme1
  gRNA
ucggguacugggauguccaa

SEQ ID NO: 110883 - RNA, 20 nt, Artificial Sequence
  MKO10110883_B_Psme1
  gRNA
ggagcggaagaagcaacagg

SEQ ID NO: 110884 - RNA, 20 nt, Artificial Sequence
  MKO10110884_B_Psme2b
  gRNA
auccauuacauggguauccu

SEQ ID NO: 110885 - RNA, 20 nt, Artificial Sequence
  MKO10110885_B_Psme2b
  gRNA
augauaaagcucagcauaga

SEQ ID NO: 110886 - RNA, 20 nt, Artificial Sequence
  MKO10110886_B_Psme2b
  gRNA
ccuccugcaagagcugacuc

SEQ ID NO: 110887 - RNA, 20 nt, Artificial Sequence
  MKO10110887_B_Psme2
  gRNA
uuagauggaaacagacaagc

SEQ ID NO: 110888 - RNA, 20 nt, Artificial Sequence
  MKO10110888_B_Psme2
  gRNA
uccucugcacuuucuugcca

SEQ ID NO: 110889 - RNA, 20 nt, Artificial Sequence
  MKO10110889_B_Psme2
  gRNA
aucccugagucagcucuugc

SEQ ID NO: 110890 - RNA, 20 nt, Artificial Sequence
  MKO10110890_B_Psme3
  gRNA
cuccucaccaauagccacga

SEQ ID NO: 110891 - RNA, 20 nt, Artificial Sequence
  MKO10110891_B_Psme3
  gRNA
ucaaguucuaguaacuucuu

SEQ ID NO: 110892 - RNA, 20 nt, Artificial Sequence
  MKO10110892_B_Psme3
  gRNA
cucugucuaggcagaagacu

SEQ ID NO: 110893 - RNA, 20 nt, Artificial Sequence
  MKO10110893_B_Psme4
  gRNA
aaaccuuuaugaugcaguuc

SEQ ID NO: 110894 - RNA, 20 nt, Artificial Sequence
  MKO10110894_B_Psme4
  gRNA
acuagaaaucagcaugaugc

SEQ ID NO: 110895 - RNA, 20 nt, Artificial Sequence
  MKO10110895_B_Psme4
  gRNA
agaaaauguucucaaaacac

SEQ ID NO: 110896 - RNA, 20 nt, Artificial Sequence
  MKO10110896_B_Psmf1
  gRNA
ucaucucccccgacagcaaa

SEQ ID NO: 110897 - RNA, 20 nt, Artificial Sequence
  MKO10110897_B_Psmf1
  gRNA
cagaacuacugccagcuaag

SEQ ID NO: 110898 - RNA, 20 nt, Artificial Sequence
  MKO10110898_B_Psmf1
  gRNA
auacucacccaaaagggucu

SEQ ID NO: 110899 - RNA, 20 nt, Artificial Sequence
  MKO10110899_B_Psmg1
  gRNA
guguagcugcuacauugcug

SEQ ID NO: 110900 - RNA, 20 nt, Artificial Sequence
  MKO10110900_B_Psmg1
  gRNA
uccuacugcaauuauaaacu

SEQ ID NO: 110901 - RNA, 20 nt, Artificial Sequence
  MKO10110901_B_Psmg1
  gRNA
ucuuguagucugugaugugc

SEQ ID NO: 110902 - RNA, 20 nt, Artificial Sequence
  MKO10110902_B_Psmg2
  gRNA
acauuuccaacggauacugc

SEQ ID NO: 110903 - RNA, 20 nt, Artificial Sequence
  MKO10110903_B_Psmg2
  gRNA
uuucagccagcaguauccgu

SEQ ID NO: 110904 - RNA, 20 nt, Artificial Sequence
  MKO10110904_B_Psmg2
  gRNA
agcaccacuagcuucuuuga

SEQ ID NO: 110905 - RNA, 20 nt, Artificial Sequence
  MKO10110905_B_Psmg3
  gRNA
cuugcgacacaaaugcuacc

SEQ ID NO: 110906 - RNA, 20 nt, Artificial Sequence
  MKO10110906_B_Psmg3
  gRNA
gauggguacgcuaguguccu

SEQ ID NO: 110907 - RNA, 20 nt, Artificial Sequence
  MKO10110907_B_Psmg3
  gRNA
uucuguuuagauacuaccag

SEQ ID NO: 110908 - RNA, 20 nt, Artificial Sequence
  MKO10110908_B_Psmg4
  gRNA
acuucugauacaacuuccac

SEQ ID NO: 110909 - RNA, 20 nt, Artificial Sequence
  MKO10110909_B_Psmg4
  gRNA
agcccggaagaccagcaaac

SEQ ID NO: 110910 - RNA, 20 nt, Artificial Sequence
  MKO10110910_B_Psmg4
  gRNA
gcugacaaacaccuguuugc

SEQ ID NO: 110911 - RNA, 20 nt, Artificial Sequence
  MKO10110911_B_Psors1c2
  gRNA
agacagccaugaugcucacc

SEQ ID NO: 110912 - RNA, 20 nt, Artificial Sequence
  MKO10110912_B_Psors1c2
  gRNA
uggggaguccuccucuucgu

SEQ ID NO: 110913 - RNA, 20 nt, Artificial Sequence
  MKO10110913_B_Psors1c2
  gRNA
ggcggagguucaucaaacaa

SEQ ID NO: 110914 - RNA, 20 nt, Artificial Sequence
  MKO10110914_B_Pspc1
  gRNA
uccagucauuguagaaccca

SEQ ID NO: 110915 - RNA, 20 nt, Artificial Sequence
  MKO10110915_B_Pspc1
  gRNA
cuugccucauuagcauuaac

SEQ ID NO: 110916 - RNA, 20 nt, Artificial Sequence
  MKO10110916_B_Pspc1
  gRNA
ucaagaagaacucagacguu

SEQ ID NO: 110917 - RNA, 20 nt, Artificial Sequence
  MKO10110917_B_Psph
  gRNA
acaccuggacauuacgcucc

SEQ ID NO: 110918 - RNA, 20 nt, Artificial Sequence
  MKO10110918_B_Psph
  gRNA
gugguacaucacugacuucg

SEQ ID NO: 110919 - RNA, 20 nt, Artificial Sequence
  MKO10110919_B_Psph
  gRNA
gaugcagccgacagccgagu

SEQ ID NO: 110920 - RNA, 20 nt, Artificial Sequence
  MKO10110920_B_Pspn
  gRNA
ccagccgaggcucgggugca

SEQ ID NO: 110921 - RNA, 20 nt, Artificial Sequence
  MKO10110921_B_Pspn
  gRNA
gucaucuuccgauacugugc

SEQ ID NO: 110922 - RNA, 20 nt, Artificial Sequence
  MKO10110922_B_Pspn
  gRNA
ucuccuccgaggcauagccc

SEQ ID NO: 110923 - RNA, 20 nt, Artificial Sequence
  MKO10110923_B_Psrc1
  gRNA
ccaagcgccauagggcacag

SEQ ID NO: 110924 - RNA, 20 nt, Artificial Sequence
  MKO10110924_B_Psrc1
  gRNA
acgagaccuuggacuucgga

SEQ ID NO: 110925 - RNA, 20 nt, Artificial Sequence
  MKO10110925_B_Psrc1
  gRNA
ggaaaacuggguucggugcc

SEQ ID NO: 110926 - RNA, 20 nt, Artificial Sequence
  MKO10110926_B_Pstk
  gRNA
gcaacaaaccagucaccucc

SEQ ID NO: 110927 - RNA, 20 nt, Artificial Sequence
  MKO10110927_B_Pstk
  gRNA
gaacugucucucagacgaug

SEQ ID NO: 110928 - RNA, 20 nt, Artificial Sequence
  MKO10110928_B_Pstk
  gRNA
gugucucaucagcuuuauga

SEQ ID NO: 110929 - RNA, 20 nt, Artificial Sequence
  MKO10110929_B_Pstpip1
  gRNA
ucccguaccucuccuccgcc

SEQ ID NO: 110930 - RNA, 20 nt, Artificial Sequence
  MKO10110930_B_Pstpip1
  gRNA
ggcuccgcagcuccucacgc

SEQ ID NO: 110931 - RNA, 20 nt, Artificial Sequence
  MKO10110931_B_Pstpip1
  gRNA
gguaugaggugcuacugcag

SEQ ID NO: 110932 - RNA, 20 nt, Artificial Sequence
  MKO10110932_B_Pstpip2
  gRNA
gcagaagcugcagcggaaaa

SEQ ID NO: 110933 - RNA, 20 nt, Artificial Sequence
  MKO10110933_B_Pstpip2
  gRNA
aagaccugcugaaccucucc

SEQ ID NO: 110934 - RNA, 20 nt, Artificial Sequence
  MKO10110934_B_Pstpip2
  gRNA
ugcgcagacucuaagagaag

SEQ ID NO: 110935 - RNA, 20 nt, Artificial Sequence
  MKO10110935_B_Puafr
  gRNA
auugucuacuacuacaacga

SEQ ID NO: 110936 - RNA, 20 nt, Artificial Sequence
  MKO10110936_B_Puafr
  gRNA
caccaaccuagugcccaaua

SEQ ID NO: 110937 - RNA, 20 nt, Artificial Sequence
  MKO10110937_B_Puafr
  gRNA
gauaggcuacugccugguag

SEQ ID NO: 110938 - RNA, 20 nt, Artificial Sequence
  MKO10110938_B_Puar1
  gRNA
uccaauuaaggaucugcauc

SEQ ID NO: 110939 - RNA, 20 nt, Artificial Sequence
  MKO10110939_B_Puar1
  gRNA
ucuguaaaacccagaugcga

SEQ ID NO: 110940 - RNA, 20 nt, Artificial Sequence
  MKO10110940_B_Puar1
  gRNA
acucuuaggaaacuuaguua

SEQ ID NO: 110941 - RNA, 20 nt, Artificial Sequence
  MKO10110941_B_Ptbp1
  gRNA
uuuguaccgacugcuauguc

SEQ ID NO: 110942 - RNA, 20 nt, Artificial Sequence
  MKO10110942_B_Ptbp1
  gRNA
aucgucccagacauagcagu

SEQ ID NO: 110943 - RNA, 20 nt, Artificial Sequence
  MKO10110943_B_Ptbp1
  gRNA
ggcagagcugcucaugauga

SEQ ID NO: 110944 - RNA, 20 nt, Artificial Sequence
  MKO10110944_B_Ptbp2
  gRNA
aguacuggauguaaauuggu

SEQ ID NO: 110945 - RNA, 20 nt, Artificial Sequence
  MKO10110945_B_Ptbp2
  gRNA
agccccaacucuaauaugag

SEQ ID NO: 110946 - RNA, 20 nt, Artificial Sequence
  MKO10110946_B_Ptbp2
  gRNA
ccuuuacagaauugucacug

SEQ ID NO: 110947 - RNA, 20 nt, Artificial Sequence
  MKO10110947_B_Ptbp3
  gRNA
uuggaauacuggauauaaac

SEQ ID NO: 110948 - RNA, 20 nt, Artificial Sequence
  MKO10110948_B_Ptbp3
  gRNA
agaacacgggaaggcgaaca

SEQ ID NO: 110949 - RNA, 20 nt, Artificial Sequence
  MKO10110949_B_Ptbp3
  gRNA
ugcagaagucgagcuguuca

SEQ ID NO: 110950 - RNA, 20 nt, Artificial Sequence
  MKO10110950_B_Pucd1
  gRNA
aacguaucaugcccugcuga

SEQ ID NO: 110951 - RNA, 20 nt, Artificial Sequence
  MKO10110951_B_Pucd1
  gRNA
auugggggcugcgggcgcgu

SEQ ID NO: 110952 - RNA, 20 nt, Artificial Sequence
  MKO10110952_B_Pucd1
  gRNA
ccgccaagugugcagaccuc

SEQ ID NO: 110953 - RNA, 20 nt, Artificial Sequence
  MKO10110953_B_Pucd2
  gRNA
agcgccucaccuauaaauga

SEQ ID NO: 110954 - RNA, 20 nt, Artificial Sequence
  MKO10110954_B_Pucd2
  gRNA
cagauauuaccuuuggugcc

SEQ ID NO: 110955 - RNA, 20 nt, Artificial Sequence
  MKO10110955_B_Pucd2
  gRNA
uauugaaugacguugaaucu

SEQ ID NO: 110956 - RNA, 20 nt, Artificial Sequence
  MKO10110956_B_Pucd3
  gRNA
ccuacuuacccuguuuacug

SEQ ID NO: 110957 - RNA, 20 nt, Artificial Sequence
  MKO10110957_B_Pucd3
  gRNA
gaaucccucccaaagguuga

SEQ ID NO: 110958 - RNA, 20 nt, Artificial Sequence
  MKO10110958_B_Pucd3
  gRNA
ccucauaccaaccucugcuc

SEQ ID NO: 110959 - RNA, 20 nt, Artificial Sequence
  MKO10110959_B_Puch1
  gRNA
ucccaauaggcaauggaagu

SEQ ID NO: 110960 - RNA, 20 nt, Artificial Sequence
  MKO10110960_B_Puch1
  gRNA
cguccccaggggaaggcuac

SEQ ID NO: 110961 - RNA, 20 nt, Artificial Sequence
  MKO10110961_B_Puch1
  gRNA
gaaggggcaaagcuacaguc

SEQ ID NO: 110962 - RNA, 20 nt, Artificial Sequence
  MKO10110962_B_Puch2
  gRNA
uggcuucgagcuuacuucca

SEQ ID NO: 110963 - RNA, 20 nt, Artificial Sequence
  MKO10110963_B_Puch2
  gRNA
uugaaaaugggaugaucgag

SEQ ID NO: 110964 - RNA, 20 nt, Artificial Sequence
  MKO10110964_B_Puch2
  gRNA
gcaaguaggcagagcccccu

SEQ ID NO: 110965 - RNA, 20 nt, Artificial Sequence
  MKO10110965_B_Puchd1
  gRNA
gauagcaaaauugguccgau

SEQ ID NO: 110966 - RNA, 20 nt, Artificial Sequence
  MKO10110966_B_Puchd1
  gRNA
ccguguaucagaacguuacc

SEQ ID NO: 110967 - RNA, 20 nt, Artificial Sequence
  MKO10110967_B_Puchd1
  gRNA
cuccaagcaccggcucuacu

SEQ ID NO: 110968 - RNA, 20 nt, Artificial Sequence
  MKO10110968_B_Puchd2
  gRNA
gagcuucguagucacguaug

SEQ ID NO: 110969 - RNA, 20 nt, Artificial Sequence
  MKO10110969_B_Puchd2
  gRNA
auucaucaacacuuaccgcc

SEQ ID NO: 110970 - RNA, 20 nt, Artificial Sequence
  MKO10110970_B_Puchd2
  gRNA
gcuucccaacuacuacucag

SEQ ID NO: 110971 - RNA, 20 nt, Artificial Sequence
  MKO10110971_B_Puchd3
  gRNA
uugucuaucaaugaaccgaa

SEQ ID NO: 110972 - RNA, 20 nt, Artificial Sequence
  MKO10110972_B_Puchd3
  gRNA
cacccccuacuucaauguag

SEQ ID NO: 110973 - RNA, 20 nt, Artificial Sequence
  MKO10110973_B_Puchd3
  gRNA
cgugaucccccuguuucacu

SEQ ID NO: 110974 - RNA, 20 nt, Artificial Sequence
  MKO10110974_B_Puchd4
  gRNA
cuuaugcgugagccggcacc

SEQ ID NO: 110975 - RNA, 20 nt, Artificial Sequence
  MKO10110975_B_Puchd4
  gRNA
guguggcagaaccauagguc

SEQ ID NO: 110976 - RNA, 20 nt, Artificial Sequence
  MKO10110976_B_Puchd4
  gRNA
cuugcgcaguaagcccuucc

SEQ ID NO: 110977 - RNA, 20 nt, Artificial Sequence
  MKO10110977_B_Pucra
  gRNA
cucuggcaccggacggcacc

SEQ ID NO: 110978 - RNA, 20 nt, Artificial Sequence
  MKO10110978_B_Pucra
  gRNA
caggggaaucuucgacagcc

SEQ ID NO: 110979 - RNA, 20 nt, Artificial Sequence
  MKO10110979_B_Pucra
  gRNA
ggugcuggcccgccagcaca

SEQ ID NO: 110980 - RNA, 20 nt, Artificial Sequence
  MKO10110980_B_Ptdss1
  gRNA
cucgaccucauccagccuua

SEQ ID NO: 110981 - RNA, 20 nt, Artificial Sequence
  MKO10110981_B_Ptdss1
  gRNA
gcuggacaaucaguaucacc

SEQ ID NO: 110982 - RNA, 20 nt, Artificial Sequence
  MKO10110982_B_Ptdss1
  gRNA
gugacuaacgauucucuccc

SEQ ID NO: 110983 - RNA, 20 nt, Artificial Sequence
  MKO10110983_B_Ptdss2
  gRNA
guucauccucaccugugcgc

SEQ ID NO: 110984 - RNA, 20 nt, Artificial Sequence
  MKO10110984_B_Ptdss2
  gRNA
ugaguuaccuggaugagguc

SEQ ID NO: 110985 - RNA, 20 nt, Artificial Sequence
  MKO10110985_B_Ptdss2
  gRNA
cugacccuuuccacaacauc

SEQ ID NO: 110986 - RNA, 20 nt, Artificial Sequence
  MKO10110986_B_Pten
  gRNA
acaauauugaugauguagua

SEQ ID NO: 110987 - RNA, 20 nt, Artificial Sequence
  MKO10110987_B_Pten
  gRNA
cauaccucugcaguuaaauu

SEQ ID NO: 110988 - RNA, 20 nt, Artificial Sequence
  MKO10110988_B_Pten
  gRNA
aaucccauagcaauaauauu

SEQ ID NO: 110989 - RNA, 20 nt, Artificial Sequence
  MKO10110989_B_Pter
  gRNA
ugcucaacuuggcugcuacu

SEQ ID NO: 110990 - RNA, 20 nt, Artificial Sequence
  MKO10110990_B_Pter
  gRNA
cgugcauacgcugaaguggc

SEQ ID NO: 110991 - RNA, 20 nt, Artificial Sequence
  MKO10110991_B_Pter
  gRNA
uugaugaaguacggagguca

SEQ ID NO: 110992 - RNA, 20 nt, Artificial Sequence
  MKO10110992_B_Ptf1a
  gRNA
ucauccguacagcuaaagug

SEQ ID NO: 110993 - RNA, 20 nt, Artificial Sequence
  MKO10110993_B_Ptf1a
  gRNA
gguagcaguauucguguagc

SEQ ID NO: 110994 - RNA, 20 nt, Artificial Sequence
  MKO10110994_B_Ptf1a
  gRNA
guccaucaacgacgccuucg

SEQ ID NO: 110995 - RNA, 20 nt, Artificial Sequence
  MKO10110995_B_Pugdr
  gRNA
cuccaguuucuguagaucag

SEQ ID NO: 110996 - RNA, 20 nt, Artificial Sequence
  MKO10110996_B_Pugdr
  gRNA
ucugggcaaucuucuggcgc

SEQ ID NO: 110997 - RNA, 20 nt, Artificial Sequence
  MKO10110997_B_Pugdr
  gRNA
gccacuacacccgccgcccu

SEQ ID NO: 110998 - RNA, 20 nt, Artificial Sequence
  MKO10110998_B_Pugds
  gRNA
ccgcgcuguaccagcgcccc

SEQ ID NO: 110999 - RNA, 20 nt, Artificial Sequence
  MKO10110999_B_Pugds
  gRNA
cccccucacccgguuggggc

SEQ ID NO: 111000 - RNA, 20 nt, Artificial Sequence
  MKO10111000_B_Pugds
  gRNA
uaguguccaggagcccccgc

SEQ ID NO: 111001 - RNA, 20 nt, Artificial Sequence
  MKO10111001_B_Puger1
  gRNA
guuagaguuccagcccccga

SEQ ID NO: 111002 - RNA, 20 nt, Artificial Sequence
  MKO10111002_B_Puger1
  gRNA
cgacgauuccgaaagaccgc

SEQ ID NO: 111003 - RNA, 20 nt, Artificial Sequence
  MKO10111003_B_Puger1
  gRNA
gaugugccauuaucgccugu

SEQ ID NO: 111004 - RNA, 20 nt, Artificial Sequence
  MKO10111004_B_Puger2
  gRNA
ucagugaaguccgacaacag

SEQ ID NO: 111005 - RNA, 20 nt, Artificial Sequence
  MKO10111005_B_Puger2
  gRNA
uccgacggugcaugcgaaug

SEQ ID NO: 111006 - RNA, 20 nt, Artificial Sequence
  MKO10111006_B_Puger2
  gRNA
accucauucgcaugcaccgu

SEQ ID NO: 111007 - RNA, 20 nt, Artificial Sequence
  MKO10111007_B_Puger3
  gRNA
agaucugguucagcgaagcc

SEQ ID NO: 111008 - RNA, 20 nt, Artificial Sequence
  MKO10111008_B_Puger3
  gRNA
cugcaaugaaaguccacuuc

SEQ ID NO: 111009 - RNA, 20 nt, Artificial Sequence
  MKO10111009_B_Puger3
  gRNA
agaugaugaacaaccugaag

SEQ ID NO: 111010 - RNA, 20 nt, Artificial Sequence
  MKO10111010_B_Puger4
  gRNA
aauucgcaaaguucucagcg

SEQ ID NO: 111011 - RNA, 20 nt, Artificial Sequence
  MKO10111011_B_Puger4
  gRNA
aagagacugauggcugaggu

SEQ ID NO: 111012 - RNA, 20 nt, Artificial Sequence
  MKO10111012_B_Puger4
  gRNA
aguauugugcaagucgcgca

SEQ ID NO: 111013 - RNA, 20 nt, Artificial Sequence
  MKO10111013_B_Puges2
  gRNA
uagugcccucaagaccuacc

SEQ ID NO: 111014 - RNA, 20 nt, Artificial Sequence
  MKO10111014_B_Puges2
  gRNA
agaagggacaugucuuguac

SEQ ID NO: 111015 - RNA, 20 nt, Artificial Sequence
  MKO10111015_B_Puges2
  gRNA
ccaguacuuguugcaaaacu

SEQ ID NO: 111016 - RNA, 20 nt, Artificial Sequence
  MKO10111016_B_Puges3l
  gRNA
cgagauugaauucuaugcca

SEQ ID NO: 111017 - RNA, 20 nt, Artificial Sequence
  MKO10111017_B_Puges3l
  gRNA
ucagguggaacauuaugcag

SEQ ID NO: 111018 - RNA, 20 nt, Artificial Sequence
  MKO10111018_B_Puges3l
  gRNA
gacucccaggauaagcguuc

SEQ ID NO: 111019 - RNA, 20 nt, Artificial Sequence
  MKO10111019_B_Puges3
  gRNA
aaaaacuuaccucagagaaa

SEQ ID NO: 111020 - RNA, 20 nt, Artificial Sequence
  MKO10111020_B_Puges3
  gRNA
gcccuuuccuuuguuaaccu

SEQ ID NO: 111021 - RNA, 20 nt, Artificial Sequence
  MKO10111021_B_Puges3
  gRNA
aauccggccagucauggccu

SEQ ID NO: 111022 - RNA, 20 nt, Artificial Sequence
  MKO10111022_B_Puges
  gRNA
uacgcgguggcugucaucac

SEQ ID NO: 111023 - RNA, 20 nt, Artificial Sequence
  MKO10111023_B_Puges
  gRNA
uccacguuucagcgcauccu

SEQ ID NO: 111024 - RNA, 20 nt, Artificial Sequence
  MKO10111024_B_Puges
  gRNA
cagauguggagcgcugccuc

SEQ ID NO: 111025 - RNA, 20 nt, Artificial Sequence
  MKO10111025_B_Pugfrn
  gRNA
guguccgacuuaccgugucg

SEQ ID NO: 111026 - RNA, 20 nt, Artificial Sequence
  MKO10111026_B_Pugfrn
  gRNA
gacguacgccuggacacagu

SEQ ID NO: 111027 - RNA, 20 nt, Artificial Sequence
  MKO10111027_B_Pugfrn
  gRNA
cacuguccagggcaacuacg

SEQ ID NO: 111028 - RNA, 20 nt, Artificial Sequence
  MKO10111028_B_Pugfr
  gRNA
aaacuugccagucguugcug

SEQ ID NO: 111029 - RNA, 20 nt, Artificial Sequence
  MKO10111029_B_Pugfr
  gRNA
cuucucgugcaaugccguca

SEQ ID NO: 111030 - RNA, 20 nt, Artificial Sequence
  MKO10111030_B_Pugfr
  gRNA
acacagagcacaucgaagac

SEQ ID NO: 111031 - RNA, 20 nt, Artificial Sequence
  MKO10111031_B_Pugir
  gRNA
ggggcgccugcaaaucccca

SEQ ID NO: 111032 - RNA, 20 nt, Artificial Sequence
  MKO10111032_B_Pugir
  gRNA
caccagcacgcugauguucg

SEQ ID NO: 111033 - RNA, 20 nt, Artificial Sequence
  MKO10111033_B_Pugir
  gRNA
ccccuaccuguacgcccagc

SEQ ID NO: 111034 - RNA, 20 nt, Artificial Sequence
  MKO10111034_B_Pugis
  gRNA
cauguauaccaaccuucgca

SEQ ID NO: 111035 - RNA, 20 nt, Artificial Sequence
  MKO10111035_B_Pugis
  gRNA
gagaccuggugagccuccgu

SEQ ID NO: 111036 - RNA, 20 nt, Artificial Sequence
  MKO10111036_B_Pugis
  gRNA
gugggagcugcguacacggc

SEQ ID NO: 111037 - RNA, 20 nt, Artificial Sequence
  MKO10111037_B_Pugr1
  gRNA
ugcugcugcgcugaccauca

SEQ ID NO: 111038 - RNA, 20 nt, Artificial Sequence
  MKO10111038_B_Pugr1
  gRNA
caggaugaugggcgagcaag

SEQ ID NO: 111039 - RNA, 20 nt, Artificial Sequence
  MKO10111039_B_Pugr1
  gRNA
ucucuguggauccuuacaug

SEQ ID NO: 111040 - RNA, 20 nt, Artificial Sequence
  MKO10111040_B_Pugr2
  gRNA
auccagucgcagagaacuuc

SEQ ID NO: 111041 - RNA, 20 nt, Artificial Sequence
  MKO10111041_B_Pugr2
  gRNA
ccagcgcuguaagaugaacg

SEQ ID NO: 111042 - RNA, 20 nt, Artificial Sequence
  MKO10111042_B_Pugr2
  gRNA
uuaccggaugcucucaauga

SEQ ID NO: 111043 - RNA, 20 nt, Artificial Sequence
  MKO10111043_B_Pugs1
  gRNA
ccgcagagaauuccgaagcc

SEQ ID NO: 111044 - RNA, 20 nt, Artificial Sequence
  MKO10111044_B_Pugs1
  gRNA
guagucaugcgcugaguugu

SEQ ID NO: 111045 - RNA, 20 nt, Artificial Sequence
  MKO10111045_B_Pugs1
  gRNA
ccgugcgaguacaaucacac

SEQ ID NO: 111046 - RNA, 20 nt, Artificial Sequence
  MKO10111046_B_Pugs2
  gRNA
auuucaugauuaaacuucgc

SEQ ID NO: 111047 - RNA, 20 nt, Artificial Sequence
  MKO10111047_B_Pugs2
  gRNA
ccuacuuacaaugugcacua

SEQ ID NO: 111048 - RNA, 20 nt, Artificial Sequence
  MKO10111048_B_Pugs2
  gRNA
uccaauccaugucaaaaccg

SEQ ID NO: 111049 - RNA, 20 nt, Artificial Sequence
  MKO10111049_B_Pth1r
  gRNA
cccaccggcagcaggcgccg

SEQ ID NO: 111050 - RNA, 20 nt, Artificial Sequence
  MKO10111050_B_Pth1r
  gRNA
uuuccugcugcaccgugccc

SEQ ID NO: 111051 - RNA, 20 nt, Artificial Sequence
  MKO10111051_B_Pth1r
  gRNA
uggacgccagcaucuacguc

SEQ ID NO: 111052 - RNA, 20 nt, Artificial Sequence
  MKO10111052_B_Pth2r
  gRNA
guuuacgacuucaaucauaa

SEQ ID NO: 111053 - RNA, 20 nt, Artificial Sequence
  MKO10111053_B_Pth2r
  gRNA
uucucauuauuggcuacuuc

SEQ ID NO: 111054 - RNA, 20 nt, Artificial Sequence
  MKO10111054_B_Pth2r
  gRNA
gcagauuguucuuguuauga

SEQ ID NO: 111055 - RNA, 20 nt, Artificial Sequence
  MKO10111055_B_Pth2
  gRNA
gguguugcccugccccucgc

SEQ ID NO: 111056 - RNA, 20 nt, Artificial Sequence
  MKO10111056_B_Pth2
  gRNA
ggggcuacccaagcccgccc

SEQ ID NO: 111057 - RNA, 20 nt, Artificial Sequence
  MKO10111057_B_Pth2
  gRNA
ccgcccuggagcgccgccgc

SEQ ID NO: 111058 - RNA, 20 nt, Artificial Sequence
  MKO10111058_B_Pthlh
  gRNA
aucgucugacccaaaccgca

SEQ ID NO: 111059 - RNA, 20 nt, Artificial Sequence
  MKO10111059_B_Pthlh
  gRNA
agcuacuccgugcccucccg

SEQ ID NO: 111060 - RNA, 20 nt, Artificial Sequence
  MKO10111060_B_Pthlh
  gRNA
uuuguacgucuccaccuugu

SEQ ID NO: 111061 - RNA, 20 nt, Artificial Sequence
  MKO10111061_B_Pth
  gRNA
guccaaauggcugccagaga

SEQ ID NO: 111062 - RNA, 20 nt, Artificial Sequence
  MKO10111062_B_Pth
  gRNA
uaaagugaugaucaucaugc

SEQ ID NO: 111063 - RNA, 20 nt, Artificial Sequence
  MKO10111063_B_Pth
  gRNA
gaugaucaucacuuuagcca

SEQ ID NO: 111064 - RNA, 20 nt, Artificial Sequence
  MKO10111064_B_Ptk2b
  gRNA
ccuucaaauccgcuacuugc

SEQ ID NO: 111065 - RNA, 20 nt, Artificial Sequence
  MKO10111065_B_Ptk2b
  gRNA
cugcacccacagaugaccgu

SEQ ID NO: 111066 - RNA, 20 nt, Artificial Sequence
  MKO10111066_B_Ptk2b
  gRNA
agcguugcauguagucauuc

SEQ ID NO: 111067 - RNA, 20 nt, Artificial Sequence
  MKO10111067_B_Ptk2
  gRNA
acugaggcgaaauccauagc

SEQ ID NO: 111068 - RNA, 20 nt, Artificial Sequence
  MKO10111068_B_Ptk2
  gRNA
agaauucguuacuugccaaa

SEQ ID NO: 111069 - RNA, 20 nt, Artificial Sequence
  MKO10111069_B_Ptk2
  gRNA
auugaauuucuucuaucaac

SEQ ID NO: 111070 - RNA, 20 nt, Artificial Sequence
  MKO10111070_B_Ptk6
  gRNA
aaccugcugcagcuacugcg

SEQ ID NO: 111071 - RNA, 20 nt, Artificial Sequence
  MKO10111071_B_Ptk6
  gRNA
uaccacgcaguagcugcagc

SEQ ID NO: 111072 - RNA, 20 nt, Artificial Sequence
  MKO10111072_B_Ptk6
  gRNA
gggaggucuuugaagcgcuc

SEQ ID NO: 111073 - RNA, 20 nt, Artificial Sequence
  MKO10111073_B_Ptk7
  gRNA
cguuaucccgagccacacac

SEQ ID NO: 111074 - RNA, 20 nt, Artificial Sequence
  MKO10111074_B_Ptk7
  gRNA
cucccaucacuaaccgaagc

SEQ ID NO: 111075 - RNA, 20 nt, Artificial Sequence
  MKO10111075_B_Ptk7
  gRNA
acacugcgaugucacauuga

SEQ ID NO: 111076 - RNA, 20 nt, Artificial Sequence
  MKO10111076_B_Ptma
  gRNA
uuaaagcaaaaugaggaaaa

SEQ ID NO: 111077 - RNA, 20 nt, Artificial Sequence
  MKO10111077_B_Ptma
  gRNA
aaaggacuugaaggagaaga

SEQ ID NO: 111078 - RNA, 20 nt, Artificial Sequence
  MKO10111078_B_Ptma
  gRNA
ggagcaggaggcugacaaug

SEQ ID NO: 111079 - RNA, 20 nt, Artificial Sequence
  MKO10111079_B_Ptms
  gRNA
aggaggaugaaggccccgug

SEQ ID NO: 111080 - RNA, 20 nt, Artificial Sequence
  MKO10111080_B_Ptms
  gRNA
agguggaggagaaggccggc

SEQ ID NO: 111081 - RNA, 20 nt, Artificial Sequence
  MKO10111081_B_Ptms
  gRNA
uccccauaggaggaggagaa

SEQ ID NO: 111082 - RNA, 20 nt, Artificial Sequence
  MKO10111082_B_Ptn
  gRNA
gccaguucuggucuucaagg

SEQ ID NO: 111083 - RNA, 20 nt, Artificial Sequence
  MKO10111083_B_Ptn
  gRNA
ccaagaugaaaaucaaugcc

SEQ ID NO: 111084 - RNA, 20 nt, Artificial Sequence
  MKO10111084_B_Ptn
  gRNA
uacguugcugcugauauugc

SEQ ID NO: 111085 - RNA, 20 nt, Artificial Sequence
  MKO10111085_B_Ptov1
  gRNA
cuuggcuguggaguccgaga

SEQ ID NO: 111086 - RNA, 20 nt, Artificial Sequence
  MKO10111086_B_Ptov1
  gRNA
ccuguuccgaaacucucagc

SEQ ID NO: 111087 - RNA, 20 nt, Artificial Sequence
  MKO10111087_B_Ptov1
  gRNA
ugagcugcaugaucaacuuc

SEQ ID NO: 111088 - RNA, 20 nt, Artificial Sequence
  MKO10111088_B_Ptp4a1
  gRNA
ugccaaggccugcgacacaa

SEQ ID NO: 111089 - RNA, 20 nt, Artificial Sequence
  MKO10111089_B_Ptp4a1
  gRNA
ccaaccagauugucgaugac

SEQ ID NO: 111090 - RNA, 20 nt, Artificial Sequence
  MKO10111090_B_Ptp4a1
  gRNA
guugcccuagcauuaauuga

SEQ ID NO: 111091 - RNA, 20 nt, Artificial Sequence
  MKO10111091_B_Ptp4a2
  gRNA
accaaauuucgugaagagcc

SEQ ID NO: 111092 - RNA, 20 nt, Artificial Sequence
  MKO10111092_B_Ptp4a2
  gRNA
caggauuggccguuugauga

SEQ ID NO: 111093 - RNA, 20 nt, Artificial Sequence
  MKO10111093_B_Ptp4a2
  gRNA
gcgcuugcauugauugaaug

SEQ ID NO: 111094 - RNA, 20 nt, Artificial Sequence
  MKO10111094_B_Ptp4a3
  gRNA
agggggcgcuccaucaucaa

SEQ ID NO: 111095 - RNA, 20 nt, Artificial Sequence
  MKO10111095_B_Ptp4a3
  gRNA
gagcuacaugacgcagcauc

SEQ ID NO: 111096 - RNA, 20 nt, Artificial Sequence
  MKO10111096_B_Ptp4a3
  gRNA
cuugucugcaggaagcgccg

SEQ ID NO: 111097 - RNA, 20 nt, Artificial Sequence
  MKO10111097_B_Ptpdc1
  gRNA
auggcauguuccauggcgug

SEQ ID NO: 111098 - RNA, 20 nt, Artificial Sequence
  MKO10111098_B_Ptpdc1
  gRNA
ucguccguccuccgagcugc

SEQ ID NO: 111099 - RNA, 20 nt, Artificial Sequence
  MKO10111099_B_Ptpdc1
  gRNA
caccuuuaccauguccaaga

SEQ ID NO: 111100 - RNA, 20 nt, Artificial Sequence
  MKO10111100_B_Ptplad1
  gRNA
caaugucuaugaauuucacc

SEQ ID NO: 111101 - RNA, 20 nt, Artificial Sequence
  MKO10111101_B_Ptplad1
  gRNA
uugucugugaugcugauagc

SEQ ID NO: 111102 - RNA, 20 nt, Artificial Sequence
  MKO10111102_B_Ptplad1
  gRNA
uuguuugcagcucagggaca

SEQ ID NO: 111103 - RNA, 20 nt, Artificial Sequence
  MKO10111103_B_Ptplad2
  gRNA
uauuugccaguauccaugag

SEQ ID NO: 111104 - RNA, 20 nt, Artificial Sequence
  MKO10111104_B_Ptplad2
  gRNA
ccauauccaguagauuccaa

SEQ ID NO: 111105 - RNA, 20 nt, Artificial Sequence
  MKO10111105_B_Ptplad2
  gRNA
uguuugacugagccauguca

SEQ ID NO: 111106 - RNA, 20 nt, Artificial Sequence
  MKO10111106_B_Ptpla
  gRNA
ggucaccauggcguccagug

SEQ ID NO: 111107 - RNA, 20 nt, Artificial Sequence
  MKO10111107_B_Ptpla
  gRNA
guugguucuugcuauugcua

SEQ ID NO: 111108 - RNA, 20 nt, Artificial Sequence
  MKO10111108_B_Ptpla
  gRNA
ccucaagcaaagcaaauguu

SEQ ID NO: 111109 - RNA, 20 nt, Artificial Sequence
  MKO10111109_B_Ptplb
  gRNA
ccuccaguaaggcuccuguc

SEQ ID NO: 111110 - RNA, 20 nt, Artificial Sequence
  MKO10111110_B_Ptplb
  gRNA
uaugugucacugcccauauu

SEQ ID NO: 111111 - RNA, 20 nt, Artificial Sequence
  MKO10111111_B_Ptplb
  gRNA
uguuguccugacuucuuucc

SEQ ID NO: 111112 - RNA, 20 nt, Artificial Sequence
  MKO10111112_B_Ptpmt1
  gRNA
guacuggacgagaacgugcg

SEQ ID NO: 111113 - RNA, 20 nt, Artificial Sequence
  MKO10111113_B_Ptpmt1
  gRNA
auuccugugcaacaccucga

SEQ ID NO: 111114 - RNA, 20 nt, Artificial Sequence
  MKO10111114_B_Ptpmt1
  gRNA
cucagcacagucgacaugac

SEQ ID NO: 111115 - RNA, 20 nt, Artificial Sequence
  MKO10111115_B_Ptpn11
  gRNA
gacuacuaugaccucuaugg

SEQ ID NO: 111116 - RNA, 20 nt, Artificial Sequence
  MKO10111116_B_Ptpn11
  gRNA
cugaaccaguucagccaaag

SEQ ID NO: 111117 - RNA, 20 nt, Artificial Sequence
  MKO10111117_B_Ptpn11
  gRNA
ugguuucaccccaacaucac

SEQ ID NO: 111118 - RNA, 20 nt, Artificial Sequence
  MKO10111118_B_Ptpn12
  gRNA
cgaauacagucauagacuuc

SEQ ID NO: 111119 - RNA, 20 nt, Artificial Sequence
  MKO10111119_B_Ptpn12
  gRNA
aagauuuaucccacagccac

SEQ ID NO: 111120 - RNA, 20 nt, Artificial Sequence
  MKO10111120_B_Ptpn12
  gRNA
cauugauauaaucugaaucu

SEQ ID NO: 111121 - RNA, 20 nt, Artificial Sequence
  MKO10111121_B_Ptpn13
  gRNA
cgaauggccuggcuccgguc

SEQ ID NO: 111122 - RNA, 20 nt, Artificial Sequence
  MKO10111122_B_Ptpn13
  gRNA
ccaucuuaauagcauccugc

SEQ ID NO: 111123 - RNA, 20 nt, Artificial Sequence
  MKO10111123_B_Ptpn13
  gRNA
aagauggucucccagcuuga

SEQ ID NO: 111124 - RNA, 20 nt, Artificial Sequence
  MKO10111124_B_Ptpn14
  gRNA
gucaaaaaagacgugcuuga

SEQ ID NO: 111125 - RNA, 20 nt, Artificial Sequence
  MKO10111125_B_Ptpn14
  gRNA
gcucccuggaacaagugauc

SEQ ID NO: 111126 - RNA, 20 nt, Artificial Sequence
  MKO10111126_B_Ptpn14
  gRNA
agaguaugugcucuuuccua

SEQ ID NO: 111127 - RNA, 20 nt, Artificial Sequence
  MKO10111127_B_Ptpn18
  gRNA
uagccugacccggaugaagu

SEQ ID NO: 111128 - RNA, 20 nt, Artificial Sequence
  MKO10111128_B_Ptpn18
  gRNA
accccugccucacacacugu

SEQ ID NO: 111129 - RNA, 20 nt, Artificial Sequence
  MKO10111129_B_Ptpn18
  gRNA
acaucaaugccaacuucauc

SEQ ID NO: 111130 - RNA, 20 nt, Artificial Sequence
  MKO10111130_B_Ptpn1
  gRNA
ggcccuuuaccaaacacaug

SEQ ID NO: 111131 - RNA, 20 nt, Artificial Sequence
  MKO10111131_B_Ptpn1
  gRNA
ugauauagucauuaucuucc

SEQ ID NO: 111132 - RNA, 20 nt, Artificial Sequence
  MKO10111132_B_Ptpn1
  gRNA
gaggagcuauauucucaccc

SEQ ID NO: 111133 - RNA, 20 nt, Artificial Sequence
  MKO10111133_B_Ptpn20
  gRNA
cauacuuaucugagaaugac

SEQ ID NO: 111134 - RNA, 20 nt, Artificial Sequence
  MKO10111134_B_Ptpn20
  gRNA
uaauauucaacaguucugca

SEQ ID NO: 111135 - RNA, 20 nt, Artificial Sequence
  MKO10111135_B_Ptpn20
  gRNA
gcagaacuguugaauauuaa

SEQ ID NO: 111136 - RNA, 20 nt, Artificial Sequence
  MKO10111136_B_Ptpn21
  gRNA
ccuuacugcaccagaaauac

SEQ ID NO: 111137 - RNA, 20 nt, Artificial Sequence
  MKO10111137_B_Ptpn21
  gRNA
auuagaacacgccauucagc

SEQ ID NO: 111138 - RNA, 20 nt, Artificial Sequence
  MKO10111138_B_Ptpn21
  gRNA
gaaauuugccuugcuccccg

SEQ ID NO: 111139 - RNA, 20 nt, Artificial Sequence
  MKO10111139_B_Ptpn22
  gRNA
gaguuguagauaaaggaccc

SEQ ID NO: 111140 - RNA, 20 nt, Artificial Sequence
  MKO10111140_B_Ptpn22
  gRNA
uaucaaugccagcuuuauua

SEQ ID NO: 111141 - RNA, 20 nt, Artificial Sequence
  MKO10111141_B_Ptpn22
  gRNA
cugccucuaggucauuguca

SEQ ID NO: 111142 - RNA, 20 nt, Artificial Sequence
  MKO10111142_B_Ptpn23
  gRNA
ugaagacaucaaguacgagc

SEQ ID NO: 111143 - RNA, 20 nt, Artificial Sequence
  MKO10111143_B_Ptpn23
  gRNA
cuucuuuaguuccucguugu

SEQ ID NO: 111144 - RNA, 20 nt, Artificial Sequence
  MKO10111144_B_Ptpn23
  gRNA
aggugcacugcacuccaugc

SEQ ID NO: 111145 - RNA, 20 nt, Artificial Sequence
  MKO10111145_B_Ptpn2
  gRNA
ggaaacuuggccacucuaug

SEQ ID NO: 111146 - RNA, 20 nt, Artificial Sequence
  MKO10111146_B_Ptpn2
  gRNA
cucuucuaugucaacuaagc

SEQ ID NO: 111147 - RNA, 20 nt, Artificial Sequence
  MKO10111147_B_Ptpn2
  gRNA
cgaacacaugcugccauuuc

SEQ ID NO: 111148 - RNA, 20 nt, Artificial Sequence
  MKO10111148_B_Ptpn3
  gRNA
cacuccacagagauggcuug

SEQ ID NO: 111149 - RNA, 20 nt, Artificial Sequence
  MKO10111149_B_Ptpn3
  gRNA
ugaucccaacacacugcagc

SEQ ID NO: 111150 - RNA, 20 nt, Artificial Sequence
  MKO10111150_B_Ptpn3
  gRNA
ccccucaggaagcagcugaa

SEQ ID NO: 111151 - RNA, 20 nt, Artificial Sequence
  MKO10111151_B_Ptpn4
  gRNA
uggauccaaacaaaccaaua

SEQ ID NO: 111152 - RNA, 20 nt, Artificial Sequence
  MKO10111152_B_Ptpn4
  gRNA
cucuuuagcugcuuccuuau

SEQ ID NO: 111153 - RNA, 20 nt, Artificial Sequence
  MKO10111153_B_Ptpn4
  gRNA
aguuacaagaagaguauaca

SEQ ID NO: 111154 - RNA, 20 nt, Artificial Sequence
  MKO10111154_B_Ptpn5
  gRNA
gaguggcucccagcgccuug

SEQ ID NO: 111155 - RNA, 20 nt, Artificial Sequence
  MKO10111155_B_Ptpn5
  gRNA
cgggcaccgcguccaggucc

SEQ ID NO: 111156 - RNA, 20 nt, Artificial Sequence
  MKO10111156_B_Ptpn5
  gRNA
ccaggguggugacgaugacc

SEQ ID NO: 111157 - RNA, 20 nt, Artificial Sequence
  MKO10111157_B_Ptpn6
  gRNA
ucggcccagccgcaagaacc

SEQ ID NO: 111158 - RNA, 20 nt, Artificial Sequence
  MKO10111158_B_Ptpn6
  gRNA
cgggugccuuugucuaccug

SEQ ID NO: 111159 - RNA, 20 nt, Artificial Sequence
  MKO10111159_B_Ptpn6
  gRNA
cuggcccagguuccccgcuc

SEQ ID NO: 111160 - RNA, 20 nt, Artificial Sequence
  MKO10111160_B_Ptpn7
  gRNA
uguagcggucuuuggaggcg

SEQ ID NO: 111161 - RNA, 20 nt, Artificial Sequence
  MKO10111161_B_Ptpn7
  gRNA
ugauguagucacuguccucc

SEQ ID NO: 111162 - RNA, 20 nt, Artificial Sequence
  MKO10111162_B_Ptpn7
  gRNA
gugcuccuuacuuggcaaga

SEQ ID NO: 111163 - RNA, 20 nt, Artificial Sequence
  MKO10111163_B_Ptpn9
  gRNA
ccacaagucugcccagcacg

SEQ ID NO: 111164 - RNA, 20 nt, Artificial Sequence
  MKO10111164_B_Ptpn9
  gRNA
gaacggagaggcuccucaug

SEQ ID NO: 111165 - RNA, 20 nt, Artificial Sequence
  MKO10111165_B_Ptpn9
  gRNA
gaaaguccuaaaccugcuga

SEQ ID NO: 111166 - RNA, 20 nt, Artificial Sequence
  MKO10111166_B_Ptpra
  gRNA
aaacacgauuacuagcagag

SEQ ID NO: 111167 - RNA, 20 nt, Artificial Sequence
  MKO10111167_B_Ptpra
  gRNA
aacucuuuccgccugucaaa

SEQ ID NO: 111168 - RNA, 20 nt, Artificial Sequence
  MKO10111168_B_Ptpra
  gRNA
guauuagaccacugccaaac

SEQ ID NO: 111169 - RNA, 20 nt, Artificial Sequence
  MKO10111169_B_Ptprb
  gRNA
guaaaguugucuauccgaau

SEQ ID NO: 111170 - RNA, 20 nt, Artificial Sequence
  MKO10111170_B_Ptprb
  gRNA
caucguucaagacacaaacg

SEQ ID NO: 111171 - RNA, 20 nt, Artificial Sequence
  MKO10111171_B_Ptprb
  gRNA
ucacuugguaaagccgucca

SEQ ID NO: 111172 - RNA, 20 nt, Artificial Sequence
  MKO10111172_B_Ptprcap
  gRNA
acuccuauagugcagugacc

SEQ ID NO: 111173 - RNA, 20 nt, Artificial Sequence
  MKO10111173_B_Ptprcap
  gRNA
ccccgaggaagcugccgcca

SEQ ID NO: 111174 - RNA, 20 nt, Artificial Sequence
  MKO10111174_B_Ptprcap
  gRNA
guacuaccacccagcucgcc

SEQ ID NO: 111175 - RNA, 20 nt, Artificial Sequence
  MKO10111175_B_Ptprc
  gRNA
cacaguaauguucccaaaca

SEQ ID NO: 111176 - RNA, 20 nt, Artificial Sequence
  MKO10111176_B_Ptprc
  gRNA
accacaacgaagcaaacaug

SEQ ID NO: 111177 - RNA, 20 nt, Artificial Sequence
  MKO10111177_B_Ptprc
  gRNA
cagauaugaccauggguuug

SEQ ID NO: 111178 - RNA, 20 nt, Artificial Sequence
  MKO10111178_B_Ptprd
  gRNA
ucaaucguagggaacccucu

SEQ ID NO: 111179 - RNA, 20 nt, Artificial Sequence
  MKO10111179_B_Ptprd
  gRNA
ucauaaauggccucaucccg

SEQ ID NO: 111180 - RNA, 20 nt, Artificial Sequence
  MKO10111180_B_Ptprd
  gRNA
gagaccccugucugaucaac

SEQ ID NO: 111181 - RNA, 20 nt, Artificial Sequence
  MKO10111181_B_Ptpre
  gRNA
ugggaugcaccaggguccgg

SEQ ID NO: 111182 - RNA, 20 nt, Artificial Sequence
  MKO10111182_B_Ptpre
  gRNA
cccacaggcccuccggaccc

SEQ ID NO: 111183 - RNA, 20 nt, Artificial Sequence
  MKO10111183_B_Ptpre
  gRNA
aacgacaagaaaaugccuaa

SEQ ID NO: 111184 - RNA, 20 nt, Artificial Sequence
  MKO10111184_B_Ptprf
  gRNA
ucgauagucgggaacccaga

SEQ ID NO: 111185 - RNA, 20 nt, Artificial Sequence
  MKO10111185_B_Ptprf
  gRNA
ucgucucgcugcacucguaa

SEQ ID NO: 111186 - RNA, 20 nt, Artificial Sequence
  MKO10111186_B_Ptprf
  gRNA
cccgccaaccuguaugugcg

SEQ ID NO: 111187 - RNA, 20 nt, Artificial Sequence
  MKO10111187_B_Ptprg
  gRNA
ucaccagaauacgcccagua

SEQ ID NO: 111188 - RNA, 20 nt, Artificial Sequence
  MKO10111188_B_Ptprg
  gRNA
ugaaagcugucaaagucguc

SEQ ID NO: 111189 - RNA, 20 nt, Artificial Sequence
  MKO10111189_B_Ptprg
  gRNA
caaaauaaucgucuuucagc

SEQ ID NO: 111190 - RNA, 20 nt, Artificial Sequence
  MKO10111190_B_Ptprh
  gRNA
ucuacugcacuggguccagu

SEQ ID NO: 111191 - RNA, 20 nt, Artificial Sequence
  MKO10111191_B_Ptprh
  gRNA
uggacccagugcaguagaca

SEQ ID NO: 111192 - RNA, 20 nt, Artificial Sequence
  MKO10111192_B_Ptprh
  gRNA
caaacccagugagaaaccug

SEQ ID NO: 111193 - RNA, 20 nt, Artificial Sequence
  MKO10111193_B_Ptprj
  gRNA
caacuaguguguuauuaaca

SEQ ID NO: 111194 - RNA, 20 nt, Artificial Sequence
  MKO10111194_B_Ptprj
  gRNA
uguacugaguaucaggcuuu

SEQ ID NO: 111195 - RNA, 20 nt, Artificial Sequence
  MKO10111195_B_Ptprj
  gRNA
agaauguauacgaagugccu

SEQ ID NO: 111196 - RNA, 20 nt, Artificial Sequence
  MKO10111196_B_Ptprk
  gRNA
auuuauacgaugacuuugag

SEQ ID NO: 111197 - RNA, 20 nt, Artificial Sequence
  MKO10111197_B_Ptprk
  gRNA
caaagucaucguauaaaucc

SEQ ID NO: 111198 - RNA, 20 nt, Artificial Sequence
  MKO10111198_B_Ptprk
  gRNA
caaguccugaguuauccuug

SEQ ID NO: 111199 - RNA, 20 nt, Artificial Sequence
  MKO10111199_B_Ptprm
  gRNA
ggucagaggucgguuugguc

SEQ ID NO: 111200 - RNA, 20 nt, Artificial Sequence
  MKO10111200_B_Ptprm
  gRNA
ccuccacguucugaauccgc

SEQ ID NO: 111201 - RNA, 20 nt, Artificial Sequence
  MKO10111201_B_Ptprm
  gRNA
ccuugcuaucgaugaaguua

SEQ ID NO: 111202 - RNA, 20 nt, Artificial Sequence
  MKO10111202_B_Ptprn2
  gRNA
uaccgauaugagguaccacc

SEQ ID NO: 111203 - RNA, 20 nt, Artificial Sequence
  MKO10111203_B_Ptprn2
  gRNA
uccguacucaccguucacac

SEQ ID NO: 111204 - RNA, 20 nt, Artificial Sequence
  MKO10111204_B_Ptprn2
  gRNA
cgcuuccccaugccauaggu

SEQ ID NO: 111205 - RNA, 20 nt, Artificial Sequence
  MKO10111205_B_Ptprn
  gRNA
cuaggucugguuuggugccc

SEQ ID NO: 111206 - RNA, 20 nt, Artificial Sequence
  MKO10111206_B_Ptprn
  gRNA
caccuugggacaugaguugc

SEQ ID NO: 111207 - RNA, 20 nt, Artificial Sequence
  MKO10111207_B_Ptprn
  gRNA
ccagaugcgaacaaagucug

SEQ ID NO: 111208 - RNA, 20 nt, Artificial Sequence
  MKO10111208_B_Ptpro
  gRNA
aucauacucaccaacuguag

SEQ ID NO: 111209 - RNA, 20 nt, Artificial Sequence
  MKO10111209_B_Ptpro
  gRNA
gcuucuuucggagaaugaca

SEQ ID NO: 111210 - RNA, 20 nt, Artificial Sequence
  MKO10111210_B_Ptpro
  gRNA
uuaacuuugcauccuuagaa

SEQ ID NO: 111211 - RNA, 20 nt, Artificial Sequence
  MKO10111211_B_Ptprq
  gRNA
uauuuaccucggcaaccaaa

SEQ ID NO: 111212 - RNA, 20 nt, Artificial Sequence
  MKO10111212_B_Ptprq
  gRNA
cucacccgugaguagaacac

SEQ ID NO: 111213 - RNA, 20 nt, Artificial Sequence
  MKO10111213_B_Ptprq
  gRNA
guugcugccgaaaacagcgc

SEQ ID NO: 111214 - RNA, 20 nt, Artificial Sequence
  MKO10111214_B_Ptprr
  gRNA
uuccaauguaucucuuacgc

SEQ ID NO: 111215 - RNA, 20 nt, Artificial Sequence
  MKO10111215_B_Ptprr
  gRNA
gaaauugauauuccacguca

SEQ ID NO: 111216 - RNA, 20 nt, Artificial Sequence
  MKO10111216_B_Ptprr
  gRNA
uugggauccacaaaauucau

SEQ ID NO: 111217 - RNA, 20 nt, Artificial Sequence
  MKO10111217_B_Ptprs
  gRNA
cggaucaagcagcuucgauc

SEQ ID NO: 111218 - RNA, 20 nt, Artificial Sequence
  MKO10111218_B_Ptprs
  gRNA
ucguacacguucucaucccg

SEQ ID NO: 111219 - RNA, 20 nt, Artificial Sequence
  MKO10111219_B_Ptprs
  gRNA
ggggcucuuccucguacugc

SEQ ID NO: 111220 - RNA, 20 nt, Artificial Sequence
  MKO10111220_B_Ptprt
  gRNA
ccacauucaccucaacguuu

SEQ ID NO: 111221 - RNA, 20 nt, Artificial Sequence
  MKO10111221_B_Ptprt
  gRNA
ucguccacagcgauguaacc

SEQ ID NO: 111222 - RNA, 20 nt, Artificial Sequence
  MKO10111222_B_Ptprt
  gRNA
ucauccugguuacaucgcug

SEQ ID NO: 111223 - RNA, 20 nt, Artificial Sequence
  MKO10111223_B_Ptpru
  gRNA
ucacgcgcacguagaccccc

SEQ ID NO: 111224 - RNA, 20 nt, Artificial Sequence
  MKO10111224_B_Ptpru
  gRNA
cgugcccugcgaguucagcc

SEQ ID NO: 111225 - RNA, 20 nt, Artificial Sequence
  MKO10111225_B_Ptpru
  gRNA
cuaagccuauguagcccuug

SEQ ID NO: 111226 - RNA, 20 nt, Artificial Sequence
  MKO10111226_B_Ptprv
  gRNA
uucccuucccacggcugagu

SEQ ID NO: 111227 - RNA, 20 nt, Artificial Sequence
  MKO10111227_B_Ptprv
  gRNA
auucugaaguaagaugcucc

SEQ ID NO: 111228 - RNA, 20 nt, Artificial Sequence
  MKO10111228_B_Ptprv
  gRNA
cucuuguagcagagucugug

SEQ ID NO: 111229 - RNA, 20 nt, Artificial Sequence
  MKO10111229_B_Ptprz1
  gRNA
acuaaugacuacuaucucag

SEQ ID NO: 111230 - RNA, 20 nt, Artificial Sequence
  MKO10111230_B_Ptprz1
  gRNA
uuuaacugcuuccucaaaac

SEQ ID NO: 111231 - RNA, 20 nt, Artificial Sequence
  MKO10111231_B_Ptprz1
  gRNA
acuuucagaaaaggucuuca

SEQ ID NO: 111232 - RNA, 20 nt, Artificial Sequence
  MKO10111232_B_Ptrf
  gRNA
aauacggccgcucaacgaua

SEQ ID NO: 111233 - RNA, 20 nt, Artificial Sequence
  MKO10111233_B_Ptrf
  gRNA
gaucgagcugucguccgacg

SEQ ID NO: 111234 - RNA, 20 nt, Artificial Sequence
  MKO10111234_B_Ptrf
  gRNA
gccgagcgcaucaagcgcag

SEQ ID NO: 111235 - RNA, 20 nt, Artificial Sequence
  MKO10111235_B_Ptrh1
  gRNA
ccacauccgugcucgaagcc

SEQ ID NO: 111236 - RNA, 20 nt, Artificial Sequence
  MKO10111236_B_Ptrh1
  gRNA
ccuggcuucgagcacggaug

SEQ ID NO: 111237 - RNA, 20 nt, Artificial Sequence
  MKO10111237_B_Ptrh1
  gRNA
ugaugaacuggacaagccgu

SEQ ID NO: 111238 - RNA, 20 nt, Artificial Sequence
  MKO10111238_B_Ptrh2
  gRNA
gcccucaagugcucaaagag

SEQ ID NO: 111239 - RNA, 20 nt, Artificial Sequence
  MKO10111239_B_Ptrh2
  gRNA
acucacccaugcaaaaaccu

SEQ ID NO: 111240 - RNA, 20 nt, Artificial Sequence
  MKO10111240_B_Ptrh2
  gRNA
acuucaucaauuaguucuac

SEQ ID NO: 111241 - RNA, 20 nt, Artificial Sequence
  MKO10111241_B_Ptrhd1
  gRNA
uggccucagggcuaugcaug

SEQ ID NO: 111242 - RNA, 20 nt, Artificial Sequence
  MKO10111242_B_Ptrhd1
  gRNA
caugcgcaaggugguucucg

SEQ ID NO: 111243 - RNA, 20 nt, Artificial Sequence
  MKO10111243_B_Ptrhd1
  gRNA
gauaagcugccgugugcgga

SEQ ID NO: 111244 - RNA, 20 nt, Artificial Sequence
  MKO10111244_B_Pts
  gRNA
gaccgaccucaaagaauaca

SEQ ID NO: 111245 - RNA, 20 nt, Artificial Sequence
  MKO10111245_B_Pts
  gRNA
gccucuugaucacaagaacc

SEQ ID NO: 111246 - RNA, 20 nt, Artificial Sequence
  MKO10111246_B_Pts
  gRNA
ccuuagauugauccuguuac

SEQ ID NO: 111247 - RNA, 20 nt, Artificial Sequence
  MKO10111247_B_Puug1ip
  gRNA
aacuuacggagacauuccug

SEQ ID NO: 111248 - RNA, 20 nt, Artificial Sequence
  MKO10111248_B_Puug1ip
  gRNA
ugggcuugcagugaacuucg

SEQ ID NO: 111249 - RNA, 20 nt, Artificial Sequence
  MKO10111249_B_Puug1ip
  gRNA
agucaagacaugaugaaauc

SEQ ID NO: 111250 - RNA, 20 nt, Artificial Sequence
  MKO10111250_B_Puug1
  gRNA
cagguuucaacgccucgagu

SEQ ID NO: 111251 - RNA, 20 nt, Artificial Sequence
  MKO10111251_B_Puug1
  gRNA
acccauccuuagaugccaaa

SEQ ID NO: 111252 - RNA, 20 nt, Artificial Sequence
  MKO10111252_B_Puug1
  gRNA
accagauucccaugauagaa

SEQ ID NO: 111253 - RNA, 20 nt, Artificial Sequence
  MKO10111253_B_Ptx3
  gRNA
ccagccugaggcucgcguca

SEQ ID NO: 111254 - RNA, 20 nt, Artificial Sequence
  MKO10111254_B_Ptx3
  gRNA
aaugaacuuacgguccucgg

SEQ ID NO: 111255 - RNA, 20 nt, Artificial Sequence
  MKO10111255_B_Ptx3
  gRNA
caugagcucguagucauccg

SEQ ID NO: 111256 - RNA, 20 nt, Artificial Sequence
  MKO10111256_B_Ptx4
  gRNA
ccuaagcguucaggcacuac

SEQ ID NO: 111257 - RNA, 20 nt, Artificial Sequence
  MKO10111257_B_Ptx4
  gRNA
gagggaggcuauugcaagcc

SEQ ID NO: 111258 - RNA, 20 nt, Artificial Sequence
  MKO10111258_B_Ptx4
  gRNA
acggaguccuguguacauuc

SEQ ID NO: 111259 - RNA, 20 nt, Artificial Sequence
  MKO10111259_B_Puf60
  gRNA
cugcuccauugcauauuucu

SEQ ID NO: 111260 - RNA, 20 nt, Artificial Sequence
  MKO10111260_B_Puf60
  gRNA
gggcacagaauccaucaaga

SEQ ID NO: 111261 - RNA, 20 nt, Artificial Sequence
  MKO10111261_B_Puf60
  gRNA
agacaaauggaaaccuccac

SEQ ID NO: 111262 - RNA, 20 nt, Artificial Sequence
  MKO10111262_B_Pum1
  gRNA
aggacuuaccgaugugaggc

SEQ ID NO: 111263 - RNA, 20 nt, Artificial Sequence
  MKO10111263_B_Pum1
  gRNA
ggagcagcgcugaugaugua

SEQ ID NO: 111264 - RNA, 20 nt, Artificial Sequence
  MKO10111264_B_Pum1
  gRNA
ggaccccuacacagcuggau

SEQ ID NO: 111265 - RNA, 20 nt, Artificial Sequence
  MKO10111265_B_Pum2
  gRNA
caaggcuucuccauuugagg

SEQ ID NO: 111266 - RNA, 20 nt, Artificial Sequence
  MKO10111266_B_Pum2
  gRNA
aagcucuugcauuagaaucu

SEQ ID NO: 111267 - RNA, 20 nt, Artificial Sequence
  MKO10111267_B_Pum2
  gRNA
agaucuuaaacaagaugaug

SEQ ID NO: 111268 - RNA, 20 nt, Artificial Sequence
  MKO10111268_B_Pura
  gRNA
guucuggauguccacccgcu

SEQ ID NO: 111269 - RNA, 20 nt, Artificial Sequence
  MKO10111269_B_Pura
  gRNA
aucauggcggaccgagacag

SEQ ID NO: 111270 - RNA, 20 nt, Artificial Sequence
  MKO10111270_B_Pura
  gRNA
caagcgcuucuucuucgaug

SEQ ID NO: 111271 - RNA, 20 nt, Artificial Sequence
  MKO10111271_B_Purb
  gRNA
gagccgccucacgcugucga

SEQ ID NO: 111272 - RNA, 20 nt, Artificial Sequence
  MKO10111272_B_Purb
  gRNA
gauaagcuuuacgagcgacg

SEQ ID NO: 111273 - RNA, 20 nt, Artificial Sequence
  MKO10111273_B_Purb
  gRNA
ccuccgggagcucuccguac

SEQ ID NO: 111274 - RNA, 20 nt, Artificial Sequence
  MKO10111274_B_Purg
  gRNA
ugauacuccaaagacaguug

SEQ ID NO: 111275 - RNA, 20 nt, Artificial Sequence
  MKO10111275_B_Purg
  gRNA
cugauugaagacuacggcga

SEQ ID NO: 111276 - RNA, 20 nt, Artificial Sequence
  MKO10111276_B_Purg
  gRNA
gguggcugacgcggaguagu

SEQ ID NO: 111277 - RNA, 20 nt, Artificial Sequence
  MKO10111277_B_Pus10
  gRNA
aaaauucgucuacaugaaga

SEQ ID NO: 111278 - RNA, 20 nt, Artificial Sequence
  MKO10111278_B_Pus10
  gRNA
agcugaaagaagccuacaag

SEQ ID NO: 111279 - RNA, 20 nt, Artificial Sequence
  MKO10111279_B_Pus10
  gRNA
cuugccuacagcaugcugca

SEQ ID NO: 111280 - RNA, 20 nt, Artificial Sequence
  MKO10111280_B_Pus1
  gRNA
gcuuacccagaauccgaaug

SEQ ID NO: 111281 - RNA, 20 nt, Artificial Sequence
  MKO10111281_B_Pus1
  gRNA
cgauaccaagucaucuucga

SEQ ID NO: 111282 - RNA, 20 nt, Artificial Sequence
  MKO10111282_B_Pus1
  gRNA
uacucgggcaagggcuacca

SEQ ID NO: 111283 - RNA, 20 nt, Artificial Sequence
  MKO10111283_B_Pus3
  gRNA
gacagacauccaacuaucau

SEQ ID NO: 111284 - RNA, 20 nt, Artificial Sequence
  MKO10111284_B_Pus3
  gRNA
gcgcacauauaagccccuca

SEQ ID NO: 111285 - RNA, 20 nt, Artificial Sequence
  MKO10111285_B_Pus3
  gRNA
guuaugguaacaugugcagc

SEQ ID NO: 111286 - RNA, 20 nt, Artificial Sequence
  MKO10111286_B_Pus7l
  gRNA
auuucuuacaccagaagacg

SEQ ID NO: 111287 - RNA, 20 nt, Artificial Sequence
  MKO10111287_B_Pus7l
  gRNA
guaggcgauugucucagacu

SEQ ID NO: 111288 - RNA, 20 nt, Artificial Sequence
  MKO10111288_B_Pus7l
  gRNA
ucaguagagccaacccaauu

SEQ ID NO: 111289 - RNA, 20 nt, Artificial Sequence
  MKO10111289_B_Pus7
  gRNA
agauggacggaucagccauu

SEQ ID NO: 111290 - RNA, 20 nt, Artificial Sequence
  MKO10111290_B_Pus7
  gRNA
aucuguuccgguggaugaag

SEQ ID NO: 111291 - RNA, 20 nt, Artificial Sequence
  MKO10111291_B_Pus7
  gRNA
uagaacauugauggcaucca

SEQ ID NO: 111292 - RNA, 20 nt, Artificial Sequence
  MKO10111292_B_Pusl1
  gRNA
uucagcaccccaacagcgcg

SEQ ID NO: 111293 - RNA, 20 nt, Artificial Sequence
  MKO10111293_B_Pusl1
  gRNA
uaccaauaucgucuggccac

SEQ ID NO: 111294 - RNA, 20 nt, Artificial Sequence
  MKO10111294_B_Pusl1
  gRNA
agguggcugcgugucgagcg

SEQ ID NO: 111295 - RNA, 20 nt, Artificial Sequence
  MKO10111295_B_Pvalb
  gRNA
cucccccagguccauucuga

SEQ ID NO: 111296 - RNA, 20 nt, Artificial Sequence
  MKO10111296_B_Pvalb
  gRNA
uaaagaaacaaagacgcuuc

SEQ ID NO: 111297 - RNA, 20 nt, Artificial Sequence
  MKO10111297_B_Pvalb
  gRNA
uuagcuuucagccaccagag

SEQ ID NO: 111298 - RNA, 20 nt, Artificial Sequence
  MKO10111298_B_Pvrl1
  gRNA
cgaucgggugccaauagggu

SEQ ID NO: 111299 - RNA, 20 nt, Artificial Sequence
  MKO10111299_B_Pvrl1
  gRNA
cccgggcggugcuucgagcc

SEQ ID NO: 111300 - RNA, 20 nt, Artificial Sequence
  MKO10111300_B_Pvrl1
  gRNA
cacccgaucgggccaggugg

SEQ ID NO: 111301 - RNA, 20 nt, Artificial Sequence
  MKO10111301_B_Pvrl2
  gRNA
ccacgggcaccaaggaguau

SEQ ID NO: 111302 - RNA, 20 nt, Artificial Sequence
  MKO10111302_B_Pvrl2
  gRNA
agcgucggugacaaucugga

SEQ ID NO: 111303 - RNA, 20 nt, Artificial Sequence
  MKO10111303_B_Pvrl2
  gRNA
guugucaucauagccggaga

SEQ ID NO: 111304 - RNA, 20 nt, Artificial Sequence
  MKO10111304_B_Pvrl3
  gRNA
ccggauucuuuaauugaugg

SEQ ID NO: 111305 - RNA, 20 nt, Artificial Sequence
  MKO10111305_B_Pvrl3
  gRNA
aaagccguuacauucccacu

SEQ ID NO: 111306 - RNA, 20 nt, Artificial Sequence
  MKO10111306_B_Pvrl3
  gRNA
uucccuauaggugccuuagc

SEQ ID NO: 111307 - RNA, 20 nt, Artificial Sequence
  MKO10111307_B_Pvrl4
  gRNA
uccuaccuguaaacgaugcc

SEQ ID NO: 111308 - RNA, 20 nt, Artificial Sequence
  MKO10111308_B_Pvrl4
  gRNA
uuguuccuggcaucguuuac

SEQ ID NO: 111309 - RNA, 20 nt, Artificial Sequence
  MKO10111309_B_Pvrl4
  gRNA
gcggcugcccauucauacuu

SEQ ID NO: 111310 - RNA, 20 nt, Artificial Sequence
  MKO10111310_B_Pvr
  gRNA
uaacugugguggugcccggc

SEQ ID NO: 111311 - RNA, 20 nt, Artificial Sequence
  MKO10111311_B_Pvr
  gRNA
gcuucuaaucuccaccguag

SEQ ID NO: 111312 - RNA, 20 nt, Artificial Sequence
  MKO10111312_B_Pvr
  gRNA
uaugacggcaacugguaugu

SEQ ID NO: 111313 - RNA, 20 nt, Artificial Sequence
  MKO10111313_B_Pwp1
  gRNA
caaacgaugagguugucagu

SEQ ID NO: 111314 - RNA, 20 nt, Artificial Sequence
  MKO10111314_B_Pwp1
  gRNA
cgucucaucgcugaagcaaa

SEQ ID NO: 111315 - RNA, 20 nt, Artificial Sequence
  MKO10111315_B_Pwp1
  gRNA
acccaacagagacucgccaa

SEQ ID NO: 111316 - RNA, 20 nt, Artificial Sequence
  MKO10111316_B_Pwp2
  gRNA
cuucaucaacgaugauugcg

SEQ ID NO: 111317 - RNA, 20 nt, Artificial Sequence
  MKO10111317_B_Pwp2
  gRNA
aaauucuguuaucagccccg

SEQ ID NO: 111318 - RNA, 20 nt, Artificial Sequence
  MKO10111318_B_Pwp2
  gRNA
uuugcaguucucgaauuugu

SEQ ID NO: 111319 - RNA, 20 nt, Artificial Sequence
  MKO10111319_B_Pwwp2a
  gRNA
caauaccucagccgccgccu

SEQ ID NO: 111320 - RNA, 20 nt, Artificial Sequence
  MKO10111320_B_Pwwp2a
  gRNA
cuaccauaggucucaacaaa

SEQ ID NO: 111321 - RNA, 20 nt, Artificial Sequence
  MKO10111321_B_Pwwp2a
  gRNA
cauugaaguuaacagugaag

SEQ ID NO: 111322 - RNA, 20 nt, Artificial Sequence
  MKO10111322_B_Pwwp2b
  gRNA
gucggcgacucuccagaaac

SEQ ID NO: 111323 - RNA, 20 nt, Artificial Sequence
  MKO10111323_B_Pwwp2b
  gRNA
ucccaaggucaccgacaaug

SEQ ID NO: 111324 - RNA, 20 nt, Artificial Sequence
  MKO10111324_B_Pwwp2b
  gRNA
uucuuagcacaauccgccug

SEQ ID NO: 111325 - RNA, 20 nt, Artificial Sequence
  MKO10111325_B_Pxdc1
  gRNA
caacuuguccuauuaccauu

SEQ ID NO: 111326 - RNA, 20 nt, Artificial Sequence
  MKO10111326_B_Pxdc1
  gRNA
cuucuuugaaagaucgccuu

SEQ ID NO: 111327 - RNA, 20 nt, Artificial Sequence
  MKO10111327_B_Pxdc1
  gRNA
ggugagaacaaccucagacc

SEQ ID NO: 111328 - RNA, 20 nt, Artificial Sequence
  MKO10111328_B_Pxdn
  gRNA
uucuaacuuacaguguguuc

SEQ ID NO: 111329 - RNA, 20 nt, Artificial Sequence
  MKO10111329_B_Pxdn
  gRNA
uuucuaucugauuaaagugc

SEQ ID NO: 111330 - RNA, 20 nt, Artificial Sequence
  MKO10111330_B_Pxdn
  gRNA
augcuugccugucaauugau

SEQ ID NO: 111331 - RNA, 20 nt, Artificial Sequence
  MKO10111331_B_Pxk
  gRNA
gccucgacggccgcugucag

SEQ ID NO: 111332 - RNA, 20 nt, Artificial Sequence
  MKO10111332_B_Pxk
  gRNA
cagaaauuccucuuugcacc

SEQ ID NO: 111333 - RNA, 20 nt, Artificial Sequence
  MKO10111333_B_Pxk
  gRNA
gaauuucugcagaaaacagc

SEQ ID NO: 111334 - RNA, 20 nt, Artificial Sequence
  MKO10111334_B_Pxmp2
  gRNA
ccgggugcucuuugccaaca

SEQ ID NO: 111335 - RNA, 20 nt, Artificial Sequence
  MKO10111335_B_Pxmp2
  gRNA
ggcccgcacugcaaaugaac

SEQ ID NO: 111336 - RNA, 20 nt, Artificial Sequence
  MKO10111336_B_Pxmp2
  gRNA
ucuguucugguaugccuacc

SEQ ID NO: 111337 - RNA, 20 nt, Artificial Sequence
  MKO10111337_B_Pxmp4
  gRNA
ccuguacgccuugugccgcc

SEQ ID NO: 111338 - RNA, 20 nt, Artificial Sequence
  MKO10111338_B_Pxmp4
  gRNA
aucggggggcuccugcuguu

SEQ ID NO: 111339 - RNA, 20 nt, Artificial Sequence
  MKO10111339_B_Pxmp4
  gRNA
aagccacguacauccacucu

SEQ ID NO: 111340 - RNA, 20 nt, Artificial Sequence
  MKO10111340_B_Pxn
  gRNA
ggagcucaugacgguaggug

SEQ ID NO: 111341 - RNA, 20 nt, Artificial Sequence
  MKO10111341_B_Pxn
  gRNA
uaccugcuggugagcguauc

SEQ ID NO: 111342 - RNA, 20 nt, Artificial Sequence
  MKO10111342_B_Pxn
  gRNA
ggcucccuuuguucccgagc

SEQ ID NO: 111343 - RNA, 20 nt, Artificial Sequence
  MKO10111343_B_Pxt1
  gRNA
uuccacacagcaucuugcac

SEQ ID NO: 111344 - RNA, 20 nt, Artificial Sequence
  MKO10111344_B_Pxt1
  gRNA
ugucaaucacagggugauuc

SEQ ID NO: 111345 - RNA, 20 nt, Artificial Sequence
  MKO10111345_B_Pxt1
  gRNA
uguccuuccuuuacagcaaa

SEQ ID NO: 111346 - RNA, 20 nt, Artificial Sequence
  MKO10111346_B_Pycard
  gRNA
gaaggaaauacaucccuacu

SEQ ID NO: 111347 - RNA, 20 nt, Artificial Sequence
  MKO10111347_B_Pycard
  gRNA
guucuggcuguacucugagc

SEQ ID NO: 111348 - RNA, 20 nt, Artificial Sequence
  MKO10111348_B_Pycard
  gRNA
gcucagaguacagccagaac

SEQ ID NO: 111349 - RNA, 20 nt, Artificial Sequence
  MKO10111349_B_Pycr1
  gRNA
ggagggccgagaccguagcu

SEQ ID NO: 111350 - RNA, 20 nt, Artificial Sequence
  MKO10111350_B_Pycr1
  gRNA
ugaaauuggggcgaacauug

SEQ ID NO: 111351 - RNA, 20 nt, Artificial Sequence
  MKO10111351_B_Pycr1
  gRNA
caccaucaacuccaucgaaa

SEQ ID NO: 111352 - RNA, 20 nt, Artificial Sequence
  MKO10111352_B_Pycr2
  gRNA
cuauuaucuugugagccgac

SEQ ID NO: 111353 - RNA, 20 nt, Artificial Sequence
  MKO10111353_B_Pycr2
  gRNA
cugcaugaccaacacgcccg

SEQ ID NO: 111354 - RNA, 20 nt, Artificial Sequence
  MKO10111354_B_Pycr2
  gRNA
gaugugccucuccugcacgu

SEQ ID NO: 111355 - RNA, 20 nt, Artificial Sequence
  MKO10111355_B_Pycrl
  gRNA
ugagcacaucaucguaucug

SEQ ID NO: 111356 - RNA, 20 nt, Artificial Sequence
  MKO10111356_B_Pycrl
  gRNA
aguagaagcuaaacaagugc

SEQ ID NO: 111357 - RNA, 20 nt, Artificial Sequence
  MKO10111357_B_Pycrl
  gRNA
ggcugaaggugccaucaaaa

SEQ ID NO: 111358 - RNA, 20 nt, Artificial Sequence
  MKO10111358_B_Pydc3
  gRNA
gagucaacccgaugccaacc

SEQ ID NO: 111359 - RNA, 20 nt, Artificial Sequence
  MKO10111359_B_Pydc3
  gRNA
ggcaaagauaggaucucauc

SEQ ID NO: 111360 - RNA, 20 nt, Artificial Sequence
  MKO10111360_B_Pydc3
  gRNA
cccacuuaccuccagccuga

SEQ ID NO: 111361 - RNA, 20 nt, Artificial Sequence
  MKO10111361_B_Pydc4
  gRNA
uugggaaguagaaccagcua

SEQ ID NO: 111362 - RNA, 20 nt, Artificial Sequence
  MKO10111362_B_Pydc4
  gRNA
cuuauccaugacuggagaga

SEQ ID NO: 111363 - RNA, 20 nt, Artificial Sequence
  MKO10111363_B_Pydc4
  gRNA
ucaacacgagcugcaaguuc

SEQ ID NO: 111364 - RNA, 20 nt, Artificial Sequence
  MKO10111364_B_Pygb
  gRNA
uauggaauccgauaugaauu

SEQ ID NO: 111365 - RNA, 20 nt, Artificial Sequence
  MKO10111365_B_Pygb
  gRNA
acccucccguagaaaugcac

SEQ ID NO: 111366 - RNA, 20 nt, Artificial Sequence
  MKO10111366_B_Pygb
  gRNA
uggucuugggaauggcggcc

SEQ ID NO: 111367 - RNA, 20 nt, Artificial Sequence
  MKO10111367_B_Pygl
  gRNA
gacaaagugggucgacaccc

SEQ ID NO: 111368 - RNA, 20 nt, Artificial Sequence
  MKO10111368_B_Pygl
  gRNA
uuggcaauggcggucuuggg

SEQ ID NO: 111369 - RNA, 20 nt, Artificial Sequence
  MKO10111369_B_Pygl
  gRNA
cugguaaauggccucaucgc

SEQ ID NO: 111370 - RNA, 20 nt, Artificial Sequence
  MKO10111370_B_Pygm
  gRNA
acgcugccugugcacuucua

SEQ ID NO: 111371 - RNA, 20 nt, Artificial Sequence
  MKO10111371_B_Pygm
  gRNA
cuuggagaacgccugugaug

SEQ ID NO: 111372 - RNA, 20 nt, Artificial Sequence
  MKO10111372_B_Pygm
  gRNA
cccuuagcugggcuuggaca

SEQ ID NO: 111373 - RNA, 20 nt, Artificial Sequence
  MKO10111373_B_Pygo1
  gRNA
ggagggcccaauauacaacu

SEQ ID NO: 111374 - RNA, 20 nt, Artificial Sequence
  MKO10111374_B_Pygo1
  gRNA
ucuaacucucuucagcgcga

SEQ ID NO: 111375 - RNA, 20 nt, Artificial Sequence
  MKO10111375_B_Pygo1
  gRNA
cccagauaagaaaaaacgca

SEQ ID NO: 111376 - RNA, 20 nt, Artificial Sequence
  MKO10111376_B_Pygo2
  gRNA
cuuuggaggcuuucguguac

SEQ ID NO: 111377 - RNA, 20 nt, Artificial Sequence
  MKO10111377_B_Pygo2
  gRNA
ggcgcaggcccuccguuccu

SEQ ID NO: 111378 - RNA, 20 nt, Artificial Sequence
  MKO10111378_B_Pygo2
  gRNA
aucauuuaccucacuacggc

SEQ ID NO: 111379 - RNA, 20 nt, Artificial Sequence
  MKO10111379_B_Pyhin1
  gRNA
uaucuuugcucgaagaaaag

SEQ ID NO: 111380 - RNA, 20 nt, Artificial Sequence
  MKO10111380_B_Pyhin1
  gRNA
uacaacacacaguaacaugc

SEQ ID NO: 111381 - RNA, 20 nt, Artificial Sequence
  MKO10111381_B_Pyhin1
  gRNA
uugcaucagcuaaaaggaca

SEQ ID NO: 111382 - RNA, 20 nt, Artificial Sequence
  MKO10111382_B_Pyroxd1
  gRNA
agccguuacaaacuucagac

SEQ ID NO: 111383 - RNA, 20 nt, Artificial Sequence
  MKO10111383_B_Pyroxd1
  gRNA
cccgacaaucauuauccucc

SEQ ID NO: 111384 - RNA, 20 nt, Artificial Sequence
  MKO10111384_B_Pyroxd1
  gRNA
aggauaaugauugucgggaa

SEQ ID NO: 111385 - RNA, 20 nt, Artificial Sequence
  MKO10111385_B_Pyroxd2
  gRNA
ggcgaucuaccuucagcucc

SEQ ID NO: 111386 - RNA, 20 nt, Artificial Sequence
  MKO10111386_B_Pyroxd2
  gRNA
ccuaucuccugagccuacug

SEQ ID NO: 111387 - RNA, 20 nt, Artificial Sequence
  MKO10111387_B_Pyroxd2
  gRNA
cuacuccuucacccccaugc

SEQ ID NO: 111388 - RNA, 20 nt, Artificial Sequence
  MKO10111388_B_Pyurf
  gRNA
gcugccugugguaucauauu

SEQ ID NO: 111389 - RNA, 20 nt, Artificial Sequence
  MKO10111389_B_Pyurf
  gRNA
ugcugagcgccacgugccgc

SEQ ID NO: 111390 - RNA, 20 nt, Artificial Sequence
  MKO10111390_B_Pyurf
  gRNA
gcagcgccggggcgagccug

SEQ ID NO: 111391 - RNA, 20 nt, Artificial Sequence
  MKO10111391_B_Pyy
  gRNA
caccacugguccaaaccuuc

SEQ ID NO: 111392 - RNA, 20 nt, Artificial Sequence
  MKO10111392_B_Pyy
  gRNA
ucuaccgagaccugaagggg

SEQ ID NO: 111393 - RNA, 20 nt, Artificial Sequence
  MKO10111393_B_Pyy
  gRNA
cuccugcaggccagaagguu

SEQ ID NO: 111394 - RNA, 20 nt, Artificial Sequence
  MKO10111394_B_Pzp
  gRNA
aacgaagcuccucacagacc

SEQ ID NO: 111395 - RNA, 20 nt, Artificial Sequence
  MKO10111395_B_Pzp
  gRNA
agacucaccguuucauucaa

SEQ ID NO: 111396 - RNA, 20 nt, Artificial Sequence
  MKO10111396_B_Pzp
  gRNA
gaaauuccgaguuguuucug

SEQ ID NO: 111397 - RNA, 20 nt, Artificial Sequence
  MKO10111397_B_Qars
  gRNA
gcuccaucagagacaggguc

SEQ ID NO: 111398 - RNA, 20 nt, Artificial Sequence
  MKO10111398_B_Qars
  gRNA
gcacuuaaguuucauaagcc

SEQ ID NO: 111399 - RNA, 20 nt, Artificial Sequence
  MKO10111399_B_Qars
  gRNA
gcccaagauggaagcugauc

SEQ ID NO: 111400 - RNA, 20 nt, Artificial Sequence
  MKO10111400_B_Qdpr
  gRNA
aaagcuccuaggugaccaga

SEQ ID NO: 111401 - RNA, 20 nt, Artificial Sequence
  MKO10111401_B_Qdpr
  gRNA
ugucaucuuaacaaccacgc

SEQ ID NO: 111402 - RNA, 20 nt, Artificial Sequence
  MKO10111402_B_Qdpr
  gRNA
agagaauugcauccaccuuc

SEQ ID NO: 111403 - RNA, 20 nt, Artificial Sequence
  MKO10111403_B_Qk
  gRNA
aaaauaaugguccgaggcaa

SEQ ID NO: 111404 - RNA, 20 nt, Artificial Sequence
  MKO10111404_B_Qk
  gRNA
aagugcagaauugccugacg

SEQ ID NO: 111405 - RNA, 20 nt, Artificial Sequence
  MKO10111405_B_Qk
  gRNA
uucauuuagaugcucccaau

SEQ ID NO: 111406 - RNA, 20 nt, Artificial Sequence
  MKO10111406_B_Qpcul
  gRNA
acuucccucgcacagcccgc

SEQ ID NO: 111407 - RNA, 20 nt, Artificial Sequence
  MKO10111407_B_Qpcul
  gRNA
aaggggguugaggccgugaa

SEQ ID NO: 111408 - RNA, 20 nt, Artificial Sequence
  MKO10111408_B_Qpcul
  gRNA
accacguucccgaaguccag

SEQ ID NO: 111409 - RNA, 20 nt, Artificial Sequence
  MKO10111409_B_Qpcu
  gRNA
cgcccggaagcuauucugcu

SEQ ID NO: 111410 - RNA, 20 nt, Artificial Sequence
  MKO10111410_B_Qpcu
  gRNA
uccccucaagauucucugua

SEQ ID NO: 111411 - RNA, 20 nt, Artificial Sequence
  MKO10111411_B_Qpcu
  gRNA
uuggugccucuugauccagg

SEQ ID NO: 111412 - RNA, 20 nt, Artificial Sequence
  MKO10111412_B_Qprt
  gRNA
ccucccggagggaucgaagc

SEQ ID NO: 111413 - RNA, 20 nt, Artificial Sequence
  MKO10111413_B_Qprt
  gRNA
cccagccucugcugcccgaa

SEQ ID NO: 111414 - RNA, 20 nt, Artificial Sequence
  MKO10111414_B_Qprt
  gRNA
agagguggaauguagcagcc

SEQ ID NO: 111415 - RNA, 20 nt, Artificial Sequence
  MKO10111415_B_Qrfpr
  gRNA
caagcaucaccacaagcggc

SEQ ID NO: 111416 - RNA, 20 nt, Artificial Sequence
  MKO10111416_B_Qrfpr
  gRNA
uggcucucuucgcugcgugc

SEQ ID NO: 111417 - RNA, 20 nt, Artificial Sequence
  MKO10111417_B_Qrfpr
  gRNA
cauagccaaucuugcuguag

SEQ ID NO: 111418 - RNA, 20 nt, Artificial Sequence
  MKO10111418_B_Qrfp
  gRNA
gagcacaccggcuuccgucu

SEQ ID NO: 111419 - RNA, 20 nt, Artificial Sequence
  MKO10111419_B_Qrfp
  gRNA
aggguuccugcccgccgacu

SEQ ID NO: 111420 - RNA, 20 nt, Artificial Sequence
  MKO10111420_B_Qrfp
  gRNA
uaccgucuugccucccuaga

SEQ ID NO: 111421 - RNA, 20 nt, Artificial Sequence
  MKO10111421_B_Qrich1
  gRNA
acuauguucguuucaccgaa

SEQ ID NO: 111422 - RNA, 20 nt, Artificial Sequence
  MKO10111422_B_Qrich1
  gRNA
guuuaaugacacgagaagcu

SEQ ID NO: 111423 - RNA, 20 nt, Artificial Sequence
  MKO10111423_B_Qrich1
  gRNA
cagaacuucauguagccauu

SEQ ID NO: 111424 - RNA, 20 nt, Artificial Sequence
  MKO10111424_B_Qrich2
  gRNA
gcucuguaguggcaucaaac

SEQ ID NO: 111425 - RNA, 20 nt, Artificial Sequence
  MKO10111425_B_Qrich2
  gRNA
guaggauggcgcucugcacg

SEQ ID NO: 111426 - RNA, 20 nt, Artificial Sequence
  MKO10111426_B_Qrich2
  gRNA
uaccacgagcaaccucauug

SEQ ID NO: 111427 - RNA, 20 nt, Artificial Sequence
  MKO10111427_B_Qrsl1
  gRNA
aaagacaacuuuagcacaac

SEQ ID NO: 111428 - RNA, 20 nt, Artificial Sequence
  MKO10111428_B_Qrsl1
  gRNA
gguuucugcggcacugaagc

SEQ ID NO: 111429 - RNA, 20 nt, Artificial Sequence
  MKO10111429_B_Qrsl1
  gRNA
uuacauuacuguaucagaag

SEQ ID NO: 111430 - RNA, 20 nt, Artificial Sequence
  MKO10111430_B_Qser1
  gRNA
cauccucacuacugcuagaa

SEQ ID NO: 111431 - RNA, 20 nt, Artificial Sequence
  MKO10111431_B_Qser1
  gRNA
cagggaacgugaugaauuug

SEQ ID NO: 111432 - RNA, 20 nt, Artificial Sequence
  MKO10111432_B_Qser1
  gRNA
auaagccuucacaaacuauc

SEQ ID NO: 111433 - RNA, 20 nt, Artificial Sequence
  MKO10111433_B_Qsox1
  gRNA
ugcaggcugaaugauaucga

SEQ ID NO: 111434 - RNA, 20 nt, Artificial Sequence
  MKO10111434_B_Qsox1
  gRNA
ccuucgcauacccucacagu

SEQ ID NO: 111435 - RNA, 20 nt, Artificial Sequence
  MKO10111435_B_Qsox1
  gRNA
aaauacuuggcagguuccag

SEQ ID NO: 111436 - RNA, 20 nt, Artificial Sequence
  MKO10111436_B_Qsox2
  gRNA
ugccauccguguugcugcuc

SEQ ID NO: 111437 - RNA, 20 nt, Artificial Sequence
  MKO10111437_B_Qsox2
  gRNA
agaaguggaugucauaugug

SEQ ID NO: 111438 - RNA, 20 nt, Artificial Sequence
  MKO10111438_B_Qsox2
  gRNA
gcuauuguguuugaaagcaa

SEQ ID NO: 111439 - RNA, 20 nt, Artificial Sequence
  MKO10111439_B_Qtrt1
  gRNA
ccuccugcaggucaguccgc

SEQ ID NO: 111440 - RNA, 20 nt, Artificial Sequence
  MKO10111440_B_Qtrt1
  gRNA
ugcauggccuccuccacuag

SEQ ID NO: 111441 - RNA, 20 nt, Artificial Sequence
  MKO10111441_B_Qtrt1
  gRNA
cacagggaccggagcugauc

SEQ ID NO: 111442 - RNA, 20 nt, Artificial Sequence
  MKO10111442_B_Qtrtd1
  gRNA
ccccuugaaagccguccagc

SEQ ID NO: 111443 - RNA, 20 nt, Artificial Sequence
  MKO10111443_B_Qtrtd1
  gRNA
uuacuuguuacauaaccagc

SEQ ID NO: 111444 - RNA, 20 nt, Artificial Sequence
  MKO10111444_B_Qtrtd1
  gRNA
cgggggugacuggaucgugc

SEQ ID NO: 111445 - RNA, 20 nt, Artificial Sequence
  MKO10111445_B_R3hcc1l
  gRNA
ucuguuugcuucgaacccca

SEQ ID NO: 111446 - RNA, 20 nt, Artificial Sequence
  MKO10111446_B_R3hcc1l
  gRNA
gacaauaccugugauugggc

SEQ ID NO: 111447 - RNA, 20 nt, Artificial Sequence
  MKO10111447_B_R3hcc1l
  gRNA
cauucacugaggucaauauc

SEQ ID NO: 111448 - RNA, 20 nt, Artificial Sequence
  MKO10111448_B_R3hcc1
  gRNA
cuugagcacggagaaauccu

SEQ ID NO: 111449 - RNA, 20 nt, Artificial Sequence
  MKO10111449_B_R3hcc1
  gRNA
cugugaaggcggaugugucc

SEQ ID NO: 111450 - RNA, 20 nt, Artificial Sequence
  MKO10111450_B_R3hcc1
  gRNA
guggaugacacucaugcuau

SEQ ID NO: 111451 - RNA, 20 nt, Artificial Sequence
  MKO10111451_B_R3hdm1
  gRNA
caagaauacacugauucaac

SEQ ID NO: 111452 - RNA, 20 nt, Artificial Sequence
  MKO10111452_B_R3hdm1
  gRNA
caguugaaucaguguauucu

SEQ ID NO: 111453 - RNA, 20 nt, Artificial Sequence
  MKO10111453_B_R3hdm1
  gRNA
ccugucuguccaaaugacug

SEQ ID NO: 111454 - RNA, 20 nt, Artificial Sequence
  MKO10111454_B_R3hdm2
  gRNA
uucucgacgucuuccuuacu

SEQ ID NO: 111455 - RNA, 20 nt, Artificial Sequence
  MKO10111455_B_R3hdm2
  gRNA
caucagcugccccucugaca

SEQ ID NO: 111456 - RNA, 20 nt, Artificial Sequence
  MKO10111456_B_R3hdm2
  gRNA
uauauccaaaacuccaagua

SEQ ID NO: 111457 - RNA, 20 nt, Artificial Sequence
  MKO10111457_B_R3hdm4
  gRNA
gauaaaaugcugcuugcguc

SEQ ID NO: 111458 - RNA, 20 nt, Artificial Sequence
  MKO10111458_B_R3hdm4
  gRNA
gcucuugcuccucucccgag

SEQ ID NO: 111459 - RNA, 20 nt, Artificial Sequence
  MKO10111459_B_R3hdm4
  gRNA
cggucuccagcaguguuagc

SEQ ID NO: 111460 - RNA, 20 nt, Artificial Sequence
  MKO10111460_B_R3hdml
  gRNA
ccuccccagguuccguucug

SEQ ID NO: 111461 - RNA, 20 nt, Artificial Sequence
  MKO10111461_B_R3hdml
  gRNA
cucacagcugaugaaguacg

SEQ ID NO: 111462 - RNA, 20 nt, Artificial Sequence
  MKO10111462_B_R3hdml
  gRNA
aauggcacagcccagccgac

SEQ ID NO: 111463 - RNA, 20 nt, Artificial Sequence
  MKO10111463_B_Rab10
  gRNA
gcccauugcuccucuguagu

SEQ ID NO: 111464 - RNA, 20 nt, Artificial Sequence
  MKO10111464_B_Rab10
  gRNA
ggaugucuucagcuaaugug

SEQ ID NO: 111465 - RNA, 20 nt, Artificial Sequence
  MKO10111465_B_Rab10
  gRNA
acuagggaacaagugugaca

SEQ ID NO: 111466 - RNA, 20 nt, Artificial Sequence
  MKO10111466_B_Rab11a
  gRNA
guggugggcggaacaugaau

SEQ ID NO: 111467 - RNA, 20 nt, Artificial Sequence
  MKO10111467_B_Rab11a
  gRNA
agagugauuuacgucaucuc

SEQ ID NO: 111468 - RNA, 20 nt, Artificial Sequence
  MKO10111468_B_Rab11a
  gRNA
uucugacagcacugcaccuu

SEQ ID NO: 111469 - RNA, 20 nt, Artificial Sequence
  MKO10111469_B_Rab11b
  gRNA
cuaaacucacgcagagguaa

SEQ ID NO: 111470 - RNA, 20 nt, Artificial Sequence
  MKO10111470_B_Rab11b
  gRNA
gcauucaagaacauccucac

SEQ ID NO: 111471 - RNA, 20 nt, Artificial Sequence
  MKO10111471_B_Rab11b
  gRNA
cuucauugagaccucagccu

SEQ ID NO: 111472 - RNA, 20 nt, Artificial Sequence
  MKO10111472_B_Rab11fip1
  gRNA
gggcacgagcgacgcguacg

SEQ ID NO: 111473 - RNA, 20 nt, Artificial Sequence
  MKO10111473_B_Rab11fip1
  gRNA
caugggcgucaucgucccac

SEQ ID NO: 111474 - RNA, 20 nt, Artificial Sequence
  MKO10111474_B_Rab11fip1
  gRNA
cucaucgucacugucgacug

SEQ ID NO: 111475 - RNA, 20 nt, Artificial Sequence
  MKO10111475_B_Rab11fip2
  gRNA
caacaagcagugaagaccuc

SEQ ID NO: 111476 - RNA, 20 nt, Artificial Sequence
  MKO10111476_B_Rab11fip2
  gRNA
agucgccagauagauuccuu

SEQ ID NO: 111477 - RNA, 20 nt, Artificial Sequence
  MKO10111477_B_Rab11fip2
  gRNA
cauucgaugucugauuuaac

SEQ ID NO: 111478 - RNA, 20 nt, Artificial Sequence
  MKO10111478_B_Rab11fip3
  gRNA
ccuccagggccuccauaguc

SEQ ID NO: 111479 - RNA, 20 nt, Artificial Sequence
  MKO10111479_B_Rab11fip3
  gRNA
gcacuguccacguccccuuc

SEQ ID NO: 111480 - RNA, 20 nt, Artificial Sequence
  MKO10111480_B_Rab11fip3
  gRNA
cugcagcucggggugcacca

SEQ ID NO: 111481 - RNA, 20 nt, Artificial Sequence
  MKO10111481_B_Rab11fip4
  gRNA
cgccucucuuaucagcaacg

SEQ ID NO: 111482 - RNA, 20 nt, Artificial Sequence
  MKO10111482_B_Rab11fip4
  gRNA
gugcugucgguggagagcgc

SEQ ID NO: 111483 - RNA, 20 nt, Artificial Sequence
  MKO10111483_B_Rab11fip4
  gRNA
aggcccggagggcucuguca

SEQ ID NO: 111484 - RNA, 20 nt, Artificial Sequence
  MKO10111484_B_Rab11fip5
  gRNA
cugucggggcuagccuccac

SEQ ID NO: 111485 - RNA, 20 nt, Artificial Sequence
  MKO10111485_B_Rab11fip5
  gRNA
ucugccccaagaaucauccg

SEQ ID NO: 111486 - RNA, 20 nt, Artificial Sequence
  MKO10111486_B_Rab11fip5
  gRNA
gccucuccaguccgcuacuc

SEQ ID NO: 111487 - RNA, 20 nt, Artificial Sequence
  MKO10111487_B_Rab12
  gRNA
aguccagcuuauuuccaacc

SEQ ID NO: 111488 - RNA, 20 nt, Artificial Sequence
  MKO10111488_B_Rab12
  gRNA
agaagacgccgagcuccucc

SEQ ID NO: 111489 - RNA, 20 nt, Artificial Sequence
  MKO10111489_B_Rab12
  gRNA
aucaagacuguagaacuaag

SEQ ID NO: 111490 - RNA, 20 nt, Artificial Sequence
  MKO10111490_B_Rab13
  gRNA
ccaguucugaauauucucga

SEQ ID NO: 111491 - RNA, 20 nt, Artificial Sequence
  MKO10111491_B_Rab13
  gRNA
ccuucgagaauauucagaac

SEQ ID NO: 111492 - RNA, 20 nt, Artificial Sequence
  MKO10111492_B_Rab13
  gRNA
agaggaucaaacugcaagug

SEQ ID NO: 111493 - RNA, 20 nt, Artificial Sequence
  MKO10111493_B_Rab14
  gRNA
aauucaacaccaauugugug

SEQ ID NO: 111494 - RNA, 20 nt, Artificial Sequence
  MKO10111494_B_Rab14
  gRNA
aauuagguaauaauucucau

SEQ ID NO: 111495 - RNA, 20 nt, Artificial Sequence
  MKO10111495_B_Rab14
  gRNA
uaaacaggggauaugggagu

SEQ ID NO: 111496 - RNA, 20 nt, Artificial Sequence
  MKO10111496_B_Rab15
  gRNA
caucagccuuauucccaauu

SEQ ID NO: 111497 - RNA, 20 nt, Artificial Sequence
  MKO10111497_B_Rab15
  gRNA
augaagacuaucgaaguaga

SEQ ID NO: 111498 - RNA, 20 nt, Artificial Sequence
  MKO10111498_B_Rab15
  gRNA
ccuaucagcauaucaugaag

SEQ ID NO: 111499 - RNA, 20 nt, Artificial Sequence
  MKO10111499_B_Rab17
  gRNA
cacggggagcagccgcccac

SEQ ID NO: 111500 - RNA, 20 nt, Artificial Sequence
  MKO10111500_B_Rab17
  gRNA
ggagcgggaagugaccuucc

SEQ ID NO: 111501 - RNA, 20 nt, Artificial Sequence
  MKO10111501_B_Rab17
  gRNA
cuccgccaagcugaacuacc

SEQ ID NO: 111502 - RNA, 20 nt, Artificial Sequence
  MKO10111502_B_Rab18
  gRNA
uuaacucccagcuauuauag

SEQ ID NO: 111503 - RNA, 20 nt, Artificial Sequence
  MKO10111503_B_Rab18
  gRNA
aagagacaccuuuguuaaac

SEQ ID NO: 111504 - RNA, 20 nt, Artificial Sequence
  MKO10111504_B_Rab18
  gRNA
gacauaguaaacaugcuagu

SEQ ID NO: 111505 - RNA, 20 nt, Artificial Sequence
  MKO10111505_B_Rab19
  gRNA
gugagggacagauucgaaug

SEQ ID NO: 111506 - RNA, 20 nt, Artificial Sequence
  MKO10111506_B_Rab19
  gRNA
ugucuuggagacauccgcca

SEQ ID NO: 111507 - RNA, 20 nt, Artificial Sequence
  MKO10111507_B_Rab19
  gRNA
gaagcggcauguccuguuug

SEQ ID NO: 111508 - RNA, 20 nt, Artificial Sequence
  MKO10111508_B_Rab1b
  gRNA
caagauucgaaccauugagc

SEQ ID NO: 111509 - RNA, 20 nt, Artificial Sequence
  MKO10111509_B_Rab1b
  gRNA
gacucguagugggacacagc

SEQ ID NO: 111510 - RNA, 20 nt, Artificial Sequence
  MKO10111510_B_Rab1b
  gRNA
caggcacgacuugcccacgc

SEQ ID NO: 111511 - RNA, 20 nt, Artificial Sequence
  MKO10111511_B_Rab1
  gRNA
uuucuauagugggacacagc

SEQ ID NO: 111512 - RNA, 20 nt, Artificial Sequence
  MKO10111512_B_Rab1
  gRNA
auacgaacuauagaguuaga

SEQ ID NO: 111513 - RNA, 20 nt, Artificial Sequence
  MKO10111513_B_Rab1
  gRNA
uguguaugaugugacagauc

SEQ ID NO: 111514 - RNA, 20 nt, Artificial Sequence
  MKO10111514_B_Rab20
  gRNA
ggugguucacaucguaugua

SEQ ID NO: 111515 - RNA, 20 nt, Artificial Sequence
  MKO10111515_B_Rab20
  gRNA
cggccgcuccgcggcaguac

SEQ ID NO: 111516 - RNA, 20 nt, Artificial Sequence
  MKO10111516_B_Rab20
  gRNA
cugccauuaggcacaacacc

SEQ ID NO: 111517 - RNA, 20 nt, Artificial Sequence
  MKO10111517_B_Rab21
  gRNA
uguguacacagguaaaaaac

SEQ ID NO: 111518 - RNA, 20 nt, Artificial Sequence
  MKO10111518_B_Rab21
  gRNA
caaagaauuacgaaaaaugu

SEQ ID NO: 111519 - RNA, 20 nt, Artificial Sequence
  MKO10111519_B_Rab21
  gRNA
auuagguaauaaaauagacu

SEQ ID NO: 111520 - RNA, 20 nt, Artificial Sequence
  MKO10111520_B_Rab22a
  gRNA
guaaaucgagcaucgugugg

SEQ ID NO: 111521 - RNA, 20 nt, Artificial Sequence
  MKO10111521_B_Rab22a
  gRNA
gcugacccucgauaguacau

SEQ ID NO: 111522 - RNA, 20 nt, Artificial Sequence
  MKO10111522_B_Rab22a
  gRNA
caaugcugggggggccgugc

SEQ ID NO: 111523 - RNA, 20 nt, Artificial Sequence
  MKO10111523_B_Rab23
  gRNA
gaaaaaguaguagcggaggu

SEQ ID NO: 111524 - RNA, 20 nt, Artificial Sequence
  MKO10111524_B_Rab23
  gRNA
gcaaaacaagaucgaucugc

SEQ ID NO: 111525 - RNA, 20 nt, Artificial Sequence
  MKO10111525_B_Rab23
  gRNA
gaaccucagcuuuagccuuu

SEQ ID NO: 111526 - RNA, 20 nt, Artificial Sequence
  MKO10111526_B_Rab24
  gRNA
ggagcugcgcaguuuagaag

SEQ ID NO: 111527 - RNA, 20 nt, Artificial Sequence
  MKO10111527_B_Rab24
  gRNA
ggcugucaaaucuaccugug

SEQ ID NO: 111528 - RNA, 20 nt, Artificial Sequence
  MKO10111528_B_Rab24
  gRNA
caauugcagcuuuagcaccc

SEQ ID NO: 111529 - RNA, 20 nt, Artificial Sequence
  MKO10111529_B_Rab25
  gRNA
cacgacagucgcaccaccau

SEQ ID NO: 111530 - RNA, 20 nt, Artificial Sequence
  MKO10111530_B_Rab25
  gRNA
gcucaacauugguggagucg

SEQ ID NO: 111531 - RNA, 20 nt, Artificial Sequence
  MKO10111531_B_Rab25
  gRNA
acccugggcaaugcccaagc

SEQ ID NO: 111532 - RNA, 20 nt, Artificial Sequence
  MKO10111532_B_Rab26
  gRNA
gccuacuaccgagaugcuca

SEQ ID NO: 111533 - RNA, 20 nt, Artificial Sequence
  MKO10111533_B_Rab26
  gRNA
ugggcuuaccgugagcaucu

SEQ ID NO: 111534 - RNA, 20 nt, Artificial Sequence
  MKO10111534_B_Rab26
  gRNA
agauuccuucgacaacauuc

SEQ ID NO: 111535 - RNA, 20 nt, Artificial Sequence
  MKO10111535_B_Rab27a
  gRNA
guuuccucaauguccgaaac

SEQ ID NO: 111536 - RNA, 20 nt, Artificial Sequence
  MKO10111536_B_Rab27a
  gRNA
ccgccgugucccauaacugc

SEQ ID NO: 111537 - RNA, 20 nt, Artificial Sequence
  MKO10111537_B_Rab27a
  gRNA
cacacguacuuauccaguuu

SEQ ID NO: 111538 - RNA, 20 nt, Artificial Sequence
  MKO10111538_B_Rab27b
  gRNA
aagucaaugaacggcaagca

SEQ ID NO: 111539 - RNA, 20 nt, Artificial Sequence
  MKO10111539_B_Rab27b
  gRNA
uugccaauuaauacuauguc

SEQ ID NO: 111540 - RNA, 20 nt, Artificial Sequence
  MKO10111540_B_Rab27b
  gRNA
auucaagaagcucuguugac

SEQ ID NO: 111541 - RNA, 20 nt, Artificial Sequence
  MKO10111541_B_Rab28
  gRNA
cacuuuguuucagccaagac

SEQ ID NO: 111542 - RNA, 20 nt, Artificial Sequence
  MKO10111542_B_Rab28
  gRNA
uuguaauaucauauaccaag

SEQ ID NO: 111543 - RNA, 20 nt, Artificial Sequence
  MKO10111543_B_Rab28
  gRNA
auguuggauaaauacaucua

SEQ ID NO: 111544 - RNA, 20 nt, Artificial Sequence
  MKO10111544_B_Rab2a
  gRNA
cguucaaccacuugacaacc

SEQ ID NO: 111545 - RNA, 20 nt, Artificial Sequence
  MKO10111545_B_Rab2a
  gRNA
ucaugcuuauuggaaauaaa

SEQ ID NO: 111546 - RNA, 20 nt, Artificial Sequence
  MKO10111546_B_Rab2a
  gRNA
aguccuuucguucuaucaca

SEQ ID NO: 111547 - RNA, 20 nt, Artificial Sequence
  MKO10111547_B_Rab2b
  gRNA
gcacguauggucaacaucga

SEQ ID NO: 111548 - RNA, 20 nt, Artificial Sequence
  MKO10111548_B_Rab2b
  gRNA
accuauugugaggucgugca

SEQ ID NO: 111549 - RNA, 20 nt, Artificial Sequence
  MKO10111549_B_Rab2b
  gRNA
cuaucacccguuccuacuac

SEQ ID NO: 111550 - RNA, 20 nt, Artificial Sequence
  MKO10111550_B_Rab30
  gRNA
aauguaucgucacccuuacc

SEQ ID NO: 111551 - RNA, 20 nt, Artificial Sequence
  MKO10111551_B_Rab30
  gRNA
agaccucucgccuuucagcc

SEQ ID NO: 111552 - RNA, 20 nt, Artificial Sequence
  MKO10111552_B_Rab30
  gRNA
cccuuaccugagugaaucuu

SEQ ID NO: 111553 - RNA, 20 nt, Artificial Sequence
  MKO10111553_B_Rab31
  gRNA
cucuucuaggacacgggggu

SEQ ID NO: 111554 - RNA, 20 nt, Artificial Sequence
  MKO10111554_B_Rab31
  gRNA
agugaugucauagacgauga

SEQ ID NO: 111555 - RNA, 20 nt, Artificial Sequence
  MKO10111555_B_Rab31
  gRNA
augaccaaaaccgugccuug

SEQ ID NO: 111556 - RNA, 20 nt, Artificial Sequence
  MKO10111556_B_Rab32
  gRNA
uccuagugaagaaaucgacc

SEQ ID NO: 111557 - RNA, 20 nt, Artificial Sequence
  MKO10111557_B_Rab32
  gRNA
caugacucgaguauacuaua

SEQ ID NO: 111558 - RNA, 20 nt, Artificial Sequence
  MKO10111558_B_Rab32
  gRNA
ucucuaggacaggaacgguu

SEQ ID NO: 111559 - RNA, 20 nt, Artificial Sequence
  MKO10111559_B_Rab33a
  gRNA
cuuggagcucgacucaucga

SEQ ID NO: 111560 - RNA, 20 nt, Artificial Sequence
  MKO10111560_B_Rab33a
  gRNA
gagaagaccguggaaaucga

SEQ ID NO: 111561 - RNA, 20 nt, Artificial Sequence
  MKO10111561_B_Rab33a
  gRNA
ucuuguaccgugaugccgag

SEQ ID NO: 111562 - RNA, 20 nt, Artificial Sequence
  MKO10111562_B_Rab33b
  gRNA
gcaugguccagcacuacuac

SEQ ID NO: 111563 - RNA, 20 nt, Artificial Sequence
  MKO10111563_B_Rab33b
  gRNA
uauugauggagagcgcauca

SEQ ID NO: 111564 - RNA, 20 nt, Artificial Sequence
  MKO10111564_B_Rab33b
  gRNA
gaacgacauaccucgaauuc

SEQ ID NO: 111565 - RNA, 20 nt, Artificial Sequence
  MKO10111565_B_Rab34
  gRNA
agccuuguaauucuuaucga

SEQ ID NO: 111566 - RNA, 20 nt, Artificial Sequence
  MKO10111566_B_Rab34
  gRNA
ucuuccaguugggacacggc

SEQ ID NO: 111567 - RNA, 20 nt, Artificial Sequence
  MKO10111567_B_Rab34
  gRNA
caucucaaaauccacuccga

SEQ ID NO: 111568 - RNA, 20 nt, Artificial Sequence
  MKO10111568_B_Rab35
  gRNA
gucucuaccaccuuccgcuc

SEQ ID NO: 111569 - RNA, 20 nt, Artificial Sequence
  MKO10111569_B_Rab35
  gRNA
ggcagcuacaucaccacaau

SEQ ID NO: 111570 - RNA, 20 nt, Artificial Sequence
  MKO10111570_B_Rab35
  gRNA
uuccacauugacguucuccu

SEQ ID NO: 111571 - RNA, 20 nt, Artificial Sequence
  MKO10111571_B_Rab36
  gRNA
aucgagcgcuuugagaucgc

SEQ ID NO: 111572 - RNA, 20 nt, Artificial Sequence
  MKO10111572_B_Rab36
  gRNA
cuuccuguagugguacacgc

SEQ ID NO: 111573 - RNA, 20 nt, Artificial Sequence
  MKO10111573_B_Rab36
  gRNA
auugcgucugccuacuaccg

SEQ ID NO: 111574 - RNA, 20 nt, Artificial Sequence
  MKO10111574_B_Rab37
  gRNA
uacccugauguugucaaaag

SEQ ID NO: 111575 - RNA, 20 nt, Artificial Sequence
  MKO10111575_B_Rab37
  gRNA
uggugccagggugaagcuuc

SEQ ID NO: 111576 - RNA, 20 nt, Artificial Sequence
  MKO10111576_B_Rab37
  gRNA
ucagaauaaaguggugacag

SEQ ID NO: 111577 - RNA, 20 nt, Artificial Sequence
  MKO10111577_B_Rab38
  gRNA
ucaaaguuaacgcucccuaa

SEQ ID NO: 111578 - RNA, 20 nt, Artificial Sequence
  MKO10111578_B_Rab38
  gRNA
ugcaaggagcauggcuucgu

SEQ ID NO: 111579 - RNA, 20 nt, Artificial Sequence
  MKO10111579_B_Rab38
  gRNA
ccuccuagagucuauagaac

SEQ ID NO: 111580 - RNA, 20 nt, Artificial Sequence
  MKO10111580_B_Rab39b
  gRNA
agcccgagaugccauuaaug

SEQ ID NO: 111581 - RNA, 20 nt, Artificial Sequence
  MKO10111581_B_Rab39b
  gRNA
ccugauccgccgcuucaccg

SEQ ID NO: 111582 - RNA, 20 nt, Artificial Sequence
  MKO10111582_B_Rab39b
  gRNA
aaucgccgaugacaaugagc

SEQ ID NO: 111583 - RNA, 20 nt, Artificial Sequence
  MKO10111583_B_Rab39
  gRNA
ugaccuggcuucgcaacgcc

SEQ ID NO: 111584 - RNA, 20 nt, Artificial Sequence
  MKO10111584_B_Rab39
  gRNA
caguuccgccuuauugugau

SEQ ID NO: 111585 - RNA, 20 nt, Artificial Sequence
  MKO10111585_B_Rab39
  gRNA
cccgccugcgaccccacagu

SEQ ID NO: 111586 - RNA, 20 nt, Artificial Sequence
  MKO10111586_B_Rab3a
  gRNA
agucaucugcguagcggaag

SEQ ID NO: 111587 - RNA, 20 nt, Artificial Sequence
  MKO10111587_B_Rab3a
  gRNA
cucagagcguggccggcagc

SEQ ID NO: 111588 - RNA, 20 nt, Artificial Sequence
  MKO10111588_B_Rab3a
  gRNA
cucagaucaaaacuuacucg

SEQ ID NO: 111589 - RNA, 20 nt, Artificial Sequence
  MKO10111589_B_Rab3b
  gRNA
aaugaccugugcguuguccc

SEQ ID NO: 111590 - RNA, 20 nt, Artificial Sequence
  MKO10111590_B_Rab3b
  gRNA
cucagauuaagaccuacucc

SEQ ID NO: 111591 - RNA, 20 nt, Artificial Sequence
  MKO10111591_B_Rab3b
  gRNA
ugaaggugucaucagcauag

SEQ ID NO: 111592 - RNA, 20 nt, Artificial Sequence
  MKO10111592_B_Rab3c
  gRNA
ccuucaacgcuguacaagau

SEQ ID NO: 111593 - RNA, 20 nt, Artificial Sequence
  MKO10111593_B_Rab3c
  gRNA
accgagagaggccagcgcuu

SEQ ID NO: 111594 - RNA, 20 nt, Artificial Sequence
  MKO10111594_B_Rab3c
  gRNA
gaccgacccagccaucacag

SEQ ID NO: 111595 - RNA, 20 nt, Artificial Sequence
  MKO10111595_B_Rab3d
  gRNA
ugaaggagucaucggcauag

SEQ ID NO: 111596 - RNA, 20 nt, Artificial Sequence
  MKO10111596_B_Rab3d
  gRNA
ggucacacuuguuccccacg

SEQ ID NO: 111597 - RNA, 20 nt, Artificial Sequence
  MKO10111597_B_Rab3d
  gRNA
ugucacagaugauguccacc

SEQ ID NO: 111598 - RNA, 20 nt, Artificial Sequence
  MKO10111598_B_Rab3gap1
  gRNA
auucaagacuucuucaacuu

SEQ ID NO: 111599 - RNA, 20 nt, Artificial Sequence
  MKO10111599_B_Rab3gap1
  gRNA
aaauuuccuuugcugacuuc

SEQ ID NO: 111600 - RNA, 20 nt, Artificial Sequence
  MKO10111600_B_Rab3gap1
  gRNA
augcaggguauauuuacuuc

SEQ ID NO: 111601 - RNA, 20 nt, Artificial Sequence
  MKO10111601_B_Rab3gap2
  gRNA
gagcggcuccguaagugcag

SEQ ID NO: 111602 - RNA, 20 nt, Artificial Sequence
  MKO10111602_B_Rab3gap2
  gRNA
guacuuacgcacuaggaaug

SEQ ID NO: 111603 - RNA, 20 nt, Artificial Sequence
  MKO10111603_B_Rab3gap2
  gRNA
cucuagguaaaacaucaagc

SEQ ID NO: 111604 - RNA, 20 nt, Artificial Sequence
  MKO10111604_B_Rab3il1
  gRNA
cagccaaccccaacaagacg

SEQ ID NO: 111605 - RNA, 20 nt, Artificial Sequence
  MKO10111605_B_Rab3il1
  gRNA
uugcaaaguacgugcacagc

SEQ ID NO: 111606 - RNA, 20 nt, Artificial Sequence
  MKO10111606_B_Rab3il1
  gRNA
cgaugucgccugcuucaugu

SEQ ID NO: 111607 - RNA, 20 nt, Artificial Sequence
  MKO10111607_B_Rab3ip
  gRNA
gccgccagaggcuccugcgu

SEQ ID NO: 111608 - RNA, 20 nt, Artificial Sequence
  MKO10111608_B_Rab3ip
  gRNA
aggacacguucuguccaucg

SEQ ID NO: 111609 - RNA, 20 nt, Artificial Sequence
  MKO10111609_B_Rab3ip
  gRNA
uguauaaugaguucagaucu

SEQ ID NO: 111610 - RNA, 20 nt, Artificial Sequence
  MKO10111610_B_Rab40b
  gRNA
ccuuugauggcauuaaucga

SEQ ID NO: 111611 - RNA, 20 nt, Artificial Sequence
  MKO10111611_B_Rab40b
  gRNA
acaaaaucuccccugccccg

SEQ ID NO: 111612 - RNA, 20 nt, Artificial Sequence
  MKO10111612_B_Rab40b
  gRNA
acgaccaccauccugcuaga

SEQ ID NO: 111613 - RNA, 20 nt, Artificial Sequence
  MKO10111613_B_Rab40c
  gRNA
uguacgacaucaccaaccgu

SEQ ID NO: 111614 - RNA, 20 nt, Artificial Sequence
  MKO10111614_B_Rab40c
  gRNA
ccuuugauggcauugaccgg

SEQ ID NO: 111615 - RNA, 20 nt, Artificial Sequence
  MKO10111615_B_Rab40c
  gRNA
uaccugugcaccccuugagu

SEQ ID NO: 111616 - RNA, 20 nt, Artificial Sequence
  MKO10111616_B_Rab42
  gRNA
ugucaccagcgccaucgaac

SEQ ID NO: 111617 - RNA, 20 nt, Artificial Sequence
  MKO10111617_B_Rab42
  gRNA
cgcgcgcugcaacuacccgc

SEQ ID NO: 111618 - RNA, 20 nt, Artificial Sequence
  MKO10111618_B_Rab42
  gRNA
ccggaucccgaacccacugu

SEQ ID NO: 111619 - RNA, 20 nt, Artificial Sequence
  MKO10111619_B_Rab43
  gRNA
ugccaucgagaccuccgcaa

SEQ ID NO: 111620 - RNA, 20 nt, Artificial Sequence
  MKO10111620_B_Rab43
  gRNA
agucagaccuugccgauuuc

SEQ ID NO: 111621 - RNA, 20 nt, Artificial Sequence
  MKO10111621_B_Rab43
  gRNA
cucacauccucgauccagug

SEQ ID NO: 111622 - RNA, 20 nt, Artificial Sequence
  MKO10111622_B_Rab44
  gRNA
aaaccuucgcccugcaacug

SEQ ID NO: 111623 - RNA, 20 nt, Artificial Sequence
  MKO10111623_B_Rab44
  gRNA
caaaagcgucaugauguagc

SEQ ID NO: 111624 - RNA, 20 nt, Artificial Sequence
  MKO10111624_B_Rab44
  gRNA
gaggcugagcgggaccuagc

SEQ ID NO: 111625 - RNA, 20 nt, Artificial Sequence
  MKO10111625_B_Rab4a
  gRNA
gaugacucaaaucauaccau

SEQ ID NO: 111626 - RNA, 20 nt, Artificial Sequence
  MKO10111626_B_Rab4a
  gRNA
gugacgagaagcuacuacag

SEQ ID NO: 111627 - RNA, 20 nt, Artificial Sequence
  MKO10111627_B_Rab4a
  gRNA
uccuugucuaugacaucacc

SEQ ID NO: 111628 - RNA, 20 nt, Artificial Sequence
  MKO10111628_B_Rab4b
  gRNA
aguuauuaccgaggggcagc

SEQ ID NO: 111629 - RNA, 20 nt, Artificial Sequence
  MKO10111629_B_Rab4b
  gRNA
ugaccucacgcucgggaucc

SEQ ID NO: 111630 - RNA, 20 nt, Artificial Sequence
  MKO10111630_B_Rab4b
  gRNA
acagaggaugaccacgaugu

SEQ ID NO: 111631 - RNA, 20 nt, Artificial Sequence
  MKO10111631_B_Rab5a
  gRNA
gacaaagcuaucacaauauu

SEQ ID NO: 111632 - RNA, 20 nt, Artificial Sequence
  MKO10111632_B_Rab5a
  gRNA
gcaaacucagccagaggacg

SEQ ID NO: 111633 - RNA, 20 nt, Artificial Sequence
  MKO10111633_B_Rab5a
  gRNA
aagaaugaaccacagaaucc

SEQ ID NO: 111634 - RNA, 20 nt, Artificial Sequence
  MKO10111634_B_Rab5b
  gRNA
cccuagcauuguuauugccu

SEQ ID NO: 111635 - RNA, 20 nt, Artificial Sequence
  MKO10111635_B_Rab5b
  gRNA
uguugugucaucuaaacaca

SEQ ID NO: 111636 - RNA, 20 nt, Artificial Sequence
  MKO10111636_B_Rab5b
  gRNA
caacagucaaguuugagauc

SEQ ID NO: 111637 - RNA, 20 nt, Artificial Sequence
  MKO10111637_B_Rab5c
  gRNA
ggggcuccgggccgaaccag

SEQ ID NO: 111638 - RNA, 20 nt, Artificial Sequence
  MKO10111638_B_Rab5c
  gRNA
ugucugcuuagacgauacaa

SEQ ID NO: 111639 - RNA, 20 nt, Artificial Sequence
  MKO10111639_B_Rab5c
  gRNA
ccggagccccagccgcauuc

SEQ ID NO: 111640 - RNA, 20 nt, Artificial Sequence
  MKO10111640_B_Rab6a
  gRNA
gaugucaucaucaugcuagu

SEQ ID NO: 111641 - RNA, 20 nt, Artificial Sequence
  MKO10111641_B_Rab6a
  gRNA
cuuaucaaaaacaauguacu

SEQ ID NO: 111642 - RNA, 20 nt, Artificial Sequence
  MKO10111642_B_Rab6a
  gRNA
aaacagaucuugcugauaag

SEQ ID NO: 111643 - RNA, 20 nt, Artificial Sequence
  MKO10111643_B_Rab6b
  gRNA
uugaugacgucaggacggag

SEQ ID NO: 111644 - RNA, 20 nt, Artificial Sequence
  MKO10111644_B_Rab6b
  gRNA
cguacggucuuccaaguaca

SEQ ID NO: 111645 - RNA, 20 nt, Artificial Sequence
  MKO10111645_B_Rab6b
  gRNA
ugacgugaucaucaugcuug

SEQ ID NO: 111646 - RNA, 20 nt, Artificial Sequence
  MKO10111646_B_Rab7l1
  gRNA
ggagauugauguaguucccu

SEQ ID NO: 111647 - RNA, 20 nt, Artificial Sequence
  MKO10111647_B_Rab7l1
  gRNA
gucagagugaucuguccccu

SEQ ID NO: 111648 - RNA, 20 nt, Artificial Sequence
  MKO10111648_B_Rab7l1
  gRNA
ccaucucugagucagaccac

SEQ ID NO: 111649 - RNA, 20 nt, Artificial Sequence
  MKO10111649_B_Rab7
  gRNA
ugaacuucuuguucacauac

SEQ ID NO: 111650 - RNA, 20 nt, Artificial Sequence
  MKO10111650_B_Rab7
  gRNA
uccuauccaggaaacagaag

SEQ ID NO: 111651 - RNA, 20 nt, Artificial Sequence
  MKO10111651_B_Rab7
  gRNA
caagaacgguuccagucucu

SEQ ID NO: 111652 - RNA, 20 nt, Artificial Sequence
  MKO10111652_B_Rab8a
  gRNA
ccucuugccaucgagcucua

SEQ ID NO: 111653 - RNA, 20 nt, Artificial Sequence
  MKO10111653_B_Rab8a
  gRNA
ccauagagcucgauggcaag

SEQ ID NO: 111654 - RNA, 20 nt, Artificial Sequence
  MKO10111654_B_Rab8a
  gRNA
caauguuccgaauccaauuc

SEQ ID NO: 111655 - RNA, 20 nt, Artificial Sequence
  MKO10111655_B_Rab8b
  gRNA
agaaaauuaaacuucagaua

SEQ ID NO: 111656 - RNA, 20 nt, Artificial Sequence
  MKO10111656_B_Rab8b
  gRNA
aguaugcugucguaauuguu

SEQ ID NO: 111657 - RNA, 20 nt, Artificial Sequence
  MKO10111657_B_Rab8b
  gRNA
auuacgacagcauacuauag

SEQ ID NO: 111658 - RNA, 20 nt, Artificial Sequence
  MKO10111658_B_Rab9b
  gRNA
cgaacuuguugguuacauaa

SEQ ID NO: 111659 - RNA, 20 nt, Artificial Sequence
  MKO10111659_B_Rab9b
  gRNA
gccuuagaacaccauucuac

SEQ ID NO: 111660 - RNA, 20 nt, Artificial Sequence
  MKO10111660_B_Rab9b
  gRNA
cccagaucauuuccccuuug

SEQ ID NO: 111661 - RNA, 20 nt, Artificial Sequence
  MKO10111661_B_Rab9
  gRNA
ucuucgaacugccuccucaa

SEQ ID NO: 111662 - RNA, 20 nt, Artificial Sequence
  MKO10111662_B_Rab9
  gRNA
cuuguugcccaaaaucacaa

SEQ ID NO: 111663 - RNA, 20 nt, Artificial Sequence
  MKO10111663_B_Rab9
  gRNA
cagucagaaccccgguaaaa

SEQ ID NO: 111664 - RNA, 20 nt, Artificial Sequence
  MKO10111664_B_Rabac1
  gRNA
ugcagcuccucgccaucugc

SEQ ID NO: 111665 - RNA, 20 nt, Artificial Sequence
  MKO10111665_B_Rabac1
  gRNA
cagucuaagcuuguacucuu

SEQ ID NO: 111666 - RNA, 20 nt, Artificial Sequence
  MKO10111666_B_Rabac1
  gRNA
cccagcacaucaguaugccc

SEQ ID NO: 111667 - RNA, 20 nt, Artificial Sequence
  MKO10111667_B_Rabep1
  gRNA
augagcaucaguuucaccug

SEQ ID NO: 111668 - RNA, 20 nt, Artificial Sequence
  MKO10111668_B_Rabep1
  gRNA
gaaacugaugcucauaguca

SEQ ID NO: 111669 - RNA, 20 nt, Artificial Sequence
  MKO10111669_B_Rabep1
  gRNA
agcugcaauuuccuucucca

SEQ ID NO: 111670 - RNA, 20 nt, Artificial Sequence
  MKO10111670_B_Rabep2
  gRNA
gccggcagugccucccuacg

SEQ ID NO: 111671 - RNA, 20 nt, Artificial Sequence
  MKO10111671_B_Rabep2
  gRNA
gcaggagauuaccgagcuga

SEQ ID NO: 111672 - RNA, 20 nt, Artificial Sequence
  MKO10111672_B_Rabep2
  gRNA
ccagaucgcagcccugaaac

SEQ ID NO: 111673 - RNA, 20 nt, Artificial Sequence
  MKO10111673_B_Rabepk
  gRNA
caugcucguaccgaggcaag

SEQ ID NO: 111674 - RNA, 20 nt, Artificial Sequence
  MKO10111674_B_Rabepk
  gRNA
gacaggcccugcccucgagu

SEQ ID NO: 111675 - RNA, 20 nt, Artificial Sequence
  MKO10111675_B_Rabepk
  gRNA
gacaguuucgauuuccugac

SEQ ID NO: 111676 - RNA, 20 nt, Artificial Sequence
  MKO10111676_B_Rabgap1l
  gRNA
ggucuaccuguugauugcca

SEQ ID NO: 111677 - RNA, 20 nt, Artificial Sequence
  MKO10111677_B_Rabgap1l
  gRNA
cauaccuuguaucuauccau

SEQ ID NO: 111678 - RNA, 20 nt, Artificial Sequence
  MKO10111678_B_Rabgap1l
  gRNA
ggacccaauggauagauaca

SEQ ID NO: 111679 - RNA, 20 nt, Artificial Sequence
  MKO10111679_B_Rabgap1
  gRNA
ugaugagaagacgggacuca

SEQ ID NO: 111680 - RNA, 20 nt, Artificial Sequence
  MKO10111680_B_Rabgap1
  gRNA
acacuauccucaucagccac

SEQ ID NO: 111681 - RNA, 20 nt, Artificial Sequence
  MKO10111681_B_Rabgap1
  gRNA
ucacucccauuauuuguaga

SEQ ID NO: 111682 - RNA, 20 nt, Artificial Sequence
  MKO10111682_B_Rabgef1
  gRNA
acccuucuuggauccagcuc

SEQ ID NO: 111683 - RNA, 20 nt, Artificial Sequence
  MKO10111683_B_Rabgef1
  gRNA
gaauuucagacuucagcggg

SEQ ID NO: 111684 - RNA, 20 nt, Artificial Sequence
  MKO10111684_B_Rabgef1
  gRNA
caacauauuaccuuucccac

SEQ ID NO: 111685 - RNA, 20 nt, Artificial Sequence
  MKO10111685_B_Rabggua
  gRNA
cugguagcaugggcgccuga

SEQ ID NO: 111686 - RNA, 20 nt, Artificial Sequence
  MKO10111686_B_Rabggua
  gRNA
cuguucccgcucuagccuuu

SEQ ID NO: 111687 - RNA, 20 nt, Artificial Sequence
  MKO10111687_B_Rabggua
  gRNA
auaaugccaggaagaauagu

SEQ ID NO: 111688 - RNA, 20 nt, Artificial Sequence
  MKO10111688_B_Rabggub
  gRNA
ugcgccugacacccuguugc

SEQ ID NO: 111689 - RNA, 20 nt, Artificial Sequence
  MKO10111689_B_Rabggub
  gRNA
gccgauuauauugcuuccua

SEQ ID NO: 111690 - RNA, 20 nt, Artificial Sequence
  MKO10111690_B_Rabggub
  gRNA
accccaaaugucuccagcaa

SEQ ID NO: 111691 - RNA, 20 nt, Artificial Sequence
  MKO10111691_B_Rabif
  gRNA
accaucaggauugcugccgu

SEQ ID NO: 111692 - RNA, 20 nt, Artificial Sequence
  MKO10111692_B_Rabif
  gRNA
acagcaccgccuuccgguuc

SEQ ID NO: 111693 - RNA, 20 nt, Artificial Sequence
  MKO10111693_B_Rabif
  gRNA
gagcucguucugcagcucgc

SEQ ID NO: 111694 - RNA, 20 nt, Artificial Sequence
  MKO10111694_B_Rabl2
  gRNA
ugaugcaggcgugagccuug

SEQ ID NO: 111695 - RNA, 20 nt, Artificial Sequence
  MKO10111695_B_Rabl2
  gRNA
aguaggaagcaugcaugcuc

SEQ ID NO: 111696 - RNA, 20 nt, Artificial Sequence
  MKO10111696_B_Rabl2
  gRNA
auacagagucagagcauaug

SEQ ID NO: 111697 - RNA, 20 nt, Artificial Sequence
  MKO10111697_B_Rabl3
  gRNA
aaucgggaugcaguuccaac

SEQ ID NO: 111698 - RNA, 20 nt, Artificial Sequence
  MKO10111698_B_Rabl3
  gRNA
cagcauugaaguccucagcc

SEQ ID NO: 111699 - RNA, 20 nt, Artificial Sequence
  MKO10111699_B_Rabl3
  gRNA
gagcagcccacaguccauga

SEQ ID NO: 111700 - RNA, 20 nt, Artificial Sequence
  MKO10111700_B_Rabl5
  gRNA
ugaugaugagcaucuccucg

SEQ ID NO: 111701 - RNA, 20 nt, Artificial Sequence
  MKO10111701_B_Rabl5
  gRNA
acgucagguuugaguccugu

SEQ ID NO: 111702 - RNA, 20 nt, Artificial Sequence
  MKO10111702_B_Rabl5
  gRNA
gcucaccucacaccuugugu

SEQ ID NO: 111703 - RNA, 20 nt, Artificial Sequence
  MKO10111703_B_Rabl6
  gRNA
uaaggaaaguguaaaaaacg

SEQ ID NO: 111704 - RNA, 20 nt, Artificial Sequence
  MKO10111704_B_Rabl6
  gRNA
ggugaccuggaucuccugug

SEQ ID NO: 111705 - RNA, 20 nt, Artificial Sequence
  MKO10111705_B_Rabl6
  gRNA
gaagacggaaaaugaccccc

SEQ ID NO: 111706 - RNA, 20 nt, Artificial Sequence
  MKO10111706_B_Rac1
  gRNA
auuugaaaauguccgugcaa

SEQ ID NO: 111707 - RNA, 20 nt, Artificial Sequence
  MKO10111707_B_Rac1
  gRNA
acgguggggauguacucucc

SEQ ID NO: 111708 - RNA, 20 nt, Artificial Sequence
  MKO10111708_B_Rac1
  gRNA
uggucguguaacugaugagc

SEQ ID NO: 111709 - RNA, 20 nt, Artificial Sequence
  MKO10111709_B_Rac2
  gRNA
gcugugggauaccgcagguc

SEQ ID NO: 111710 - RNA, 20 nt, Artificial Sequence
  MKO10111710_B_Rac2
  gRNA
gagaagacacgucuugccca

SEQ ID NO: 111711 - RNA, 20 nt, Artificial Sequence
  MKO10111711_B_Rac2
  gRNA
cuuggcacggacauucucau

SEQ ID NO: 111712 - RNA, 20 nt, Artificial Sequence
  MKO10111712_B_Rac3
  gRNA
gcuggaccuccgugaugaca

SEQ ID NO: 111713 - RNA, 20 nt, Artificial Sequence
  MKO10111713_B_Rac3
  gRNA
uggucguguagcugaucagc

SEQ ID NO: 111714 - RNA, 20 nt, Artificial Sequence
  MKO10111714_B_Rac3
  gRNA
acuguggggauauauucucc

SEQ ID NO: 111715 - RNA, 20 nt, Artificial Sequence
  MKO10111715_B_Racgap1
  gRNA
agucccccaccuauuguugc

SEQ ID NO: 111716 - RNA, 20 nt, Artificial Sequence
  MKO10111716_B_Racgap1
  gRNA
cugucaacgauugaugaauc

SEQ ID NO: 111717 - RNA, 20 nt, Artificial Sequence
  MKO10111717_B_Racgap1
  gRNA
acaggacugggauucuucuu

SEQ ID NO: 111718 - RNA, 20 nt, Artificial Sequence
  MKO10111718_B_Rad17
  gRNA
uugggauccaaguacaagaa

SEQ ID NO: 111719 - RNA, 20 nt, Artificial Sequence
  MKO10111719_B_Rad17
  gRNA
ugaagacugcuaucugagau

SEQ ID NO: 111720 - RNA, 20 nt, Artificial Sequence
  MKO10111720_B_Rad17
  gRNA
aacugauaagaagaucauuc

SEQ ID NO: 111721 - RNA, 20 nt, Artificial Sequence
  MKO10111721_B_Rad18
  gRNA
ucagugcccaacuuguugcg

SEQ ID NO: 111722 - RNA, 20 nt, Artificial Sequence
  MKO10111722_B_Rad18
  gRNA
auagaugacuugcugcgcug

SEQ ID NO: 111723 - RNA, 20 nt, Artificial Sequence
  MKO10111723_B_Rad18
  gRNA
accuucaucaccgccaaccc

SEQ ID NO: 111724 - RNA, 20 nt, Artificial Sequence
  MKO10111724_B_Rad1
  gRNA
ggucugcaaaauuaccacuc

SEQ ID NO: 111725 - RNA, 20 nt, Artificial Sequence
  MKO10111725_B_Rad1
  gRNA
uaaagcuagugccuuuguag

SEQ ID NO: 111726 - RNA, 20 nt, Artificial Sequence
  MKO10111726_B_Rad1
  gRNA
aacuauagguugucuacuuu

SEQ ID NO: 111727 - RNA, 20 nt, Artificial Sequence
  MKO10111727_B_Rad21l
  gRNA
augaagaugacauuucgccc

SEQ ID NO: 111728 - RNA, 20 nt, Artificial Sequence
  MKO10111728_B_Rad21l
  gRNA
ucagaaccaaaguagaccag

SEQ ID NO: 111729 - RNA, 20 nt, Artificial Sequence
  MKO10111729_B_Rad21l
  gRNA
ucucaccaaagcucccagcu

SEQ ID NO: 111730 - RNA, 20 nt, Artificial Sequence
  MKO10111730_B_Rad21
  gRNA
auguuuaggugacuucggaa

SEQ ID NO: 111731 - RNA, 20 nt, Artificial Sequence
  MKO10111731_B_Rad21
  gRNA
ucaaaaucguggaauuccuc

SEQ ID NO: 111732 - RNA, 20 nt, Artificial Sequence
  MKO10111732_B_Rad21
  gRNA
cucaggugaagauggcgcug

SEQ ID NO: 111733 - RNA, 20 nt, Artificial Sequence
  MKO10111733_B_Rad23a
  gRNA
gagugacgauguucccauca

SEQ ID NO: 111734 - RNA, 20 nt, Artificial Sequence
  MKO10111734_B_Rad23a
  gRNA
ucgcccgcugcuaccugaag

SEQ ID NO: 111735 - RNA, 20 nt, Artificial Sequence
  MKO10111735_B_Rad23a
  gRNA
gaagacgcagcuuccacauu

SEQ ID NO: 111736 - RNA, 20 nt, Artificial Sequence
  MKO10111736_B_Rad23b
  gRNA
ucuucugaacccgcaccugc

SEQ ID NO: 111737 - RNA, 20 nt, Artificial Sequence
  MKO10111737_B_Rad23b
  gRNA
guacaccaggagauucuucc

SEQ ID NO: 111738 - RNA, 20 nt, Artificial Sequence
  MKO10111738_B_Rad23b
  gRNA
gaagaugcaacaagugcccu

SEQ ID NO: 111739 - RNA, 20 nt, Artificial Sequence
  MKO10111739_B_Rad50
  gRNA
gucaccaagaagacuccaac

SEQ ID NO: 111740 - RNA, 20 nt, Artificial Sequence
  MKO10111740_B_Rad50
  gRNA
ucugucgauuucugcacauu

SEQ ID NO: 111741 - RNA, 20 nt, Artificial Sequence
  MKO10111741_B_Rad50
  gRNA
ucuaguaaugacuccuucca

SEQ ID NO: 111742 - RNA, 20 nt, Artificial Sequence
  MKO10111742_B_Rad51ap1
  gRNA
aaacuuaccuacaucaucac

SEQ ID NO: 111743 - RNA, 20 nt, Artificial Sequence
  MKO10111743_B_Rad51ap1
  gRNA
uauucacaguuugaagauuc

SEQ ID NO: 111744 - RNA, 20 nt, Artificial Sequence
  MKO10111744_B_Rad51ap1
  gRNA
caacagaacccccuaaaaaa

SEQ ID NO: 111745 - RNA, 20 nt, Artificial Sequence
  MKO10111745_B_Rad51ap2
  gRNA
cuugacaagccaacccuaau

SEQ ID NO: 111746 - RNA, 20 nt, Artificial Sequence
  MKO10111746_B_Rad51ap2
  gRNA
uaaaaaugaaacuuuauuga

SEQ ID NO: 111747 - RNA, 20 nt, Artificial Sequence
  MKO10111747_B_Rad51ap2
  gRNA
ggcgggauggccgcugcuug

SEQ ID NO: 111748 - RNA, 20 nt, Artificial Sequence
  MKO10111748_B_Rad51b
  gRNA
gcaaagaugaacucuacugc

SEQ ID NO: 111749 - RNA, 20 nt, Artificial Sequence
  MKO10111749_B_Rad51b
  gRNA
uuacuguaugaagaagcucg

SEQ ID NO: 111750 - RNA, 20 nt, Artificial Sequence
  MKO10111750_B_Rad51b
  gRNA
uugccgagagcucaccugug

SEQ ID NO: 111751 - RNA, 20 nt, Artificial Sequence
  MKO10111751_B_Rad51c
  gRNA
aaacuucugucgucuucauu

SEQ ID NO: 111752 - RNA, 20 nt, Artificial Sequence
  MKO10111752_B_Rad51c
  gRNA
cagcaccuucaucucauagc

SEQ ID NO: 111753 - RNA, 20 nt, Artificial Sequence
  MKO10111753_B_Rad51c
  gRNA
agcaguauuuauugauacag

SEQ ID NO: 111754 - RNA, 20 nt, Artificial Sequence
  MKO10111754_B_Rad51d
  gRNA
ggacgccgucauuccuccau

SEQ ID NO: 111755 - RNA, 20 nt, Artificial Sequence
  MKO10111755_B_Rad51d
  gRNA
gcagcagaauguacuguaug

SEQ ID NO: 111756 - RNA, 20 nt, Artificial Sequence
  MKO10111756_B_Rad51d
  gRNA
cuggacaaacuacuugaugc

SEQ ID NO: 111757 - RNA, 20 nt, Artificial Sequence
  MKO10111757_B_Rad51
  gRNA
auguuuggagaauuccgaac

SEQ ID NO: 111758 - RNA, 20 nt, Artificial Sequence
  MKO10111758_B_Rad51
  gRNA
caacugaguuucaccagcgc

SEQ ID NO: 111759 - RNA, 20 nt, Artificial Sequence
  MKO10111759_B_Rad51
  gRNA
uguugcuuaugcaccgaaga

SEQ ID NO: 111760 - RNA, 20 nt, Artificial Sequence
  MKO10111760_B_Rad52
  gRNA
gaugguugucacacccucug

SEQ ID NO: 111761 - RNA, 20 nt, Artificial Sequence
  MKO10111761_B_Rad52
  gRNA
auuguaaccaaacaucucau

SEQ ID NO: 111762 - RNA, 20 nt, Artificial Sequence
  MKO10111762_B_Rad52
  gRNA
aaccaguuaccuguccaaag

SEQ ID NO: 111763 - RNA, 20 nt, Artificial Sequence
  MKO10111763_B_Rad54b
  gRNA
gaacagucacaaaaugaucc

SEQ ID NO: 111764 - RNA, 20 nt, Artificial Sequence
  MKO10111764_B_Rad54b
  gRNA
uuggaugagacugcccaagc

SEQ ID NO: 111765 - RNA, 20 nt, Artificial Sequence
  MKO10111765_B_Rad54b
  gRNA
uccagauccaaaacuguuuc

SEQ ID NO: 111766 - RNA, 20 nt, Artificial Sequence
  MKO10111766_B_Rad54l2
  gRNA
aagaugggcagcggccgccg

SEQ ID NO: 111767 - RNA, 20 nt, Artificial Sequence
  MKO10111767_B_Rad54l2
  gRNA
ggaggauacgcugcacaucg

SEQ ID NO: 111768 - RNA, 20 nt, Artificial Sequence
  MKO10111768_B_Rad54l2
  gRNA
auuuguuuggacaguagcag

SEQ ID NO: 111769 - RNA, 20 nt, Artificial Sequence
  MKO10111769_B_Rad54l
  gRNA
cugcuggacuugcguuucuu

SEQ ID NO: 111770 - RNA, 20 nt, Artificial Sequence
  MKO10111770_B_Rad54l
  gRNA
uguugacugcuauccagaca

SEQ ID NO: 111771 - RNA, 20 nt, Artificial Sequence
  MKO10111771_B_Rad54l
  gRNA
uuuccuccuagccaacuggc

SEQ ID NO: 111772 - RNA, 20 nt, Artificial Sequence
  MKO10111772_B_Rad9a
  gRNA
acuuauugcgcaccccagca

SEQ ID NO: 111773 - RNA, 20 nt, Artificial Sequence
  MKO10111773_B_Rad9a
  gRNA
ccuguccgucuuccgcucuc

SEQ ID NO: 111774 - RNA, 20 nt, Artificial Sequence
  MKO10111774_B_Rad9a
  gRNA
gggacgaguucacaguccgu

SEQ ID NO: 111775 - RNA, 20 nt, Artificial Sequence
  MKO10111775_B_Rad9b
  gRNA
uaagucaguaucacucaucg

SEQ ID NO: 111776 - RNA, 20 nt, Artificial Sequence
  MKO10111776_B_Rad9b
  gRNA
cacgagugagcgaugagcug

SEQ ID NO: 111777 - RNA, 20 nt, Artificial Sequence
  MKO10111777_B_Rad9b
  gRNA
uaacuuacaccuuucucgga

SEQ ID NO: 111778 - RNA, 20 nt, Artificial Sequence
  MKO10111778_B_Radil
  gRNA
gcuacagcguauccgugcca

SEQ ID NO: 111779 - RNA, 20 nt, Artificial Sequence
  MKO10111779_B_Radil
  gRNA
uccaugcucugcacguacag

SEQ ID NO: 111780 - RNA, 20 nt, Artificial Sequence
  MKO10111780_B_Radil
  gRNA
accugcagcacauccuguuu

SEQ ID NO: 111781 - RNA, 20 nt, Artificial Sequence
  MKO10111781_B_Rae1
  gRNA
uucagcccgccaacuuuacc

SEQ ID NO: 111782 - RNA, 20 nt, Artificial Sequence
  MKO10111782_B_Rae1
  gRNA
gagcugggauaagacucuga

SEQ ID NO: 111783 - RNA, 20 nt, Artificial Sequence
  MKO10111783_B_Rae1
  gRNA
aaguugccugguaaaguugg

SEQ ID NO: 111784 - RNA, 20 nt, Artificial Sequence
  MKO10111784_B_Raet1a
  gRNA
ccuucugugacugcugcucc

SEQ ID NO: 111785 - RNA, 20 nt, Artificial Sequence
  MKO10111785_B_Raet1a
  gRNA
uguguaugcagugugugcag

SEQ ID NO: 111786 - RNA, 20 nt, Artificial Sequence
  MKO10111786_B_Raet1a
  gRNA
ucaccaacagcugcgcccuc

SEQ ID NO: 111787 - RNA, 20 nt, Artificial Sequence
  MKO10111787_B_Raet1b
  gRNA
acuucacgucacaccaggga

SEQ ID NO: 111788 - RNA, 20 nt, Artificial Sequence
  MKO10111788_B_Raet1b
  gRNA
ucuacacagagauuaugagc

SEQ ID NO: 111789 - RNA, 20 nt, Artificial Sequence
  MKO10111789_B_Raet1b
  gRNA
ugcugagguaggauccuuga

SEQ ID NO: 111790 - RNA, 20 nt, Artificial Sequence
  MKO10111790_B_Raet1c
  gRNA
uuugcauuugcgaugugaag

SEQ ID NO: 111791 - RNA, 20 nt, Artificial Sequence
  MKO10111791_B_Raet1c
  gRNA
ucuacacagagaauaugagc

SEQ ID NO: 111792 - RNA, 20 nt, Artificial Sequence
  MKO10111792_B_Raet1c
  gRNA
aguauuucaauuguugcaca

SEQ ID NO: 111793 - RNA, 20 nt, Artificial Sequence
  MKO10111793_B_Raet1d
  gRNA
ucuacacagagauuaugagc

SEQ ID NO: 111794 - RNA, 20 nt, Artificial Sequence
  MKO10111794_B_Raet1d
  gRNA
caauugaaauucuugauaca

SEQ ID NO: 111795 - RNA, 20 nt, Artificial Sequence
  MKO10111795_B_Raet1d
  gRNA
cuguuaauucuacugagcua

SEQ ID NO: 111796 - RNA, 20 nt, Artificial Sequence
  MKO10111796_B_Raet1e
  gRNA
ucuacacagagaauaugagc

SEQ ID NO: 111797 - RNA, 20 nt, Artificial Sequence
  MKO10111797_B_Raet1e
  gRNA
aguauuucaauuguugcaca

SEQ ID NO: 111798 - RNA, 20 nt, Artificial Sequence
  MKO10111798_B_Raet1e
  gRNA
cuguuaauucuacugagcua

SEQ ID NO: 111799 - RNA, 20 nt, Artificial Sequence
  MKO10111799_B_Raf1
  gRNA
guaagaaagcacgcuuagau

SEQ ID NO: 111800 - RNA, 20 nt, Artificial Sequence
  MKO10111800_B_Raf1
  gRNA
cuguuucccggaugccugcu

SEQ ID NO: 111801 - RNA, 20 nt, Artificial Sequence
  MKO10111801_B_Raf1
  gRNA
cuccaguccacacacauagu

SEQ ID NO: 111802 - RNA, 20 nt, Artificial Sequence
  MKO10111802_B_Rag1
  gRNA
uuucaacucacagcguuucg

SEQ ID NO: 111803 - RNA, 20 nt, Artificial Sequence
  MKO10111803_B_Rag1
  gRNA
ucccgcgcaagauugcaaug

SEQ ID NO: 111804 - RNA, 20 nt, Artificial Sequence
  MKO10111804_B_Rag1
  gRNA
cugugcucaaccacgcgaga

SEQ ID NO: 111805 - RNA, 20 nt, Artificial Sequence
  MKO10111805_B_Rag2
  gRNA
gugauguugacaucaauacc

SEQ ID NO: 111806 - RNA, 20 nt, Artificial Sequence
  MKO10111806_B_Rag2
  gRNA
aacauagccuuaauucaacc

SEQ ID NO: 111807 - RNA, 20 nt, Artificial Sequence
  MKO10111807_B_Rag2
  gRNA
gcaacauguuauccaguagc

SEQ ID NO: 111808 - RNA, 20 nt, Artificial Sequence
  MKO10111808_B_Rai14
  gRNA
cgccacgaagcaugacagcg

SEQ ID NO: 111809 - RNA, 20 nt, Artificial Sequence
  MKO10111809_B_Rai14
  gRNA
cgugugucaccaugaccuug

SEQ ID NO: 111810 - RNA, 20 nt, Artificial Sequence
  MKO10111810_B_Rai14
  gRNA
aaaacagcuuugcauuaugc

SEQ ID NO: 111811 - RNA, 20 nt, Artificial Sequence
  MKO10111811_B_Rai1
  gRNA
cacagguugcacguucauug

SEQ ID NO: 111812 - RNA, 20 nt, Artificial Sequence
  MKO10111812_B_Rai1
  gRNA
cgccccgggcucgugacagc

SEQ ID NO: 111813 - RNA, 20 nt, Artificial Sequence
  MKO10111813_B_Rai1
  gRNA
ugcucaccuaccuuauguuu

SEQ ID NO: 111814 - RNA, 20 nt, Artificial Sequence
  MKO10111814_B_Rai2
  gRNA
agcugauaacuaccgaggcc

SEQ ID NO: 111815 - RNA, 20 nt, Artificial Sequence
  MKO10111815_B_Rai2
  gRNA
gcgccagagcucaaccccaa

SEQ ID NO: 111816 - RNA, 20 nt, Artificial Sequence
  MKO10111816_B_Rai2
  gRNA
uaacagacuggagaaccgca

SEQ ID NO: 111817 - RNA, 20 nt, Artificial Sequence
  MKO10111817_B_Rala
  gRNA
ccacauaguuaacguuccac

SEQ ID NO: 111818 - RNA, 20 nt, Artificial Sequence
  MKO10111818_B_Rala
  gRNA
gaucgacaucuuagauacag

SEQ ID NO: 111819 - RNA, 20 nt, Artificial Sequence
  MKO10111819_B_Rala
  gRNA
cguacaugaacugcagaguc

SEQ ID NO: 111820 - RNA, 20 nt, Artificial Sequence
  MKO10111820_B_Ralbp1
  gRNA
caugugugaaaagcacguac

SEQ ID NO: 111821 - RNA, 20 nt, Artificial Sequence
  MKO10111821_B_Ralbp1
  gRNA
aaaagcagccuaugaccgag

SEQ ID NO: 111822 - RNA, 20 nt, Artificial Sequence
  MKO10111822_B_Ralbp1
  gRNA
uuguuuacaucgagaucugc

SEQ ID NO: 111823 - RNA, 20 nt, Artificial Sequence
  MKO10111823_B_Ralb
  gRNA
agcacaccugaacucggcug

SEQ ID NO: 111824 - RNA, 20 nt, Artificial Sequence
  MKO10111824_B_Ralb
  gRNA
gcuucaguucauguaugaug

SEQ ID NO: 111825 - RNA, 20 nt, Artificial Sequence
  MKO10111825_B_Ralb
  gRNA
gggcucccugguacuucaca

SEQ ID NO: 111826 - RNA, 20 nt, Artificial Sequence
  MKO10111826_B_Ralgapa1
  gRNA
uuaaagaaacuacugcacac

SEQ ID NO: 111827 - RNA, 20 nt, Artificial Sequence
  MKO10111827_B_Ralgapa1
  gRNA
gaagcuagucuuaaacagaa

SEQ ID NO: 111828 - RNA, 20 nt, Artificial Sequence
  MKO10111828_B_Ralgapa1
  gRNA
aguauauaugugaaaaaugu

SEQ ID NO: 111829 - RNA, 20 nt, Artificial Sequence
  MKO10111829_B_Ralgapa2
  gRNA
gaaauauaucugagaauagu

SEQ ID NO: 111830 - RNA, 20 nt, Artificial Sequence
  MKO10111830_B_Ralgapa2
  gRNA
aacuuacuucaaauagaaag

SEQ ID NO: 111831 - RNA, 20 nt, Artificial Sequence
  MKO10111831_B_Ralgapb
  gRNA
gcaaauuaaugacauacuuc

SEQ ID NO: 111832 - RNA, 20 nt, Artificial Sequence
  MKO10111832_B_Ralgapb
  gRNA
ccaaggagaugguggcuaac

SEQ ID NO: 111833 - RNA, 20 nt, Artificial Sequence
  MKO10111833_B_Ralgapb
  gRNA
ugccuagguaaaauggacca

SEQ ID NO: 111834 - RNA, 20 nt, Artificial Sequence
  MKO10111834_B_Ralgds
  gRNA
uauguacagcucaacaugcc

SEQ ID NO: 111835 - RNA, 20 nt, Artificial Sequence
  MKO10111835_B_Ralgds
  gRNA
gcgccgcgcucaccuucucc

SEQ ID NO: 111836 - RNA, 20 nt, Artificial Sequence
  MKO10111836_B_Ralgds
  gRNA
uaguggcuccuugguguagc

SEQ ID NO: 111837 - RNA, 20 nt, Artificial Sequence
  MKO10111837_B_Ralgps1
  gRNA
cguucugaaagugacucccg

SEQ ID NO: 111838 - RNA, 20 nt, Artificial Sequence
  MKO10111838_B_Ralgps1
  gRNA
guagagucagaucacauuga

SEQ ID NO: 111839 - RNA, 20 nt, Artificial Sequence
  MKO10111839_B_Ralgps1
  gRNA
gguacagaccucuggcugga

SEQ ID NO: 111840 - RNA, 20 nt, Artificial Sequence
  MKO10111840_B_Ralgps2
  gRNA
ccacuauauuaagacugcua

SEQ ID NO: 111841 - RNA, 20 nt, Artificial Sequence
  MKO10111841_B_Ralgps2
  gRNA
cuugugaaagcaacugcauu

SEQ ID NO: 111842 - RNA, 20 nt, Artificial Sequence
  MKO10111842_B_Ralgps2
  gRNA
ggcugaauagcuuuaaacac

SEQ ID NO: 111843 - RNA, 20 nt, Artificial Sequence
  MKO10111843_B_Ralyl
  gRNA
cuuaccuguacagggcugac

SEQ ID NO: 111844 - RNA, 20 nt, Artificial Sequence
  MKO10111844_B_Ralyl
  gRNA
acagagaugauuucuacaau

SEQ ID NO: 111845 - RNA, 20 nt, Artificial Sequence
  MKO10111845_B_Ralyl
  gRNA
ggucucuuacuuccaggcuu

SEQ ID NO: 111846 - RNA, 20 nt, Artificial Sequence
  MKO10111846_B_Raly
  gRNA
cacaggcuguuugauuaucg

SEQ ID NO: 111847 - RNA, 20 nt, Artificial Sequence
  MKO10111847_B_Raly
  gRNA
cauggcgcucauuggcauac

SEQ ID NO: 111848 - RNA, 20 nt, Artificial Sequence
  MKO10111848_B_Raly
  gRNA
gcccaagccuaauagaccca

SEQ ID NO: 111849 - RNA, 20 nt, Artificial Sequence
  MKO10111849_B_Ramp1
  gRNA
gcugugccucagccgcuuca

SEQ ID NO: 111850 - RNA, 20 nt, Artificial Sequence
  MKO10111850_B_Ramp1
  gRNA
agacuauugggaagacgcua

SEQ ID NO: 111851 - RNA, 20 nt, Artificial Sequence
  MKO10111851_B_Ramp1
  gRNA
gcugcaauggcauuucaguu

SEQ ID NO: 111852 - RNA, 20 nt, Artificial Sequence
  MKO10111852_B_Ramp2
  gRNA
cccguuccuuguuacucuug

SEQ ID NO: 111853 - RNA, 20 nt, Artificial Sequence
  MKO10111853_B_Ramp2
  gRNA
acuccggaagagauugguuc

SEQ ID NO: 111854 - RNA, 20 nt, Artificial Sequence
  MKO10111854_B_Ramp2
  gRNA
cagugggaugagauugauuc

SEQ ID NO: 111855 - RNA, 20 nt, Artificial Sequence
  MKO10111855_B_Ramp3
  gRNA
auagccacagucagcacgac

SEQ ID NO: 111856 - RNA, 20 nt, Artificial Sequence
  MKO10111856_B_Ramp3
  gRNA
agaaggugcagccgcugugc

SEQ ID NO: 111857 - RNA, 20 nt, Artificial Sequence
  MKO10111857_B_Ramp3
  gRNA
ccacuguuguugcugcuuug

SEQ ID NO: 111858 - RNA, 20 nt, Artificial Sequence
  MKO10111858_B_Ranbp10
  gRNA
gguugggacaagcauuccua

SEQ ID NO: 111859 - RNA, 20 nt, Artificial Sequence
  MKO10111859_B_Ranbp10
  gRNA
guuaacaugaacagacugcc

SEQ ID NO: 111860 - RNA, 20 nt, Artificial Sequence
  MKO10111860_B_Ranbp10
  gRNA
acucaccgggagaucuguga

SEQ ID NO: 111861 - RNA, 20 nt, Artificial Sequence
  MKO10111861_B_Ranbp17
  gRNA
auccuuuaccuauugaacag

SEQ ID NO: 111862 - RNA, 20 nt, Artificial Sequence
  MKO10111862_B_Ranbp17
  gRNA
augucuauccucuguucaau

SEQ ID NO: 111863 - RNA, 20 nt, Artificial Sequence
  MKO10111863_B_Ranbp17
  gRNA
cgaucucacugaaagaauag

SEQ ID NO: 111864 - RNA, 20 nt, Artificial Sequence
  MKO10111864_B_Ranbp1
  gRNA
cucuacacaggacagucacg

SEQ ID NO: 111865 - RNA, 20 nt, Artificial Sequence
  MKO10111865_B_Ranbp1
  gRNA
ggggcacucgucagcaaagu

SEQ ID NO: 111866 - RNA, 20 nt, Artificial Sequence
  MKO10111866_B_Ranbp1
  gRNA
ggacucaucugcauucucug

SEQ ID NO: 111867 - RNA, 20 nt, Artificial Sequence
  MKO10111867_B_Ranbp2
  gRNA
caaagcuguagaauguuaua

SEQ ID NO: 111868 - RNA, 20 nt, Artificial Sequence
  MKO10111868_B_Ranbp2
  gRNA
uguaaaaaugaugugacuga

SEQ ID NO: 111869 - RNA, 20 nt, Artificial Sequence
  MKO10111869_B_Ranbp2
  gRNA
aaagaagacccaaaaaucug

SEQ ID NO: 111870 - RNA, 20 nt, Artificial Sequence
  MKO10111870_B_Ranbp3l
  gRNA
uaccuaccuccuugagacug

SEQ ID NO: 111871 - RNA, 20 nt, Artificial Sequence
  MKO10111871_B_Ranbp3l
  gRNA
caggcucugccguuucuucc

SEQ ID NO: 111872 - RNA, 20 nt, Artificial Sequence
  MKO10111872_B_Ranbp3l
  gRNA
gagaccugcagaagacagcc

SEQ ID NO: 111873 - RNA, 20 nt, Artificial Sequence
  MKO10111873_B_Ranbp3
  gRNA
ggcagcuccagucccgaagc

SEQ ID NO: 111874 - RNA, 20 nt, Artificial Sequence
  MKO10111874_B_Ranbp3
  gRNA
cugcacugggugccugaccg

SEQ ID NO: 111875 - RNA, 20 nt, Artificial Sequence
  MKO10111875_B_Ranbp3
  gRNA
aagcccccaacacucaucca

SEQ ID NO: 111876 - RNA, 20 nt, Artificial Sequence
  MKO10111876_B_Ranbp6
  gRNA
gcgugucgacauuuccaguc

SEQ ID NO: 111877 - RNA, 20 nt, Artificial Sequence
  MKO10111877_B_Ranbp6
  gRNA
acgauuuggauaucaucaag

SEQ ID NO: 111878 - RNA, 20 nt, Artificial Sequence
  MKO10111878_B_Ranbp6
  gRNA
uaguaaccugcaacgccagc

SEQ ID NO: 111879 - RNA, 20 nt, Artificial Sequence
  MKO10111879_B_Ranbp9
  gRNA
uccauucuucguguaaaagc

SEQ ID NO: 111880 - RNA, 20 nt, Artificial Sequence
  MKO10111880_B_Ranbp9
  gRNA
acaucaccaguuguaaaagu

SEQ ID NO: 111881 - RNA, 20 nt, Artificial Sequence
  MKO10111881_B_Ranbp9
  gRNA
ucgaacagaugcugcaucuu

SEQ ID NO: 111882 - RNA, 20 nt, Artificial Sequence
  MKO10111882_B_Rangap1
  gRNA
uuccugcacagcgaugccac

SEQ ID NO: 111883 - RNA, 20 nt, Artificial Sequence
  MKO10111883_B_Rangap1
  gRNA
caccgcaaguccagugccca

SEQ ID NO: 111884 - RNA, 20 nt, Artificial Sequence
  MKO10111884_B_Rangap1
  gRNA
uugguccuuaccagagcugg

SEQ ID NO: 111885 - RNA, 20 nt, Artificial Sequence
  MKO10111885_B_Rangrf
  gRNA
cagccgcuucgcccugcacg

SEQ ID NO: 111886 - RNA, 20 nt, Artificial Sequence
  MKO10111886_B_Rangrf
  gRNA
cuaccugcugcuugccagaa

SEQ ID NO: 111887 - RNA, 20 nt, Artificial Sequence
  MKO10111887_B_Rangrf
  gRNA
uuggccgggugcagggggcu

SEQ ID NO: 111888 - RNA, 20 nt, Artificial Sequence
  MKO10111888_B_Ran
  gRNA
guaccugaagauucuucuuc

SEQ ID NO: 111889 - RNA, 20 nt, Artificial Sequence
  MKO10111889_B_Ran
  gRNA
gaguuugagaagaaguaugu

SEQ ID NO: 111890 - RNA, 20 nt, Artificial Sequence
  MKO10111890_B_Ran
  gRNA
cuuacaagaauguaccuaac

SEQ ID NO: 111891 - RNA, 20 nt, Artificial Sequence
  MKO10111891_B_Rap1a
  gRNA
cuguaggaaucuucuaucgu

SEQ ID NO: 111892 - RNA, 20 nt, Artificial Sequence
  MKO10111892_B_Rap1a
  gRNA
gauagaagauuccuacagaa

SEQ ID NO: 111893 - RNA, 20 nt, Artificial Sequence
  MKO10111893_B_Rap1a
  gRNA
aggagcaauuuacagcaaug

SEQ ID NO: 111894 - RNA, 20 nt, Artificial Sequence
  MKO10111894_B_Rap1b
  gRNA
cuguacaugaagaacggaca

SEQ ID NO: 111895 - RNA, 20 nt, Artificial Sequence
  MKO10111895_B_Rap1b
  gRNA
gucagaaccuagcaagacag

SEQ ID NO: 111896 - RNA, 20 nt, Artificial Sequence
  MKO10111896_B_Rap1b
  gRNA
cagacuguacaguuuguuca

SEQ ID NO: 111897 - RNA, 20 nt, Artificial Sequence
  MKO10111897_B_Rap1gap2
  gRNA
cacugcucccccgaccauga

SEQ ID NO: 111898 - RNA, 20 nt, Artificial Sequence
  MKO10111898_B_Rap1gap2
  gRNA
gaaucaagcuugaagagcag

SEQ ID NO: 111899 - RNA, 20 nt, Artificial Sequence
  MKO10111899_B_Rap1gap2
  gRNA
ccuaucccaccuuguucuuc

SEQ ID NO: 111900 - RNA, 20 nt, Artificial Sequence
  MKO10111900_B_Rap1gap
  gRNA
gaacugaguccaccaguaac

SEQ ID NO: 111901 - RNA, 20 nt, Artificial Sequence
  MKO10111901_B_Rap1gap
  gRNA
ucucccuucgacagagugug

SEQ ID NO: 111902 - RNA, 20 nt, Artificial Sequence
  MKO10111902_B_Rap1gap
  gRNA
gggucacuuaccuuagggua

SEQ ID NO: 111903 - RNA, 20 nt, Artificial Sequence
  MKO10111903_B_Rap1gds1
  gRNA
ugaagauaacagcugcugac

SEQ ID NO: 111904 - RNA, 20 nt, Artificial Sequence
  MKO10111904_B_Rap1gds1
  gRNA
ggcuacuucugcuaugaugu

SEQ ID NO: 111905 - RNA, 20 nt, Artificial Sequence
  MKO10111905_B_Rap1gds1
  gRNA
aaacuuacuauucugagcca

SEQ ID NO: 111906 - RNA, 20 nt, Artificial Sequence
  MKO10111906_B_Rap2a
  gRNA
agagaaguguccuccaacga

SEQ ID NO: 111907 - RNA, 20 nt, Artificial Sequence
  MKO10111907_B_Rap2a
  gRNA
cggucacgaacugcacgguc

SEQ ID NO: 111908 - RNA, 20 nt, Artificial Sequence
  MKO10111908_B_Rap2a
  gRNA
gacgaugcgcgaguacaaag

SEQ ID NO: 111909 - RNA, 20 nt, Artificial Sequence
  MKO10111909_B_Rap2b
  gRNA
aacuacgcggcacagcccaa

SEQ ID NO: 111910 - RNA, 20 nt, Artificial Sequence
  MKO10111910_B_Rap2b
  gRNA
acgugaggucuccuauggcg

SEQ ID NO: 111911 - RNA, 20 nt, Artificial Sequence
  MKO10111911_B_Rap2b
  gRNA
cgcgcucguaccgcuucacg

SEQ ID NO: 111912 - RNA, 20 nt, Artificial Sequence
  MKO10111912_B_Rap2c
  gRNA
uuugcugacguuuccaugaa

SEQ ID NO: 111913 - RNA, 20 nt, Artificial Sequence
  MKO10111913_B_Rap2c
  gRNA
cuaccgcaaagagaucgaag

SEQ ID NO: 111914 - RNA, 20 nt, Artificial Sequence
  MKO10111914_B_Rap2c
  gRNA
cucaccgugcaguuugucac

SEQ ID NO: 111915 - RNA, 20 nt, Artificial Sequence
  MKO10111915_B_Rapgef1
  gRNA
accugcuuucucgaucuugc

SEQ ID NO: 111916 - RNA, 20 nt, Artificial Sequence
  MKO10111916_B_Rapgef1
  gRNA
aauggucuuaaaguagcgca

SEQ ID NO: 111917 - RNA, 20 nt, Artificial Sequence
  MKO10111917_B_Rapgef1
  gRNA
acucaccugugcuggauccg

SEQ ID NO: 111918 - RNA, 20 nt, Artificial Sequence
  MKO10111918_B_Rapgef2
  gRNA
auuuaaggccacggagagcg

SEQ ID NO: 111919 - RNA, 20 nt, Artificial Sequence
  MKO10111919_B_Rapgef2
  gRNA
agugauucucaaugguuccg

SEQ ID NO: 111920 - RNA, 20 nt, Artificial Sequence
  MKO10111920_B_Rapgef2
  gRNA
cuuugguguuucgcccacca

SEQ ID NO: 111921 - RNA, 20 nt, Artificial Sequence
  MKO10111921_B_Rapgef3
  gRNA
aauaccaucugcgacuauau

SEQ ID NO: 111922 - RNA, 20 nt, Artificial Sequence
  MKO10111922_B_Rapgef3
  gRNA
gaguccucgcuguugguaag

SEQ ID NO: 111923 - RNA, 20 nt, Artificial Sequence
  MKO10111923_B_Rapgef3
  gRNA
gacaccacuuaccaacagcg

SEQ ID NO: 111924 - RNA, 20 nt, Artificial Sequence
  MKO10111924_B_Rapgef4
  gRNA
agacauccuguguucacucg

SEQ ID NO: 111925 - RNA, 20 nt, Artificial Sequence
  MKO10111925_B_Rapgef4
  gRNA
aguaccaccuaaagacauac

SEQ ID NO: 111926 - RNA, 20 nt, Artificial Sequence
  MKO10111926_B_Rapgef4
  gRNA
cccucuagggauuccugaca

SEQ ID NO: 111927 - RNA, 20 nt, Artificial Sequence
  MKO10111927_B_Rapgef5
  gRNA
agagcuggucgacuggcucc

SEQ ID NO: 111928 - RNA, 20 nt, Artificial Sequence
  MKO10111928_B_Rapgef5
  gRNA
ccuuaaugcucuuccugcac

SEQ ID NO: 111929 - RNA, 20 nt, Artificial Sequence
  MKO10111929_B_Rapgef5
  gRNA
ccugagaaggacuauguuca

SEQ ID NO: 111930 - RNA, 20 nt, Artificial Sequence
  MKO10111930_B_Rapgef6
  gRNA
uguacuuguaaaagauucua

SEQ ID NO: 111931 - RNA, 20 nt, Artificial Sequence
  MKO10111931_B_Rapgef6
  gRNA
accuaagcugaugcucccug

SEQ ID NO: 111932 - RNA, 20 nt, Artificial Sequence
  MKO10111932_B_Rapgef6
  gRNA
agaaccuucagaaaugauug

SEQ ID NO: 111933 - RNA, 20 nt, Artificial Sequence
  MKO10111933_B_Rapgefl1
  gRNA
cggagccccugaaugccacu

SEQ ID NO: 111934 - RNA, 20 nt, Artificial Sequence
  MKO10111934_B_Rapgefl1
  gRNA
ucuuuaccaggaccuccgag

SEQ ID NO: 111935 - RNA, 20 nt, Artificial Sequence
  MKO10111935_B_Rapgefl1
  gRNA
acuguaucuacuaauuauga

SEQ ID NO: 111936 - RNA, 20 nt, Artificial Sequence
  MKO10111936_B_Raph1
  gRNA
cuuaccauucaaguuguaua

SEQ ID NO: 111937 - RNA, 20 nt, Artificial Sequence
  MKO10111937_B_Raph1
  gRNA
ugagaagauccgaguugcuc

SEQ ID NO: 111938 - RNA, 20 nt, Artificial Sequence
  MKO10111938_B_Raph1
  gRNA
uccgaugaagagauugacca

SEQ ID NO: 111939 - RNA, 20 nt, Artificial Sequence
  MKO10111939_B_Rapsn
  gRNA
gcagcacgugcaccugcccg

SEQ ID NO: 111940 - RNA, 20 nt, Artificial Sequence
  MKO10111940_B_Rapsn
  gRNA
ucugcuuugccgauauccau

SEQ ID NO: 111941 - RNA, 20 nt, Artificial Sequence
  MKO10111941_B_Rapsn
  gRNA
aaggcuggagccucaaauau

SEQ ID NO: 111942 - RNA, 20 nt, Artificial Sequence
  MKO10111942_B_Rara
  gRNA
cgucgaaacauuucugcagc

SEQ ID NO: 111943 - RNA, 20 nt, Artificial Sequence
  MKO10111943_B_Rara
  gRNA
cucagaacaacgagucuccc

SEQ ID NO: 111944 - RNA, 20 nt, Artificial Sequence
  MKO10111944_B_Rara
  gRNA
acugcugcucugggucucga

SEQ ID NO: 111945 - RNA, 20 nt, Artificial Sequence
  MKO10111945_B_Rarb
  gRNA
aagcagggcuuguacacccg

SEQ ID NO: 111946 - RNA, 20 nt, Artificial Sequence
  MKO10111946_B_Rarb
  gRNA
agaauuccagcgcugaccac

SEQ ID NO: 111947 - RNA, 20 nt, Artificial Sequence
  MKO10111947_B_Rarb
  gRNA
ccgugguguauuuacccagc

SEQ ID NO: 111948 - RNA, 20 nt, Artificial Sequence
  MKO10111948_B_Rarg
  gRNA
cagccuugagcagcgugauc

SEQ ID NO: 111949 - RNA, 20 nt, Artificial Sequence
  MKO10111949_B_Rarg
  gRNA
gugaugaguuccucuaacug

SEQ ID NO: 111950 - RNA, 20 nt, Artificial Sequence
  MKO10111950_B_Rarg
  gRNA
gaaaucgaugccaguacugc

SEQ ID NO: 111951 - RNA, 20 nt, Artificial Sequence
  MKO10111951_B_Rarres1
  gRNA
acaucacguaugagcugccg

SEQ ID NO: 111952 - RNA, 20 nt, Artificial Sequence
  MKO10111952_B_Rarres1
  gRNA
agagcaauacaaccccgagc

SEQ ID NO: 111953 - RNA, 20 nt, Artificial Sequence
  MKO10111953_B_Rarres1
  gRNA
uuucaggucaacccucaaga

SEQ ID NO: 111954 - RNA, 20 nt, Artificial Sequence
  MKO10111954_B_Rarres2
  gRNA
uuugguuugauugugcacuc

SEQ ID NO: 111955 - RNA, 20 nt, Artificial Sequence
  MKO10111955_B_Rarres2
  gRNA
gcagaccaacugccccaaga

SEQ ID NO: 111956 - RNA, 20 nt, Artificial Sequence
  MKO10111956_B_Rarres2
  gRNA
ccagagaaggcggaaaugcc

SEQ ID NO: 111957 - RNA, 20 nt, Artificial Sequence
  MKO10111957_B_Rars2
  gRNA
auugacuugaucaagcuuuc

SEQ ID NO: 111958 - RNA, 20 nt, Artificial Sequence
  MKO10111958_B_Rars2
  gRNA
uugcaacaaguuacugaaga

SEQ ID NO: 111959 - RNA, 20 nt, Artificial Sequence
  MKO10111959_B_Rars2
  gRNA
uagacacucaagaccaagcc

SEQ ID NO: 111960 - RNA, 20 nt, Artificial Sequence
  MKO10111960_B_Rars
  gRNA
ucucguaacuguuccaaacu

SEQ ID NO: 111961 - RNA, 20 nt, Artificial Sequence
  MKO10111961_B_Rars
  gRNA
gacuccauucacuaggagac

SEQ ID NO: 111962 - RNA, 20 nt, Artificial Sequence
  MKO10111962_B_Rars
  gRNA
cuaaccagucuccuagugaa

SEQ ID NO: 111963 - RNA, 20 nt, Artificial Sequence
  MKO10111963_B_Rasa1
  gRNA
uauaggauuauugcuaugug

SEQ ID NO: 111964 - RNA, 20 nt, Artificial Sequence
  MKO10111964_B_Rasa1
  gRNA
ccuuauuguugaagaccuag

SEQ ID NO: 111965 - RNA, 20 nt, Artificial Sequence
  MKO10111965_B_Rasa1
  gRNA
uaccuuauuucaucaguguc

SEQ ID NO: 111966 - RNA, 20 nt, Artificial Sequence
  MKO10111966_B_Rasa2
  gRNA
acuucugaauuugagucaau

SEQ ID NO: 111967 - RNA, 20 nt, Artificial Sequence
  MKO10111967_B_Rasa2
  gRNA
cuuacuguacaacaagcugc

SEQ ID NO: 111968 - RNA, 20 nt, Artificial Sequence
  MKO10111968_B_Rasa2
  gRNA
gaagacuugugcagucauag

SEQ ID NO: 111969 - RNA, 20 nt, Artificial Sequence
  MKO10111969_B_Rasa3
  gRNA
guaaaaguccucuccguaaa

SEQ ID NO: 111970 - RNA, 20 nt, Artificial Sequence
  MKO10111970_B_Rasa3
  gRNA
ucugccacaaacucgcugca

SEQ ID NO: 111971 - RNA, 20 nt, Artificial Sequence
  MKO10111971_B_Rasa3
  gRNA
aaauugucgagaagucacuc

SEQ ID NO: 111972 - RNA, 20 nt, Artificial Sequence
  MKO10111972_B_Rasa4
  gRNA
cgaccccuacugcaucguga

SEQ ID NO: 111973 - RNA, 20 nt, Artificial Sequence
  MKO10111973_B_Rasa4
  gRNA
acguggggggcaaguguacu

SEQ ID NO: 111974 - RNA, 20 nt, Artificial Sequence
  MKO10111974_B_Rasa4
  gRNA
guccaccuucacgaugcagu

SEQ ID NO: 111975 - RNA, 20 nt, Artificial Sequence
  MKO10111975_B_Rasal1
  gRNA
gcccugcucaccucgagggu

SEQ ID NO: 111976 - RNA, 20 nt, Artificial Sequence
  MKO10111976_B_Rasal1
  gRNA
ccaccuggccuucuacgugc

SEQ ID NO: 111977 - RNA, 20 nt, Artificial Sequence
  MKO10111977_B_Rasal1
  gRNA
ggauccagacgcugaaguac

SEQ ID NO: 111978 - RNA, 20 nt, Artificial Sequence
  MKO10111978_B_Rasal2
  gRNA
cccuucgcaaugcagaugac

SEQ ID NO: 111979 - RNA, 20 nt, Artificial Sequence
  MKO10111979_B_Rasal2
  gRNA
ccaugaugucgucucaguau

SEQ ID NO: 111980 - RNA, 20 nt, Artificial Sequence
  MKO10111980_B_Rasal2
  gRNA
ccuauacugagacgacauca

SEQ ID NO: 111981 - RNA, 20 nt, Artificial Sequence
  MKO10111981_B_Rasal3
  gRNA
aucugugcaacggguagauc

SEQ ID NO: 111982 - RNA, 20 nt, Artificial Sequence
  MKO10111982_B_Rasal3
  gRNA
uacccuucucgaaggaaagc

SEQ ID NO: 111983 - RNA, 20 nt, Artificial Sequence
  MKO10111983_B_Rasal3
  gRNA
gcugccauacccgaacauug

SEQ ID NO: 111984 - RNA, 20 nt, Artificial Sequence
  MKO10111984_B_Rasd1
  gRNA
aucauccguuucccgccaug

SEQ ID NO: 111985 - RNA, 20 nt, Artificial Sequence
  MKO10111985_B_Rasd1
  gRNA
cgugaggaagcgcgacacaa

SEQ ID NO: 111986 - RNA, 20 nt, Artificial Sequence
  MKO10111986_B_Rasd1
  gRNA
ugcccacuuuggaugagccg

SEQ ID NO: 111987 - RNA, 20 nt, Artificial Sequence
  MKO10111987_B_Rasd2
  gRNA
ccaguacacgcccacuaucg

SEQ ID NO: 111988 - RNA, 20 nt, Artificial Sequence
  MKO10111988_B_Rasd2
  gRNA
cauaagaucuccgugcagua

SEQ ID NO: 111989 - RNA, 20 nt, Artificial Sequence
  MKO10111989_B_Rasd2
  gRNA
cuucugcaugcgucgcacua

SEQ ID NO: 111990 - RNA, 20 nt, Artificial Sequence
  MKO10111990_B_Rasef
  gRNA
gcaaauccaugauuuaacaa

SEQ ID NO: 111991 - RNA, 20 nt, Artificial Sequence
  MKO10111991_B_Rasef
  gRNA
uuccagcucacuuagcugaa

SEQ ID NO: 111992 - RNA, 20 nt, Artificial Sequence
  MKO10111992_B_Rasef
  gRNA
ggccauucagcuaagugagc

SEQ ID NO: 111993 - RNA, 20 nt, Artificial Sequence
  MKO10111993_B_Rasgef1a
  gRNA
ucgaguagggcagaucugcc

SEQ ID NO: 111994 - RNA, 20 nt, Artificial Sequence
  MKO10111994_B_Rasgef1a
  gRNA
gcagcugacucacauugaac

SEQ ID NO: 111995 - RNA, 20 nt, Artificial Sequence
  MKO10111995_B_Rasgef1a
  gRNA
ccgccaugaccuucucgucc

SEQ ID NO: 111996 - RNA, 20 nt, Artificial Sequence
  MKO10111996_B_Rasgef1b
  gRNA
accuuagccaugagcucgua

SEQ ID NO: 111997 - RNA, 20 nt, Artificial Sequence
  MKO10111997_B_Rasgef1b
  gRNA
gugaccaaccuccucgccac

SEQ ID NO: 111998 - RNA, 20 nt, Artificial Sequence
  MKO10111998_B_Rasgef1b
  gRNA
aaaccucuaccaguccgcag

SEQ ID NO: 111999 - RNA, 20 nt, Artificial Sequence
  MKO10111999_B_Rasgef1c
  gRNA
ggccaagugacgccaauuuc

SEQ ID NO: 112000 - RNA, 20 nt, Artificial Sequence
  MKO10112000_B_Rasgef1c
  gRNA
cugguguacccugcucccgu

SEQ ID NO: 112001 - RNA, 20 nt, Artificial Sequence
  MKO10112001_B_Rasgef1c
  gRNA
ugggcccgaggaguuugucc

SEQ ID NO: 112002 - RNA, 20 nt, Artificial Sequence
  MKO10112002_B_Rasgrf1
  gRNA
cgauggccacgucgugaccc

SEQ ID NO: 112003 - RNA, 20 nt, Artificial Sequence
  MKO10112003_B_Rasgrf1
  gRNA
cgcagcguugucaagucuuc

SEQ ID NO: 112004 - RNA, 20 nt, Artificial Sequence
  MKO10112004_B_Rasgrf1
  gRNA
auccucgguccucaacucca

SEQ ID NO: 112005 - RNA, 20 nt, Artificial Sequence
  MKO10112005_B_Rasgrf2
  gRNA
caccuccgcuaucggcagcc

SEQ ID NO: 112006 - RNA, 20 nt, Artificial Sequence
  MKO10112006_B_Rasgrf2
  gRNA
gguacuuuaccagugugcgg

SEQ ID NO: 112007 - RNA, 20 nt, Artificial Sequence
  MKO10112007_B_Rasgrf2
  gRNA
gagaacuugcgacagagacg

SEQ ID NO: 112008 - RNA, 20 nt, Artificial Sequence
  MKO10112008_B_Rasgrp1
  gRNA
gaucacccaguuccgaauga

SEQ ID NO: 112009 - RNA, 20 nt, Artificial Sequence
  MKO10112009_B_Rasgrp1
  gRNA
acauuugggucgugucgaug

SEQ ID NO: 112010 - RNA, 20 nt, Artificial Sequence
  MKO10112010_B_Rasgrp1
  gRNA
cccuacauauaaggaugccc

SEQ ID NO: 112011 - RNA, 20 nt, Artificial Sequence
  MKO10112011_B_Rasgrp2
  gRNA
ggcagaacaucuuaccuacc

SEQ ID NO: 112012 - RNA, 20 nt, Artificial Sequence
  MKO10112012_B_Rasgrp2
  gRNA
ccuuuaccuaucagcaaucc

SEQ ID NO: 112013 - RNA, 20 nt, Artificial Sequence
  MKO10112013_B_Rasgrp2
  gRNA
caguuucgaagccagcugag

SEQ ID NO: 112014 - RNA, 20 nt, Artificial Sequence
  MKO10112014_B_Rasgrp3
  gRNA
ccuacguaucggaaugccag

SEQ ID NO: 112015 - RNA, 20 nt, Artificial Sequence
  MKO10112015_B_Rasgrp3
  gRNA
acacgcuagauauguccaug

SEQ ID NO: 112016 - RNA, 20 nt, Artificial Sequence
  MKO10112016_B_Rasgrp3
  gRNA
cugccucuuauuugaccauc

SEQ ID NO: 112017 - RNA, 20 nt, Artificial Sequence
  MKO10112017_B_Rasgrp4
  gRNA
cuccccggagccugacaauc

SEQ ID NO: 112018 - RNA, 20 nt, Artificial Sequence
  MKO10112018_B_Rasgrp4
  gRNA
ggucauggcguccaugaauc

SEQ ID NO: 112019 - RNA, 20 nt, Artificial Sequence
  MKO10112019_B_Rasgrp4
  gRNA
acagcuacagaucuguuacu

SEQ ID NO: 112020 - RNA, 20 nt, Artificial Sequence
  MKO10112020_B_Rasip1
  gRNA
gcugcgguucagaccacgag

SEQ ID NO: 112021 - RNA, 20 nt, Artificial Sequence
  MKO10112021_B_Rasip1
  gRNA
gucaacugaucgaagucucc

SEQ ID NO: 112022 - RNA, 20 nt, Artificial Sequence
  MKO10112022_B_Rasip1
  gRNA
ccccacuggguccgggggca

SEQ ID NO: 112023 - RNA, 20 nt, Artificial Sequence
  MKO10112023_B_Rasl10a
  gRNA
ccagccccuacgaacuagag

SEQ ID NO: 112024 - RNA, 20 nt, Artificial Sequence
  MKO10112024_B_Rasl10a
  gRNA
guccgaagcgcagccgcuga

SEQ ID NO: 112025 - RNA, 20 nt, Artificial Sequence
  MKO10112025_B_Rasl10a
  gRNA
gaugucguagaccagcacaa

SEQ ID NO: 112026 - RNA, 20 nt, Artificial Sequence
  MKO10112026_B_Rasl10b
  gRNA
ugaacucguuguauaagaau

SEQ ID NO: 112027 - RNA, 20 nt, Artificial Sequence
  MKO10112027_B_Rasl10b
  gRNA
gaaguccucaccucgucucc

SEQ ID NO: 112028 - RNA, 20 nt, Artificial Sequence
  MKO10112028_B_Rasl10b
  gRNA
gacuauccgucagcagaucc

SEQ ID NO: 112029 - RNA, 20 nt, Artificial Sequence
  MKO10112029_B_Rasl11a
  gRNA
augagagcuaccaauccauc

SEQ ID NO: 112030 - RNA, 20 nt, Artificial Sequence
  MKO10112030_B_Rasl11a
  gRNA
augcggccgcucaccauguc

SEQ ID NO: 112031 - RNA, 20 nt, Artificial Sequence
  MKO10112031_B_Rasl11a
  gRNA
uucuugaccaagagauucau

SEQ ID NO: 112032 - RNA, 20 nt, Artificial Sequence
  MKO10112032_B_Rasl11b
  gRNA
gguccaccugcuugacgugu

SEQ ID NO: 112033 - RNA, 20 nt, Artificial Sequence
  MKO10112033_B_Rasl11b
  gRNA
ccacggcgaucuuaacgagc

SEQ ID NO: 112034 - RNA, 20 nt, Artificial Sequence
  MKO10112034_B_Rasl11b
  gRNA
uuccucacuaaacgauucau

SEQ ID NO: 112035 - RNA, 20 nt, Artificial Sequence
  MKO10112035_B_Rasl12
  gRNA
acugcgagcgcuaccugaac

SEQ ID NO: 112036 - RNA, 20 nt, Artificial Sequence
  MKO10112036_B_Rasl12
  gRNA
cggugaaguuccucaccaag

SEQ ID NO: 112037 - RNA, 20 nt, Artificial Sequence
  MKO10112037_B_Rasl12
  gRNA
auauucgcugauaaaccucu

SEQ ID NO: 112038 - RNA, 20 nt, Artificial Sequence
  MKO10112038_B_Rasl2-9
  gRNA
accuaucaaguucaaugugu

SEQ ID NO: 112039 - RNA, 20 nt, Artificial Sequence
  MKO10112039_B_Rasl2-9
  gRNA
cuuacaagaaugugccuagc

SEQ ID NO: 112040 - RNA, 20 nt, Artificial Sequence
  MKO10112040_B_Rasl2-9
  gRNA
ccccccgaacuucuccugac

SEQ ID NO: 112041 - RNA, 20 nt, Artificial Sequence
  MKO10112041_B_Rassf10
  gRNA
gcccccggacgaaaacgacg

SEQ ID NO: 112042 - RNA, 20 nt, Artificial Sequence
  MKO10112042_B_Rassf10
  gRNA
ugacgacgacgcgaugcccc

SEQ ID NO: 112043 - RNA, 20 nt, Artificial Sequence
  MKO10112043_B_Rassf10
  gRNA
cacccgcaccacguccgagc

SEQ ID NO: 112044 - RNA, 20 nt, Artificial Sequence
  MKO10112044_B_Rassf1
  gRNA
ucguugucgccagaagaucc

SEQ ID NO: 112045 - RNA, 20 nt, Artificial Sequence
  MKO10112045_B_Rassf1
  gRNA
gacaacgagaauacuucugc

SEQ ID NO: 112046 - RNA, 20 nt, Artificial Sequence
  MKO10112046_B_Rassf1
  gRNA
aguauaccuccggaagcugu

SEQ ID NO: 112047 - RNA, 20 nt, Artificial Sequence
  MKO10112047_B_Rassf2
  gRNA
cggcuguaaccugggcgcac

SEQ ID NO: 112048 - RNA, 20 nt, Artificial Sequence
  MKO10112048_B_Rassf2
  gRNA
accuacaacuuguacuauga

SEQ ID NO: 112049 - RNA, 20 nt, Artificial Sequence
  MKO10112049_B_Rassf2
  gRNA
cucgagacacacagcccaac

SEQ ID NO: 112050 - RNA, 20 nt, Artificial Sequence
  MKO10112050_B_Rassf3
  gRNA
gcagaacuuccugcgcaucu

SEQ ID NO: 112051 - RNA, 20 nt, Artificial Sequence
  MKO10112051_B_Rassf3
  gRNA
cucccggucggagagcuugc

SEQ ID NO: 112052 - RNA, 20 nt, Artificial Sequence
  MKO10112052_B_Rassf3
  gRNA
cuuccuuguccaagaugcgc

SEQ ID NO: 112053 - RNA, 20 nt, Artificial Sequence
  MKO10112053_B_Rassf4
  gRNA
ggggacucagacgacccauc

SEQ ID NO: 112054 - RNA, 20 nt, Artificial Sequence
  MKO10112054_B_Rassf4
  gRNA
accuacaacugcuaccauga

SEQ ID NO: 112055 - RNA, 20 nt, Artificial Sequence
  MKO10112055_B_Rassf4
  gRNA
cuuucagcuaagacaccgag

SEQ ID NO: 112056 - RNA, 20 nt, Artificial Sequence
  MKO10112056_B_Rassf5
  gRNA
cucuaccuucgucugcucgc

SEQ ID NO: 112057 - RNA, 20 nt, Artificial Sequence
  MKO10112057_B_Rassf5
  gRNA
ucaggcugcggcacuccgag

SEQ ID NO: 112058 - RNA, 20 nt, Artificial Sequence
  MKO10112058_B_Rassf5
  gRNA
aucccagcgggcaccgucac

SEQ ID NO: 112059 - RNA, 20 nt, Artificial Sequence
  MKO10112059_B_Rassf6
  gRNA
aacaaucagcuguccgucuu

SEQ ID NO: 112060 - RNA, 20 nt, Artificial Sequence
  MKO10112060_B_Rassf6
  gRNA
uucgcaggaggaugacucgc

SEQ ID NO: 112061 - RNA, 20 nt, Artificial Sequence
  MKO10112061_B_Rassf6
  gRNA
accauacgcagacgaagagc

SEQ ID NO: 112062 - RNA, 20 nt, Artificial Sequence
  MKO10112062_B_Rassf7
  gRNA
gaccuucugucuccaaauag

SEQ ID NO: 112063 - RNA, 20 nt, Artificial Sequence
  MKO10112063_B_Rassf7
  gRNA
acuguugcagguugcacuga

SEQ ID NO: 112064 - RNA, 20 nt, Artificial Sequence
  MKO10112064_B_Rassf7
  gRNA
uucucacaguuccccccaug

SEQ ID NO: 112065 - RNA, 20 nt, Artificial Sequence
  MKO10112065_B_Rassf8
  gRNA
gagaaacgacguggagaucg

SEQ ID NO: 112066 - RNA, 20 nt, Artificial Sequence
  MKO10112066_B_Rassf8
  gRNA
gaccaaagucaccgugcugc

SEQ ID NO: 112067 - RNA, 20 nt, Artificial Sequence
  MKO10112067_B_Rassf8
  gRNA
gggaugaaccaggucgcuuc

SEQ ID NO: 112068 - RNA, 20 nt, Artificial Sequence
  MKO10112068_B_Rassf9
  gRNA
ggacagaccauggcucccuu

SEQ ID NO: 112069 - RNA, 20 nt, Artificial Sequence
  MKO10112069_B_Rassf9
  gRNA
caccuccaucgauguuaucc

SEQ ID NO: 112070 - RNA, 20 nt, Artificial Sequence
  MKO10112070_B_Rassf9
  gRNA
ggaaagcguuaagugcgauu

SEQ ID NO: 112071 - RNA, 20 nt, Artificial Sequence
  MKO10112071_B_Raver1
  gRNA
cgaacucaaguacuguuucg

SEQ ID NO: 112072 - RNA, 20 nt, Artificial Sequence
  MKO10112072_B_Raver1
  gRNA
cuuccucaggcucuuaaucg

SEQ ID NO: 112073 - RNA, 20 nt, Artificial Sequence
  MKO10112073_B_Raver1
  gRNA
uaucuuacccugcuugccac

SEQ ID NO: 112074 - RNA, 20 nt, Artificial Sequence
  MKO10112074_B_Raver2
  gRNA
aggcgcagagcgcgauucag

SEQ ID NO: 112075 - RNA, 20 nt, Artificial Sequence
  MKO10112075_B_Raver2
  gRNA
ggagguucaugaguuauuac

SEQ ID NO: 112076 - RNA, 20 nt, Artificial Sequence
  MKO10112076_B_Raver2
  gRNA
auuacugccagaacccaauc

SEQ ID NO: 112077 - RNA, 20 nt, Artificial Sequence
  MKO10112077_B_Rax
  gRNA
guugcgucgaugcuucuucu

SEQ ID NO: 112078 - RNA, 20 nt, Artificial Sequence
  MKO10112078_B_Rax
  gRNA
cggcaagguuaaccuacccg

SEQ ID NO: 112079 - RNA, 20 nt, Artificial Sequence
  MKO10112079_B_Rax
  gRNA
gcgccucuagagggcuugcc

SEQ ID NO: 112080 - RNA, 20 nt, Artificial Sequence
  MKO10112080_B_Rb1cc1
  gRNA
cuccauugaccaccagaacc

SEQ ID NO: 112081 - RNA, 20 nt, Artificial Sequence
  MKO10112081_B_Rb1cc1
  gRNA
auuugaacaguccuccagau

SEQ ID NO: 112082 - RNA, 20 nt, Artificial Sequence
  MKO10112082_B_Rb1cc1
  gRNA
cuuuaggaauagcaggugca

SEQ ID NO: 112083 - RNA, 20 nt, Artificial Sequence
  MKO10112083_B_Rb1
  gRNA
ucuuaccaggauuccaucca

SEQ ID NO: 112084 - RNA, 20 nt, Artificial Sequence
  MKO10112084_B_Rb1
  gRNA
uguagcucaguaaaagugaa

SEQ ID NO: 112085 - RNA, 20 nt, Artificial Sequence
  MKO10112085_B_Rb1
  gRNA
uacagaaaagcauagaaacc

SEQ ID NO: 112086 - RNA, 20 nt, Artificial Sequence
  MKO10112086_B_Rbak
  gRNA
cggucaccuuccacugucca

SEQ ID NO: 112087 - RNA, 20 nt, Artificial Sequence
  MKO10112087_B_Rbak
  gRNA
cagcaucacaucccuguaug

SEQ ID NO: 112088 - RNA, 20 nt, Artificial Sequence
  MKO10112088_B_Rbak
  gRNA
gcagaacaugagcagaucaa

SEQ ID NO: 112089 - RNA, 20 nt, Artificial Sequence
  MKO10112089_B_Rbbp4
  gRNA
acaaagcacccuucuaaacc

SEQ ID NO: 112090 - RNA, 20 nt, Artificial Sequence
  MKO10112090_B_Rbbp4
  gRNA
ucgggguugcauucuccaga

SEQ ID NO: 112091 - RNA, 20 nt, Artificial Sequence
  MKO10112091_B_Rbbp4
  gRNA
gcuggacacuggcaaucacc

SEQ ID NO: 112092 - RNA, 20 nt, Artificial Sequence
  MKO10112092_B_Rbbp5
  gRNA
cgaugacucggauuugaacg

SEQ ID NO: 112093 - RNA, 20 nt, Artificial Sequence
  MKO10112093_B_Rbbp5
  gRNA
cccugaccugcaccuuuaac

SEQ ID NO: 112094 - RNA, 20 nt, Artificial Sequence
  MKO10112094_B_Rbbp5
  gRNA
aaauccgagucaucgucuac

SEQ ID NO: 112095 - RNA, 20 nt, Artificial Sequence
  MKO10112095_B_Rbbp6
  gRNA
guagacuugacaccuccaau

SEQ ID NO: 112096 - RNA, 20 nt, Artificial Sequence
  MKO10112096_B_Rbbp6
  gRNA
agaacucaucugugauuguc

SEQ ID NO: 112097 - RNA, 20 nt, Artificial Sequence
  MKO10112097_B_Rbbp6
  gRNA
auauauauaccuuuguaagc

SEQ ID NO: 112098 - RNA, 20 nt, Artificial Sequence
  MKO10112098_B_Rbbp7
  gRNA
aacccuuacuuagucacuuc

SEQ ID NO: 112099 - RNA, 20 nt, Artificial Sequence
  MKO10112099_B_Rbbp7
  gRNA
cccacucagauuagaauucc

SEQ ID NO: 112100 - RNA, 20 nt, Artificial Sequence
  MKO10112100_B_Rbbp7
  gRNA
cauggucaucagaugcacuc

SEQ ID NO: 112101 - RNA, 20 nt, Artificial Sequence
  MKO10112101_B_Rbbp8nl
  gRNA
cuugucccuaggcugcgggc

SEQ ID NO: 112102 - RNA, 20 nt, Artificial Sequence
  MKO10112102_B_Rbbp8nl
  gRNA
accuguucuccagcacucgc

SEQ ID NO: 112103 - RNA, 20 nt, Artificial Sequence
  MKO10112103_B_Rbbp8nl
  gRNA
ucucagcccauucaucucau

SEQ ID NO: 112104 - RNA, 20 nt, Artificial Sequence
  MKO10112104_B_Rbbp8
  gRNA
uuuccugaaggacuuucugc

SEQ ID NO: 112105 - RNA, 20 nt, Artificial Sequence
  MKO10112105_B_Rbbp8
  gRNA
ugaacaacugcagcagaaaa

SEQ ID NO: 112106 - RNA, 20 nt, Artificial Sequence
  MKO10112106_B_Rbbp8
  gRNA
caaaguaaccaaacugaaaa

SEQ ID NO: 112107 - RNA, 20 nt, Artificial Sequence
  MKO10112107_B_Rbbp9
  gRNA
gaugaaaaugagcgugcaag

SEQ ID NO: 112108 - RNA, 20 nt, Artificial Sequence
  MKO10112108_B_Rbbp9
  gRNA
caggguacuucagccgcccc

SEQ ID NO: 112109 - RNA, 20 nt, Artificial Sequence
  MKO10112109_B_Rbbp9
  gRNA
gauuccugguuuccaguguu

SEQ ID NO: 112110 - RNA, 20 nt, Artificial Sequence
  MKO10112110_B_Rbck1
  gRNA
aaccuguccuuccgaagccc

SEQ ID NO: 112111 - RNA, 20 nt, Artificial Sequence
  MKO10112111_B_Rbck1
  gRNA
cgggcguacugugagccaaa

SEQ ID NO: 112112 - RNA, 20 nt, Artificial Sequence
  MKO10112112_B_Rbck1
  gRNA
cugcuaucaaguaugccacc

SEQ ID NO: 112113 - RNA, 20 nt, Artificial Sequence
  MKO10112113_B_Rbfa
  gRNA
ccgucaaugauuuguagaga

SEQ ID NO: 112114 - RNA, 20 nt, Artificial Sequence
  MKO10112114_B_Rbfa
  gRNA
cuucgugaggaacucaugcu

SEQ ID NO: 112115 - RNA, 20 nt, Artificial Sequence
  MKO10112115_B_Rbfa
  gRNA
cccccgucuuccaguacacu

SEQ ID NO: 112116 - RNA, 20 nt, Artificial Sequence
  MKO10112116_B_Rbfox1
  gRNA
ucuggaucccggaaccggaa

SEQ ID NO: 112117 - RNA, 20 nt, Artificial Sequence
  MKO10112117_B_Rbfox1
  gRNA
cguaacuuucgaaaauagug

SEQ ID NO: 112118 - RNA, 20 nt, Artificial Sequence
  MKO10112118_B_Rbfox1
  gRNA
agggcgagggagaaauugca

SEQ ID NO: 112119 - RNA, 20 nt, Artificial Sequence
  MKO10112119_B_Rbfox2
  gRNA
auuagagacauguagucgcu

SEQ ID NO: 112120 - RNA, 20 nt, Artificial Sequence
  MKO10112120_B_Rbfox2
  gRNA
gucagggucucggaagcgga

SEQ ID NO: 112121 - RNA, 20 nt, Artificial Sequence
  MKO10112121_B_Rbfox2
  gRNA
ggagaaauugcacggcaccg

SEQ ID NO: 112122 - RNA, 20 nt, Artificial Sequence
  MKO10112122_B_Rbfox3
  gRNA
gcugaaugggacgaucguag

SEQ ID NO: 112123 - RNA, 20 nt, Artificial Sequence
  MKO10112123_B_Rbfox3
  gRNA
ucggggucccugaaccggaa

SEQ ID NO: 112124 - RNA, 20 nt, Artificial Sequence
  MKO10112124_B_Rbfox3
  gRNA
gcucagaugcugaccgagcc

SEQ ID NO: 112125 - RNA, 20 nt, Artificial Sequence
  MKO10112125_B_Rbks
  gRNA
cagguuggcaacgauucuuu

SEQ ID NO: 112126 - RNA, 20 nt, Artificial Sequence
  MKO10112126_B_Rbks
  gRNA
ccacuaugacgaugauauuc

SEQ ID NO: 112127 - RNA, 20 nt, Artificial Sequence
  MKO10112127_B_Rbks
  gRNA
accuucauuauugacaauua

SEQ ID NO: 112128 - RNA, 20 nt, Artificial Sequence
  MKO10112128_B_Rbl1
  gRNA
uaccacaagaguuucgugag

SEQ ID NO: 112129 - RNA, 20 nt, Artificial Sequence
  MKO10112129_B_Rbl1
  gRNA
uacugcgcucagcuaaguua

SEQ ID NO: 112130 - RNA, 20 nt, Artificial Sequence
  MKO10112130_B_Rbl1
  gRNA
gaagggaauuuccguaugau

SEQ ID NO: 112131 - RNA, 20 nt, Artificial Sequence
  MKO10112131_B_Rbl2
  gRNA
gaccagaucaucgcuaauca

SEQ ID NO: 112132 - RNA, 20 nt, Artificial Sequence
  MKO10112132_B_Rbl2
  gRNA
gaacagccucgccagcaaag

SEQ ID NO: 112133 - RNA, 20 nt, Artificial Sequence
  MKO10112133_B_Rbl2
  gRNA
aaccagaauccuucgcuguu

SEQ ID NO: 112134 - RNA, 20 nt, Artificial Sequence
  MKO10112134_B_Rbm10
  gRNA
cguggacagcugcaguccca

SEQ ID NO: 112135 - RNA, 20 nt, Artificial Sequence
  MKO10112135_B_Rbm10
  gRNA
aucugaagagcaaagugcag

SEQ ID NO: 112136 - RNA, 20 nt, Artificial Sequence
  MKO10112136_B_Rbm10
  gRNA
aggacauggaguaugaaaga

SEQ ID NO: 112137 - RNA, 20 nt, Artificial Sequence
  MKO10112137_B_Rbm11
  gRNA
aaccgauacugcacauuaau

SEQ ID NO: 112138 - RNA, 20 nt, Artificial Sequence
  MKO10112138_B_Rbm11
  gRNA
gcacucguaauugggaaaaa

SEQ ID NO: 112139 - RNA, 20 nt, Artificial Sequence
  MKO10112139_B_Rbm11
  gRNA
ucugcaaaggaacgaugaaa

SEQ ID NO: 112140 - RNA, 20 nt, Artificial Sequence
  MKO10112140_B_Rbm12b1
  gRNA
auaucucaaaucuucuuggg

SEQ ID NO: 112141 - RNA, 20 nt, Artificial Sequence
  MKO10112141_B_Rbm12b1
  gRNA
gucaucuccaucgugugacc

SEQ ID NO: 112142 - RNA, 20 nt, Artificial Sequence
  MKO10112142_B_Rbm12b1
  gRNA
acaauuuaaauuuagaucag

SEQ ID NO: 112143 - RNA, 20 nt, Artificial Sequence
  MKO10112143_B_Rbm12b2
  gRNA
ggccaccccaagaacauuuc

SEQ ID NO: 112144 - RNA, 20 nt, Artificial Sequence
  MKO10112144_B_Rbm12b2
  gRNA
cugaaccacaauuaaacuuu

SEQ ID NO: 112145 - RNA, 20 nt, Artificial Sequence
  MKO10112145_B_Rbm12b2
  gRNA
agaggacacaagccuguucc

SEQ ID NO: 112146 - RNA, 20 nt, Artificial Sequence
  MKO10112146_B_Rbm12
  gRNA
uacaauaugcacgcccccau

SEQ ID NO: 112147 - RNA, 20 nt, Artificial Sequence
  MKO10112147_B_Rbm12
  gRNA
auagguggcaccgaagggac

SEQ ID NO: 112148 - RNA, 20 nt, Artificial Sequence
  MKO10112148_B_Rbm12
  gRNA
uauucccgcaccggguauuc

SEQ ID NO: 112149 - RNA, 20 nt, Artificial Sequence
  MKO10112149_B_Rbm14
  gRNA
cggcggggugcuguuggcgu

SEQ ID NO: 112150 - RNA, 20 nt, Artificial Sequence
  MKO10112150_B_Rbm14
  gRNA
cgacuagguaugguuccgac

SEQ ID NO: 112151 - RNA, 20 nt, Artificial Sequence
  MKO10112151_B_Rbm14
  gRNA
uuccgauuacgcacgcuauu

SEQ ID NO: 112152 - RNA, 20 nt, Artificial Sequence
  MKO10112152_B_Rbm15b
  gRNA
auauacccggcaucggaacu

SEQ ID NO: 112153 - RNA, 20 nt, Artificial Sequence
  MKO10112153_B_Rbm15b
  gRNA
ccgccgccgcgcagguacac

SEQ ID NO: 112154 - RNA, 20 nt, Artificial Sequence
  MKO10112154_B_Rbm15b
  gRNA
gauugcccagcgccuucgac

SEQ ID NO: 112155 - RNA, 20 nt, Artificial Sequence
  MKO10112155_B_Rbm15
  gRNA
cccgcgcucguuucacacag

SEQ ID NO: 112156 - RNA, 20 nt, Artificial Sequence
  MKO10112156_B_Rbm15
  gRNA
ccccgccggucucguacucg

SEQ ID NO: 112157 - RNA, 20 nt, Artificial Sequence
  MKO10112157_B_Rbm15
  gRNA
aggacgaucagcgugccaac

SEQ ID NO: 112158 - RNA, 20 nt, Artificial Sequence
  MKO10112158_B_Rbm17
  gRNA
uucagcccagcugccacgug

SEQ ID NO: 112159 - RNA, 20 nt, Artificial Sequence
  MKO10112159_B_Rbm17
  gRNA
gccucugccgcucuucucuc

SEQ ID NO: 112160 - RNA, 20 nt, Artificial Sequence
  MKO10112160_B_Rbm17
  gRNA
ccccaaugacuaugagaaag

SEQ ID NO: 112161 - RNA, 20 nt, Artificial Sequence
  MKO10112161_B_Rbm18
  gRNA
augggcccacgcucaaguca

SEQ ID NO: 112162 - RNA, 20 nt, Artificial Sequence
  MKO10112162_B_Rbm18
  gRNA
cuccuuacucuagaacagcc

SEQ ID NO: 112163 - RNA, 20 nt, Artificial Sequence
  MKO10112163_B_Rbm18
  gRNA
agccugcucagucuaaccuc

SEQ ID NO: 112164 - RNA, 20 nt, Artificial Sequence
  MKO10112164_B_Rbm19
  gRNA
uuccgaaaguucggcuucau

SEQ ID NO: 112165 - RNA, 20 nt, Artificial Sequence
  MKO10112165_B_Rbm19
  gRNA
gggucgugucaauaaagcuc

SEQ ID NO: 112166 - RNA, 20 nt, Artificial Sequence
  MKO10112166_B_Rbm19
  gRNA
caaagcgucguuugcccacg

SEQ ID NO: 112167 - RNA, 20 nt, Artificial Sequence
  MKO10112167_B_Rbm20
  gRNA
cauaugcagccauuccaacg

SEQ ID NO: 112168 - RNA, 20 nt, Artificial Sequence
  MKO10112168_B_Rbm20
  gRNA
cguacucacacuugucccag

SEQ ID NO: 112169 - RNA, 20 nt, Artificial Sequence
  MKO10112169_B_Rbm20
  gRNA
ccacucacccucguuuccag

SEQ ID NO: 112170 - RNA, 20 nt, Artificial Sequence
  MKO10112170_B_Rbm22
  gRNA
uguaccaggccuacccaucc

SEQ ID NO: 112171 - RNA, 20 nt, Artificial Sequence
  MKO10112171_B_Rbm22
  gRNA
uaccauauucaaggucuaac

SEQ ID NO: 112172 - RNA, 20 nt, Artificial Sequence
  MKO10112172_B_Rbm22
  gRNA
cagucuucuugaagcgcaug

SEQ ID NO: 112173 - RNA, 20 nt, Artificial Sequence
  MKO10112173_B_Rbm24
  gRNA
gugaagcuguugaacgccaa

SEQ ID NO: 112174 - RNA, 20 nt, Artificial Sequence
  MKO10112174_B_Rbm24
  gRNA
agaccucaaaguacuugcgc

SEQ ID NO: 112175 - RNA, 20 nt, Artificial Sequence
  MKO10112175_B_Rbm24
  gRNA
gcccuuauccagagaccuuu

SEQ ID NO: 112176 - RNA, 20 nt, Artificial Sequence
  MKO10112176_B_Rbm25
  gRNA
ccuaguaccuaccgugucca

SEQ ID NO: 112177 - RNA, 20 nt, Artificial Sequence
  MKO10112177_B_Rbm25
  gRNA
ccaacaaaaacuguaguagu

SEQ ID NO: 112178 - RNA, 20 nt, Artificial Sequence
  MKO10112178_B_Rbm25
  gRNA
uuauugcaugaccuucagau

SEQ ID NO: 112179 - RNA, 20 nt, Artificial Sequence
  MKO10112179_B_Rbm26
  gRNA
aucaccuauuaucucuguau

SEQ ID NO: 112180 - RNA, 20 nt, Artificial Sequence
  MKO10112180_B_Rbm26
  gRNA
gcucccgauacagagauaau

SEQ ID NO: 112181 - RNA, 20 nt, Artificial Sequence
  MKO10112181_B_Rbm26
  gRNA
gcugaagaaagucuaccuuc

SEQ ID NO: 112182 - RNA, 20 nt, Artificial Sequence
  MKO10112182_B_Rbm27
  gRNA
guucagaaucuagugaacga

SEQ ID NO: 112183 - RNA, 20 nt, Artificial Sequence
  MKO10112183_B_Rbm27
  gRNA
uaagaacuaccuuccaccau

SEQ ID NO: 112184 - RNA, 20 nt, Artificial Sequence
  MKO10112184_B_Rbm27
  gRNA
gauucugaacgacucuucug

SEQ ID NO: 112185 - RNA, 20 nt, Artificial Sequence
  MKO10112185_B_Rbm28
  gRNA
caucacucaccuuaaagcug

SEQ ID NO: 112186 - RNA, 20 nt, Artificial Sequence
  MKO10112186_B_Rbm28
  gRNA
agaaagccagauuaauuauc

SEQ ID NO: 112187 - RNA, 20 nt, Artificial Sequence
  MKO10112187_B_Rbm28
  gRNA
gugaauaucccaaagaagcc

SEQ ID NO: 112188 - RNA, 20 nt, Artificial Sequence
  MKO10112188_B_Rbm31y
  gRNA
caagaaaauagaauuuaaaa

SEQ ID NO: 112189 - RNA, 20 nt, Artificial Sequence
  MKO10112189_B_Rbm31y
  gRNA
cguuuguacccaaacuauac

SEQ ID NO: 112190 - RNA, 20 nt, Artificial Sequence
  MKO10112190_B_Rbm31y
  gRNA
gacuugucccagaagcauau

SEQ ID NO: 112191 - RNA, 20 nt, Artificial Sequence
  MKO10112191_B_Rbm33
  gRNA
aaaugauguaacuaugccag

SEQ ID NO: 112192 - RNA, 20 nt, Artificial Sequence
  MKO10112192_B_Rbm33
  gRNA
uuugaccaguuugacaagcc

SEQ ID NO: 112193 - RNA, 20 nt, Artificial Sequence
  MKO10112193_B_Rbm33
  gRNA
gaacuggaagaugacuugcu

SEQ ID NO: 112194 - RNA, 20 nt, Artificial Sequence
  MKO10112194_B_Rbm34
  gRNA
uaccacagaacgaaaucgua

SEQ ID NO: 112195 - RNA, 20 nt, Artificial Sequence
  MKO10112195_B_Rbm34
  gRNA
ucucgggguaaaguggcaga

SEQ ID NO: 112196 - RNA, 20 nt, Artificial Sequence
  MKO10112196_B_Rbm34
  gRNA
gccugucacauguaauaaaa

SEQ ID NO: 112197 - RNA, 20 nt, Artificial Sequence
  MKO10112197_B_Rbm38
  gRNA
ccuugcgaccaucgaugaua

SEQ ID NO: 112198 - RNA, 20 nt, Artificial Sequence
  MKO10112198_B_Rbm38
  gRNA
ccacucacccguaggugcgc

SEQ ID NO: 112199 - RNA, 20 nt, Artificial Sequence
  MKO10112199_B_Rbm38
  gRNA
accuugauccagcgcaccua

SEQ ID NO: 112200 - RNA, 20 nt, Artificial Sequence
  MKO10112200_B_Rbm39
  gRNA
caauccaaucuuuccucgga

SEQ ID NO: 112201 - RNA, 20 nt, Artificial Sequence
  MKO10112201_B_Rbm39
  gRNA
ugccucauagcaucaaauua

SEQ ID NO: 112202 - RNA, 20 nt, Artificial Sequence
  MKO10112202_B_Rbm39
  gRNA
gggcucuugucuuuccuaaa

SEQ ID NO: 112203 - RNA, 20 nt, Artificial Sequence
  MKO10112203_B_Rbm3
  gRNA
uucuguaggugguggagacc

SEQ ID NO: 112204 - RNA, 20 nt, Artificial Sequence
  MKO10112204_B_Rbm3
  gRNA
gaugcgaugagagcuaugaa

SEQ ID NO: 112205 - RNA, 20 nt, Artificial Sequence
  MKO10112205_B_Rbm3
  gRNA
ucugccaugucgucugaaga

SEQ ID NO: 112206 - RNA, 20 nt, Artificial Sequence
  MKO10112206_B_Rbm41
  gRNA
ccaguccaauauugcucagu

SEQ ID NO: 112207 - RNA, 20 nt, Artificial Sequence
  MKO10112207_B_Rbm41
  gRNA
aagaaaaagagcuuugcgcc

SEQ ID NO: 112208 - RNA, 20 nt, Artificial Sequence
  MKO10112208_B_Rbm41
  gRNA
aagccguuucuguauugcuu

SEQ ID NO: 112209 - RNA, 20 nt, Artificial Sequence
  MKO10112209_B_Rbm42
  gRNA
acuguccaggugaccacgau

SEQ ID NO: 112210 - RNA, 20 nt, Artificial Sequence
  MKO10112210_B_Rbm42
  gRNA
acgaaggcaggacgcaggau

SEQ ID NO: 112211 - RNA, 20 nt, Artificial Sequence
  MKO10112211_B_Rbm42
  gRNA
ccccacgugcuacagagagc

SEQ ID NO: 112212 - RNA, 20 nt, Artificial Sequence
  MKO10112212_B_Rbm43
  gRNA
cauuugucuacaagacgccc

SEQ ID NO: 112213 - RNA, 20 nt, Artificial Sequence
  MKO10112213_B_Rbm43
  gRNA
aagugagagacugugagccg

SEQ ID NO: 112214 - RNA, 20 nt, Artificial Sequence
  MKO10112214_B_Rbm43
  gRNA
agucucucacuucagugaaa

SEQ ID NO: 112215 - RNA, 20 nt, Artificial Sequence
  MKO10112215_B_Rbm44
  gRNA
aaaguagagcgggacucaau

SEQ ID NO: 112216 - RNA, 20 nt, Artificial Sequence
  MKO10112216_B_Rbm44
  gRNA
cuuccagagguaugcccuua

SEQ ID NO: 112217 - RNA, 20 nt, Artificial Sequence
  MKO10112217_B_Rbm44
  gRNA
gacagugucgauggcacauc

SEQ ID NO: 112218 - RNA, 20 nt, Artificial Sequence
  MKO10112218_B_Rbm45
  gRNA
agcugucuccaaacgccugu

SEQ ID NO: 112219 - RNA, 20 nt, Artificial Sequence
  MKO10112219_B_Rbm45
  gRNA
cugcuguaaucaucuuguuc

SEQ ID NO: 112220 - RNA, 20 nt, Artificial Sequence
  MKO10112220_B_Rbm45
  gRNA
gaacaagaugauuacagcag

SEQ ID NO: 112221 - RNA, 20 nt, Artificial Sequence
  MKO10112221_B_Rbm46
  gRNA
ggaugcaguaaagugcgcac

SEQ ID NO: 112222 - RNA, 20 nt, Artificial Sequence
  MKO10112222_B_Rbm46
  gRNA
ucaucuucauacauaucacg

SEQ ID NO: 112223 - RNA, 20 nt, Artificial Sequence
  MKO10112223_B_Rbm46
  gRNA
aacaauuaugaaauucgacc

SEQ ID NO: 112224 - RNA, 20 nt, Artificial Sequence
  MKO10112224_B_Rbm47
  gRNA
gccggcguagcccccauaca

SEQ ID NO: 112225 - RNA, 20 nt, Artificial Sequence
  MKO10112225_B_Rbm47
  gRNA
ggccagcggaauauccuccg

SEQ ID NO: 112226 - RNA, 20 nt, Artificial Sequence
  MKO10112226_B_Rbm47
  gRNA
auauauagccgauaucacga

SEQ ID NO: 112227 - RNA, 20 nt, Artificial Sequence
  MKO10112227_B_Rbm48
  gRNA
acgcucaacuaauuccuuca

SEQ ID NO: 112228 - RNA, 20 nt, Artificial Sequence
  MKO10112228_B_Rbm48
  gRNA
gacguguguacaagucaccc

SEQ ID NO: 112229 - RNA, 20 nt, Artificial Sequence
  MKO10112229_B_Rbm48
  gRNA
ucuucaacugucucaaauuc

SEQ ID NO: 112230 - RNA, 20 nt, Artificial Sequence
  MKO10112230_B_Rbm4b
  gRNA
cuugaaacucuguguugucg

SEQ ID NO: 112231 - RNA, 20 nt, Artificial Sequence
  MKO10112231_B_Rbm4b
  gRNA
agucugccacacgcccugua

SEQ ID NO: 112232 - RNA, 20 nt, Artificial Sequence
  MKO10112232_B_Rbm4b
  gRNA
agugcgcacaccuuauacua

SEQ ID NO: 112233 - RNA, 20 nt, Artificial Sequence
  MKO10112233_B_Rbm4
  gRNA
cuugaaacucuguguugucg

SEQ ID NO: 112234 - RNA, 20 nt, Artificial Sequence
  MKO10112234_B_Rbm4
  gRNA
cuuaggaccgcgcccgggau

SEQ ID NO: 112235 - RNA, 20 nt, Artificial Sequence
  MKO10112235_B_Rbm4
  gRNA
cgcaccgauagcagccgcuc

SEQ ID NO: 112236 - RNA, 20 nt, Artificial Sequence
  MKO10112236_B_Rbm5
  gRNA
acaaaagaucaagcgaugau

SEQ ID NO: 112237 - RNA, 20 nt, Artificial Sequence
  MKO10112237_B_Rbm5
  gRNA
gugaguagaacagaacguag

SEQ ID NO: 112238 - RNA, 20 nt, Artificial Sequence
  MKO10112238_B_Rbm5
  gRNA
caagugauaaaacuccacga

SEQ ID NO: 112239 - RNA, 20 nt, Artificial Sequence
  MKO10112239_B_Rbm6
  gRNA
aauucaaggaucaagauuau

SEQ ID NO: 112240 - RNA, 20 nt, Artificial Sequence
  MKO10112240_B_Rbm6
  gRNA
cuuaaucgaauaagccuguu

SEQ ID NO: 112241 - RNA, 20 nt, Artificial Sequence
  MKO10112241_B_Rbm6
  gRNA
uucaacugcaaguccuuuac

SEQ ID NO: 112242 - RNA, 20 nt, Artificial Sequence
  MKO10112242_B_Rbm7
  gRNA
acaguaccuguuaggagaug

SEQ ID NO: 112243 - RNA, 20 nt, Artificial Sequence
  MKO10112243_B_Rbm7
  gRNA
ucauuacagaggcagccgag

SEQ ID NO: 112244 - RNA, 20 nt, Artificial Sequence
  MKO10112244_B_Rbm7
  gRNA
cgugucuccgacagcucaga

SEQ ID NO: 112245 - RNA, 20 nt, Artificial Sequence
  MKO10112245_B_Rbm8a
  gRNA
acucaccggagccaaagccg

SEQ ID NO: 112246 - RNA, 20 nt, Artificial Sequence
  MKO10112246_B_Rbm8a
  gRNA
gauggggcagccaaucagug

SEQ ID NO: 112247 - RNA, 20 nt, Artificial Sequence
  MKO10112247_B_Rbm8a
  gRNA
acccaacagcuguugaaggu

SEQ ID NO: 112248 - RNA, 20 nt, Artificial Sequence
  MKO10112248_B_Rbms1
  gRNA
aaccguaccuuugcacuugu

SEQ ID NO: 112249 - RNA, 20 nt, Artificial Sequence
  MKO10112249_B_Rbms1
  gRNA
gaaagcugucuccgcccuga

SEQ ID NO: 112250 - RNA, 20 nt, Artificial Sequence
  MKO10112250_B_Rbms1
  gRNA
acgguuggcagagcuucacc

SEQ ID NO: 112251 - RNA, 20 nt, Artificial Sequence
  MKO10112251_B_Rbms2
  gRNA
uggcaagauugucuccacua

SEQ ID NO: 112252 - RNA, 20 nt, Artificial Sequence
  MKO10112252_B_Rbms2
  gRNA
gugcuauuccuuggacuugg

SEQ ID NO: 112253 - RNA, 20 nt, Artificial Sequence
  MKO10112253_B_Rbms2
  gRNA
ggauccgaguagagaugacc

SEQ ID NO: 112254 - RNA, 20 nt, Artificial Sequence
  MKO10112254_B_Rbms3
  gRNA
cagcuacaugggcaaacgcc

SEQ ID NO: 112255 - RNA, 20 nt, Artificial Sequence
  MKO10112255_B_Rbms3
  gRNA
uggaaaaaucguauccacaa

SEQ ID NO: 112256 - RNA, 20 nt, Artificial Sequence
  MKO10112256_B_Rbms3
  gRNA
cuugucaagaauugccuuug

SEQ ID NO: 112257 - RNA, 20 nt, Artificial Sequence
  MKO10112257_B_Rbmx2
  gRNA
ucgccuucugucaauucaua

SEQ ID NO: 112258 - RNA, 20 nt, Artificial Sequence
  MKO10112258_B_Rbmx2
  gRNA
cuuccuuaugaauugacaga

SEQ ID NO: 112259 - RNA, 20 nt, Artificial Sequence
  MKO10112259_B_Rbmx2
  gRNA
cuugugagagacaagaagac

SEQ ID NO: 112260 - RNA, 20 nt, Artificial Sequence
  MKO10112260_B_Rbmxl1
  gRNA
uaaguauaaucucuuggugg

SEQ ID NO: 112261 - RNA, 20 nt, Artificial Sequence
  MKO10112261_B_Rbmxl1
  gRNA
ggaccacuuccaguaaagag

SEQ ID NO: 112262 - RNA, 20 nt, Artificial Sequence
  MKO10112262_B_Rbmxl1
  gRNA
ugcauaaucucuggugucuc

SEQ ID NO: 112263 - RNA, 20 nt, Artificial Sequence
  MKO10112263_B_Rbmxl2
  gRNA
cccgggcgcucggguagucg

SEQ ID NO: 112264 - RNA, 20 nt, Artificial Sequence
  MKO10112264_B_Rbmxl2
  gRNA
cgccggccgcucucgaacac

SEQ ID NO: 112265 - RNA, 20 nt, Artificial Sequence
  MKO10112265_B_Rbmxl2
  gRNA
ggcgaguagcccucgucgcg

SEQ ID NO: 112266 - RNA, 20 nt, Artificial Sequence
  MKO10112266_B_Rbmx
  gRNA
ccccucccggggaggacaca

SEQ ID NO: 112267 - RNA, 20 nt, Artificial Sequence
  MKO10112267_B_Rbmx
  gRNA
cuuuacccauguguccuccc

SEQ ID NO: 112268 - RNA, 20 nt, Artificial Sequence
  MKO10112268_B_Rbmx
  gRNA
guuacggaggcccgccacga

SEQ ID NO: 112269 - RNA, 20 nt, Artificial Sequence
  MKO10112269_B_Rbmy
  gRNA
gaauuaaaguaaaacaagcc

SEQ ID NO: 112270 - RNA, 20 nt, Artificial Sequence
  MKO10112270_B_Rbmy
  gRNA
aauuucaaugugaguucuuc

SEQ ID NO: 112271 - RNA, 20 nt, Artificial Sequence
  MKO10112271_B_Rbmy
  gRNA
aaagaaauccaucuucaaaa

SEQ ID NO: 112272 - RNA, 20 nt, Artificial Sequence
  MKO10112272_B_Rbp1
  gRNA
caguacccguugaaguccac

SEQ ID NO: 112273 - RNA, 20 nt, Artificial Sequence
  MKO10112273_B_Rbp1
  gRNA
cgagggugaugaacuucacc

SEQ ID NO: 112274 - RNA, 20 nt, Artificial Sequence
  MKO10112274_B_Rbp1
  gRNA
uuuggcagaccacugugagc

SEQ ID NO: 112275 - RNA, 20 nt, Artificial Sequence
  MKO10112275_B_Rbp2
  gRNA
ggagggagacaagcuguacc

SEQ ID NO: 112276 - RNA, 20 nt, Artificial Sequence
  MKO10112276_B_Rbp2
  gRNA
acccucgugugugugcagaa

SEQ ID NO: 112277 - RNA, 20 nt, Artificial Sequence
  MKO10112277_B_Rbp2
  gRNA
gacuugcaggagcugaccug

SEQ ID NO: 112278 - RNA, 20 nt, Artificial Sequence
  MKO10112278_B_Rbp3
  gRNA
aaguucgcugaccgagucau

SEQ ID NO: 112279 - RNA, 20 nt, Artificial Sequence
  MKO10112279_B_Rbp3
  gRNA
uguccuccaggugaacgaua

SEQ ID NO: 112280 - RNA, 20 nt, Artificial Sequence
  MKO10112280_B_Rbp3
  gRNA
cugaccucaugucgaugauc

SEQ ID NO: 112281 - RNA, 20 nt, Artificial Sequence
  MKO10112281_B_Rbp4
  gRNA
caucgccaaaaaggaccccg

SEQ ID NO: 112282 - RNA, 20 nt, Artificial Sequence
  MKO10112282_B_Rbp4
  gRNA
gacuuacagacgaugaccac

SEQ ID NO: 112283 - RNA, 20 nt, Artificial Sequence
  MKO10112283_B_Rbp4
  gRNA
gucuugcaaaaagagacccu

SEQ ID NO: 112284 - RNA, 20 nt, Artificial Sequence
  MKO10112284_B_Rbp7
  gRNA
ucccaggaaauguucugcga

SEQ ID NO: 112285 - RNA, 20 nt, Artificial Sequence
  MKO10112285_B_Rbp7
  gRNA
uggagauguaucaggcucuc

SEQ ID NO: 112286 - RNA, 20 nt, Artificial Sequence
  MKO10112286_B_Rbp7
  gRNA
gucgcugcugagaagauucc

SEQ ID NO: 112287 - RNA, 20 nt, Artificial Sequence
  MKO10112287_B_Rbpjl
  gRNA
gaggugcggcuacagagcga

SEQ ID NO: 112288 - RNA, 20 nt, Artificial Sequence
  MKO10112288_B_Rbpjl
  gRNA
ugcagaccccucguugcccc

SEQ ID NO: 112289 - RNA, 20 nt, Artificial Sequence
  MKO10112289_B_Rbpjl
  gRNA
uccacccugugucuaccucg

SEQ ID NO: 112290 - RNA, 20 nt, Artificial Sequence
  MKO10112290_B_Rbpj
  gRNA
aaaguugcacagaagucuua

SEQ ID NO: 112291 - RNA, 20 nt, Artificial Sequence
  MKO10112291_B_Rbpj
  gRNA
aguucagcugcugcauuucu

SEQ ID NO: 112292 - RNA, 20 nt, Artificial Sequence
  MKO10112292_B_Rbpj
  gRNA
uccuccuuguguguaucuua

SEQ ID NO: 112293 - RNA, 20 nt, Artificial Sequence
  MKO10112293_B_Rbpms2
  gRNA
cuaggguauucgcuuugauc

SEQ ID NO: 112294 - RNA, 20 nt, Artificial Sequence
  MKO10112294_B_Rbpms2
  gRNA
ccugcucuuccguccauuca

SEQ ID NO: 112295 - RNA, 20 nt, Artificial Sequence
  MKO10112295_B_Rbpms2
  gRNA
gccccacucacaaggguccc

SEQ ID NO: 112296 - RNA, 20 nt, Artificial Sequence
  MKO10112296_B_Rbpms
  gRNA
uacguucaaagcguucuuug

SEQ ID NO: 112297 - RNA, 20 nt, Artificial Sequence
  MKO10112297_B_Rbpms
  gRNA
ucucggggcuugauguccag

SEQ ID NO: 112298 - RNA, 20 nt, Artificial Sequence
  MKO10112298_B_Rbpms
  gRNA
cauaaagcucacaucuaaac

SEQ ID NO: 112299 - RNA, 20 nt, Artificial Sequence
  MKO10112299_B_Rbx1
  gRNA
guuaucaaccacaauguccc

SEQ ID NO: 112300 - RNA, 20 nt, Artificial Sequence
  MKO10112300_B_Rbx1
  gRNA
aacgaggcagguguguccgu

SEQ ID NO: 112301 - RNA, 20 nt, Artificial Sequence
  MKO10112301_B_Rbx1
  gRNA
ccaugcaaccguacacucuu

SEQ ID NO: 112302 - RNA, 20 nt, Artificial Sequence
  MKO10112302_B_Rc3h1
  gRNA
aagccacucagcagugcgag

SEQ ID NO: 112303 - RNA, 20 nt, Artificial Sequence
  MKO10112303_B_Rc3h1
  gRNA
cagcccauuacuuuguguag

SEQ ID NO: 112304 - RNA, 20 nt, Artificial Sequence
  MKO10112304_B_Rc3h1
  gRNA
agcucugaagcuggucuugc

SEQ ID NO: 112305 - RNA, 20 nt, Artificial Sequence
  MKO10112305_B_Rc3h2
  gRNA
ccagauuguucauauugcca

SEQ ID NO: 112306 - RNA, 20 nt, Artificial Sequence
  MKO10112306_B_Rc3h2
  gRNA
aacuuuauugacugaugauc

SEQ ID NO: 112307 - RNA, 20 nt, Artificial Sequence
  MKO10112307_B_Rc3h2
  gRNA
cucuacuuaaaaccacuaag

SEQ ID NO: 112308 - RNA, 20 nt, Artificial Sequence
  MKO10112308_B_Rcan1
  gRNA
uuuauaugccaucuccaagc

SEQ ID NO: 112309 - RNA, 20 nt, Artificial Sequence
  MKO10112309_B_Rcan1
  gRNA
uguacuccggucuccguguc

SEQ ID NO: 112310 - RNA, 20 nt, Artificial Sequence
  MKO10112310_B_Rcan1
  gRNA
aacuguuugucgggauuggg

SEQ ID NO: 112311 - RNA, 20 nt, Artificial Sequence
  MKO10112311_B_Rcan2
  gRNA
gcuaaaacucuacuucgccc

SEQ ID NO: 112312 - RNA, 20 nt, Artificial Sequence
  MKO10112312_B_Rcan2
  gRNA
uuccacucuggucgccugug

SEQ ID NO: 112313 - RNA, 20 nt, Artificial Sequence
  MKO10112313_B_Rcan2
  gRNA
acugguguggcaucgcugau

SEQ ID NO: 112314 - RNA, 20 nt, Artificial Sequence
  MKO10112314_B_Rcan3
  gRNA
aacagaaaaucacgcagacg

SEQ ID NO: 112315 - RNA, 20 nt, Artificial Sequence
  MKO10112315_B_Rcan3
  gRNA
uccgagacagccugaaaucu

SEQ ID NO: 112316 - RNA, 20 nt, Artificial Sequence
  MKO10112316_B_Rcan3
  gRNA
agaccucuguagcagcgacc

SEQ ID NO: 112317 - RNA, 20 nt, Artificial Sequence
  MKO10112317_B_Rcbtb1
  gRNA
ugcagagccgccacucucac

SEQ ID NO: 112318 - RNA, 20 nt, Artificial Sequence
  MKO10112318_B_Rcbtb1
  gRNA
aaacaguuuguaacuuuccg

SEQ ID NO: 112319 - RNA, 20 nt, Artificial Sequence
  MKO10112319_B_Rcbtb1
  gRNA
gcacggcaugugugugaacc

SEQ ID NO: 112320 - RNA, 20 nt, Artificial Sequence
  MKO10112320_B_Rcbtb2
  gRNA
uugacaaauucguagagaua

SEQ ID NO: 112321 - RNA, 20 nt, Artificial Sequence
  MKO10112321_B_Rcbtb2
  gRNA
ucguugucccauugcccagc

SEQ ID NO: 112322 - RNA, 20 nt, Artificial Sequence
  MKO10112322_B_Rcbtb2
  gRNA
cccauuccccgaagagucac

SEQ ID NO: 112323 - RNA, 20 nt, Artificial Sequence
  MKO10112323_B_Rcc1
  gRNA
acccucgucauugcagccaa

SEQ ID NO: 112324 - RNA, 20 nt, Artificial Sequence
  MKO10112324_B_Rcc1
  gRNA
acccgaggccaccuuuacca

SEQ ID NO: 112325 - RNA, 20 nt, Artificial Sequence
  MKO10112325_B_Rcc1
  gRNA
ccaagcgcauagcuaagaga

SEQ ID NO: 112326 - RNA, 20 nt, Artificial Sequence
  MKO10112326_B_Rcc2
  gRNA
uucgcacccggacuccugac

SEQ ID NO: 112327 - RNA, 20 nt, Artificial Sequence
  MKO10112327_B_Rcc2
  gRNA
ccuugcaggucggaaugaga

SEQ ID NO: 112328 - RNA, 20 nt, Artificial Sequence
  MKO10112328_B_Rcc2
  gRNA
gcaaccaacugggacuugau

SEQ ID NO: 112329 - RNA, 20 nt, Artificial Sequence
  MKO10112329_B_Rccd1
  gRNA
uuugaucaggcauggacagc

SEQ ID NO: 112330 - RNA, 20 nt, Artificial Sequence
  MKO10112330_B_Rccd1
  gRNA
cagccaccuuagccauccgc

SEQ ID NO: 112331 - RNA, 20 nt, Artificial Sequence
  MKO10112331_B_Rccd1
  gRNA
aaacgggggauauuuauauc

SEQ ID NO: 112332 - RNA, 20 nt, Artificial Sequence
  MKO10112332_B_Rce1
  gRNA
aguuauugcaccgcugacag

SEQ ID NO: 112333 - RNA, 20 nt, Artificial Sequence
  MKO10112333_B_Rce1
  gRNA
gcugccccugcugcuaacua

SEQ ID NO: 112334 - RNA, 20 nt, Artificial Sequence
  MKO10112334_B_Rce1
  gRNA
caaccuucagcccaucuguc

SEQ ID NO: 112335 - RNA, 20 nt, Artificial Sequence
  MKO10112335_B_Rchy1
  gRNA
gaauuguccaauaugcuugg

SEQ ID NO: 112336 - RNA, 20 nt, Artificial Sequence
  MKO10112336_B_Rchy1
  gRNA
uacagucuucacaagucugc

SEQ ID NO: 112337 - RNA, 20 nt, Artificial Sequence
  MKO10112337_B_Rchy1
  gRNA
gaagacuguagcacauuguu

SEQ ID NO: 112338 - RNA, 20 nt, Artificial Sequence
  MKO10112338_B_Rcl1
  gRNA
gauuucaauucgagaaccau

SEQ ID NO: 112339 - RNA, 20 nt, Artificial Sequence
  MKO10112339_B_Rcl1
  gRNA
cucccucuacugaaacaguu

SEQ ID NO: 112340 - RNA, 20 nt, Artificial Sequence
  MKO10112340_B_Rcl1
  gRNA
aaucaagcggaucagaggaa

SEQ ID NO: 112341 - RNA, 20 nt, Artificial Sequence
  MKO10112341_B_Rcn1
  gRNA
acuccucccgaguagcuguc

SEQ ID NO: 112342 - RNA, 20 nt, Artificial Sequence
  MKO10112342_B_Rcn1
  gRNA
uuaaaccuccucucaucucg

SEQ ID NO: 112343 - RNA, 20 nt, Artificial Sequence
  MKO10112343_B_Rcn1
  gRNA
augauaaugucgcuaaaguc

SEQ ID NO: 112344 - RNA, 20 nt, Artificial Sequence
  MKO10112344_B_Rcn2
  gRNA
aucgucuuugcugcucuucg

SEQ ID NO: 112345 - RNA, 20 nt, Artificial Sequence
  MKO10112345_B_Rcn2
  gRNA
auaggaguucgucauccaag

SEQ ID NO: 112346 - RNA, 20 nt, Artificial Sequence
  MKO10112346_B_Rcn2
  gRNA
gucauauagucaacuucuuc

SEQ ID NO: 112347 - RNA, 20 nt, Artificial Sequence
  MKO10112347_B_Rcn3
  gRNA
cccaacccacgcgcccgucg

SEQ ID NO: 112348 - RNA, 20 nt, Artificial Sequence
  MKO10112348_B_Rcn3
  gRNA
uucagcggaccuguacuccg

SEQ ID NO: 112349 - RNA, 20 nt, Artificial Sequence
  MKO10112349_B_Rcn3
  gRNA
auggcagugaagucgguuac

SEQ ID NO: 112350 - RNA, 20 nt, Artificial Sequence
  MKO10112350_B_Rcor1
  gRNA
ucuucuacaguccacucauc

SEQ ID NO: 112351 - RNA, 20 nt, Artificial Sequence
  MKO10112351_B_Rcor1
  gRNA
guuguacccgugcuucucuu

SEQ ID NO: 112352 - RNA, 20 nt, Artificial Sequence
  MKO10112352_B_Rcor1
  gRNA
ugauaaauccauagcaaguu

SEQ ID NO: 112353 - RNA, 20 nt, Artificial Sequence
  MKO10112353_B_Rcor2
  gRNA
cccugcacgcuauagcaaca

SEQ ID NO: 112354 - RNA, 20 nt, Artificial Sequence
  MKO10112354_B_Rcor2
  gRNA
uccuuguugcuauagcgugc

SEQ ID NO: 112355 - RNA, 20 nt, Artificial Sequence
  MKO10112355_B_Rcor2
  gRNA
gcauggcuauaacauugagc

SEQ ID NO: 112356 - RNA, 20 nt, Artificial Sequence
  MKO10112356_B_Rcor3
  gRNA
cccuaacuucacgcccuuuc

SEQ ID NO: 112357 - RNA, 20 nt, Artificial Sequence
  MKO10112357_B_Rcor3
  gRNA
aaaaacuuacauuuggcauc

SEQ ID NO: 112358 - RNA, 20 nt, Artificial Sequence
  MKO10112358_B_Rcor3
  gRNA
gccauugcaaaagagaaaca

SEQ ID NO: 112359 - RNA, 20 nt, Artificial Sequence
  MKO10112359_B_Rcsd1
  gRNA
accccugaucgagaagcuuc

SEQ ID NO: 112360 - RNA, 20 nt, Artificial Sequence
  MKO10112360_B_Rcsd1
  gRNA
cccgaaagcgcccagccagc

SEQ ID NO: 112361 - RNA, 20 nt, Artificial Sequence
  MKO10112361_B_Rcsd1
  gRNA
cccagcuggcugggcgcuuu

SEQ ID NO: 112362 - RNA, 20 nt, Artificial Sequence
  MKO10112362_B_Rcvrn
  gRNA
cagucgcagaauuuccuuau

SEQ ID NO: 112363 - RNA, 20 nt, Artificial Sequence
  MKO10112363_B_Rcvrn
  gRNA
gggaggaguuucacauccuc

SEQ ID NO: 112364 - RNA, 20 nt, Artificial Sequence
  MKO10112364_B_Rcvrn
  gRNA
gagaagaucugggcauucuu

SEQ ID NO: 112365 - RNA, 20 nt, Artificial Sequence
  MKO10112365_B_Rd3
  gRNA
uccacugacgugucagcuua

SEQ ID NO: 112366 - RNA, 20 nt, Artificial Sequence
  MKO10112366_B_Rd3
  gRNA
uagaaaguugagcggcaaac

SEQ ID NO: 112367 - RNA, 20 nt, Artificial Sequence
  MKO10112367_B_Rd3
  gRNA
accuuagguccaccuccuuc

SEQ ID NO: 112368 - RNA, 20 nt, Artificial Sequence
  MKO10112368_B_Rdh10
  gRNA
uguucagaggcugccgaauc

SEQ ID NO: 112369 - RNA, 20 nt, Artificial Sequence
  MKO10112369_B_Rdh10
  gRNA
ccacaccagcauuauugacc

SEQ ID NO: 112370 - RNA, 20 nt, Artificial Sequence
  MKO10112370_B_Rdh10
  gRNA
ugaacaugcccgugucuaca

SEQ ID NO: 112371 - RNA, 20 nt, Artificial Sequence
  MKO10112371_B_Rdh11
  gRNA
cccuacucgaagacugcaga

SEQ ID NO: 112372 - RNA, 20 nt, Artificial Sequence
  MKO10112372_B_Rdh11
  gRNA
gacaaguugacuauccuuga

SEQ ID NO: 112373 - RNA, 20 nt, Artificial Sequence
  MKO10112373_B_Rdh11
  gRNA
auuagaugugcacaccccac

SEQ ID NO: 112374 - RNA, 20 nt, Artificial Sequence
  MKO10112374_B_Rdh12
  gRNA
ugcuaggaagcguucagcaa

SEQ ID NO: 112375 - RNA, 20 nt, Artificial Sequence
  MKO10112375_B_Rdh12
  gRNA
gucaucacaggugccaacac

SEQ ID NO: 112376 - RNA, 20 nt, Artificial Sequence
  MKO10112376_B_Rdh12
  gRNA
ccacuuuggagucaaccacc

SEQ ID NO: 112377 - RNA, 20 nt, Artificial Sequence
  MKO10112377_B_Rdh13
  gRNA
caucaucaaucucucguccc

SEQ ID NO: 112378 - RNA, 20 nt, Artificial Sequence
  MKO10112378_B_Rdh13
  gRNA
ucuacacaccuugcagccgg

SEQ ID NO: 112379 - RNA, 20 nt, Artificial Sequence
  MKO10112379_B_Rdh13
  gRNA
ucaacaacgcagccgugaug

SEQ ID NO: 112380 - RNA, 20 nt, Artificial Sequence
  MKO10112380_B_Rdh14
  gRNA
ccaugaugacccgcgccccc

SEQ ID NO: 112381 - RNA, 20 nt, Artificial Sequence
  MKO10112381_B_Rdh14
  gRNA
aaacccccgcauuauugauc

SEQ ID NO: 112382 - RNA, 20 nt, Artificial Sequence
  MKO10112382_B_Rdh14
  gRNA
cuguuauagucgaagcaaac

SEQ ID NO: 112383 - RNA, 20 nt, Artificial Sequence
  MKO10112383_B_Rdh16
  gRNA
ugcagucagucaccccagac

SEQ ID NO: 112384 - RNA, 20 nt, Artificial Sequence
  MKO10112384_B_Rdh16
  gRNA
agaagcgcagaagcguccac

SEQ ID NO: 112385 - RNA, 20 nt, Artificial Sequence
  MKO10112385_B_Rdh16
  gRNA
ggacgcuucugcgcuucuuc

SEQ ID NO: 112386 - RNA, 20 nt, Artificial Sequence
  MKO10112386_B_Rdh19
  gRNA
acagucccaccagugauacu

SEQ ID NO: 112387 - RNA, 20 nt, Artificial Sequence
  MKO10112387_B_Rdh19
  gRNA
ccacagcaucuggguauuug

SEQ ID NO: 112388 - RNA, 20 nt, Artificial Sequence
  MKO10112388_B_Rdh19
  gRNA
aggagggaacucuccuacuu

SEQ ID NO: 112389 - RNA, 20 nt, Artificial Sequence
  MKO10112389_B_Rdh1
  gRNA
ggucaacgucuccagcguca

SEQ ID NO: 112390 - RNA, 20 nt, Artificial Sequence
  MKO10112390_B_Rdh1
  gRNA
accucuuguccaauucguuu

SEQ ID NO: 112391 - RNA, 20 nt, Artificial Sequence
  MKO10112391_B_Rdh1
  gRNA
guaaaccauguggcucuacc

SEQ ID NO: 112392 - RNA, 20 nt, Artificial Sequence
  MKO10112392_B_Rdh5
  gRNA
ccccgaacacgcuacagccc

SEQ ID NO: 112393 - RNA, 20 nt, Artificial Sequence
  MKO10112393_B_Rdh5
  gRNA
cucuggcuuugggcgccuuc

SEQ ID NO: 112394 - RNA, 20 nt, Artificial Sequence
  MKO10112394_B_Rdh5
  gRNA
cugugacccagaacuaacga

SEQ ID NO: 112395 - RNA, 20 nt, Artificial Sequence
  MKO10112395_B_Rdh7
  gRNA
ccagcugaguaucuugugcg

SEQ ID NO: 112396 - RNA, 20 nt, Artificial Sequence
  MKO10112396_B_Rdh7
  gRNA
gugucuuugcuaucaaugag

SEQ ID NO: 112397 - RNA, 20 nt, Artificial Sequence
  MKO10112397_B_Rdh7
  gRNA
augcucagaugaccugucug

SEQ ID NO: 112398 - RNA, 20 nt, Artificial Sequence
  MKO10112398_B_Rdh8
  gRNA
agggugucaggguccguguc

SEQ ID NO: 112399 - RNA, 20 nt, Artificial Sequence
  MKO10112399_B_Rdh8
  gRNA
gccuccaaguuugcccuaga

SEQ ID NO: 112400 - RNA, 20 nt, Artificial Sequence
  MKO10112400_B_Rdh8
  gRNA
uaucccuuagugaacaaugc

SEQ ID NO: 112401 - RNA, 20 nt, Artificial Sequence
  MKO10112401_B_Rdh9
  gRNA
caacgaguggaugaagaaac

SEQ ID NO: 112402 - RNA, 20 nt, Artificial Sequence
  MKO10112402_B_Rdh9
  gRNA
ucagggaaguccaauagaga

SEQ ID NO: 112403 - RNA, 20 nt, Artificial Sequence
  MKO10112403_B_Rdh9
  gRNA
acgcuccuucacccacugag

SEQ ID NO: 112404 - RNA, 20 nt, Artificial Sequence
  MKO10112404_B_Rdm1
  gRNA
aggcaucugauacagccgcc

SEQ ID NO: 112405 - RNA, 20 nt, Artificial Sequence
  MKO10112405_B_Rdm1
  gRNA
guuucccaucgcaagccuuc

SEQ ID NO: 112406 - RNA, 20 nt, Artificial Sequence
  MKO10112406_B_Rdm1
  gRNA
aguccucguuucuuaugaag

SEQ ID NO: 112407 - RNA, 20 nt, Artificial Sequence
  MKO10112407_B_Rdx
  gRNA
uuacagguuguaaaaacagu

SEQ ID NO: 112408 - RNA, 20 nt, Artificial Sequence
  MKO10112408_B_Rdx
  gRNA
caauguaagaguaacuacaa

SEQ ID NO: 112409 - RNA, 20 nt, Artificial Sequence
  MKO10112409_B_Rdx
  gRNA
cugcaauauguagacagcaa

SEQ ID NO: 112410 - RNA, 20 nt, Artificial Sequence
  MKO10112410_B_Rec8
  gRNA
guaggugcuccaggauaugc

SEQ ID NO: 112411 - RNA, 20 nt, Artificial Sequence
  MKO10112411_B_Rec8
  gRNA
uccaggcuggcagcaacccg

SEQ ID NO: 112412 - RNA, 20 nt, Artificial Sequence
  MKO10112412_B_Rec8
  gRNA
gcuucaccaaacggcugccu

SEQ ID NO: 112413 - RNA, 20 nt, Artificial Sequence
  MKO10112413_B_Reck
  gRNA
guaagacucaccauuguuuc

SEQ ID NO: 112414 - RNA, 20 nt, Artificial Sequence
  MKO10112414_B_Reck
  gRNA
gugccgugauguaugugagc

SEQ ID NO: 112415 - RNA, 20 nt, Artificial Sequence
  MKO10112415_B_Reck
  gRNA
ucugcaacagauguuucagu

SEQ ID NO: 112416 - RNA, 20 nt, Artificial Sequence
  MKO10112416_B_Recql4
  gRNA
ugcucaccgcgggucucuuc

SEQ ID NO: 112417 - RNA, 20 nt, Artificial Sequence
  MKO10112417_B_Recql4
  gRNA
ccugacgcaccgccugcuuu

SEQ ID NO: 112418 - RNA, 20 nt, Artificial Sequence
  MKO10112418_B_Recql4
  gRNA
ugaguaccguaaccuaaagc

SEQ ID NO: 112419 - RNA, 20 nt, Artificial Sequence
  MKO10112419_B_Recql5
  gRNA
gacuacaauggugaucccac

SEQ ID NO: 112420 - RNA, 20 nt, Artificial Sequence
  MKO10112420_B_Recql5
  gRNA
auuguugcgaccaucaguuu

SEQ ID NO: 112421 - RNA, 20 nt, Artificial Sequence
  MKO10112421_B_Recql5
  gRNA
cagcaggggugugaacgcca

SEQ ID NO: 112422 - RNA, 20 nt, Artificial Sequence
  MKO10112422_B_Recql
  gRNA
ugccauugacauccagauuc

SEQ ID NO: 112423 - RNA, 20 nt, Artificial Sequence
  MKO10112423_B_Recql
  gRNA
aucuuucuugucaugcccac

SEQ ID NO: 112424 - RNA, 20 nt, Artificial Sequence
  MKO10112424_B_Recql
  gRNA
guugaaugcuuccagcucua

SEQ ID NO: 112425 - RNA, 20 nt, Artificial Sequence
  MKO10112425_B_Reep1
  gRNA
cccgcuucccaaagugcaca

SEQ ID NO: 112426 - RNA, 20 nt, Artificial Sequence
  MKO10112426_B_Reep1
  gRNA
uauauuugcccucuucacca

SEQ ID NO: 112427 - RNA, 20 nt, Artificial Sequence
  MKO10112427_B_Reep1
  gRNA
gaugaacaaacuuccuguac

SEQ ID NO: 112428 - RNA, 20 nt, Artificial Sequence
  MKO10112428_B_Reep2
  gRNA
cacggccuuguaggaagaau

SEQ ID NO: 112429 - RNA, 20 nt, Artificial Sequence
  MKO10112429_B_Reep2
  gRNA
gggcaagaggggccugaacc

SEQ ID NO: 112430 - RNA, 20 nt, Artificial Sequence
  MKO10112430_B_Reep2
  gRNA
acacuggagcccuuggugua

SEQ ID NO: 112431 - RNA, 20 nt, Artificial Sequence
  MKO10112431_B_Reep3
  gRNA
uggccgaucagacacuugca

SEQ ID NO: 112432 - RNA, 20 nt, Artificial Sequence
  MKO10112432_B_Reep3
  gRNA
cgugaagacgaaaaacguca

SEQ ID NO: 112433 - RNA, 20 nt, Artificial Sequence
  MKO10112433_B_Reep3
  gRNA
uaugagacaauggugaauuu

SEQ ID NO: 112434 - RNA, 20 nt, Artificial Sequence
  MKO10112434_B_Reep4
  gRNA
ccgcuucccaaaacugagca

SEQ ID NO: 112435 - RNA, 20 nt, Artificial Sequence
  MKO10112435_B_Reep4
  gRNA
ugcuguuccaggcucauauu

SEQ ID NO: 112436 - RNA, 20 nt, Artificial Sequence
  MKO10112436_B_Reep4
  gRNA
uccugcguaugcuuccuaca

SEQ ID NO: 112437 - RNA, 20 nt, Artificial Sequence
  MKO10112437_B_Reep5
  gRNA
auggcccccagcccggcuaa

SEQ ID NO: 112438 - RNA, 20 nt, Artificial Sequence
  MKO10112438_B_Reep5
  gRNA
cgaaaccuaucagguugcag

SEQ ID NO: 112439 - RNA, 20 nt, Artificial Sequence
  MKO10112439_B_Reep5
  gRNA
uaccuucagcauguaguaga

SEQ ID NO: 112440 - RNA, 20 nt, Artificial Sequence
  MKO10112440_B_Reep6
  gRNA
agaguggucuuaugacgcga

SEQ ID NO: 112441 - RNA, 20 nt, Artificial Sequence
  MKO10112441_B_Reep6
  gRNA
gguguacgcccuguucgguc

SEQ ID NO: 112442 - RNA, 20 nt, Artificial Sequence
  MKO10112442_B_Reep6
  gRNA
cguaaccgaacagaagauac

SEQ ID NO: 112443 - RNA, 20 nt, Artificial Sequence
  MKO10112443_B_Reg1
  gRNA
ucacugaagaccguuuaacu

SEQ ID NO: 112444 - RNA, 20 nt, Artificial Sequence
  MKO10112444_B_Reg1
  gRNA
gccacucuccuuaaucagag

SEQ ID NO: 112445 - RNA, 20 nt, Artificial Sequence
  MKO10112445_B_Reg1
  gRNA
cuguaggcauuggaaccuuc

SEQ ID NO: 112446 - RNA, 20 nt, Artificial Sequence
  MKO10112446_B_Reg2
  gRNA
accacucuccuuaaccagcg

SEQ ID NO: 112447 - RNA, 20 nt, Artificial Sequence
  MKO10112447_B_Reg2
  gRNA
uaauugaagaccguuugacc

SEQ ID NO: 112448 - RNA, 20 nt, Artificial Sequence
  MKO10112448_B_Reg2
  gRNA
ccauaggcguuggcacccuc

SEQ ID NO: 112449 - RNA, 20 nt, Artificial Sequence
  MKO10112449_B_Reg3a
  gRNA
ugggcuccaugauccaacaa

SEQ ID NO: 112450 - RNA, 20 nt, Artificial Sequence
  MKO10112450_B_Reg3a
  gRNA
aucucaccauuguuggauca

SEQ ID NO: 112451 - RNA, 20 nt, Artificial Sequence
  MKO10112451_B_Reg3a
  gRNA
guguagggucaacaacccaa

SEQ ID NO: 112452 - RNA, 20 nt, Artificial Sequence
  MKO10112452_B_Reg3b
  gRNA
cacuagggugcagaacccaa

SEQ ID NO: 112453 - RNA, 20 nt, Artificial Sequence
  MKO10112453_B_Reg3b
  gRNA
gccuuagaccgugcuuucug

SEQ ID NO: 112454 - RNA, 20 nt, Artificial Sequence
  MKO10112454_B_Reg3b
  gRNA
cccuaugucugcaaauuuac

SEQ ID NO: 112455 - RNA, 20 nt, Artificial Sequence
  MKO10112455_B_Reg3d
  gRNA
ucucugcagguuaucagaag

SEQ ID NO: 112456 - RNA, 20 nt, Artificial Sequence
  MKO10112456_B_Reg3d
  gRNA
cuauugcuauuuacugauuc

SEQ ID NO: 112457 - RNA, 20 nt, Artificial Sequence
  MKO10112457_B_Reg3d
  gRNA
agccauaagcuugggcuucu

SEQ ID NO: 112458 - RNA, 20 nt, Artificial Sequence
  MKO10112458_B_Reg3g
  gRNA
uagggcuaugaacccaacag

SEQ ID NO: 112459 - RNA, 20 nt, Artificial Sequence
  MKO10112459_B_Reg3g
  gRNA
uucacguagcagcugcccca

SEQ ID NO: 112460 - RNA, 20 nt, Artificial Sequence
  MKO10112460_B_Reg3g
  gRNA
uguuuaguguaucuaaaaac

SEQ ID NO: 112461 - RNA, 20 nt, Artificial Sequence
  MKO10112461_B_Reg4
  gRNA
cuacaaaccuguacagacgc

SEQ ID NO: 112462 - RNA, 20 nt, Artificial Sequence
  MKO10112462_B_Reg4
  gRNA
acuuccggaagcuaagaaac

SEQ ID NO: 112463 - RNA, 20 nt, Artificial Sequence
  MKO10112463_B_Reg4
  gRNA
gucauaucaaaguacauaac

SEQ ID NO: 112464 - RNA, 20 nt, Artificial Sequence
  MKO10112464_B_Rela
  gRNA
cugccgggauggcuacuaug

SEQ ID NO: 112465 - RNA, 20 nt, Artificial Sequence
  MKO10112465_B_Rela
  gRNA
accgugaaagggguuauugu

SEQ ID NO: 112466 - RNA, 20 nt, Artificial Sequence
  MKO10112466_B_Rela
  gRNA
acuuaccugagggaaagaug

SEQ ID NO: 112467 - RNA, 20 nt, Artificial Sequence
  MKO10112467_B_Relb
  gRNA
gguacacccacauagccucg

SEQ ID NO: 112468 - RNA, 20 nt, Artificial Sequence
  MKO10112468_B_Relb
  gRNA
ccucucuucccugucacuaa

SEQ ID NO: 112469 - RNA, 20 nt, Artificial Sequence
  MKO10112469_B_Relb
  gRNA
ccguuagugacagggaagag

SEQ ID NO: 112470 - RNA, 20 nt, Artificial Sequence
  MKO10112470_B_Rell1
  gRNA
aucgcuugugccugcaucgc

SEQ ID NO: 112471 - RNA, 20 nt, Artificial Sequence
  MKO10112471_B_Rell1
  gRNA
cuaccgguguacaacagagg

SEQ ID NO: 112472 - RNA, 20 nt, Artificial Sequence
  MKO10112472_B_Rell1
  gRNA
ugcagauaucuugaaagcua

SEQ ID NO: 112473 - RNA, 20 nt, Artificial Sequence
  MKO10112473_B_Rell2
  gRNA
ugaagacgaugacgugaaug

SEQ ID NO: 112474 - RNA, 20 nt, Artificial Sequence
  MKO10112474_B_Rell2
  gRNA
cuuccuuagagcgacccuga

SEQ ID NO: 112475 - RNA, 20 nt, Artificial Sequence
  MKO10112475_B_Rell2
  gRNA
cgcugcaucauccaaaauga

SEQ ID NO: 112476 - RNA, 20 nt, Artificial Sequence
  MKO10112476_B_Reln
  gRNA
ggcuccagcgccuuuggauu

SEQ ID NO: 112477 - RNA, 20 nt, Artificial Sequence
  MKO10112477_B_Reln
  gRNA
gugcgucuuugaaaaucacc

SEQ ID NO: 112478 - RNA, 20 nt, Artificial Sequence
  MKO10112478_B_Reln
  gRNA
uaaccaguuuaugugcagug

SEQ ID NO: 112479 - RNA, 20 nt, Artificial Sequence
  MKO10112479_B_Relt
  gRNA
uccgugucagccauguucca

SEQ ID NO: 112480 - RNA, 20 nt, Artificial Sequence
  MKO10112480_B_Relt
  gRNA
ccaaguacugguggcuguga

SEQ ID NO: 112481 - RNA, 20 nt, Artificial Sequence
  MKO10112481_B_Relt
  gRNA
ucucccacaggauccaggac

SEQ ID NO: 112482 - RNA, 20 nt, Artificial Sequence
  MKO10112482_B_Rel
  gRNA
ccucauccucaugauuuagu

SEQ ID NO: 112483 - RNA, 20 nt, Artificial Sequence
  MKO10112483_B_Rel
  gRNA
uguucaauuauuucuacgua

SEQ ID NO: 112484 - RNA, 20 nt, Artificial Sequence
  MKO10112484_B_Rel
  gRNA
uacaacaaaggucugcguuc

SEQ ID NO: 112485 - RNA, 20 nt, Artificial Sequence
  MKO10112485_B_Rem1
  gRNA
cugcauuguccuggcggcgc

SEQ ID NO: 112486 - RNA, 20 nt, Artificial Sequence
  MKO10112486_B_Rem1
  gRNA
aaagcugcugcgauccgcua

SEQ ID NO: 112487 - RNA, 20 nt, Artificial Sequence
  MKO10112487_B_Rem1
  gRNA
guacgagagaacgcugucag

SEQ ID NO: 112488 - RNA, 20 nt, Artificial Sequence
  MKO10112488_B_Rem2
  gRNA
cgugggcaagagcacucuag

SEQ ID NO: 112489 - RNA, 20 nt, Artificial Sequence
  MKO10112489_B_Rem2
  gRNA
aguucuccaucucgugagca

SEQ ID NO: 112490 - RNA, 20 nt, Artificial Sequence
  MKO10112490_B_Rem2
  gRNA
agagugaccuggcccgcucc

SEQ ID NO: 112491 - RNA, 20 nt, Artificial Sequence
  MKO10112491_B_Ren1
  gRNA
ugacucucccugauccguag

SEQ ID NO: 112492 - RNA, 20 nt, Artificial Sequence
  MKO10112492_B_Ren1
  gRNA
agccgccucuaccuugcuug

SEQ ID NO: 112493 - RNA, 20 nt, Artificial Sequence
  MKO10112493_B_Ren1
  gRNA
gaccaaucuuaccucccccg

SEQ ID NO: 112494 - RNA, 20 nt, Artificial Sequence
  MKO10112494_B_Ren2
  gRNA
ugacucucccugauccguag

SEQ ID NO: 112495 - RNA, 20 nt, Artificial Sequence
  MKO10112495_B_Ren2
  gRNA
agccgccucuaccuugcuug

SEQ ID NO: 112496 - RNA, 20 nt, Artificial Sequence
  MKO10112496_B_Ren2
  gRNA
gaccaaucuuaccucccccg

SEQ ID NO: 112497 - RNA, 20 nt, Artificial Sequence
  MKO10112497_B_Renbp
  gRNA
cugcauccagaagcucaaca

SEQ ID NO: 112498 - RNA, 20 nt, Artificial Sequence
  MKO10112498_B_Renbp
  gRNA
aggggcuucuucacaugucu

SEQ ID NO: 112499 - RNA, 20 nt, Artificial Sequence
  MKO10112499_B_Renbp
  gRNA
gaucauauaccuucccauca

SEQ ID NO: 112500 - RNA, 20 nt, Artificial Sequence
  MKO10112500_B_Rep15
  gRNA
agaagguaacgaaguggacg

SEQ ID NO: 112501 - RNA, 20 nt, Artificial Sequence
  MKO10112501_B_Rep15
  gRNA
uucacagcagguagcuccga

SEQ ID NO: 112502 - RNA, 20 nt, Artificial Sequence
  MKO10112502_B_Rep15
  gRNA
ugcagcgaguucacugacug

SEQ ID NO: 112503 - RNA, 20 nt, Artificial Sequence
  MKO10112503_B_Repin1
  gRNA
cgaacgucccuucgccugcg

SEQ ID NO: 112504 - RNA, 20 nt, Artificial Sequence
  MKO10112504_B_Repin1
  gRNA
gcacgcgugagugcgccacc

SEQ ID NO: 112505 - RNA, 20 nt, Artificial Sequence
  MKO10112505_B_Repin1
  gRNA
agcuucgagcucaucugcga

SEQ ID NO: 112506 - RNA, 20 nt, Artificial Sequence
  MKO10112506_B_Reps1
  gRNA
ucacacccgaguaagagccc

SEQ ID NO: 112507 - RNA, 20 nt, Artificial Sequence
  MKO10112507_B_Reps1
  gRNA
aauggccccgguccuguaag

SEQ ID NO: 112508 - RNA, 20 nt, Artificial Sequence
  MKO10112508_B_Reps1
  gRNA
aauagugagagaccucuuac

SEQ ID NO: 112509 - RNA, 20 nt, Artificial Sequence
  MKO10112509_B_Reps2
  gRNA
uuugugaugucgaagaauga

SEQ ID NO: 112510 - RNA, 20 nt, Artificial Sequence
  MKO10112510_B_Reps2
  gRNA
aaggacacccucugguaaug

SEQ ID NO: 112511 - RNA, 20 nt, Artificial Sequence
  MKO10112511_B_Reps2
  gRNA
uucuucgacaucacaaagcg

SEQ ID NO: 112512 - RNA, 20 nt, Artificial Sequence
  MKO10112512_B_Rer1
  gRNA
uuaaggcacgcagcuacaaa

SEQ ID NO: 112513 - RNA, 20 nt, Artificial Sequence
  MKO10112513_B_Rer1
  gRNA
ccuuacagauuuaucagucc

SEQ ID NO: 112514 - RNA, 20 nt, Artificial Sequence
  MKO10112514_B_Rer1
  gRNA
cuacccccuacacagccguc

SEQ ID NO: 112515 - RNA, 20 nt, Artificial Sequence
  MKO10112515_B_Rere
  gRNA
auuugacguucaugaguaga

SEQ ID NO: 112516 - RNA, 20 nt, Artificial Sequence
  MKO10112516_B_Rere
  gRNA
cagauccagucaucaagaau

SEQ ID NO: 112517 - RNA, 20 nt, Artificial Sequence
  MKO10112517_B_Rere
  gRNA
ugcuuaccaguuugaagucu

SEQ ID NO: 112518 - RNA, 20 nt, Artificial Sequence
  MKO10112518_B_Rergl
  gRNA
auauuccccaaugaaucgcu

SEQ ID NO: 112519 - RNA, 20 nt, Artificial Sequence
  MKO10112519_B_Rergl
  gRNA
cccagccaaccucucgcaug

SEQ ID NO: 112520 - RNA, 20 nt, Artificial Sequence
  MKO10112520_B_Rergl
  gRNA
aaacaucaccucgaccucca

SEQ ID NO: 112521 - RNA, 20 nt, Artificial Sequence
  MKO10112521_B_Rerg
  gRNA
agaaucaaccuaccgacacc

SEQ ID NO: 112522 - RNA, 20 nt, Artificial Sequence
  MKO10112522_B_Rerg
  gRNA
ugggaguacgauccaacccu

SEQ ID NO: 112523 - RNA, 20 nt, Artificial Sequence
  MKO10112523_B_Rerg
  gRNA
agccauggcuaagagcgcag

SEQ ID NO: 112524 - RNA, 20 nt, Artificial Sequence
  MKO10112524_B_Resp18
  gRNA
uaccaccaaaguaaucccaa

SEQ ID NO: 112525 - RNA, 20 nt, Artificial Sequence
  MKO10112525_B_Resp18
  gRNA
ccauuagaguccaacaguca

SEQ ID NO: 112526 - RNA, 20 nt, Artificial Sequence
  MKO10112526_B_Resp18
  gRNA
ucacccuacaggcauguucu

SEQ ID NO: 112527 - RNA, 20 nt, Artificial Sequence
  MKO10112527_B_Rest
  gRNA
ggggucgucuccggccgaag

SEQ ID NO: 112528 - RNA, 20 nt, Artificial Sequence
  MKO10112528_B_Rest
  gRNA
cucaucuaacgcgacacaug

SEQ ID NO: 112529 - RNA, 20 nt, Artificial Sequence
  MKO10112529_B_Rest
  gRNA
gucuucugagagcuugagua

SEQ ID NO: 112530 - RNA, 20 nt, Artificial Sequence
  MKO10112530_B_Retnla
  gRNA
ccaggaugccaacuuugaau

SEQ ID NO: 112531 - RNA, 20 nt, Artificial Sequence
  MKO10112531_B_Retnla
  gRNA
agagagagucuucguuacag

SEQ ID NO: 112532 - RNA, 20 nt, Artificial Sequence
  MKO10112532_B_Retnla
  gRNA
gcguauaaaagcaucucauc

SEQ ID NO: 112533 - RNA, 20 nt, Artificial Sequence
  MKO10112533_B_Retnlb
  gRNA
aaggaagcucucagucguca

SEQ ID NO: 112534 - RNA, 20 nt, Artificial Sequence
  MKO10112534_B_Retnlb
  gRNA
cuugcagggaugguugucac

SEQ ID NO: 112535 - RNA, 20 nt, Artificial Sequence
  MKO10112535_B_Retnlb
  gRNA
cuccucauucuuaagccauu

SEQ ID NO: 112536 - RNA, 20 nt, Artificial Sequence
  MKO10112536_B_Retnlg
  gRNA
ccauuguugagcacugacag

SEQ ID NO: 112537 - RNA, 20 nt, Artificial Sequence
  MKO10112537_B_Retnlg
  gRNA
aaggaacuucuugccaaucg

SEQ ID NO: 112538 - RNA, 20 nt, Artificial Sequence
  MKO10112538_B_Retnlg
  gRNA
uuucuccuguacuaguauca

SEQ ID NO: 112539 - RNA, 20 nt, Artificial Sequence
  MKO10112539_B_Retn
  gRNA
uuguuugaucuucuugucga

SEQ ID NO: 112540 - RNA, 20 nt, Artificial Sequence
  MKO10112540_B_Retn
  gRNA
ugcuggacagucuccuccag

SEQ ID NO: 112541 - RNA, 20 nt, Artificial Sequence
  MKO10112541_B_Retn
  gRNA
gaugggacacaguggcaugc

SEQ ID NO: 112542 - RNA, 20 nt, Artificial Sequence
  MKO10112542_B_Retsau
  gRNA
caaggggcauauuacccucg

SEQ ID NO: 112543 - RNA, 20 nt, Artificial Sequence
  MKO10112543_B_Retsau
  gRNA
cgaaugcgggagggcaacau

SEQ ID NO: 112544 - RNA, 20 nt, Artificial Sequence
  MKO10112544_B_Retsau
  gRNA
uuaucccaggugguggcccg

SEQ ID NO: 112545 - RNA, 20 nt, Artificial Sequence
  MKO10112545_B_Ret
  gRNA
gacucggcgcccaccuucuc

SEQ ID NO: 112546 - RNA, 20 nt, Artificial Sequence
  MKO10112546_B_Ret
  gRNA
ggaacugcacggguaacaug

SEQ ID NO: 112547 - RNA, 20 nt, Artificial Sequence
  MKO10112547_B_Ret
  gRNA
ccguugugacccagacugcc

SEQ ID NO: 112548 - RNA, 20 nt, Artificial Sequence
  MKO10112548_B_Rev1
  gRNA
ucagcucuacaccaagccgu

SEQ ID NO: 112549 - RNA, 20 nt, Artificial Sequence
  MKO10112549_B_Rev1
  gRNA
uuucucaauuccuccgcaga

SEQ ID NO: 112550 - RNA, 20 nt, Artificial Sequence
  MKO10112550_B_Rev1
  gRNA
cacccuguuguugagcuguu

SEQ ID NO: 112551 - RNA, 20 nt, Artificial Sequence
  MKO10112551_B_Rev3l
  gRNA
uuauucaagcaucaauuguc

SEQ ID NO: 112552 - RNA, 20 nt, Artificial Sequence
  MKO10112552_B_Rev3l
  gRNA
caccuaaauaaagugccagc

SEQ ID NO: 112553 - RNA, 20 nt, Artificial Sequence
  MKO10112553_B_Rev3l
  gRNA
cuaucuuuacaauccugcaa

SEQ ID NO: 112554 - RNA, 20 nt, Artificial Sequence
  MKO10112554_B_Rex2
  gRNA
acagugucuauuaaccuuca

SEQ ID NO: 112555 - RNA, 20 nt, Artificial Sequence
  MKO10112555_B_Rex2
  gRNA
ucgcauucauugcauuugua

SEQ ID NO: 112556 - RNA, 20 nt, Artificial Sequence
  MKO10112556_B_Rex2
  gRNA
ucagaaaaucacugcauaug

SEQ ID NO: 112557 - RNA, 20 nt, Artificial Sequence
  MKO10112557_B_Rexo1
  gRNA
gcugugggcgaugcgcuugg

SEQ ID NO: 112558 - RNA, 20 nt, Artificial Sequence
  MKO10112558_B_Rexo1
  gRNA
ggcugccagguucggggccg

SEQ ID NO: 112559 - RNA, 20 nt, Artificial Sequence
  MKO10112559_B_Rexo1
  gRNA
aggacuuaccggcagccagu

SEQ ID NO: 112560 - RNA, 20 nt, Artificial Sequence
  MKO10112560_B_Rexo2
  gRNA
cuugcagucuggucuuacca

SEQ ID NO: 112561 - RNA, 20 nt, Artificial Sequence
  MKO10112561_B_Rexo2
  gRNA
ugcuggacagcaugucagac

SEQ ID NO: 112562 - RNA, 20 nt, Artificial Sequence
  MKO10112562_B_Rexo2
  gRNA
gaaggaucagauuauugaga

SEQ ID NO: 112563 - RNA, 20 nt, Artificial Sequence
  MKO10112563_B_Rexo4
  gRNA
acuaguaucuuccuguccgu

SEQ ID NO: 112564 - RNA, 20 nt, Artificial Sequence
  MKO10112564_B_Rexo4
  gRNA
ugucucauagggaagacauc

SEQ ID NO: 112565 - RNA, 20 nt, Artificial Sequence
  MKO10112565_B_Rexo4
  gRNA
aauguugaagggcagaaucc

SEQ ID NO: 112566 - RNA, 20 nt, Artificial Sequence
  MKO10112566_B_Rfc1
  gRNA
aaauagucgagcacugacgu

SEQ ID NO: 112567 - RNA, 20 nt, Artificial Sequence
  MKO10112567_B_Rfc1
  gRNA
ugucuccaggucaauaacuc

SEQ ID NO: 112568 - RNA, 20 nt, Artificial Sequence
  MKO10112568_B_Rfc1
  gRNA
gucaccuacgucucugagac

SEQ ID NO: 112569 - RNA, 20 nt, Artificial Sequence
  MKO10112569_B_Rfc2
  gRNA
cugugucaggggcaucgaug

SEQ ID NO: 112570 - RNA, 20 nt, Artificial Sequence
  MKO10112570_B_Rfc2
  gRNA
cuagaaugaugaucuugugc

SEQ ID NO: 112571 - RNA, 20 nt, Artificial Sequence
  MKO10112571_B_Rfc2
  gRNA
acucacagcaaugaugauau

SEQ ID NO: 112572 - RNA, 20 nt, Artificial Sequence
  MKO10112572_B_Rfc3
  gRNA
uguauucuacgugaacuuua

SEQ ID NO: 112573 - RNA, 20 nt, Artificial Sequence
  MKO10112573_B_Rfc3
  gRNA
gcaucuccugaauuacaacu

SEQ ID NO: 112574 - RNA, 20 nt, Artificial Sequence
  MKO10112574_B_Rfc3
  gRNA
uuuaccugggauuaacuuca

SEQ ID NO: 112575 - RNA, 20 nt, Artificial Sequence
  MKO10112575_B_Rfc4
  gRNA
gcacugcaaccacuucgucc

SEQ ID NO: 112576 - RNA, 20 nt, Artificial Sequence
  MKO10112576_B_Rfc4
  gRNA
uucgaugacuucagcugcuc

SEQ ID NO: 112577 - RNA, 20 nt, Artificial Sequence
  MKO10112577_B_Rfc4
  gRNA
cagcagcuagagagcucuuu

SEQ ID NO: 112578 - RNA, 20 nt, Artificial Sequence
  MKO10112578_B_Rfc5
  gRNA
auuucaggguugagaaguac

SEQ ID NO: 112579 - RNA, 20 nt, Artificial Sequence
  MKO10112579_B_Rfc5
  gRNA
augagaucggccagggucug

SEQ ID NO: 112580 - RNA, 20 nt, Artificial Sequence
  MKO10112580_B_Rfc5
  gRNA
cuccuucaccuccaagacca

SEQ ID NO: 112581 - RNA, 20 nt, Artificial Sequence
  MKO10112581_B_Rfesd
  gRNA
aaauauacuuccgucugugu

SEQ ID NO: 112582 - RNA, 20 nt, Artificial Sequence
  MKO10112582_B_Rfesd
  gRNA
caaaggggaauaucaugcua

SEQ ID NO: 112583 - RNA, 20 nt, Artificial Sequence
  MKO10112583_B_Rfesd
  gRNA
cucaauuucucccaagugua

SEQ ID NO: 112584 - RNA, 20 nt, Artificial Sequence
  MKO10112584_B_Rffl
  gRNA
ggcguggcccauuccccucu

SEQ ID NO: 112585 - RNA, 20 nt, Artificial Sequence
  MKO10112585_B_Rffl
  gRNA
aggccguggcucggaaccgu

SEQ ID NO: 112586 - RNA, 20 nt, Artificial Sequence
  MKO10112586_B_Rffl
  gRNA
acacaagccuauuccaaccc

SEQ ID NO: 112587 - RNA, 20 nt, Artificial Sequence
  MKO10112587_B_Rfk
  gRNA
gagcggcgauguccauaaaa

SEQ ID NO: 112588 - RNA, 20 nt, Artificial Sequence
  MKO10112588_B_Rfk
  gRNA
cuauggggaaauucucaaug

SEQ ID NO: 112589 - RNA, 20 nt, Artificial Sequence
  MKO10112589_B_Rfk
  gRNA
ucacuuauuucugcaauuca

SEQ ID NO: 112590 - RNA, 20 nt, Artificial Sequence
  MKO10112590_B_Rfng
  gRNA
cacucacggugccaccgccu

SEQ ID NO: 112591 - RNA, 20 nt, Artificial Sequence
  MKO10112591_B_Rfng
  gRNA
uaugauaaguuccuagaauc

SEQ ID NO: 112592 - RNA, 20 nt, Artificial Sequence
  MKO10112592_B_Rfng
  gRNA
agucaaacacagugaaauuc

SEQ ID NO: 112593 - RNA, 20 nt, Artificial Sequence
  MKO10112593_B_Rfpl3s
  gRNA
gcccaggaucaugaauacag

SEQ ID NO: 112594 - RNA, 20 nt, Artificial Sequence
  MKO10112594_B_Rfpl3s
  gRNA
agaaagcacugaugaugauu

SEQ ID NO: 112595 - RNA, 20 nt, Artificial Sequence
  MKO10112595_B_Rfpl3s
  gRNA
cugugagcagaacaaaauga

SEQ ID NO: 112596 - RNA, 20 nt, Artificial Sequence
  MKO10112596_B_Rfpl4b
  gRNA
cgcaaucaaagcaaaguaug

SEQ ID NO: 112597 - RNA, 20 nt, Artificial Sequence
  MKO10112597_B_Rfpl4b
  gRNA
cccacccuuuaaaucauuag

SEQ ID NO: 112598 - RNA, 20 nt, Artificial Sequence
  MKO10112598_B_Rfpl4b
  gRNA
ucgucuucucaccaagcaac

SEQ ID NO: 112599 - RNA, 20 nt, Artificial Sequence
  MKO10112599_B_Rfpl4
  gRNA
uauccacaguucaaguacac

SEQ ID NO: 112600 - RNA, 20 nt, Artificial Sequence
  MKO10112600_B_Rfpl4
  gRNA
agauaugggagccaucgcua

SEQ ID NO: 112601 - RNA, 20 nt, Artificial Sequence
  MKO10112601_B_Rfpl4
  gRNA
agaguccauuaaucgaaaaa

SEQ ID NO: 112602 - RNA, 20 nt, Artificial Sequence
  MKO10112602_B_Rft1
  gRNA
cagcacaccaguuccauagu

SEQ ID NO: 112603 - RNA, 20 nt, Artificial Sequence
  MKO10112603_B_Rft1
  gRNA
gguucuugcugagagcaugu

SEQ ID NO: 112604 - RNA, 20 nt, Artificial Sequence
  MKO10112604_B_Rft1
  gRNA
ugcccacaaucuccuuugac

SEQ ID NO: 112605 - RNA, 20 nt, Artificial Sequence
  MKO10112605_B_Rftn1
  gRNA
cuggucggccagguguucua

SEQ ID NO: 112606 - RNA, 20 nt, Artificial Sequence
  MKO10112606_B_Rftn1
  gRNA
gugaacgccgucuuccagcu

SEQ ID NO: 112607 - RNA, 20 nt, Artificial Sequence
  MKO10112607_B_Rftn1
  gRNA
ugagcagucuagacgccagc

SEQ ID NO: 112608 - RNA, 20 nt, Artificial Sequence
  MKO10112608_B_Rftn2
  gRNA
caguuaccuucuccccgcuu

SEQ ID NO: 112609 - RNA, 20 nt, Artificial Sequence
  MKO10112609_B_Rftn2
  gRNA
ccagcuacgcuaacccaaag

SEQ ID NO: 112610 - RNA, 20 nt, Artificial Sequence
  MKO10112610_B_Rftn2
  gRNA
ggaguguccacuaacuugug

SEQ ID NO: 112611 - RNA, 20 nt, Artificial Sequence
  MKO10112611_B_Rfwd2
  gRNA
caaaauguggccacagcuuu

SEQ ID NO: 112612 - RNA, 20 nt, Artificial Sequence
  MKO10112612_B_Rfwd2
  gRNA
caaguguauucaucagaguu

SEQ ID NO: 112613 - RNA, 20 nt, Artificial Sequence
  MKO10112613_B_Rfwd2
  gRNA
caaacagaagcaaagauuug

SEQ ID NO: 112614 - RNA, 20 nt, Artificial Sequence
  MKO10112614_B_Rfwd3
  gRNA
uuccauagcagauagcaugu

SEQ ID NO: 112615 - RNA, 20 nt, Artificial Sequence
  MKO10112615_B_Rfwd3
  gRNA
acaaacacgaaaauguccuc

SEQ ID NO: 112616 - RNA, 20 nt, Artificial Sequence
  MKO10112616_B_Rfwd3
  gRNA
gaaccugaagccaacauucc

SEQ ID NO: 112617 - RNA, 20 nt, Artificial Sequence
  MKO10112617_B_Rfx1
  gRNA
cacagucucacuagcccgca

SEQ ID NO: 112618 - RNA, 20 nt, Artificial Sequence
  MKO10112618_B_Rfx1
  gRNA
ccagcaccgggcacuaagag

SEQ ID NO: 112619 - RNA, 20 nt, Artificial Sequence
  MKO10112619_B_Rfx1
  gRNA
ucaggcaccucuugggugac

SEQ ID NO: 112620 - RNA, 20 nt, Artificial Sequence
  MKO10112620_B_Rfx2
  gRNA
gggcaucaccauggacgucu

SEQ ID NO: 112621 - RNA, 20 nt, Artificial Sequence
  MKO10112621_B_Rfx2
  gRNA
uugugccguccaugccccca

SEQ ID NO: 112622 - RNA, 20 nt, Artificial Sequence
  MKO10112622_B_Rfx2
  gRNA
ggacgcagagccacugacgc

SEQ ID NO: 112623 - RNA, 20 nt, Artificial Sequence
  MKO10112623_B_Rfx3
  gRNA
ugguuguacagcgugcuccu

SEQ ID NO: 112624 - RNA, 20 nt, Artificial Sequence
  MKO10112624_B_Rfx3
  gRNA
agugauacugucuauaccaa

SEQ ID NO: 112625 - RNA, 20 nt, Artificial Sequence
  MKO10112625_B_Rfx3
  gRNA
uccacauacugcaccugagc

SEQ ID NO: 112626 - RNA, 20 nt, Artificial Sequence
  MKO10112626_B_Rfx4
  gRNA
ucaccgcuaugccauaguaa

SEQ ID NO: 112627 - RNA, 20 nt, Artificial Sequence
  MKO10112627_B_Rfx4
  gRNA
ccgaaaguuugccaagcagc

SEQ ID NO: 112628 - RNA, 20 nt, Artificial Sequence
  MKO10112628_B_Rfx4
  gRNA
aauaagagccaacuuugaug

SEQ ID NO: 112629 - RNA, 20 nt, Artificial Sequence
  MKO10112629_B_Rfx5
  gRNA
ggcccagcguuggcgagaag

SEQ ID NO: 112630 - RNA, 20 nt, Artificial Sequence
  MKO10112630_B_Rfx5
  gRNA
gcaucauagacgcucugcuu

SEQ ID NO: 112631 - RNA, 20 nt, Artificial Sequence
  MKO10112631_B_Rfx5
  gRNA
agagcgucuaugaugccuau

SEQ ID NO: 112632 - RNA, 20 nt, Artificial Sequence
  MKO10112632_B_Rfx6
  gRNA
ggcauuucuugcauuguugc

SEQ ID NO: 112633 - RNA, 20 nt, Artificial Sequence
  MKO10112633_B_Rfx6
  gRNA
cugugacucaauucuuuaua

SEQ ID NO: 112634 - RNA, 20 nt, Artificial Sequence
  MKO10112634_B_Rfx6
  gRNA
cucuucaaaguucccauuga

SEQ ID NO: 112635 - RNA, 20 nt, Artificial Sequence
  MKO10112635_B_Rfx7
  gRNA
ccauuaagugcugcugacuu

SEQ ID NO: 112636 - RNA, 20 nt, Artificial Sequence
  MKO10112636_B_Rfx7
  gRNA
ucugcacugcuaagaccaga

SEQ ID NO: 112637 - RNA, 20 nt, Artificial Sequence
  MKO10112637_B_Rfx7
  gRNA
caaaacuguacaaucuaaag

SEQ ID NO: 112638 - RNA, 20 nt, Artificial Sequence
  MKO10112638_B_Rfx8
  gRNA
gcaguaaugagcguagaaga

SEQ ID NO: 112639 - RNA, 20 nt, Artificial Sequence
  MKO10112639_B_Rfx8
  gRNA
auucccacagcuugugcgcu

SEQ ID NO: 112640 - RNA, 20 nt, Artificial Sequence
  MKO10112640_B_Rfx8
  gRNA
aguggcaaucuuauugccuu

SEQ ID NO: 112641 - RNA, 20 nt, Artificial Sequence
  MKO10112641_B_Rfxank
  gRNA
guccguguagccacccauac

SEQ ID NO: 112642 - RNA, 20 nt, Artificial Sequence
  MKO10112642_B_Rfxank
  gRNA
uccgcagaugauccuucagu

SEQ ID NO: 112643 - RNA, 20 nt, Artificial Sequence
  MKO10112643_B_Rfxank
  gRNA
agaccucauucccacguugc

SEQ ID NO: 112644 - RNA, 20 nt, Artificial Sequence
  MKO10112644_B_Rfxap
  gRNA
aagccucacacuggcgcucc

SEQ ID NO: 112645 - RNA, 20 nt, Artificial Sequence
  MKO10112645_B_Rfxap
  gRNA
gcuacuaaaucagcaaguuu

SEQ ID NO: 112646 - RNA, 20 nt, Artificial Sequence
  MKO10112646_B_Rfxap
  gRNA
aacacuugcucuagaagagu

SEQ ID NO: 112647 - RNA, 20 nt, Artificial Sequence
  MKO10112647_B_Rgag1
  gRNA
ggccugcacucugucgaagg

SEQ ID NO: 112648 - RNA, 20 nt, Artificial Sequence
  MKO10112648_B_Rgag1
  gRNA
uugaagcguagugaauguaa

SEQ ID NO: 112649 - RNA, 20 nt, Artificial Sequence
  MKO10112649_B_Rgag1
  gRNA
aaugagcacuucauccuccg

SEQ ID NO: 112650 - RNA, 20 nt, Artificial Sequence
  MKO10112650_B_Rgag4
  gRNA
gcucgagacauugccccgca

SEQ ID NO: 112651 - RNA, 20 nt, Artificial Sequence
  MKO10112651_B_Rgag4
  gRNA
cagaccauuagcuccgccau

SEQ ID NO: 112652 - RNA, 20 nt, Artificial Sequence
  MKO10112652_B_Rgag4
  gRNA
guugccccaagcgaccugca

SEQ ID NO: 112653 - RNA, 20 nt, Artificial Sequence
  MKO10112653_B_Rgcc
  gRNA
accuuuccgaggagugacag

SEQ ID NO: 112654 - RNA, 20 nt, Artificial Sequence
  MKO10112654_B_Rgcc
  gRNA
cucuuuagugucaccuaauu

SEQ ID NO: 112655 - RNA, 20 nt, Artificial Sequence
  MKO10112655_B_Rgcc
  gRNA
aaggugcagacucaguguac

SEQ ID NO: 112656 - RNA, 20 nt, Artificial Sequence
  MKO10112656_B_Rgl1
  gRNA
ccuuggacucgggugaacuu

SEQ ID NO: 112657 - RNA, 20 nt, Artificial Sequence
  MKO10112657_B_Rgl1
  gRNA
cggccaauaaaggagcgaga

SEQ ID NO: 112658 - RNA, 20 nt, Artificial Sequence
  MKO10112658_B_Rgl1
  gRNA
acacacucacuuccggauca

SEQ ID NO: 112659 - RNA, 20 nt, Artificial Sequence
  MKO10112659_B_Rgl2
  gRNA
cuggcggcuugugacaguaa

SEQ ID NO: 112660 - RNA, 20 nt, Artificial Sequence
  MKO10112660_B_Rgl2
  gRNA
gagugccagcgcggagccgu

SEQ ID NO: 112661 - RNA, 20 nt, Artificial Sequence
  MKO10112661_B_Rgl2
  gRNA
ggcugacaugauguucacuc

SEQ ID NO: 112662 - RNA, 20 nt, Artificial Sequence
  MKO10112662_B_Rgl3
  gRNA
gaaaagcgacuggcuugguc

SEQ ID NO: 112663 - RNA, 20 nt, Artificial Sequence
  MKO10112663_B_Rgl3
  gRNA
gccagcgcucgaccccagag

SEQ ID NO: 112664 - RNA, 20 nt, Artificial Sequence
  MKO10112664_B_Rgl3
  gRNA
cugcccagcccaaaaagauu

SEQ ID NO: 112665 - RNA, 20 nt, Artificial Sequence
  MKO10112665_B_Rgma
  gRNA
gugcgcacgcucccgccagc

SEQ ID NO: 112666 - RNA, 20 nt, Artificial Sequence
  MKO10112666_B_Rgma
  gRNA
gucuucgaccuccucacgac

SEQ ID NO: 112667 - RNA, 20 nt, Artificial Sequence
  MKO10112667_B_Rgma
  gRNA
aggggcaggacguucagccc

SEQ ID NO: 112668 - RNA, 20 nt, Artificial Sequence
  MKO10112668_B_Rgmb
  gRNA
cguucgucacuugaaccgaa

SEQ ID NO: 112669 - RNA, 20 nt, Artificial Sequence
  MKO10112669_B_Rgmb
  gRNA
gcugagcagucccgccgccc

SEQ ID NO: 112670 - RNA, 20 nt, Artificial Sequence
  MKO10112670_B_Rgmb
  gRNA
gcggcgggacugcucagccc

SEQ ID NO: 112671 - RNA, 20 nt, Artificial Sequence
  MKO10112671_B_Rgn
  gRNA
aucaguauuuguccuagcca

SEQ ID NO: 112672 - RNA, 20 nt, Artificial Sequence
  MKO10112672_B_Rgn
  gRNA
cgaagugccacugaacugac

SEQ ID NO: 112673 - RNA, 20 nt, Artificial Sequence
  MKO10112673_B_Rgn
  gRNA
cggccccagcuguucuugag

SEQ ID NO: 112674 - RNA, 20 nt, Artificial Sequence
  MKO10112674_B_Rgp1
  gRNA
cugagaguucucgugcugac

SEQ ID NO: 112675 - RNA, 20 nt, Artificial Sequence
  MKO10112675_B_Rgp1
  gRNA
gcuagcuggggagcgucuca

SEQ ID NO: 112676 - RNA, 20 nt, Artificial Sequence
  MKO10112676_B_Rgp1
  gRNA
ucacaugauuuggacucucc

SEQ ID NO: 112677 - RNA, 20 nt, Artificial Sequence
  MKO10112677_B_Rgr
  gRNA
cauaguggccccagcccauc

SEQ ID NO: 112678 - RNA, 20 nt, Artificial Sequence
  MKO10112678_B_Rgr
  gRNA
ccugaaugcccuuguugcag

SEQ ID NO: 112679 - RNA, 20 nt, Artificial Sequence
  MKO10112679_B_Rgr
  gRNA
uaccgggagauggccacucc

SEQ ID NO: 112680 - RNA, 20 nt, Artificial Sequence
  MKO10112680_B_Rgs10
  gRNA
ucggcucacugaaaagauuc

SEQ ID NO: 112681 - RNA, 20 nt, Artificial Sequence
  MKO10112681_B_Rgs10
  gRNA
gcgaagagaaugucuuguuu

SEQ ID NO: 112682 - RNA, 20 nt, Artificial Sequence
  MKO10112682_B_Rgs10
  gRNA
auccucccuggagaaucuuc

SEQ ID NO: 112683 - RNA, 20 nt, Artificial Sequence
  MKO10112683_B_Rgs11
  gRNA
ucugaaccagccauuccacg

SEQ ID NO: 112684 - RNA, 20 nt, Artificial Sequence
  MKO10112684_B_Rgs11
  gRNA
ucucguccggccugaguguc

SEQ ID NO: 112685 - RNA, 20 nt, Artificial Sequence
  MKO10112685_B_Rgs11
  gRNA
aacacaagacacccuacuuu

SEQ ID NO: 112686 - RNA, 20 nt, Artificial Sequence
  MKO10112686_B_Rgs12
  gRNA
uccugucaacauugacagcc

SEQ ID NO: 112687 - RNA, 20 nt, Artificial Sequence
  MKO10112687_B_Rgs12
  gRNA
aacaugacugaagcacucac

SEQ ID NO: 112688 - RNA, 20 nt, Artificial Sequence
  MKO10112688_B_Rgs12
  gRNA
uccugcacaugacaaaaaag

SEQ ID NO: 112689 - RNA, 20 nt, Artificial Sequence
  MKO10112689_B_Rgs13
  gRNA
ccaucagacuuuccaaagau

SEQ ID NO: 112690 - RNA, 20 nt, Artificial Sequence
  MKO10112690_B_Rgs13
  gRNA
guuaccucucuaggagacug

SEQ ID NO: 112691 - RNA, 20 nt, Artificial Sequence
  MKO10112691_B_Rgs13
  gRNA
ccaaucuuuggaaagucuga

SEQ ID NO: 112692 - RNA, 20 nt, Artificial Sequence
  MKO10112692_B_Rgs14
  gRNA
ccugucggucgauguucacu

SEQ ID NO: 112693 - RNA, 20 nt, Artificial Sequence
  MKO10112693_B_Rgs14
  gRNA
gcugcaagacccacgggguc

SEQ ID NO: 112694 - RNA, 20 nt, Artificial Sequence
  MKO10112694_B_Rgs14
  gRNA
gucuugcagcagccgcucaa

SEQ ID NO: 112695 - RNA, 20 nt, Artificial Sequence
  MKO10112695_B_Rgs16
  gRNA
uuugcuaauacccccaguau

SEQ ID NO: 112696 - RNA, 20 nt, Artificial Sequence
  MKO10112696_B_Rgs16
  gRNA
ccucacugaauuccgucuuu

SEQ ID NO: 112697 - RNA, 20 nt, Artificial Sequence
  MKO10112697_B_Rgs16
  gRNA
ccucuuuaggggcuucgcug

SEQ ID NO: 112698 - RNA, 20 nt, Artificial Sequence
  MKO10112698_B_Rgs17
  gRNA
ccucucuaacucgagaaucc

SEQ ID NO: 112699 - RNA, 20 nt, Artificial Sequence
  MKO10112699_B_Rgs17
  gRNA
gcauccagguccuagaggaa

SEQ ID NO: 112700 - RNA, 20 nt, Artificial Sequence
  MKO10112700_B_Rgs17
  gRNA
auccccacauaccaccaaaa

SEQ ID NO: 112701 - RNA, 20 nt, Artificial Sequence
  MKO10112701_B_Rgs18
  gRNA
ucagaaugaugcccccaaag

SEQ ID NO: 112702 - RNA, 20 nt, Artificial Sequence
  MKO10112702_B_Rgs18
  gRNA
gcccauuucacugcuucuuc

SEQ ID NO: 112703 - RNA, 20 nt, Artificial Sequence
  MKO10112703_B_Rgs18
  gRNA
gacuaagucuucuccuacag

SEQ ID NO: 112704 - RNA, 20 nt, Artificial Sequence
  MKO10112704_B_Rgs19
  gRNA
guacgagucccggugcauga

SEQ ID NO: 112705 - RNA, 20 nt, Artificial Sequence
  MKO10112705_B_Rgs19
  gRNA
uauugaugccuucucgcaca

SEQ ID NO: 112706 - RNA, 20 nt, Artificial Sequence
  MKO10112706_B_Rgs19
  gRNA
ccaacaugugguggacgaga

SEQ ID NO: 112707 - RNA, 20 nt, Artificial Sequence
  MKO10112707_B_Rgs1
  gRNA
aauacuuacucugguuggca

SEQ ID NO: 112708 - RNA, 20 nt, Artificial Sequence
  MKO10112708_B_Rgs1
  gRNA
uugugcuucaucaaaagaug

SEQ ID NO: 112709 - RNA, 20 nt, Artificial Sequence
  MKO10112709_B_Rgs1
  gRNA
acuuuaaaguauuugccuga

SEQ ID NO: 112710 - RNA, 20 nt, Artificial Sequence
  MKO10112710_B_Rgs20
  gRNA
uccguccgcucagaucccuc

SEQ ID NO: 112711 - RNA, 20 nt, Artificial Sequence
  MKO10112711_B_Rgs20
  gRNA
augcggaugcggcagaugug

SEQ ID NO: 112712 - RNA, 20 nt, Artificial Sequence
  MKO10112712_B_Rgs20
  gRNA
gcucagccccacgccuacuc

SEQ ID NO: 112713 - RNA, 20 nt, Artificial Sequence
  MKO10112713_B_Rgs22
  gRNA
gcgauugcuacuuugaauac

SEQ ID NO: 112714 - RNA, 20 nt, Artificial Sequence
  MKO10112714_B_Rgs22
  gRNA
aacucuucuucuguaacuuc

SEQ ID NO: 112715 - RNA, 20 nt, Artificial Sequence
  MKO10112715_B_Rgs22
  gRNA
acucauuaaaguaauccaca

SEQ ID NO: 112716 - RNA, 20 nt, Artificial Sequence
  MKO10112716_B_Rgs2
  gRNA
cagaugggcuggcugcauuc

SEQ ID NO: 112717 - RNA, 20 nt, Artificial Sequence
  MKO10112717_B_Rgs2
  gRNA
agaagcauuugaugaacugc

SEQ ID NO: 112718 - RNA, 20 nt, Artificial Sequence
  MKO10112718_B_Rgs2
  gRNA
cucuugcaggccuucuccug

SEQ ID NO: 112719 - RNA, 20 nt, Artificial Sequence
  MKO10112719_B_Rgs3
  gRNA
cuucagggauuguauccucc

SEQ ID NO: 112720 - RNA, 20 nt, Artificial Sequence
  MKO10112720_B_Rgs3
  gRNA
acaacugaaugagagacccg

SEQ ID NO: 112721 - RNA, 20 nt, Artificial Sequence
  MKO10112721_B_Rgs3
  gRNA
uugcagggggcccggcagag

SEQ ID NO: 112722 - RNA, 20 nt, Artificial Sequence
  MKO10112722_B_Rgs4
  gRNA
acaaaguaguaacuugccag

SEQ ID NO: 112723 - RNA, 20 nt, Artificial Sequence
  MKO10112723_B_Rgs4
  gRNA
uugugggcuguaacauguuc

SEQ ID NO: 112724 - RNA, 20 nt, Artificial Sequence
  MKO10112724_B_Rgs4
  gRNA
gaacucguuguagaucuucu

SEQ ID NO: 112725 - RNA, 20 nt, Artificial Sequence
  MKO10112725_B_Rgs5
  gRNA
aaaauucagagcgcacaaag

SEQ ID NO: 112726 - RNA, 20 nt, Artificial Sequence
  MKO10112726_B_Rgs5
  gRNA
gucuccucgcagcuuugacu

SEQ ID NO: 112727 - RNA, 20 nt, Artificial Sequence
  MKO10112727_B_Rgs5
  gRNA
uugguuuaggcccucacugg

SEQ ID NO: 112728 - RNA, 20 nt, Artificial Sequence
  MKO10112728_B_Rgs6
  gRNA
aaaauccccagugucgucac

SEQ ID NO: 112729 - RNA, 20 nt, Artificial Sequence
  MKO10112729_B_Rgs6
  gRNA
ugcaguugaagcaauacacc

SEQ ID NO: 112730 - RNA, 20 nt, Artificial Sequence
  MKO10112730_B_Rgs6
  gRNA
cagguacugacauuguacag

SEQ ID NO: 112731 - RNA, 20 nt, Artificial Sequence
  MKO10112731_B_Rgs7bp
  gRNA
cgagaguuggucauuucuau

SEQ ID NO: 112732 - RNA, 20 nt, Artificial Sequence
  MKO10112732_B_Rgs7bp
  gRNA
gggaugacaaggaguccucc

SEQ ID NO: 112733 - RNA, 20 nt, Artificial Sequence
  MKO10112733_B_Rgs7bp
  gRNA
aaaaccuucuuagcaaacuc

SEQ ID NO: 112734 - RNA, 20 nt, Artificial Sequence
  MKO10112734_B_Rgs7
  gRNA
ccacuuaccggagaacacac

SEQ ID NO: 112735 - RNA, 20 nt, Artificial Sequence
  MKO10112735_B_Rgs7
  gRNA
cguaugcaagacgagaaaaa

SEQ ID NO: 112736 - RNA, 20 nt, Artificial Sequence
  MKO10112736_B_Rgs7
  gRNA
aacuuaacuauagaagaucc

SEQ ID NO: 112737 - RNA, 20 nt, Artificial Sequence
  MKO10112737_B_Rgs8
  gRNA
cagcagaucuaaguacauuu

SEQ ID NO: 112738 - RNA, 20 nt, Artificial Sequence
  MKO10112738_B_Rgs8
  gRNA
ccaccucguugcuucuuccg

SEQ ID NO: 112739 - RNA, 20 nt, Artificial Sequence
  MKO10112739_B_Rgs8
  gRNA
cugcuacucacuugagagca

SEQ ID NO: 112740 - RNA, 20 nt, Artificial Sequence
  MKO10112740_B_Rgs9bp
  gRNA
cuuagcuaccgaggagcgcg

SEQ ID NO: 112741 - RNA, 20 nt, Artificial Sequence
  MKO10112741_B_Rgs9bp
  gRNA
cgcuagugcgcgcugcaugu

SEQ ID NO: 112742 - RNA, 20 nt, Artificial Sequence
  MKO10112742_B_Rgs9bp
  gRNA
cgcucuccgcuucgugccgc

SEQ ID NO: 112743 - RNA, 20 nt, Artificial Sequence
  MKO10112743_B_Rgs9
  gRNA
acgucaccugucauggcgug

SEQ ID NO: 112744 - RNA, 20 nt, Artificial Sequence
  MKO10112744_B_Rgs9
  gRNA
cagcagucucuaccgauuuc

SEQ ID NO: 112745 - RNA, 20 nt, Artificial Sequence
  MKO10112745_B_Rgs9
  gRNA
ccagcaguacaggccgagga

SEQ ID NO: 112746 - RNA, 20 nt, Artificial Sequence
  MKO10112746_B_Rgsl1
  gRNA
ggguggccuugagcacgagc

SEQ ID NO: 112747 - RNA, 20 nt, Artificial Sequence
  MKO10112747_B_Rgsl1
  gRNA
guugcagagagucaccacuc

SEQ ID NO: 112748 - RNA, 20 nt, Artificial Sequence
  MKO10112748_B_Rgsl1
  gRNA
cauccuccaaaagaaugaua

SEQ ID NO: 112749 - RNA, 20 nt, Artificial Sequence
  MKO10112749_B_Rhag
  gRNA
aauucagccauugcugaucc

SEQ ID NO: 112750 - RNA, 20 nt, Artificial Sequence
  MKO10112750_B_Rhag
  gRNA
uuuccccaggacagcgccaa

SEQ ID NO: 112751 - RNA, 20 nt, Artificial Sequence
  MKO10112751_B_Rhag
  gRNA
ucaaugacaauccaugccuu

SEQ ID NO: 112752 - RNA, 20 nt, Artificial Sequence
  MKO10112752_B_Rhbdd1
  gRNA
cagaaccacuuuaacaaugc

SEQ ID NO: 112753 - RNA, 20 nt, Artificial Sequence
  MKO10112753_B_Rhbdd1
  gRNA
cuuagcaaccauuacugccc

SEQ ID NO: 112754 - RNA, 20 nt, Artificial Sequence
  MKO10112754_B_Rhbdd1
  gRNA
ucccuaauagauuugcuugu

SEQ ID NO: 112755 - RNA, 20 nt, Artificial Sequence
  MKO10112755_B_Rhbdd2
  gRNA
acauagcacaggccggacgc

SEQ ID NO: 112756 - RNA, 20 nt, Artificial Sequence
  MKO10112756_B_Rhbdd2
  gRNA
uuaucacuuaccuacggcuc

SEQ ID NO: 112757 - RNA, 20 nt, Artificial Sequence
  MKO10112757_B_Rhbdd2
  gRNA
ucucaccuugccaguugcgc

SEQ ID NO: 112758 - RNA, 20 nt, Artificial Sequence
  MKO10112758_B_Rhbdd3
  gRNA
gccuguccaucuagcuaugc

SEQ ID NO: 112759 - RNA, 20 nt, Artificial Sequence
  MKO10112759_B_Rhbdd3
  gRNA
cugguggcaggagugccauc

SEQ ID NO: 112760 - RNA, 20 nt, Artificial Sequence
  MKO10112760_B_Rhbdd3
  gRNA
uacacgcccuguagcugcca

SEQ ID NO: 112761 - RNA, 20 nt, Artificial Sequence
  MKO10112761_B_Rhbdf1
  gRNA
guccucagggucggucuauu

SEQ ID NO: 112762 - RNA, 20 nt, Artificial Sequence
  MKO10112762_B_Rhbdf1
  gRNA
gagucgguugaaaccugagc

SEQ ID NO: 112763 - RNA, 20 nt, Artificial Sequence
  MKO10112763_B_Rhbdf1
  gRNA
ccaucacacagaccauccgc

SEQ ID NO: 112764 - RNA, 20 nt, Artificial Sequence
  MKO10112764_B_Rhbdf2
  gRNA
cgccgcugaccccaaaccac

SEQ ID NO: 112765 - RNA, 20 nt, Artificial Sequence
  MKO10112765_B_Rhbdf2
  gRNA
uggggucagcggcgacuggg

SEQ ID NO: 112766 - RNA, 20 nt, Artificial Sequence
  MKO10112766_B_Rhbdf2
  gRNA
gugcucacuugcggaugcuc

SEQ ID NO: 112767 - RNA, 20 nt, Artificial Sequence
  MKO10112767_B_Rhbdl1
  gRNA
cucgcagggcaggaucucgu

SEQ ID NO: 112768 - RNA, 20 nt, Artificial Sequence
  MKO10112768_B_Rhbdl1
  gRNA
gcacaccgaucaucagcugc

SEQ ID NO: 112769 - RNA, 20 nt, Artificial Sequence
  MKO10112769_B_Rhbdl1
  gRNA
ccccaccaaguuggacaugu

SEQ ID NO: 112770 - RNA, 20 nt, Artificial Sequence
  MKO10112770_B_Rhbdl2
  gRNA
gaguagucugacgauuccaa

SEQ ID NO: 112771 - RNA, 20 nt, Artificial Sequence
  MKO10112771_B_Rhbdl2
  gRNA
cuucucagggcaguacguca

SEQ ID NO: 112772 - RNA, 20 nt, Artificial Sequence
  MKO10112772_B_Rhbdl2
  gRNA
ugacguacugcccugagaag

SEQ ID NO: 112773 - RNA, 20 nt, Artificial Sequence
  MKO10112773_B_Rhbdl3
  gRNA
ccacccgcagcuccgugcgc

SEQ ID NO: 112774 - RNA, 20 nt, Artificial Sequence
  MKO10112774_B_Rhbdl3
  gRNA
cuaccaggacuuugucaacc

SEQ ID NO: 112775 - RNA, 20 nt, Artificial Sequence
  MKO10112775_B_Rhbdl3
  gRNA
acacaaaaaggaggugcucc

SEQ ID NO: 112776 - RNA, 20 nt, Artificial Sequence
  MKO10112776_B_Rhbg
  gRNA
gcgguacggcuucagcagug

SEQ ID NO: 112777 - RNA, 20 nt, Artificial Sequence
  MKO10112777_B_Rhbg
  gRNA
agaccaugacgugcacaucc

SEQ ID NO: 112778 - RNA, 20 nt, Artificial Sequence
  MKO10112778_B_Rhbg
  gRNA
acuucgggcuguuccucuca

SEQ ID NO: 112779 - RNA, 20 nt, Artificial Sequence
  MKO10112779_B_Rhcg
  gRNA
gcccuucuuguguacaauac

SEQ ID NO: 112780 - RNA, 20 nt, Artificial Sequence
  MKO10112780_B_Rhcg
  gRNA
gguuagcacacucgcugcca

SEQ ID NO: 112781 - RNA, 20 nt, Artificial Sequence
  MKO10112781_B_Rhcg
  gRNA
gucauaaugagcagcugcau

SEQ ID NO: 112782 - RNA, 20 nt, Artificial Sequence
  MKO10112782_B_Rhd
  gRNA
acaagaucaacaaucugucc

SEQ ID NO: 112783 - RNA, 20 nt, Artificial Sequence
  MKO10112783_B_Rhd
  gRNA
agauuguucccugcaccccg

SEQ ID NO: 112784 - RNA, 20 nt, Artificial Sequence
  MKO10112784_B_Rhd
  gRNA
cacguguuuggggccuauuu

SEQ ID NO: 112785 - RNA, 20 nt, Artificial Sequence
  MKO10112785_B_Rhebl1
  gRNA
ugguuacguucuuguauacu

SEQ ID NO: 112786 - RNA, 20 nt, Artificial Sequence
  MKO10112786_B_Rhebl1
  gRNA
uacuuacuauucuccacugu

SEQ ID NO: 112787 - RNA, 20 nt, Artificial Sequence
  MKO10112787_B_Rhebl1
  gRNA
agaugaguuucaccuacauc

SEQ ID NO: 112788 - RNA, 20 nt, Artificial Sequence
  MKO10112788_B_Rheb
  gRNA
ucuucagcuuguagacacag

SEQ ID NO: 112789 - RNA, 20 nt, Artificial Sequence
  MKO10112789_B_Rheb
  gRNA
acauacuccauagauauuaa

SEQ ID NO: 112790 - RNA, 20 nt, Artificial Sequence
  MKO10112790_B_Rheb
  gRNA
gaaguaauuaaaguuaucca

SEQ ID NO: 112791 - RNA, 20 nt, Artificial Sequence
  MKO10112791_B_Rhoa
  gRNA
auugacagcccugauaguuu

SEQ ID NO: 112792 - RNA, 20 nt, Artificial Sequence
  MKO10112792_B_Rhoa
  gRNA
uuuaagugauggcugccauc

SEQ ID NO: 112793 - RNA, 20 nt, Artificial Sequence
  MKO10112793_B_Rhoa
  gRNA
gcacauagaccucugggaac

SEQ ID NO: 112794 - RNA, 20 nt, Artificial Sequence
  MKO10112794_B_Rhobtb1
  gRNA
cacuucaucgacgacauccc

SEQ ID NO: 112795 - RNA, 20 nt, Artificial Sequence
  MKO10112795_B_Rhobtb1
  gRNA
gagacauucuuugauccgau

SEQ ID NO: 112796 - RNA, 20 nt, Artificial Sequence
  MKO10112796_B_Rhobtb1
  gRNA
acgguuggcgcuuuccacaa

SEQ ID NO: 112797 - RNA, 20 nt, Artificial Sequence
  MKO10112797_B_Rhobtb2
  gRNA
gcuagaacgcucccgagaug

SEQ ID NO: 112798 - RNA, 20 nt, Artificial Sequence
  MKO10112798_B_Rhobtb2
  gRNA
cuuccaggucagcauagcgc

SEQ ID NO: 112799 - RNA, 20 nt, Artificial Sequence
  MKO10112799_B_Rhobtb2
  gRNA
cauguuuggggggccauuug

SEQ ID NO: 112800 - RNA, 20 nt, Artificial Sequence
  MKO10112800_B_Rhobtb3
  gRNA
uacaccucccgaaaccuaau

SEQ ID NO: 112801 - RNA, 20 nt, Artificial Sequence
  MKO10112801_B_Rhobtb3
  gRNA
ucccucggucugaaguacac

SEQ ID NO: 112802 - RNA, 20 nt, Artificial Sequence
  MKO10112802_B_Rhobtb3
  gRNA
ccccuguguacuucagaccg

SEQ ID NO: 112803 - RNA, 20 nt, Artificial Sequence
  MKO10112803_B_Rhob
  gRNA
uccguagcgcuucugcagcg

SEQ ID NO: 112804 - RNA, 20 nt, Artificial Sequence
  MKO10112804_B_Rhob
  gRNA
guaaacgaucguaguccucc

SEQ ID NO: 112805 - RNA, 20 nt, Artificial Sequence
  MKO10112805_B_Rhob
  gRNA
cuuuacugaacacgaucagc

SEQ ID NO: 112806 - RNA, 20 nt, Artificial Sequence
  MKO10112806_B_Rhoc
  gRNA
ggcugcgauccgaaagaagc

SEQ ID NO: 112807 - RNA, 20 nt, Artificial Sequence
  MKO10112807_B_Rhoc
  gRNA
aagaagacuacgaucgccug

SEQ ID NO: 112808 - RNA, 20 nt, Artificial Sequence
  MKO10112808_B_Rhoc
  gRNA
ugguaugcucaucuugccuc

SEQ ID NO: 112809 - RNA, 20 nt, Artificial Sequence
  MKO10112809_B_Rhod
  gRNA
agacggcuuccacguuguca

SEQ ID NO: 112810 - RNA, 20 nt, Artificial Sequence
  MKO10112810_B_Rhod
  gRNA
gcagucgcagacauaacuuu

SEQ ID NO: 112811 - RNA, 20 nt, Artificial Sequence
  MKO10112811_B_Rhod
  gRNA
gagacguugucaaagcuguu

SEQ ID NO: 112812 - RNA, 20 nt, Artificial Sequence
  MKO10112812_B_Rhof
  gRNA
acucaccagccgugucguag

SEQ ID NO: 112813 - RNA, 20 nt, Artificial Sequence
  MKO10112813_B_Rhof
  gRNA
cuugcagccgaugagcaccg

SEQ ID NO: 112814 - RNA, 20 nt, Artificial Sequence
  MKO10112814_B_Rhof
  gRNA
gaagucacacauuucugccg

SEQ ID NO: 112815 - RNA, 20 nt, Artificial Sequence
  MKO10112815_B_Rhog
  gRNA
cgucaaggagguguuugcgg

SEQ ID NO: 112816 - RNA, 20 nt, Artificial Sequence
  MKO10112816_B_Rhog
  gRNA
caauuacagcgcccagagug

SEQ ID NO: 112817 - RNA, 20 nt, Artificial Sequence
  MKO10112817_B_Rhog
  gRNA
cccugacgugccuauccucc

SEQ ID NO: 112818 - RNA, 20 nt, Artificial Sequence
  MKO10112818_B_Rhoh
  gRNA
acgacgccuucagaaguauc

SEQ ID NO: 112819 - RNA, 20 nt, Artificial Sequence
  MKO10112819_B_Rhoh
  gRNA
gagcaaccuacccuguaccc

SEQ ID NO: 112820 - RNA, 20 nt, Artificial Sequence
  MKO10112820_B_Rhoh
  gRNA
caggggccggauacuucuga

SEQ ID NO: 112821 - RNA, 20 nt, Artificial Sequence
  MKO10112821_B_Rhoj
  gRNA
uggguuccgaugagcacaua

SEQ ID NO: 112822 - RNA, 20 nt, Artificial Sequence
  MKO10112822_B_Rhoj
  gRNA
gauuggagcgcagugcuacu

SEQ ID NO: 112823 - RNA, 20 nt, Artificial Sequence
  MKO10112823_B_Rhoj
  gRNA
cagcuucacgccgugcucau

SEQ ID NO: 112824 - RNA, 20 nt, Artificial Sequence
  MKO10112824_B_Rhoq
  gRNA
uugggacucuaugacacagc

SEQ ID NO: 112825 - RNA, 20 nt, Artificial Sequence
  MKO10112825_B_Rhoq
  gRNA
guguucagcuuuaacccaga

SEQ ID NO: 112826 - RNA, 20 nt, Artificial Sequence
  MKO10112826_B_Rhoq
  gRNA
acacagucuucaaacccuuc

SEQ ID NO: 112827 - RNA, 20 nt, Artificial Sequence
  MKO10112827_B_Rhot1
  gRNA
aggcucgcaggggccgcacu

SEQ ID NO: 112828 - RNA, 20 nt, Artificial Sequence
  MKO10112828_B_Rhot1
  gRNA
cagugaagaauuuccggaag

SEQ ID NO: 112829 - RNA, 20 nt, Artificial Sequence
  MKO10112829_B_Rhot1
  gRNA
cuuucaggggugacgucagc

SEQ ID NO: 112830 - RNA, 20 nt, Artificial Sequence
  MKO10112830_B_Rhot2
  gRNA
ggaugguuaucuccuccgcg

SEQ ID NO: 112831 - RNA, 20 nt, Artificial Sequence
  MKO10112831_B_Rhot2
  gRNA
ugaggagaccaccauugaga

SEQ ID NO: 112832 - RNA, 20 nt, Artificial Sequence
  MKO10112832_B_Rhot2
  gRNA
acuucaggaggagauccaca

SEQ ID NO: 112833 - RNA, 20 nt, Artificial Sequence
  MKO10112833_B_Rhou
  gRNA
gauucgacgucacugcccaa

SEQ ID NO: 112834 - RNA, 20 nt, Artificial Sequence
  MKO10112834_B_Rhou
  gRNA
caagccguggugucuguaga

SEQ ID NO: 112835 - RNA, 20 nt, Artificial Sequence
  MKO10112835_B_Rhou
  gRNA
ccgcccaucuacagacacca

SEQ ID NO: 112836 - RNA, 20 nt, Artificial Sequence
  MKO10112836_B_Rhov
  gRNA
cccggacaccgaugucuuuc

SEQ ID NO: 112837 - RNA, 20 nt, Artificial Sequence
  MKO10112837_B_Rhov
  gRNA
gcacgcugucucgcugucgc

SEQ ID NO: 112838 - RNA, 20 nt, Artificial Sequence
  MKO10112838_B_Rhov
  gRNA
aggagcggaccaugccgccg

SEQ ID NO: 112839 - RNA, 20 nt, Artificial Sequence
  MKO10112839_B_Rhox10
  gRNA
cugagccgaaaaguuguucg

SEQ ID NO: 112840 - RNA, 20 nt, Artificial Sequence
  MKO10112840_B_Rhox10
  gRNA
acuugcaaaacuuauugaug

SEQ ID NO: 112841 - RNA, 20 nt, Artificial Sequence
  MKO10112841_B_Rhox10
  gRNA
agcuuaccccauaauaaucg

SEQ ID NO: 112842 - RNA, 20 nt, Artificial Sequence
  MKO10112842_B_Rhox11
  gRNA
caagaacaucacuccuaccc

SEQ ID NO: 112843 - RNA, 20 nt, Artificial Sequence
  MKO10112843_B_Rhox11
  gRNA
cuccauagaaaagagcuggc

SEQ ID NO: 112844 - RNA, 20 nt, Artificial Sequence
  MKO10112844_B_Rhox11
  gRNA
uguggaugaacagaaaauaa

SEQ ID NO: 112845 - RNA, 20 nt, Artificial Sequence
  MKO10112845_B_Rhox12
  gRNA
ccuagcagaauccaaaguuc

SEQ ID NO: 112846 - RNA, 20 nt, Artificial Sequence
  MKO10112846_B_Rhox12
  gRNA
acugcuguucuuuccuauaa

SEQ ID NO: 112847 - RNA, 20 nt, Artificial Sequence
  MKO10112847_B_Rhox12
  gRNA
ccugaacuuuggauucugcu

SEQ ID NO: 112848 - RNA, 20 nt, Artificial Sequence
  MKO10112848_B_Rhox13
  gRNA
ccucugcuucgcucuccgau

SEQ ID NO: 112849 - RNA, 20 nt, Artificial Sequence
  MKO10112849_B_Rhox13
  gRNA
aagaacuuugaaugugccug

SEQ ID NO: 112850 - RNA, 20 nt, Artificial Sequence
  MKO10112850_B_Rhox13
  gRNA
cugaccuucacuuugaccuc

SEQ ID NO: 112851 - RNA, 20 nt, Artificial Sequence
  MKO10112851_B_Rhox1
  gRNA
cacugauguacugagugcgc

SEQ ID NO: 112852 - RNA, 20 nt, Artificial Sequence
  MKO10112852_B_Rhox1
  gRNA
uguuguagaauugguuucaa

SEQ ID NO: 112853 - RNA, 20 nt, Artificial Sequence
  MKO10112853_B_Rhox1
  gRNA
ugugugugaagccaaagugc

SEQ ID NO: 112854 - RNA, 20 nt, Artificial Sequence
  MKO10112854_B_Rhox2a
  gRNA
uuaagguguaaagacucuga

SEQ ID NO: 112855 - RNA, 20 nt, Artificial Sequence
  MKO10112855_B_Rhox2a
  gRNA
uguggcuucacucacuccca

SEQ ID NO: 112856 - RNA, 20 nt, Artificial Sequence
  MKO10112856_B_Rhox2a
  gRNA
aaaucgccuggcaagaucca

SEQ ID NO: 112857 - RNA, 20 nt, Artificial Sequence
  MKO10112857_B_Rhox2b
  gRNA
ugcugauguagugauugcac

SEQ ID NO: 112858 - RNA, 20 nt, Artificial Sequence
  MKO10112858_B_Rhox2b
  gRNA
uguggcuucacucacuccca

SEQ ID NO: 112859 - RNA, 20 nt, Artificial Sequence
  MKO10112859_B_Rhox2b
  gRNA
aaaucgccuggcaagaucca

SEQ ID NO: 112860 - RNA, 20 nt, Artificial Sequence
  MKO10112860_B_Rhox2c
  gRNA
uuaagguauaaagacucuga

SEQ ID NO: 112861 - RNA, 20 nt, Artificial Sequence
  MKO10112861_B_Rhox2c
  gRNA
uguggcuucacucacuccca

SEQ ID NO: 112862 - RNA, 20 nt, Artificial Sequence
  MKO10112862_B_Rhox2c
  gRNA
aaaucgccuggcaagaucca

SEQ ID NO: 112863 - RNA, 20 nt, Artificial Sequence
  MKO10112863_B_Rhox2d
  gRNA
caucaauuacaagcuugaug

SEQ ID NO: 112864 - RNA, 20 nt, Artificial Sequence
  MKO10112864_B_Rhox2d
  gRNA
gaggaugaggaaaaugcgaa

SEQ ID NO: 112865 - RNA, 20 nt, Artificial Sequence
  MKO10112865_B_Rhox2d
  gRNA
uguggcuucacucacaccca

SEQ ID NO: 112866 - RNA, 20 nt, Artificial Sequence
  MKO10112866_B_Rhox2e
  gRNA
uuaagguguaaagacucuga

SEQ ID NO: 112867 - RNA, 20 nt, Artificial Sequence
  MKO10112867_B_Rhox2e
  gRNA
uguggcuucacucacuccca

SEQ ID NO: 112868 - RNA, 20 nt, Artificial Sequence
  MKO10112868_B_Rhox2e
  gRNA
aaaucgccuggcaagaucca

SEQ ID NO: 112869 - RNA, 20 nt, Artificial Sequence
  MKO10112869_B_Rhox2f
  gRNA
gaggaugaggaaaaugcgaa

SEQ ID NO: 112870 - RNA, 20 nt, Artificial Sequence
  MKO10112870_B_Rhox2f
  gRNA
uguggcuucacucacaccca

SEQ ID NO: 112871 - RNA, 20 nt, Artificial Sequence
  MKO10112871_B_Rhox2f
  gRNA
aaaucgccuggcaagaucca

SEQ ID NO: 112872 - RNA, 20 nt, Artificial Sequence
  MKO10112872_B_Rhox2g
  gRNA
uguggcuuuacucacaccca

SEQ ID NO: 112873 - RNA, 20 nt, Artificial Sequence
  MKO10112873_B_Rhox2g
  gRNA
caucaauuacaagcuugaug

SEQ ID NO: 112874 - RNA, 20 nt, Artificial Sequence
  MKO10112874_B_Rhox2g
  gRNA
gaggaugaggaaaaugcgaa

SEQ ID NO: 112875 - RNA, 20 nt, Artificial Sequence
  MKO10112875_B_Rhox2h
  gRNA
gaggaugaggaaaaugcgaa

SEQ ID NO: 112876 - RNA, 20 nt, Artificial Sequence
  MKO10112876_B_Rhox2h
  gRNA
aaaucgccuggcaagaucca

SEQ ID NO: 112877 - RNA, 20 nt, Artificial Sequence
  MKO10112877_B_Rhox2h
  gRNA
uguggcuucacucacaccca

SEQ ID NO: 112878 - RNA, 20 nt, Artificial Sequence
  MKO10112878_B_Rhox3a
  gRNA
gugaccaggcugaagcgcca

SEQ ID NO: 112879 - RNA, 20 nt, Artificial Sequence
  MKO10112879_B_Rhox3a
  gRNA
cuucauucacacccauccau

SEQ ID NO: 112880 - RNA, 20 nt, Artificial Sequence
  MKO10112880_B_Rhox3a
  gRNA
ucagaaaacaacuggcccga

SEQ ID NO: 112881 - RNA, 20 nt, Artificial Sequence
  MKO10112881_B_Rhox3c
  gRNA
agacugaucuugaagcucug

SEQ ID NO: 112882 - RNA, 20 nt, Artificial Sequence
  MKO10112882_B_Rhox3c
  gRNA
ccugccuuggugcuucagcc

SEQ ID NO: 112883 - RNA, 20 nt, Artificial Sequence
  MKO10112883_B_Rhox3c
  gRNA
cuucauucacacccauccau

SEQ ID NO: 112884 - RNA, 20 nt, Artificial Sequence
  MKO10112884_B_Rhox3e
  gRNA
gugaccaggcugaagcgcca

SEQ ID NO: 112885 - RNA, 20 nt, Artificial Sequence
  MKO10112885_B_Rhox3e
  gRNA
cuucauucacacccauccau

SEQ ID NO: 112886 - RNA, 20 nt, Artificial Sequence
  MKO10112886_B_Rhox3e
  gRNA
ucagaaaacaacuggcccga

SEQ ID NO: 112887 - RNA, 20 nt, Artificial Sequence
  MKO10112887_B_Rhox3f
  gRNA
ccugccuuagcgcuucagcc

SEQ ID NO: 112888 - RNA, 20 nt, Artificial Sequence
  MKO10112888_B_Rhox3f
  gRNA
aaaaauacaggugguauaag

SEQ ID NO: 112889 - RNA, 20 nt, Artificial Sequence
  MKO10112889_B_Rhox3f
  gRNA
cuucauucacacccauccau

SEQ ID NO: 112890 - RNA, 20 nt, Artificial Sequence
  MKO10112890_B_Rhox3g
  gRNA
caacggaugugagacuaaaa

SEQ ID NO: 112891 - RNA, 20 nt, Artificial Sequence
  MKO10112891_B_Rhox3g
  gRNA
gacugagaaaauaauucauc

SEQ ID NO: 112892 - RNA, 20 nt, Artificial Sequence
  MKO10112892_B_Rhox3g
  gRNA
cuucauucacacccauccau

SEQ ID NO: 112893 - RNA, 20 nt, Artificial Sequence
  MKO10112893_B_Rhox3h
  gRNA
ugacugaccuugaagcucug

SEQ ID NO: 112894 - RNA, 20 nt, Artificial Sequence
  MKO10112894_B_Rhox3h
  gRNA
ucagaaaacaacuggcccga

SEQ ID NO: 112895 - RNA, 20 nt, Artificial Sequence
  MKO10112895_B_Rhox3h
  gRNA
cuucauucacacccauccau

SEQ ID NO: 112896 - RNA, 20 nt, Artificial Sequence
  MKO10112896_B_Rhox4a
  gRNA
acauacaggugggaagacac

SEQ ID NO: 112897 - RNA, 20 nt, Artificial Sequence
  MKO10112897_B_Rhox4a
  gRNA
ccagaagacaucuggcaaga

SEQ ID NO: 112898 - RNA, 20 nt, Artificial Sequence
  MKO10112898_B_Rhox4a
  gRNA
ugugagugaagccagaguua

SEQ ID NO: 112899 - RNA, 20 nt, Artificial Sequence
  MKO10112899_B_Rhox4b
  gRNA
gacacagacagucuuaccac

SEQ ID NO: 112900 - RNA, 20 nt, Artificial Sequence
  MKO10112900_B_Rhox4b
  gRNA
ccagaagacaucuggcaaga

SEQ ID NO: 112901 - RNA, 20 nt, Artificial Sequence
  MKO10112901_B_Rhox4b
  gRNA
ugugagugaagccagaguua

SEQ ID NO: 112902 - RNA, 20 nt, Artificial Sequence
  MKO10112902_B_Rhox4c
  gRNA
cugcuuaccuuuccucugca

SEQ ID NO: 112903 - RNA, 20 nt, Artificial Sequence
  MKO10112903_B_Rhox4c
  gRNA
acauacaggugggaagacac

SEQ ID NO: 112904 - RNA, 20 nt, Artificial Sequence
  MKO10112904_B_Rhox4c
  gRNA
ccagaagacaucuggcaaga

SEQ ID NO: 112905 - RNA, 20 nt, Artificial Sequence
  MKO10112905_B_Rhox4d
  gRNA
gacacagacagucuuaccac

SEQ ID NO: 112906 - RNA, 20 nt, Artificial Sequence
  MKO10112906_B_Rhox4d
  gRNA
ccagaagacaucuggcaaga

SEQ ID NO: 112907 - RNA, 20 nt, Artificial Sequence
  MKO10112907_B_Rhox4d
  gRNA
ugugagugaagccagaguua

SEQ ID NO: 112908 - RNA, 20 nt, Artificial Sequence
  MKO10112908_B_Rhox4e
  gRNA
acauacaggugggaagacac

SEQ ID NO: 112909 - RNA, 20 nt, Artificial Sequence
  MKO10112909_B_Rhox4e
  gRNA
ccagaagacaucuggcaaga

SEQ ID NO: 112910 - RNA, 20 nt, Artificial Sequence
  MKO10112910_B_Rhox4e
  gRNA
ugugagugaaaccagaguua

SEQ ID NO: 112911 - RNA, 20 nt, Artificial Sequence
  MKO10112911_B_Rhox4f
  gRNA
gacacagacagucuuaccac

SEQ ID NO: 112912 - RNA, 20 nt, Artificial Sequence
  MKO10112912_B_Rhox4f
  gRNA
ccagaagacaucuggcaaga

SEQ ID NO: 112913 - RNA, 20 nt, Artificial Sequence
  MKO10112913_B_Rhox4f
  gRNA
ugugagugaagccagaguua

SEQ ID NO: 112914 - RNA, 20 nt, Artificial Sequence
  MKO10112914_B_Rhox4g
  gRNA
cugcuuaccuuuccucugca

SEQ ID NO: 112915 - RNA, 20 nt, Artificial Sequence
  MKO10112915_B_Rhox4g
  gRNA
ccagaagacaucuggcaaga

SEQ ID NO: 112916 - RNA, 20 nt, Artificial Sequence
  MKO10112916_B_Rhox4g
  gRNA
ugugagugaagccagaguua

SEQ ID NO: 112917 - RNA, 20 nt, Artificial Sequence
  MKO10112917_B_Rhox5
  gRNA
caucucacuccacgacaagc

SEQ ID NO: 112918 - RNA, 20 nt, Artificial Sequence
  MKO10112918_B_Rhox5
  gRNA
guuccagccgcaaggucacc

SEQ ID NO: 112919 - RNA, 20 nt, Artificial Sequence
  MKO10112919_B_Rhox5
  gRNA
ggaggaucuugauagacuga

SEQ ID NO: 112920 - RNA, 20 nt, Artificial Sequence
  MKO10112920_B_Rhox6
  gRNA
ccugcuuauagaauugguuu

SEQ ID NO: 112921 - RNA, 20 nt, Artificial Sequence
  MKO10112921_B_Rhox6
  gRNA
cugccggacucggaggcuuu

SEQ ID NO: 112922 - RNA, 20 nt, Artificial Sequence
  MKO10112922_B_Rhox6
  gRNA
uguggaugaaugugaugugc

SEQ ID NO: 112923 - RNA, 20 nt, Artificial Sequence
  MKO10112923_B_Rhox7
  gRNA
cucuguaaauccgucccgga

SEQ ID NO: 112924 - RNA, 20 nt, Artificial Sequence
  MKO10112924_B_Rhox7
  gRNA
uucagacccauccaugcuuc

SEQ ID NO: 112925 - RNA, 20 nt, Artificial Sequence
  MKO10112925_B_Rhox7
  gRNA
agaggugcuugccagaagca

SEQ ID NO: 112926 - RNA, 20 nt, Artificial Sequence
  MKO10112926_B_Rhox8
  gRNA
cuucuugagguuccauagca

SEQ ID NO: 112927 - RNA, 20 nt, Artificial Sequence
  MKO10112927_B_Rhox8
  gRNA
gcagaagggagcucgcgaga

SEQ ID NO: 112928 - RNA, 20 nt, Artificial Sequence
  MKO10112928_B_Rhox8
  gRNA
uguagaacugguuuaagagu

SEQ ID NO: 112929 - RNA, 20 nt, Artificial Sequence
  MKO10112929_B_Rhox9
  gRNA
ggagaguuguucucuguaau

SEQ ID NO: 112930 - RNA, 20 nt, Artificial Sequence
  MKO10112930_B_Rhox9
  gRNA
uguggaugaaucugaugugc

SEQ ID NO: 112931 - RNA, 20 nt, Artificial Sequence
  MKO10112931_B_Rhox9
  gRNA
cucccggacucggaggcuuu

SEQ ID NO: 112932 - RNA, 20 nt, Artificial Sequence
  MKO10112932_B_Rho
  gRNA
ggucuccgucuuggaagcgg

SEQ ID NO: 112933 - RNA, 20 nt, Artificial Sequence
  MKO10112933_B_Rho
  gRNA
cacccgcaugguuaucauca

SEQ ID NO: 112934 - RNA, 20 nt, Artificial Sequence
  MKO10112934_B_Rho
  gRNA
caugaagauggggccgaagu

SEQ ID NO: 112935 - RNA, 20 nt, Artificial Sequence
  MKO10112935_B_Rhpn1
  gRNA
ggcacuuaccuucagcggug

SEQ ID NO: 112936 - RNA, 20 nt, Artificial Sequence
  MKO10112936_B_Rhpn1
  gRNA
gcuccagugcgacuguuucu

SEQ ID NO: 112937 - RNA, 20 nt, Artificial Sequence
  MKO10112937_B_Rhpn1
  gRNA
gcugagcaccagcguagaug

SEQ ID NO: 112938 - RNA, 20 nt, Artificial Sequence
  MKO10112938_B_Rhpn2
  gRNA
cgcuuacucacucggugccc

SEQ ID NO: 112939 - RNA, 20 nt, Artificial Sequence
  MKO10112939_B_Rhpn2
  gRNA
gagauuuaccuugaagacga

SEQ ID NO: 112940 - RNA, 20 nt, Artificial Sequence
  MKO10112940_B_Rhpn2
  gRNA
uccgcauccgcacagccuuc

SEQ ID NO: 112941 - RNA, 20 nt, Artificial Sequence
  MKO10112941_B_Ribc1
  gRNA
ugcgccuagcugcugacacg

SEQ ID NO: 112942 - RNA, 20 nt, Artificial Sequence
  MKO10112942_B_Ribc1
  gRNA
ggaggaacgaaaguuucggg

SEQ ID NO: 112943 - RNA, 20 nt, Artificial Sequence
  MKO10112943_B_Ribc1
  gRNA
cagcccgcgugucagcagcu

SEQ ID NO: 112944 - RNA, 20 nt, Artificial Sequence
  MKO10112944_B_Ribc2
  gRNA
agcccgggcugaccaccuac

SEQ ID NO: 112945 - RNA, 20 nt, Artificial Sequence
  MKO10112945_B_Ribc2
  gRNA
acuugagucucgucugagug

SEQ ID NO: 112946 - RNA, 20 nt, Artificial Sequence
  MKO10112946_B_Ribc2
  gRNA
gaaagcguucaacaagaauc

SEQ ID NO: 112947 - RNA, 20 nt, Artificial Sequence
  MKO10112947_B_Ric3
  gRNA
ggccagaucauuccaaucua

SEQ ID NO: 112948 - RNA, 20 nt, Artificial Sequence
  MKO10112948_B_Ric3
  gRNA
aucaacagaguuggaccuaa

SEQ ID NO: 112949 - RNA, 20 nt, Artificial Sequence
  MKO10112949_B_Ric3
  gRNA
uaguugaacaagcucaaagu

SEQ ID NO: 112950 - RNA, 20 nt, Artificial Sequence
  MKO10112950_B_Ric8b
  gRNA
gaccuacaauuaguaaacaa

SEQ ID NO: 112951 - RNA, 20 nt, Artificial Sequence
  MKO10112951_B_Ric8b
  gRNA
aggagguccauuauggucua

SEQ ID NO: 112952 - RNA, 20 nt, Artificial Sequence
  MKO10112952_B_Ric8b
  gRNA
cgccauuguuuacuaauugu

SEQ ID NO: 112953 - RNA, 20 nt, Artificial Sequence
  MKO10112953_B_Ric8
  gRNA
uccccaggagauucaccgug

SEQ ID NO: 112954 - RNA, 20 nt, Artificial Sequence
  MKO10112954_B_Ric8
  gRNA
caccuucgaugaugcccagc

SEQ ID NO: 112955 - RNA, 20 nt, Artificial Sequence
  MKO10112955_B_Ric8
  gRNA
ucuucugcggcacugcguga

SEQ ID NO: 112956 - RNA, 20 nt, Artificial Sequence
  MKO10112956_B_Ricuor
  gRNA
uaacagcuucuuugcgauau

SEQ ID NO: 112957 - RNA, 20 nt, Artificial Sequence
  MKO10112957_B_Ricuor
  gRNA
gcgcuuagcuuuauuaaaug

SEQ ID NO: 112958 - RNA, 20 nt, Artificial Sequence
  MKO10112958_B_Ricuor
  gRNA
ccuuagugaaguuauucaga

SEQ ID NO: 112959 - RNA, 20 nt, Artificial Sequence
  MKO10112959_B_Rif1
  gRNA
uucccuaccugacaauccug

SEQ ID NO: 112960 - RNA, 20 nt, Artificial Sequence
  MKO10112960_B_Rif1
  gRNA
uauaaucccagaauuaccuc

SEQ ID NO: 112961 - RNA, 20 nt, Artificial Sequence
  MKO10112961_B_Rif1
  gRNA
cagacaaaaauguguguacc

SEQ ID NO: 112962 - RNA, 20 nt, Artificial Sequence
  MKO10112962_B_Riiad1
  gRNA
uugcuccccagauccagacu

SEQ ID NO: 112963 - RNA, 20 nt, Artificial Sequence
  MKO10112963_B_Riiad1
  gRNA
gcaaauucaagaauguuguc

SEQ ID NO: 112964 - RNA, 20 nt, Artificial Sequence
  MKO10112964_B_Riiad1
  gRNA
uuucgucccagacuauuuca

SEQ ID NO: 112965 - RNA, 20 nt, Artificial Sequence
  MKO10112965_B_Rilpl1
  gRNA
cguguggcggggugaagcac

SEQ ID NO: 112966 - RNA, 20 nt, Artificial Sequence
  MKO10112966_B_Rilpl1
  gRNA
ugacccggugccgaagguca

SEQ ID NO: 112967 - RNA, 20 nt, Artificial Sequence
  MKO10112967_B_Rilpl1
  gRNA
cggagaagcccacguccuug

SEQ ID NO: 112968 - RNA, 20 nt, Artificial Sequence
  MKO10112968_B_Rilpl2
  gRNA
cuccuucucgccguugccca

SEQ ID NO: 112969 - RNA, 20 nt, Artificial Sequence
  MKO10112969_B_Rilpl2
  gRNA
agauccacuaccaucuuguc

SEQ ID NO: 112970 - RNA, 20 nt, Artificial Sequence
  MKO10112970_B_Rilpl2
  gRNA
ucuagguaugcuucccugac

SEQ ID NO: 112971 - RNA, 20 nt, Artificial Sequence
  MKO10112971_B_Rilp
  gRNA
cuccuugagcaagaacacgu

SEQ ID NO: 112972 - RNA, 20 nt, Artificial Sequence
  MKO10112972_B_Rilp
  gRNA
cccucaccgcuucggucucu

SEQ ID NO: 112973 - RNA, 20 nt, Artificial Sequence
  MKO10112973_B_Rilp
  gRNA
aggaguuggcguacuuccag

SEQ ID NO: 112974 - RNA, 20 nt, Artificial Sequence
  MKO10112974_B_Rimbp2
  gRNA
gaaaaguuccggcaacacac

SEQ ID NO: 112975 - RNA, 20 nt, Artificial Sequence
  MKO10112975_B_Rimbp2
  gRNA
gaacacccuggacugcaugc

SEQ ID NO: 112976 - RNA, 20 nt, Artificial Sequence
  MKO10112976_B_Rimbp2
  gRNA
ugaauaccugcaugcagucc

SEQ ID NO: 112977 - RNA, 20 nt, Artificial Sequence
  MKO10112977_B_Rimbp3
  gRNA
cgcgcgcauccgccaccugc

SEQ ID NO: 112978 - RNA, 20 nt, Artificial Sequence
  MKO10112978_B_Rimbp3
  gRNA
cgcagcugagcggcgcuacg

SEQ ID NO: 112979 - RNA, 20 nt, Artificial Sequence
  MKO10112979_B_Rimbp3
  gRNA
gcugguuccucaacgauaac

SEQ ID NO: 112980 - RNA, 20 nt, Artificial Sequence
  MKO10112980_B_Rimkla
  gRNA
guuggccucacacaccguga

SEQ ID NO: 112981 - RNA, 20 nt, Artificial Sequence
  MKO10112981_B_Rimkla
  gRNA
gucuguggagcagcgcagca

SEQ ID NO: 112982 - RNA, 20 nt, Artificial Sequence
  MKO10112982_B_Rimkla
  gRNA
acagguagggcacaucaugg

SEQ ID NO: 112983 - RNA, 20 nt, Artificial Sequence
  MKO10112983_B_Rimklb
  gRNA
ggauguacgagucauuguug

SEQ ID NO: 112984 - RNA, 20 nt, Artificial Sequence
  MKO10112984_B_Rimklb
  gRNA
ucaccguaagaaaaaguauc

SEQ ID NO: 112985 - RNA, 20 nt, Artificial Sequence
  MKO10112985_B_Rimklb
  gRNA
gagcuucaugccgaauaaga

SEQ ID NO: 112986 - RNA, 20 nt, Artificial Sequence
  MKO10112986_B_Rims1
  gRNA
guacuuacaguggugguuga

SEQ ID NO: 112987 - RNA, 20 nt, Artificial Sequence
  MKO10112987_B_Rims1
  gRNA
cucuucgcugcuuggcuuuc

SEQ ID NO: 112988 - RNA, 20 nt, Artificial Sequence
  MKO10112988_B_Rims1
  gRNA
cagaaagccaagcagcgaag

SEQ ID NO: 112989 - RNA, 20 nt, Artificial Sequence
  MKO10112989_B_Rims2
  gRNA
uccucauuucgaagcccucg

SEQ ID NO: 112990 - RNA, 20 nt, Artificial Sequence
  MKO10112990_B_Rims2
  gRNA
ccaaacaugucggcuccgcu

SEQ ID NO: 112991 - RNA, 20 nt, Artificial Sequence
  MKO10112991_B_Rims2
  gRNA
agugucuuuacgcucaaaca

SEQ ID NO: 112992 - RNA, 20 nt, Artificial Sequence
  MKO10112992_B_Rims3
  gRNA
gcgucugucgccccacaauc

SEQ ID NO: 112993 - RNA, 20 nt, Artificial Sequence
  MKO10112993_B_Rims3
  gRNA
cggggccugacccccaaacc

SEQ ID NO: 112994 - RNA, 20 nt, Artificial Sequence
  MKO10112994_B_Rims3
  gRNA
cacaugccccguucuccagc

SEQ ID NO: 112995 - RNA, 20 nt, Artificial Sequence
  MKO10112995_B_Rims4
  gRNA
ggcuggcuuggcggagcguc

SEQ ID NO: 112996 - RNA, 20 nt, Artificial Sequence
  MKO10112996_B_Rims4
  gRNA
ccuggcagugucuucgagcc

SEQ ID NO: 112997 - RNA, 20 nt, Artificial Sequence
  MKO10112997_B_Rims4
  gRNA
gcuguucaugcuguccucga

SEQ ID NO: 112998 - RNA, 20 nt, Artificial Sequence
  MKO10112998_B_Rin1
  gRNA
uaucaggugugucauacagu

SEQ ID NO: 112999 - RNA, 20 nt, Artificial Sequence
  MKO10112999_B_Rin1
  gRNA
ucuguggauacugccguacc

SEQ ID NO: 113000 - RNA, 20 nt, Artificial Sequence
  MKO10113000_B_Rin1
  gRNA
acuccccagagccauucauc

SEQ ID NO: 113001 - RNA, 20 nt, Artificial Sequence
  MKO10113001_B_Rin2
  gRNA
uccugcauacccaucccaua

SEQ ID NO: 113002 - RNA, 20 nt, Artificial Sequence
  MKO10113002_B_Rin2
  gRNA
aagacauguccccgagacuc

SEQ ID NO: 113003 - RNA, 20 nt, Artificial Sequence
  MKO10113003_B_Rin2
  gRNA
caaauucacagggcaggcga

SEQ ID NO: 113004 - RNA, 20 nt, Artificial Sequence
  MKO10113004_B_Rin3
  gRNA
cacacagcaccaauugcuuc

SEQ ID NO: 113005 - RNA, 20 nt, Artificial Sequence
  MKO10113005_B_Rin3
  gRNA
uucagauguuccuggugugc

SEQ ID NO: 113006 - RNA, 20 nt, Artificial Sequence
  MKO10113006_B_Rin3
  gRNA
aggcucaguucuuguguuug

SEQ ID NO: 113007 - RNA, 20 nt, Artificial Sequence
  MKO10113007_B_Ring1
  gRNA
ccuccuguuacccgcuccgc

SEQ ID NO: 113008 - RNA, 20 nt, Artificial Sequence
  MKO10113008_B_Ring1
  gRNA
acugcaucgucaccgcccug

SEQ ID NO: 113009 - RNA, 20 nt, Artificial Sequence
  MKO10113009_B_Ring1
  gRNA
ccugcucccaagcgaccccg

SEQ ID NO: 113010 - RNA, 20 nt, Artificial Sequence
  MKO10113010_B_Rinl
  gRNA
gcucuugcccacgccuacug

SEQ ID NO: 113011 - RNA, 20 nt, Artificial Sequence
  MKO10113011_B_Rinl
  gRNA
ggggacagucgggcaugcag

SEQ ID NO: 113012 - RNA, 20 nt, Artificial Sequence
  MKO10113012_B_Rinl
  gRNA
guaccugcuggcugacagaa

SEQ ID NO: 113013 - RNA, 20 nt, Artificial Sequence
  MKO10113013_B_Rint1
  gRNA
uuuaugccagaauuuaacug

SEQ ID NO: 113014 - RNA, 20 nt, Artificial Sequence
  MKO10113014_B_Rint1
  gRNA
cuucguuucgucaccacucu

SEQ ID NO: 113015 - RNA, 20 nt, Artificial Sequence
  MKO10113015_B_Rint1
  gRNA
uucucaaggacaagcuuacc

SEQ ID NO: 113016 - RNA, 20 nt, Artificial Sequence
  MKO10113016_B_Riok1
  gRNA
cagguaucgaauuaaagaua

SEQ ID NO: 113017 - RNA, 20 nt, Artificial Sequence
  MKO10113017_B_Riok1
  gRNA
caccguaaaauugagacaaa

SEQ ID NO: 113018 - RNA, 20 nt, Artificial Sequence
  MKO10113018_B_Riok1
  gRNA
gucaauuggaguagacauuu

SEQ ID NO: 113019 - RNA, 20 nt, Artificial Sequence
  MKO10113019_B_Riok2
  gRNA
cgauuauaaucaauuggcuu

SEQ ID NO: 113020 - RNA, 20 nt, Artificial Sequence
  MKO10113020_B_Riok2
  gRNA
gucuagcugugcagggcuau

SEQ ID NO: 113021 - RNA, 20 nt, Artificial Sequence
  MKO10113021_B_Riok2
  gRNA
uacauuguugccaaugaagc

SEQ ID NO: 113022 - RNA, 20 nt, Artificial Sequence
  MKO10113022_B_Riok3
  gRNA
aguauccuguucacugaccg

SEQ ID NO: 113023 - RNA, 20 nt, Artificial Sequence
  MKO10113023_B_Riok3
  gRNA
gccaauuccuacucccaaaa

SEQ ID NO: 113024 - RNA, 20 nt, Artificial Sequence
  MKO10113024_B_Riok3
  gRNA
gagaauaugaugcacagcuu

SEQ ID NO: 113025 - RNA, 20 nt, Artificial Sequence
  MKO10113025_B_Ripk1
  gRNA
aagucggacguguacagcuu

SEQ ID NO: 113026 - RNA, 20 nt, Artificial Sequence
  MKO10113026_B_Ripk1
  gRNA
ucucccuuggacaguacuca

SEQ ID NO: 113027 - RNA, 20 nt, Artificial Sequence
  MKO10113027_B_Ripk1
  gRNA
aaauccuugaguacugucca

SEQ ID NO: 113028 - RNA, 20 nt, Artificial Sequence
  MKO10113028_B_Ripk2
  gRNA
caccaagagcaauuucaugc

SEQ ID NO: 113029 - RNA, 20 nt, Artificial Sequence
  MKO10113029_B_Ripk2
  gRNA
agcucauuuaaugauccauu

SEQ ID NO: 113030 - RNA, 20 nt, Artificial Sequence
  MKO10113030_B_Ripk2
  gRNA
guaacuaugcccaaaaauuc

SEQ ID NO: 113031 - RNA, 20 nt, Artificial Sequence
  MKO10113031_B_Ripk3
  gRNA
aggaguuaaugauucauugc

SEQ ID NO: 113032 - RNA, 20 nt, Artificial Sequence
  MKO10113032_B_Ripk3
  gRNA
acagcuuugggauccucgug

SEQ ID NO: 113033 - RNA, 20 nt, Artificial Sequence
  MKO10113033_B_Ripk3
  gRNA
auggagaauggcucccucgc

SEQ ID NO: 113034 - RNA, 20 nt, Artificial Sequence
  MKO10113034_B_Ripk4
  gRNA
caucgugcacgagacagccg

SEQ ID NO: 113035 - RNA, 20 nt, Artificial Sequence
  MKO10113035_B_Ripk4
  gRNA
cucuucucacgaauucgcuc

SEQ ID NO: 113036 - RNA, 20 nt, Artificial Sequence
  MKO10113036_B_Ripk4
  gRNA
cuggcacaggcacgcggccg

SEQ ID NO: 113037 - RNA, 20 nt, Artificial Sequence
  MKO10113037_B_Ripply1
  gRNA
gauacccccauacacacuuc

SEQ ID NO: 113038 - RNA, 20 nt, Artificial Sequence
  MKO10113038_B_Ripply1
  gRNA
gucguuuauagaggacagcc

SEQ ID NO: 113039 - RNA, 20 nt, Artificial Sequence
  MKO10113039_B_Ripply1
  gRNA
ccugcccuagcacaaaucaa

SEQ ID NO: 113040 - RNA, 20 nt, Artificial Sequence
  MKO10113040_B_Ripply2
  gRNA
auauaaguagucguaacacu

SEQ ID NO: 113041 - RNA, 20 nt, Artificial Sequence
  MKO10113041_B_Ripply2
  gRNA
ccugcagguccgagggcuuc

SEQ ID NO: 113042 - RNA, 20 nt, Artificial Sequence
  MKO10113042_B_Ripply2
  gRNA
ugcaauaccaacacccuguc

SEQ ID NO: 113043 - RNA, 20 nt, Artificial Sequence
  MKO10113043_B_Ripply3
  gRNA
ccguggaugucgccuccccc

SEQ ID NO: 113044 - RNA, 20 nt, Artificial Sequence
  MKO10113044_B_Ripply3
  gRNA
uacaacgaugacucugaguc

SEQ ID NO: 113045 - RNA, 20 nt, Artificial Sequence
  MKO10113045_B_Ripply3
  gRNA
ccaacacacaucgggaucaa

SEQ ID NO: 113046 - RNA, 20 nt, Artificial Sequence
  MKO10113046_B_Rit1
  gRNA
uggcagguucaucaucaaug

SEQ ID NO: 113047 - RNA, 20 nt, Artificial Sequence
  MKO10113047_B_Rit1
  gRNA
ugaugaugaaccugccaauc

SEQ ID NO: 113048 - RNA, 20 nt, Artificial Sequence
  MKO10113048_B_Rit1
  gRNA
gaagaccaugaccccaccau

SEQ ID NO: 113049 - RNA, 20 nt, Artificial Sequence
  MKO10113049_B_Rit2
  gRNA
gcuuagugagagaaauucgc

SEQ ID NO: 113050 - RNA, 20 nt, Artificial Sequence
  MKO10113050_B_Rit2
  gRNA
auuguggggucgugauaguc

SEQ ID NO: 113051 - RNA, 20 nt, Artificial Sequence
  MKO10113051_B_Rit2
  gRNA
guuuauaagccaccaguucc

SEQ ID NO: 113052 - RNA, 20 nt, Artificial Sequence
  MKO10113052_B_Rlbp1
  gRNA
ccaggugggcacuuuccgca

SEQ ID NO: 113053 - RNA, 20 nt, Artificial Sequence
  MKO10113053_B_Rlbp1
  gRNA
ggcucuccgcugcacuaucg

SEQ ID NO: 113054 - RNA, 20 nt, Artificial Sequence
  MKO10113054_B_Rlbp1
  gRNA
caauacagaagccguugauu

SEQ ID NO: 113055 - RNA, 20 nt, Artificial Sequence
  MKO10113055_B_Rlf
  gRNA
cagucuguaugacucuaauc

SEQ ID NO: 113056 - RNA, 20 nt, Artificial Sequence
  MKO10113056_B_Rlf
  gRNA
guuagacaucauauguaauc

SEQ ID NO: 113057 - RNA, 20 nt, Artificial Sequence
  MKO10113057_B_Rlf
  gRNA
ucuuugauagauugcaaagg

SEQ ID NO: 113058 - RNA, 20 nt, Artificial Sequence
  MKO10113058_B_Rlim
  gRNA
uucugcgcugagcugcagac

SEQ ID NO: 113059 - RNA, 20 nt, Artificial Sequence
  MKO10113059_B_Rlim
  gRNA
cagagccccgaugaaaauag

SEQ ID NO: 113060 - RNA, 20 nt, Artificial Sequence
  MKO10113060_B_Rlim
  gRNA
acuuucaggugaaaguacug

SEQ ID NO: 113061 - RNA, 20 nt, Artificial Sequence
  MKO10113061_B_Rln1
  gRNA
cgugaauugaucaaaaucug

SEQ ID NO: 113062 - RNA, 20 nt, Artificial Sequence
  MKO10113062_B_Rln1
  gRNA
acaacagaaucgcucaacac

SEQ ID NO: 113063 - RNA, 20 nt, Artificial Sequence
  MKO10113063_B_Rln1
  gRNA
gauugcaaguauuuaagccc

SEQ ID NO: 113064 - RNA, 20 nt, Artificial Sequence
  MKO10113064_B_Rln3
  gRNA
accgcagagcuucaccccgu

SEQ ID NO: 113065 - RNA, 20 nt, Artificial Sequence
  MKO10113065_B_Rln3
  gRNA
cgcaagugaagaugaccgcg

SEQ ID NO: 113066 - RNA, 20 nt, Artificial Sequence
  MKO10113066_B_Rln3
  gRNA
agcacucacccagagauucg

SEQ ID NO: 113067 - RNA, 20 nt, Artificial Sequence
  MKO10113067_B_Rltpr
  gRNA
agaucucgcccaccugaccc

SEQ ID NO: 113068 - RNA, 20 nt, Artificial Sequence
  MKO10113068_B_Rltpr
  gRNA
caaccaaguagacucuacuu

SEQ ID NO: 113069 - RNA, 20 nt, Artificial Sequence
  MKO10113069_B_Rltpr
  gRNA
ucuggauggcguccucagcc

SEQ ID NO: 113070 - RNA, 20 nt, Artificial Sequence
  MKO10113070_B_Rmdn1
  gRNA
gcagacuaccucuaugaaag

SEQ ID NO: 113071 - RNA, 20 nt, Artificial Sequence
  MKO10113071_B_Rmdn1
  gRNA
cuuaugcuuaccuuuggcug

SEQ ID NO: 113072 - RNA, 20 nt, Artificial Sequence
  MKO10113072_B_Rmdn1
  gRNA
gugguucaugccacagccaa

SEQ ID NO: 113073 - RNA, 20 nt, Artificial Sequence
  MKO10113073_B_Rmdn2
  gRNA
uagaucauacaugucuccau

SEQ ID NO: 113074 - RNA, 20 nt, Artificial Sequence
  MKO10113074_B_Rmdn2
  gRNA
aagaagcauuaugcuaauau

SEQ ID NO: 113075 - RNA, 20 nt, Artificial Sequence
  MKO10113075_B_Rmdn2
  gRNA
cagauggcaguguccauuca

SEQ ID NO: 113076 - RNA, 20 nt, Artificial Sequence
  MKO10113076_B_Rmdn3
  gRNA
gcgccgcagcgccauaagac

SEQ ID NO: 113077 - RNA, 20 nt, Artificial Sequence
  MKO10113077_B_Rmdn3
  gRNA
uacucacccucccucgcucu

SEQ ID NO: 113078 - RNA, 20 nt, Artificial Sequence
  MKO10113078_B_Rmdn3
  gRNA
gcacuuaccauuuagggcau

SEQ ID NO: 113079 - RNA, 20 nt, Artificial Sequence
  MKO10113079_B_Rmi1
  gRNA
aauguacauuugaacugcug

SEQ ID NO: 113080 - RNA, 20 nt, Artificial Sequence
  MKO10113080_B_Rmi1
  gRNA
cgcagaguacuccaaaacca

SEQ ID NO: 113081 - RNA, 20 nt, Artificial Sequence
  MKO10113081_B_Rmi1
  gRNA
gagcugagaaucucuuauga

SEQ ID NO: 113082 - RNA, 20 nt, Artificial Sequence
  MKO10113082_B_Rmi2
  gRNA
agaaagauccgucaucuuca

SEQ ID NO: 113083 - RNA, 20 nt, Artificial Sequence
  MKO10113083_B_Rmi2
  gRNA
gccaccggaggacagcgacu

SEQ ID NO: 113084 - RNA, 20 nt, Artificial Sequence
  MKO10113084_B_Rmi2
  gRNA
ggccgcgugguacgcgcucc

SEQ ID NO: 113085 - RNA, 20 nt, Artificial Sequence
  MKO10113085_B_Rmnd1
  gRNA
ccugaacaagaauauuguuc

SEQ ID NO: 113086 - RNA, 20 nt, Artificial Sequence
  MKO10113086_B_Rmnd1
  gRNA
gggaaggagcugcuguguuc

SEQ ID NO: 113087 - RNA, 20 nt, Artificial Sequence
  MKO10113087_B_Rmnd1
  gRNA
cgaaacccagcccuaugaag

SEQ ID NO: 113088 - RNA, 20 nt, Artificial Sequence
  MKO10113088_B_Rmnd5a
  gRNA
ugaccucauugagaagccgu

SEQ ID NO: 113089 - RNA, 20 nt, Artificial Sequence
  MKO10113089_B_Rmnd5a
  gRNA
caacucgagaaacacugcua

SEQ ID NO: 113090 - RNA, 20 nt, Artificial Sequence
  MKO10113090_B_Rmnd5a
  gRNA
uuugcccuaaaucaucaaaa

SEQ ID NO: 113091 - RNA, 20 nt, Artificial Sequence
  MKO10113091_B_Rmnd5b
  gRNA
ccaggaaucgacauugaaug

SEQ ID NO: 113092 - RNA, 20 nt, Artificial Sequence
  MKO10113092_B_Rmnd5b
  gRNA
cacuuuauccgccuccuagc

SEQ ID NO: 113093 - RNA, 20 nt, Artificial Sequence
  MKO10113093_B_Rmnd5b
  gRNA
cucugguguagccuagcaaa

SEQ ID NO: 113094 - RNA, 20 nt, Artificial Sequence
  MKO10113094_B_Rnase10
  gRNA
cucacagagaaggacgcucu

SEQ ID NO: 113095 - RNA, 20 nt, Artificial Sequence
  MKO10113095_B_Rnase10
  gRNA
ucugacuuacauaaccgaaa

SEQ ID NO: 113096 - RNA, 20 nt, Artificial Sequence
  MKO10113096_B_Rnase10
  gRNA
ugaucugacauugugcaaau

SEQ ID NO: 113097 - RNA, 20 nt, Artificial Sequence
  MKO10113097_B_Rnase11
  gRNA
gccugcaaggaccuugcacg

SEQ ID NO: 113098 - RNA, 20 nt, Artificial Sequence
  MKO10113098_B_Rnase11
  gRNA
cuuugcaagaagcaguccaa

SEQ ID NO: 113099 - RNA, 20 nt, Artificial Sequence
  MKO10113099_B_Rnase11
  gRNA
cgggaaugcauccugucagu

SEQ ID NO: 113100 - RNA, 20 nt, Artificial Sequence
  MKO10113100_B_Rnase12
  gRNA
gaaauuugguaccugcaggc

SEQ ID NO: 113101 - RNA, 20 nt, Artificial Sequence
  MKO10113101_B_Rnase12
  gRNA
cacaagaacaaaccccuuua

SEQ ID NO: 113102 - RNA, 20 nt, Artificial Sequence
  MKO10113102_B_Rnase12
  gRNA
cuugccccugaugguccuaa

SEQ ID NO: 113103 - RNA, 20 nt, Artificial Sequence
  MKO10113103_B_Rnase13
  gRNA
gguagucaacauguaagguu

SEQ ID NO: 113104 - RNA, 20 nt, Artificial Sequence
  MKO10113104_B_Rnase13
  gRNA
ucccuuuggguaguuaacca

SEQ ID NO: 113105 - RNA, 20 nt, Artificial Sequence
  MKO10113105_B_Rnase13
  gRNA
cugcaguuugccucucacgu

SEQ ID NO: 113106 - RNA, 20 nt, Artificial Sequence
  MKO10113106_B_Rnase1
  gRNA
gaugugcuucugguauugag

SEQ ID NO: 113107 - RNA, 20 nt, Artificial Sequence
  MKO10113107_B_Rnase1
  gRNA
guagucacaguugggauacu

SEQ ID NO: 113108 - RNA, 20 nt, Artificial Sequence
  MKO10113108_B_Rnase1
  gRNA
augacccauuugucauaucc

SEQ ID NO: 113109 - RNA, 20 nt, Artificial Sequence
  MKO10113109_B_Rnase4
  gRNA
cugucacgaagguguaguga

SEQ ID NO: 113110 - RNA, 20 nt, Artificial Sequence
  MKO10113110_B_Rnase4
  gRNA
cauucgauccuggccauagg

SEQ ID NO: 113111 - RNA, 20 nt, Artificial Sequence
  MKO10113111_B_Rnase4
  gRNA
caugcugucgaaggaaccgu

SEQ ID NO: 113112 - RNA, 20 nt, Artificial Sequence
  MKO10113112_B_Rnase6
  gRNA
ccaugcaacacagccaugcg

SEQ ID NO: 113113 - RNA, 20 nt, Artificial Sequence
  MKO10113113_B_Rnase6
  gRNA
ugagagcaaaguagauacau

SEQ ID NO: 113114 - RNA, 20 nt, Artificial Sequence
  MKO10113114_B_Rnase6
  gRNA
cccacagcucaagcagcaau

SEQ ID NO: 113115 - RNA, 20 nt, Artificial Sequence
  MKO10113115_B_Rnase9
  gRNA
caguaaucguagucauugaa

SEQ ID NO: 113116 - RNA, 20 nt, Artificial Sequence
  MKO10113116_B_Rnase9
  gRNA
aagaagcaugaaucuaaucg

SEQ ID NO: 113117 - RNA, 20 nt, Artificial Sequence
  MKO10113117_B_Rnase9
  gRNA
cagaaguacgugacuuuauu

SEQ ID NO: 113118 - RNA, 20 nt, Artificial Sequence
  MKO10113118_B_Rnaseh1
  gRNA
uuacauggaucucggcccuc

SEQ ID NO: 113119 - RNA, 20 nt, Artificial Sequence
  MKO10113119_B_Rnaseh1
  gRNA
uguggcaaauuucuuaaacc

SEQ ID NO: 113120 - RNA, 20 nt, Artificial Sequence
  MKO10113120_B_Rnaseh1
  gRNA
cugggcgacagacaaaccag

SEQ ID NO: 113121 - RNA, 20 nt, Artificial Sequence
  MKO10113121_B_Rnaseh2a
  gRNA
cgauuacaacagcacuuucc

SEQ ID NO: 113122 - RNA, 20 nt, Artificial Sequence
  MKO10113122_B_Rnaseh2a
  gRNA
guaacagauggcguagacca

SEQ ID NO: 113123 - RNA, 20 nt, Artificial Sequence
  MKO10113123_B_Rnaseh2a
  gRNA
gaggcucuuugcgaaaaugg

SEQ ID NO: 113124 - RNA, 20 nt, Artificial Sequence
  MKO10113124_B_Rnaseh2b
  gRNA
gcuccuucacuaucuccuaa

SEQ ID NO: 113125 - RNA, 20 nt, Artificial Sequence
  MKO10113125_B_Rnaseh2b
  gRNA
auaaaucaaucaguucaauc

SEQ ID NO: 113126 - RNA, 20 nt, Artificial Sequence
  MKO10113126_B_Rnaseh2b
  gRNA
cucagcagcaaggugcaauc

SEQ ID NO: 113127 - RNA, 20 nt, Artificial Sequence
  MKO10113127_B_Rnaseh2c
  gRNA
cgcuuuguccuccgcguccc

SEQ ID NO: 113128 - RNA, 20 nt, Artificial Sequence
  MKO10113128_B_Rnaseh2c
  gRNA
guauacguaccgcugcugcg

SEQ ID NO: 113129 - RNA, 20 nt, Artificial Sequence
  MKO10113129_B_Rnaseh2c
  gRNA
ccuguugcagauucacgccc

SEQ ID NO: 113130 - RNA, 20 nt, Artificial Sequence
  MKO10113130_B_Rnasek
  gRNA
caccaacaugaucacucccc

SEQ ID NO: 113131 - RNA, 20 nt, Artificial Sequence
  MKO10113131_B_Rnasek
  gRNA
uacucuuccagauaaugcuc

SEQ ID NO: 113132 - RNA, 20 nt, Artificial Sequence
  MKO10113132_B_Rnasek
  gRNA
ccauucugcuguguuaauug

SEQ ID NO: 113133 - RNA, 20 nt, Artificial Sequence
  MKO10113133_B_Rnasel
  gRNA
ucaccuacaguauccugaua

SEQ ID NO: 113134 - RNA, 20 nt, Artificial Sequence
  MKO10113134_B_Rnasel
  gRNA
ucugaucaaaaucugccagc

SEQ ID NO: 113135 - RNA, 20 nt, Artificial Sequence
  MKO10113135_B_Rnasel
  gRNA
uagauuccaagaaagcuguc

SEQ ID NO: 113136 - RNA, 20 nt, Artificial Sequence
  MKO10113136_B_Rnaset2a
  gRNA
uccaguaauccagagagucu

SEQ ID NO: 113137 - RNA, 20 nt, Artificial Sequence
  MKO10113137_B_Rnaset2a
  gRNA
cagaagauuguaaccagucc

SEQ ID NO: 113138 - RNA, 20 nt, Artificial Sequence
  MKO10113138_B_Rnaset2a
  gRNA
cucaucuaaguuaaagugcc

SEQ ID NO: 113139 - RNA, 20 nt, Artificial Sequence
  MKO10113139_B_Rnaset2b
  gRNA
uaacagcugccaagacucuc

SEQ ID NO: 113140 - RNA, 20 nt, Artificial Sequence
  MKO10113140_B_Rnaset2b
  gRNA
cucaucuaaguuaaagugcc

SEQ ID NO: 113141 - RNA, 20 nt, Artificial Sequence
  MKO10113141_B_Rnaset2b
  gRNA
cagaagauuguaaccagucc

SEQ ID NO: 113142 - RNA, 20 nt, Artificial Sequence
  MKO10113142_B_Rnd1
  gRNA
acaguuccauuagagugcuc

SEQ ID NO: 113143 - RNA, 20 nt, Artificial Sequence
  MKO10113143_B_Rnd1
  gRNA
guguaauucucaaacacggu

SEQ ID NO: 113144 - RNA, 20 nt, Artificial Sequence
  MKO10113144_B_Rnd1
  gRNA
ugagaauuacacagccuguu

SEQ ID NO: 113145 - RNA, 20 nt, Artificial Sequence
  MKO10113145_B_Rnd2
  gRNA
cucaccugcucaugugugac

SEQ ID NO: 113146 - RNA, 20 nt, Artificial Sequence
  MKO10113146_B_Rnd2
  gRNA
ucugcagaguuaugucccca

SEQ ID NO: 113147 - RNA, 20 nt, Artificial Sequence
  MKO10113147_B_Rnd2
  gRNA
acuggacaguguccucaaga

SEQ ID NO: 113148 - RNA, 20 nt, Artificial Sequence
  MKO10113148_B_Rnd3
  gRNA
ugggcugcaagucugaucug

SEQ ID NO: 113149 - RNA, 20 nt, Artificial Sequence
  MKO10113149_B_Rnd3
  gRNA
cuuaccuggucauaugacac

SEQ ID NO: 113150 - RNA, 20 nt, Artificial Sequence
  MKO10113150_B_Rnd3
  gRNA
uacuucacagggggcaaaua

SEQ ID NO: 113151 - RNA, 20 nt, Artificial Sequence
  MKO10113151_B_Rnf103
  gRNA
uucuugaagcucaaugccac

SEQ ID NO: 113152 - RNA, 20 nt, Artificial Sequence
  MKO10113152_B_Rnf103
  gRNA
ucaacuguuccagugauccc

SEQ ID NO: 113153 - RNA, 20 nt, Artificial Sequence
  MKO10113153_B_Rnf103
  gRNA
ugaacucuauucugcucuua

SEQ ID NO: 113154 - RNA, 20 nt, Artificial Sequence
  MKO10113154_B_Rnf10
  gRNA
cugcugccaccgccccuuug

SEQ ID NO: 113155 - RNA, 20 nt, Artificial Sequence
  MKO10113155_B_Rnf10
  gRNA
caacaaggagcucuuucuac

SEQ ID NO: 113156 - RNA, 20 nt, Artificial Sequence
  MKO10113156_B_Rnf10
  gRNA
augccucuauccaccuacug

SEQ ID NO: 113157 - RNA, 20 nt, Artificial Sequence
  MKO10113157_B_Rnf111
  gRNA
uaacaguagagauccuacug

SEQ ID NO: 113158 - RNA, 20 nt, Artificial Sequence
  MKO10113158_B_Rnf111
  gRNA
uuaaggucucguucaacccu

SEQ ID NO: 113159 - RNA, 20 nt, Artificial Sequence
  MKO10113159_B_Rnf111
  gRNA
uuucuucauuggcagugacc

SEQ ID NO: 113160 - RNA, 20 nt, Artificial Sequence
  MKO10113160_B_Rnf112
  gRNA
uugguacgaaucaaugccuc

SEQ ID NO: 113161 - RNA, 20 nt, Artificial Sequence
  MKO10113161_B_Rnf112
  gRNA
cgcuucacaggguucucccc

SEQ ID NO: 113162 - RNA, 20 nt, Artificial Sequence
  MKO10113162_B_Rnf112
  gRNA
ggagagcaaacgaagcuuca

SEQ ID NO: 113163 - RNA, 20 nt, Artificial Sequence
  MKO10113163_B_Rnf113a1
  gRNA
uagacgacgccgagacccuc

SEQ ID NO: 113164 - RNA, 20 nt, Artificial Sequence
  MKO10113164_B_Rnf113a1
  gRNA
cucgcuacucaagccgccau

SEQ ID NO: 113165 - RNA, 20 nt, Artificial Sequence
  MKO10113165_B_Rnf113a1
  gRNA
aucuacgugccaccgugcgc

SEQ ID NO: 113166 - RNA, 20 nt, Artificial Sequence
  MKO10113166_B_Rnf113a2
  gRNA
ggccacagcaguuuacgagu

SEQ ID NO: 113167 - RNA, 20 nt, Artificial Sequence
  MKO10113167_B_Rnf113a2
  gRNA
aucuacgcgcuacugugcgc

SEQ ID NO: 113168 - RNA, 20 nt, Artificial Sequence
  MKO10113168_B_Rnf113a2
  gRNA
auccgugcuuguaaucugaa

SEQ ID NO: 113169 - RNA, 20 nt, Artificial Sequence
  MKO10113169_B_Rnf114
  gRNA
acucaccacaaaagugucgu

SEQ ID NO: 113170 - RNA, 20 nt, Artificial Sequence
  MKO10113170_B_Rnf114
  gRNA
auuuggaacaugacgucaca

SEQ ID NO: 113171 - RNA, 20 nt, Artificial Sequence
  MKO10113171_B_Rnf114
  gRNA
ugucgcagcgcucuggcacc

SEQ ID NO: 113172 - RNA, 20 nt, Artificial Sequence
  MKO10113172_B_Rnf115
  gRNA
aauaaagccugagucacauc

SEQ ID NO: 113173 - RNA, 20 nt, Artificial Sequence
  MKO10113173_B_Rnf115
  gRNA
uuugcaaauucugccauucc

SEQ ID NO: 113174 - RNA, 20 nt, Artificial Sequence
  MKO10113174_B_Rnf115
  gRNA
auaugucccagaugugacuc

SEQ ID NO: 113175 - RNA, 20 nt, Artificial Sequence
  MKO10113175_B_Rnf11
  gRNA
auccgacaccuagccagacu

SEQ ID NO: 113176 - RNA, 20 nt, Artificial Sequence
  MKO10113176_B_Rnf11
  gRNA
cuuauacagcaucugccuaa

SEQ ID NO: 113177 - RNA, 20 nt, Artificial Sequence
  MKO10113177_B_Rnf11
  gRNA
accagucaucuauacagucc

SEQ ID NO: 113178 - RNA, 20 nt, Artificial Sequence
  MKO10113178_B_Rnf121
  gRNA
cuugggguugucuguacuag

SEQ ID NO: 113179 - RNA, 20 nt, Artificial Sequence
  MKO10113179_B_Rnf121
  gRNA
gcugucauguuuacccucuu

SEQ ID NO: 113180 - RNA, 20 nt, Artificial Sequence
  MKO10113180_B_Rnf121
  gRNA
cauguagccaacaaugccag

SEQ ID NO: 113181 - RNA, 20 nt, Artificial Sequence
  MKO10113181_B_Rnf122
  gRNA
cguaucgcucgcucugagcc

SEQ ID NO: 113182 - RNA, 20 nt, Artificial Sequence
  MKO10113182_B_Rnf122
  gRNA
gcagaccugugcaguuugcc

SEQ ID NO: 113183 - RNA, 20 nt, Artificial Sequence
  MKO10113183_B_Rnf122
  gRNA
ccuuccccucaauaucuaca

SEQ ID NO: 113184 - RNA, 20 nt, Artificial Sequence
  MKO10113184_B_Rnf123
  gRNA
gugauuggacacagcaacuu

SEQ ID NO: 113185 - RNA, 20 nt, Artificial Sequence
  MKO10113185_B_Rnf123
  gRNA
cccuucccaggacaaguuga

SEQ ID NO: 113186 - RNA, 20 nt, Artificial Sequence
  MKO10113186_B_Rnf123
  gRNA
ucuaccacauguguguacaa

SEQ ID NO: 113187 - RNA, 20 nt, Artificial Sequence
  MKO10113187_B_Rnf125
  gRNA
gaaagcccaaguaccuucaa

SEQ ID NO: 113188 - RNA, 20 nt, Artificial Sequence
  MKO10113188_B_Rnf125
  gRNA
cgggccuccuuucugaucug

SEQ ID NO: 113189 - RNA, 20 nt, Artificial Sequence
  MKO10113189_B_Rnf125
  gRNA
uccaguucccgcugacaaaa

SEQ ID NO: 113190 - RNA, 20 nt, Artificial Sequence
  MKO10113190_B_Rnf126
  gRNA
aucauccagcagcucgugaa

SEQ ID NO: 113191 - RNA, 20 nt, Artificial Sequence
  MKO10113191_B_Rnf126
  gRNA
cagcccccaccgaccagaac

SEQ ID NO: 113192 - RNA, 20 nt, Artificial Sequence
  MKO10113192_B_Rnf126
  gRNA
ugaugccauucacgagcugc

SEQ ID NO: 113193 - RNA, 20 nt, Artificial Sequence
  MKO10113193_B_Rnf128
  gRNA
augaaacuuacuugcagguu

SEQ ID NO: 113194 - RNA, 20 nt, Artificial Sequence
  MKO10113194_B_Rnf128
  gRNA
acagcacagcuaucuccauc

SEQ ID NO: 113195 - RNA, 20 nt, Artificial Sequence
  MKO10113195_B_Rnf128
  gRNA
uuuauuacagaggcaguuaa

SEQ ID NO: 113196 - RNA, 20 nt, Artificial Sequence
  MKO10113196_B_Rnf130
  gRNA
ucccuccuaauaucaaacag

SEQ ID NO: 113197 - RNA, 20 nt, Artificial Sequence
  MKO10113197_B_Rnf130
  gRNA
ugaugauuauuucuucagcg

SEQ ID NO: 113198 - RNA, 20 nt, Artificial Sequence
  MKO10113198_B_Rnf130
  gRNA
ucuaguugucaauuuacuga

SEQ ID NO: 113199 - RNA, 20 nt, Artificial Sequence
  MKO10113199_B_Rnf133
  gRNA
guacgcaguccaaacugcac

SEQ ID NO: 113200 - RNA, 20 nt, Artificial Sequence
  MKO10113200_B_Rnf133
  gRNA
gacaucguuguaguuaugau

SEQ ID NO: 113201 - RNA, 20 nt, Artificial Sequence
  MKO10113201_B_Rnf133
  gRNA
auccucuucagaccaguacu

SEQ ID NO: 113202 - RNA, 20 nt, Artificial Sequence
  MKO10113202_B_Rnf135
  gRNA
aaguaccacaaacguuaucc

SEQ ID NO: 113203 - RNA, 20 nt, Artificial Sequence
  MKO10113203_B_Rnf135
  gRNA
gcccccuagagagcgaguuc

SEQ ID NO: 113204 - RNA, 20 nt, Artificial Sequence
  MKO10113204_B_Rnf135
  gRNA
aaacugcaagggaguguccc

SEQ ID NO: 113205 - RNA, 20 nt, Artificial Sequence
  MKO10113205_B_Rnf138rt1
  gRNA
gagcaucacccgucauucgc

SEQ ID NO: 113206 - RNA, 20 nt, Artificial Sequence
  MKO10113206_B_Rnf138rt1
  gRNA
uacgauagaguucaacgcgc

SEQ ID NO: 113207 - RNA, 20 nt, Artificial Sequence
  MKO10113207_B_Rnf138rt1
  gRNA
gcuugacccaaagcgcugcu

SEQ ID NO: 113208 - RNA, 20 nt, Artificial Sequence
  MKO10113208_B_Rnf138
  gRNA
aggugcucaagacgccggug

SEQ ID NO: 113209 - RNA, 20 nt, Artificial Sequence
  MKO10113209_B_Rnf138
  gRNA
caaaucuuguaagaaguauc

SEQ ID NO: 113210 - RNA, 20 nt, Artificial Sequence
  MKO10113210_B_Rnf138
  gRNA
agauuucucaagauucagua

SEQ ID NO: 113211 - RNA, 20 nt, Artificial Sequence
  MKO10113211_B_Rnf139
  gRNA
acuacgauuccagccaaagc

SEQ ID NO: 113212 - RNA, 20 nt, Artificial Sequence
  MKO10113212_B_Rnf139
  gRNA
gcacugagcgacauuaauac

SEQ ID NO: 113213 - RNA, 20 nt, Artificial Sequence
  MKO10113213_B_Rnf139
  gRNA
aucgaguugcuuccucggaa

SEQ ID NO: 113214 - RNA, 20 nt, Artificial Sequence
  MKO10113214_B_Rnf13
  gRNA
cucugaugaccugauuagca

SEQ ID NO: 113215 - RNA, 20 nt, Artificial Sequence
  MKO10113215_B_Rnf13
  gRNA
cucaccuuuaagccuucagc

SEQ ID NO: 113216 - RNA, 20 nt, Artificial Sequence
  MKO10113216_B_Rnf13
  gRNA
gacauuccgucugucuuuau

SEQ ID NO: 113217 - RNA, 20 nt, Artificial Sequence
  MKO10113217_B_Rnf141
  gRNA
gccugaugagaacccauccu

SEQ ID NO: 113218 - RNA, 20 nt, Artificial Sequence
  MKO10113218_B_Rnf141
  gRNA
cucuuucagaacugcuaagg

SEQ ID NO: 113219 - RNA, 20 nt, Artificial Sequence
  MKO10113219_B_Rnf141
  gRNA
ggugaagcagcugacugaug

SEQ ID NO: 113220 - RNA, 20 nt, Artificial Sequence
  MKO10113220_B_Rnf144a
  gRNA
guugagcucuugaucaaaga

SEQ ID NO: 113221 - RNA, 20 nt, Artificial Sequence
  MKO10113221_B_Rnf144a
  gRNA
agagcucaacauacuguuuc

SEQ ID NO: 113222 - RNA, 20 nt, Artificial Sequence
  MKO10113222_B_Rnf144a
  gRNA
aaugugaugggcauggucuc

SEQ ID NO: 113223 - RNA, 20 nt, Artificial Sequence
  MKO10113223_B_Rnf144b
  gRNA
caugcucuggcaucgccgac

SEQ ID NO: 113224 - RNA, 20 nt, Artificial Sequence
  MKO10113224_B_Rnf144b
  gRNA
ugguuuaggcacaccauguc

SEQ ID NO: 113225 - RNA, 20 nt, Artificial Sequence
  MKO10113225_B_Rnf144b
  gRNA
augaguuucagcuguaucag

SEQ ID NO: 113226 - RNA, 20 nt, Artificial Sequence
  MKO10113226_B_Rnf145
  gRNA
acuggaggcagugcugaacg

SEQ ID NO: 113227 - RNA, 20 nt, Artificial Sequence
  MKO10113227_B_Rnf145
  gRNA
uaagagccaaguauuuguac

SEQ ID NO: 113228 - RNA, 20 nt, Artificial Sequence
  MKO10113228_B_Rnf145
  gRNA
cgcuuuaccacagccuuaau

SEQ ID NO: 113229 - RNA, 20 nt, Artificial Sequence
  MKO10113229_B_Rnf146
  gRNA
caguuccugaucggucugac

SEQ ID NO: 113230 - RNA, 20 nt, Artificial Sequence
  MKO10113230_B_Rnf146
  gRNA
aacugaccgaucaguugcag

SEQ ID NO: 113231 - RNA, 20 nt, Artificial Sequence
  MKO10113231_B_Rnf146
  gRNA
auagcugaacggagucacag

SEQ ID NO: 113232 - RNA, 20 nt, Artificial Sequence
  MKO10113232_B_Rnf148
  gRNA
gugaucaucuauaacuaucc

SEQ ID NO: 113233 - RNA, 20 nt, Artificial Sequence
  MKO10113233_B_Rnf148
  gRNA
ugcagccuccccuuucgaug

SEQ ID NO: 113234 - RNA, 20 nt, Artificial Sequence
  MKO10113234_B_Rnf148
  gRNA
ggugccgugguacuuccuga

SEQ ID NO: 113235 - RNA, 20 nt, Artificial Sequence
  MKO10113235_B_Rnf149
  gRNA
ccuccccaagaaucauagga

SEQ ID NO: 113236 - RNA, 20 nt, Artificial Sequence
  MKO10113236_B_Rnf149
  gRNA
guaaaaaugcggauagagau

SEQ ID NO: 113237 - RNA, 20 nt, Artificial Sequence
  MKO10113237_B_Rnf149
  gRNA
ccucuacacacugugaagca

SEQ ID NO: 113238 - RNA, 20 nt, Artificial Sequence
  MKO10113238_B_Rnf14
  gRNA
cagauagccaugguaccacc

SEQ ID NO: 113239 - RNA, 20 nt, Artificial Sequence
  MKO10113239_B_Rnf14
  gRNA
ugcaacaagaugacuugcac

SEQ ID NO: 113240 - RNA, 20 nt, Artificial Sequence
  MKO10113240_B_Rnf14
  gRNA
cugagucuccaugcuuuaac

SEQ ID NO: 113241 - RNA, 20 nt, Artificial Sequence
  MKO10113241_B_Rnf150
  gRNA
gcacuacucaccggcagggc

SEQ ID NO: 113242 - RNA, 20 nt, Artificial Sequence
  MKO10113242_B_Rnf150
  gRNA
ggugcgauggucuagaagcc

SEQ ID NO: 113243 - RNA, 20 nt, Artificial Sequence
  MKO10113243_B_Rnf150
  gRNA
cugugcuuaccgggaucccu

SEQ ID NO: 113244 - RNA, 20 nt, Artificial Sequence
  MKO10113244_B_Rnf151
  gRNA
uuggccucuugagaacccca

SEQ ID NO: 113245 - RNA, 20 nt, Artificial Sequence
  MKO10113245_B_Rnf151
  gRNA
ucuguaaaaagugcaucuuc

SEQ ID NO: 113246 - RNA, 20 nt, Artificial Sequence
  MKO10113246_B_Rnf151
  gRNA
aauaaacuccgaaaaaccau

SEQ ID NO: 113247 - RNA, 20 nt, Artificial Sequence
  MKO10113247_B_Rnf152
  gRNA
gaguguacgcuccuuagaga

SEQ ID NO: 113248 - RNA, 20 nt, Artificial Sequence
  MKO10113248_B_Rnf152
  gRNA
aggcggcagcccaugucucc

SEQ ID NO: 113249 - RNA, 20 nt, Artificial Sequence
  MKO10113249_B_Rnf152
  gRNA
agcauguagcacccauugcu

SEQ ID NO: 113250 - RNA, 20 nt, Artificial Sequence
  MKO10113250_B_Rnf157
  gRNA
gagaccgugcacuacaagcg

SEQ ID NO: 113251 - RNA, 20 nt, Artificial Sequence
  MKO10113251_B_Rnf157
  gRNA
cucaguggccugguaguaga

SEQ ID NO: 113252 - RNA, 20 nt, Artificial Sequence
  MKO10113252_B_Rnf157
  gRNA
uacccgggcaucugugucaa

SEQ ID NO: 113253 - RNA, 20 nt, Artificial Sequence
  MKO10113253_B_Rnf165
  gRNA
auagcucucccgaacagcag

SEQ ID NO: 113254 - RNA, 20 nt, Artificial Sequence
  MKO10113254_B_Rnf165
  gRNA
cucgggaaguggugcauucg

SEQ ID NO: 113255 - RNA, 20 nt, Artificial Sequence
  MKO10113255_B_Rnf165
  gRNA
aaggguaguuucgaauuuca

SEQ ID NO: 113256 - RNA, 20 nt, Artificial Sequence
  MKO10113256_B_Rnf166
  gRNA
cugucgggguugcaacaaga

SEQ ID NO: 113257 - RNA, 20 nt, Artificial Sequence
  MKO10113257_B_Rnf166
  gRNA
ccgcugcucaccacacgguu

SEQ ID NO: 113258 - RNA, 20 nt, Artificial Sequence
  MKO10113258_B_Rnf166
  gRNA
gcaccacagggacgaauuug

SEQ ID NO: 113259 - RNA, 20 nt, Artificial Sequence
  MKO10113259_B_Rnf167
  gRNA
uuagguccuaaaugcucaga

SEQ ID NO: 113260 - RNA, 20 nt, Artificial Sequence
  MKO10113260_B_Rnf167
  gRNA
accccuucucguagacaaaa

SEQ ID NO: 113261 - RNA, 20 nt, Artificial Sequence
  MKO10113261_B_Rnf167
  gRNA
auaaagacugacccauugac

SEQ ID NO: 113262 - RNA, 20 nt, Artificial Sequence
  MKO10113262_B_Rnf168
  gRNA
uugucaccuaaguugaagcc

SEQ ID NO: 113263 - RNA, 20 nt, Artificial Sequence
  MKO10113263_B_Rnf168
  gRNA
aagcucagccuuacaugcca

SEQ ID NO: 113264 - RNA, 20 nt, Artificial Sequence
  MKO10113264_B_Rnf168
  gRNA
gcugagaggcgaugaagaac

SEQ ID NO: 113265 - RNA, 20 nt, Artificial Sequence
  MKO10113265_B_Rnf169
  gRNA
ucagauacacaagcuacugc

SEQ ID NO: 113266 - RNA, 20 nt, Artificial Sequence
  MKO10113266_B_Rnf169
  gRNA
agcuccgcccaacagagcca

SEQ ID NO: 113267 - RNA, 20 nt, Artificial Sequence
  MKO10113267_B_Rnf169
  gRNA
gccaaucaaguuaagcaagc

SEQ ID NO: 113268 - RNA, 20 nt, Artificial Sequence
  MKO10113268_B_Rnf170
  gRNA
cucuccuguaugcacuucuc

SEQ ID NO: 113269 - RNA, 20 nt, Artificial Sequence
  MKO10113269_B_Rnf170
  gRNA
gaacauccauccagaaaacc

SEQ ID NO: 113270 - RNA, 20 nt, Artificial Sequence
  MKO10113270_B_Rnf170
  gRNA
uguccacaguuuguuucaac

SEQ ID NO: 113271 - RNA, 20 nt, Artificial Sequence
  MKO10113271_B_Rnf17
  gRNA
uauauucuugaggugcuaac

SEQ ID NO: 113272 - RNA, 20 nt, Artificial Sequence
  MKO10113272_B_Rnf17
  gRNA
aacauucauccuccauacau

SEQ ID NO: 113273 - RNA, 20 nt, Artificial Sequence
  MKO10113273_B_Rnf17
  gRNA
gaugaagcacugaagauagc

SEQ ID NO: 113274 - RNA, 20 nt, Artificial Sequence
  MKO10113274_B_Rnf180
  gRNA
caugaauguagacgcccuuc

SEQ ID NO: 113275 - RNA, 20 nt, Artificial Sequence
  MKO10113275_B_Rnf180
  gRNA
cgucuacauucaugugccac

SEQ ID NO: 113276 - RNA, 20 nt, Artificial Sequence
  MKO10113276_B_Rnf180
  gRNA
ugucuuuggccagaguucgu

SEQ ID NO: 113277 - RNA, 20 nt, Artificial Sequence
  MKO10113277_B_Rnf181
  gRNA
gcagcucauggcggcacaga

SEQ ID NO: 113278 - RNA, 20 nt, Artificial Sequence
  MKO10113278_B_Rnf181
  gRNA
accgaguaccuuacuuagcc

SEQ ID NO: 113279 - RNA, 20 nt, Artificial Sequence
  MKO10113279_B_Rnf181
  gRNA
caagugccccgugugccuuu

SEQ ID NO: 113280 - RNA, 20 nt, Artificial Sequence
  MKO10113280_B_Rnf182
  gRNA
gguggugacagagucgaaac

SEQ ID NO: 113281 - RNA, 20 nt, Artificial Sequence
  MKO10113281_B_Rnf182
  gRNA
cuuacacucgagcucauccg

SEQ ID NO: 113282 - RNA, 20 nt, Artificial Sequence
  MKO10113282_B_Rnf182
  gRNA
gaaauucaugacaaacgcau

SEQ ID NO: 113283 - RNA, 20 nt, Artificial Sequence
  MKO10113283_B_Rnf183
  gRNA
guguccgcaacccucacuuc

SEQ ID NO: 113284 - RNA, 20 nt, Artificial Sequence
  MKO10113284_B_Rnf183
  gRNA
augggcaccggccugguguc

SEQ ID NO: 113285 - RNA, 20 nt, Artificial Sequence
  MKO10113285_B_Rnf183
  gRNA
cugucgucagcccaccgugc

SEQ ID NO: 113286 - RNA, 20 nt, Artificial Sequence
  MKO10113286_B_Rnf185
  gRNA
ggccucuggccuugaggacg

SEQ ID NO: 113287 - RNA, 20 nt, Artificial Sequence
  MKO10113287_B_Rnf185
  gRNA
aagacuccuccucguccuca

SEQ ID NO: 113288 - RNA, 20 nt, Artificial Sequence
  MKO10113288_B_Rnf185
  gRNA
cagugcugccucugccauag

SEQ ID NO: 113289 - RNA, 20 nt, Artificial Sequence
  MKO10113289_B_Rnf186
  gRNA
ccccuguccgcugugccgaa

SEQ ID NO: 113290 - RNA, 20 nt, Artificial Sequence
  MKO10113290_B_Rnf186
  gRNA
gugucaaccguguagcugcc

SEQ ID NO: 113291 - RNA, 20 nt, Artificial Sequence
  MKO10113291_B_Rnf186
  gRNA
cauccgcaugcgacauccac

SEQ ID NO: 113292 - RNA, 20 nt, Artificial Sequence
  MKO10113292_B_Rnf187
  gRNA
ccggaagcgaucugccgggu

SEQ ID NO: 113293 - RNA, 20 nt, Artificial Sequence
  MKO10113293_B_Rnf187
  gRNA
ccucaacuugacucgcaggu

SEQ ID NO: 113294 - RNA, 20 nt, Artificial Sequence
  MKO10113294_B_Rnf187
  gRNA
cccaccugcgagucaaguug

SEQ ID NO: 113295 - RNA, 20 nt, Artificial Sequence
  MKO10113295_B_Rnf19a
  gRNA
aagauucauaaucgcuauga

SEQ ID NO: 113296 - RNA, 20 nt, Artificial Sequence
  MKO10113296_B_Rnf19a
  gRNA
uuccugucgagcagcaucac

SEQ ID NO: 113297 - RNA, 20 nt, Artificial Sequence
  MKO10113297_B_Rnf19a
  gRNA
ucuccgauuuacauuaucua

SEQ ID NO: 113298 - RNA, 20 nt, Artificial Sequence
  MKO10113298_B_Rnf19b
  gRNA
guaaucgcugcuguuagcgu

SEQ ID NO: 113299 - RNA, 20 nt, Artificial Sequence
  MKO10113299_B_Rnf19b
  gRNA
gccauaucgcaggucugguu

SEQ ID NO: 113300 - RNA, 20 nt, Artificial Sequence
  MKO10113300_B_Rnf19b
  gRNA
acgcuaacagcagcgauuac

SEQ ID NO: 113301 - RNA, 20 nt, Artificial Sequence
  MKO10113301_B_Rnf207
  gRNA
ucccaguggccucccgccag

SEQ ID NO: 113302 - RNA, 20 nt, Artificial Sequence
  MKO10113302_B_Rnf207
  gRNA
gcacagcagcgacuucuugu

SEQ ID NO: 113303 - RNA, 20 nt, Artificial Sequence
  MKO10113303_B_Rnf207
  gRNA
ugcugugcauccgcugcuuu

SEQ ID NO: 113304 - RNA, 20 nt, Artificial Sequence
  MKO10113304_B_Rnf208
  gRNA
gccucugcaccuucaucguc

SEQ ID NO: 113305 - RNA, 20 nt, Artificial Sequence
  MKO10113305_B_Rnf208
  gRNA
cagauaguggguuccgcaca

SEQ ID NO: 113306 - RNA, 20 nt, Artificial Sequence
  MKO10113306_B_Rnf208
  gRNA
cagaccuuccggcaguacug

SEQ ID NO: 113307 - RNA, 20 nt, Artificial Sequence
  MKO10113307_B_Rnf20
  gRNA
uuaucccggaaacugaacag

SEQ ID NO: 113308 - RNA, 20 nt, Artificial Sequence
  MKO10113308_B_Rnf20
  gRNA
uagcuaccuggcuccaguac

SEQ ID NO: 113309 - RNA, 20 nt, Artificial Sequence
  MKO10113309_B_Rnf20
  gRNA
aacugcuagccaaaguagca

SEQ ID NO: 113310 - RNA, 20 nt, Artificial Sequence
  MKO10113310_B_Rnf214
  gRNA
gcuucucgauuucagcuuuc

SEQ ID NO: 113311 - RNA, 20 nt, Artificial Sequence
  MKO10113311_B_Rnf214
  gRNA
cuuuauggucacauccugaa

SEQ ID NO: 113312 - RNA, 20 nt, Artificial Sequence
  MKO10113312_B_Rnf214
  gRNA
aagaaguccuggacaagcag

SEQ ID NO: 113313 - RNA, 20 nt, Artificial Sequence
  MKO10113313_B_Rnf215
  gRNA
cguuacacagauggaugucg

SEQ ID NO: 113314 - RNA, 20 nt, Artificial Sequence
  MKO10113314_B_Rnf215
  gRNA
ccucaucuuaaaccacagug

SEQ ID NO: 113315 - RNA, 20 nt, Artificial Sequence
  MKO10113315_B_Rnf215
  gRNA
cuccaaugucaccaagcugu

SEQ ID NO: 113316 - RNA, 20 nt, Artificial Sequence
  MKO10113316_B_Rnf216
  gRNA
auaagccggucuucucucuu

SEQ ID NO: 113317 - RNA, 20 nt, Artificial Sequence
  MKO10113317_B_Rnf216
  gRNA
acauauccacuugcuacauc

SEQ ID NO: 113318 - RNA, 20 nt, Artificial Sequence
  MKO10113318_B_Rnf216
  gRNA
cauaucugacuccucugaug

SEQ ID NO: 113319 - RNA, 20 nt, Artificial Sequence
  MKO10113319_B_Rnf217
  gRNA
cacagaguguuucgaauucc

SEQ ID NO: 113320 - RNA, 20 nt, Artificial Sequence
  MKO10113320_B_Rnf217
  gRNA
cauuuaagaagauuaguucg

SEQ ID NO: 113321 - RNA, 20 nt, Artificial Sequence
  MKO10113321_B_Rnf217
  gRNA
auguguggucuccgaaaaac

SEQ ID NO: 113322 - RNA, 20 nt, Artificial Sequence
  MKO10113322_B_Rnf219
  gRNA
ugguuguuggugcauacgac

SEQ ID NO: 113323 - RNA, 20 nt, Artificial Sequence
  MKO10113323_B_Rnf219
  gRNA
gcaggugcuuccugaccgua

SEQ ID NO: 113324 - RNA, 20 nt, Artificial Sequence
  MKO10113324_B_Rnf219
  gRNA
uuccacucuacuacugaguc

SEQ ID NO: 113325 - RNA, 20 nt, Artificial Sequence
  MKO10113325_B_Rnf220
  gRNA
cagcgaguugcaggaacaua

SEQ ID NO: 113326 - RNA, 20 nt, Artificial Sequence
  MKO10113326_B_Rnf220
  gRNA
ccaccuaccuugggggugcc

SEQ ID NO: 113327 - RNA, 20 nt, Artificial Sequence
  MKO10113327_B_Rnf220
  gRNA
uccuccguggcagaagagug

SEQ ID NO: 113328 - RNA, 20 nt, Artificial Sequence
  MKO10113328_B_Rnf222
  gRNA
uccacgcccucaccagaccg

SEQ ID NO: 113329 - RNA, 20 nt, Artificial Sequence
  MKO10113329_B_Rnf222
  gRNA
guaccugcucucuacccgag

SEQ ID NO: 113330 - RNA, 20 nt, Artificial Sequence
  MKO10113330_B_Rnf222
  gRNA
uccgcggucuggugagggcg

SEQ ID NO: 113331 - RNA, 20 nt, Artificial Sequence
  MKO10113331_B_Rnf223
  gRNA
cucgcugcugggcgcgcuuu

SEQ ID NO: 113332 - RNA, 20 nt, Artificial Sequence
  MKO10113332_B_Rnf223
  gRNA
agggacgcuggucgggugcc

SEQ ID NO: 113333 - RNA, 20 nt, Artificial Sequence
  MKO10113333_B_Rnf223
  gRNA
cccacaaccgugccugucgc

SEQ ID NO: 113334 - RNA, 20 nt, Artificial Sequence
  MKO10113334_B_Rnf24
  gRNA
caaauacccaguucaucucu

SEQ ID NO: 113335 - RNA, 20 nt, Artificial Sequence
  MKO10113335_B_Rnf24
  gRNA
aaaagaacuuaaucuacaug

SEQ ID NO: 113336 - RNA, 20 nt, Artificial Sequence
  MKO10113336_B_Rnf24
  gRNA
ucugcaggugccuuguuaag

SEQ ID NO: 113337 - RNA, 20 nt, Artificial Sequence
  MKO10113337_B_Rnf25
  gRNA
aguauuagagucuaucuauc

SEQ ID NO: 113338 - RNA, 20 nt, Artificial Sequence
  MKO10113338_B_Rnf25
  gRNA
caugcucuaugaacucauug

SEQ ID NO: 113339 - RNA, 20 nt, Artificial Sequence
  MKO10113339_B_Rnf25
  gRNA
ucugcacccugccaccgcag

SEQ ID NO: 113340 - RNA, 20 nt, Artificial Sequence
  MKO10113340_B_Rnf26
  gRNA
ggcccugugggaugcuguaa

SEQ ID NO: 113341 - RNA, 20 nt, Artificial Sequence
  MKO10113341_B_Rnf26
  gRNA
aguugcgaugguaaacaggg

SEQ ID NO: 113342 - RNA, 20 nt, Artificial Sequence
  MKO10113342_B_Rnf26
  gRNA
agaaguucugagugcugaug

SEQ ID NO: 113343 - RNA, 20 nt, Artificial Sequence
  MKO10113343_B_Rnf2
  gRNA
ugaucacuuauccaaguauc

SEQ ID NO: 113344 - RNA, 20 nt, Artificial Sequence
  MKO10113344_B_Rnf2
  gRNA
ucucagccacagcaucgagg

SEQ ID NO: 113345 - RNA, 20 nt, Artificial Sequence
  MKO10113345_B_Rnf2
  gRNA
acucacggugaacuggccac

SEQ ID NO: 113346 - RNA, 20 nt, Artificial Sequence
  MKO10113346_B_Rnf31
  gRNA
auccaccgugcugcgaaaga

SEQ ID NO: 113347 - RNA, 20 nt, Artificial Sequence
  MKO10113347_B_Rnf31
  gRNA
caacgcucucucuuagcagc

SEQ ID NO: 113348 - RNA, 20 nt, Artificial Sequence
  MKO10113348_B_Rnf31
  gRNA
cuaagagagagcguugaaga

SEQ ID NO: 113349 - RNA, 20 nt, Artificial Sequence
  MKO10113349_B_Rnf32
  gRNA
guaucacucuuguuugauau

SEQ ID NO: 113350 - RNA, 20 nt, Artificial Sequence
  MKO10113350_B_Rnf32
  gRNA
ucagaguaaagugugccacc

SEQ ID NO: 113351 - RNA, 20 nt, Artificial Sequence
  MKO10113351_B_Rnf32
  gRNA
guggcaagaggccuaguuuc

SEQ ID NO: 113352 - RNA, 20 nt, Artificial Sequence
  MKO10113352_B_Rnf34
  gRNA
aggcgggugcuacuucuaug

SEQ ID NO: 113353 - RNA, 20 nt, Artificial Sequence
  MKO10113353_B_Rnf34
  gRNA
gaugagugugcgccagcuga

SEQ ID NO: 113354 - RNA, 20 nt, Artificial Sequence
  MKO10113354_B_Rnf34
  gRNA
uggagcuguccgaggccagc

SEQ ID NO: 113355 - RNA, 20 nt, Artificial Sequence
  MKO10113355_B_Rnf38
  gRNA
aggggcgggaacgcagcaua

SEQ ID NO: 113356 - RNA, 20 nt, Artificial Sequence
  MKO10113356_B_Rnf38
  gRNA
ccucaccaccaaugcgacca

SEQ ID NO: 113357 - RNA, 20 nt, Artificial Sequence
  MKO10113357_B_Rnf38
  gRNA
ccgaucgugacugcuguguu

SEQ ID NO: 113358 - RNA, 20 nt, Artificial Sequence
  MKO10113358_B_Rnf39
  gRNA
aggcgccuuaccucuccgug

SEQ ID NO: 113359 - RNA, 20 nt, Artificial Sequence
  MKO10113359_B_Rnf39
  gRNA
ucucccugaagauuaccccg

SEQ ID NO: 113360 - RNA, 20 nt, Artificial Sequence
  MKO10113360_B_Rnf39
  gRNA
acccaagccaucuaacucag

SEQ ID NO: 113361 - RNA, 20 nt, Artificial Sequence
  MKO10113361_B_Rnf40
  gRNA
guucuuccaccugccguugc

SEQ ID NO: 113362 - RNA, 20 nt, Artificial Sequence
  MKO10113362_B_Rnf40
  gRNA
uccucaucgucaaccgcuac

SEQ ID NO: 113363 - RNA, 20 nt, Artificial Sequence
  MKO10113363_B_Rnf40
  gRNA
gugaucccucgaccagaccc

SEQ ID NO: 113364 - RNA, 20 nt, Artificial Sequence
  MKO10113364_B_Rnf41
  gRNA
cauuaagcaccugcgcuccg

SEQ ID NO: 113365 - RNA, 20 nt, Artificial Sequence
  MKO10113365_B_Rnf41
  gRNA
cucucagcagcagacguguc

SEQ ID NO: 113366 - RNA, 20 nt, Artificial Sequence
  MKO10113366_B_Rnf41
  gRNA
acugugagcacaacccgaag

SEQ ID NO: 113367 - RNA, 20 nt, Artificial Sequence
  MKO10113367_B_Rnf43
  gRNA
uccaggcaaacuaugacgug

SEQ ID NO: 113368 - RNA, 20 nt, Artificial Sequence
  MKO10113368_B_Rnf43
  gRNA
gaugucaaagaguacugcgu

SEQ ID NO: 113369 - RNA, 20 nt, Artificial Sequence
  MKO10113369_B_Rnf43
  gRNA
guuuguguacaagaaucgga

SEQ ID NO: 113370 - RNA, 20 nt, Artificial Sequence
  MKO10113370_B_Rnf44
  gRNA
cacccagcagagcccguuca

SEQ ID NO: 113371 - RNA, 20 nt, Artificial Sequence
  MKO10113371_B_Rnf44
  gRNA
gcugcugcauggugcacgcc

SEQ ID NO: 113372 - RNA, 20 nt, Artificial Sequence
  MKO10113372_B_Rnf44
  gRNA
ucguggagaucaaccaugaa

SEQ ID NO: 113373 - RNA, 20 nt, Artificial Sequence
  MKO10113373_B_Rnf4
  gRNA
uucgaccccugagguuuccu

SEQ ID NO: 113374 - RNA, 20 nt, Artificial Sequence
  MKO10113374_B_Rnf4
  gRNA
ucuguuuccaaggaaaccuc

SEQ ID NO: 113375 - RNA, 20 nt, Artificial Sequence
  MKO10113375_B_Rnf4
  gRNA
augauggagcuacuggaccc

SEQ ID NO: 113376 - RNA, 20 nt, Artificial Sequence
  MKO10113376_B_Rnf5
  gRNA
aaucccccggcaucaccaaa

SEQ ID NO: 113377 - RNA, 20 nt, Artificial Sequence
  MKO10113377_B_Rnf5
  gRNA
caguuggcccugucuucacc

SEQ ID NO: 113378 - RNA, 20 nt, Artificial Sequence
  MKO10113378_B_Rnf5
  gRNA
aacacauaccuggugaagac

SEQ ID NO: 113379 - RNA, 20 nt, Artificial Sequence
  MKO10113379_B_Rnf6
  gRNA
cuugccgcgcugucagagcc

SEQ ID NO: 113380 - RNA, 20 nt, Artificial Sequence
  MKO10113380_B_Rnf6
  gRNA
ccaccugaucuagaucuaga

SEQ ID NO: 113381 - RNA, 20 nt, Artificial Sequence
  MKO10113381_B_Rnf6
  gRNA
ucagccuggcucugacagcg

SEQ ID NO: 113382 - RNA, 20 nt, Artificial Sequence
  MKO10113382_B_Rnf7
  gRNA
acaacugcugcaugucccug

SEQ ID NO: 113383 - RNA, 20 nt, Artificial Sequence
  MKO10113383_B_Rnf7
  gRNA
ccucucauuugccgauucuu

SEQ ID NO: 113384 - RNA, 20 nt, Artificial Sequence
  MKO10113384_B_Rnf7
  gRNA
caucaccuggacccugcaga

SEQ ID NO: 113385 - RNA, 20 nt, Artificial Sequence
  MKO10113385_B_Rnf8
  gRNA
gacacuaaguccccguccua

SEQ ID NO: 113386 - RNA, 20 nt, Artificial Sequence
  MKO10113386_B_Rnf8
  gRNA
gugcgaccugaagcaacagc

SEQ ID NO: 113387 - RNA, 20 nt, Artificial Sequence
  MKO10113387_B_Rnf8
  gRNA
ucuguagcaucaggcucuaa

SEQ ID NO: 113388 - RNA, 20 nt, Artificial Sequence
  MKO10113388_B_Rnft1
  gRNA
cacucgaacaguugagcuuc

SEQ ID NO: 113389 - RNA, 20 nt, Artificial Sequence
  MKO10113389_B_Rnft1
  gRNA
caucaaagcuccgcugugcu

SEQ ID NO: 113390 - RNA, 20 nt, Artificial Sequence
  MKO10113390_B_Rnft1
  gRNA
auucucagucacuucauuac

SEQ ID NO: 113391 - RNA, 20 nt, Artificial Sequence
  MKO10113391_B_Rnft2
  gRNA
guggcuccuugcugcgcacc

SEQ ID NO: 113392 - RNA, 20 nt, Artificial Sequence
  MKO10113392_B_Rnft2
  gRNA
gagacgccacaguagcaaca

SEQ ID NO: 113393 - RNA, 20 nt, Artificial Sequence
  MKO10113393_B_Rnft2
  gRNA
ccuaugccaacuccacccuc

SEQ ID NO: 113394 - RNA, 20 nt, Artificial Sequence
  MKO10113394_B_Rnguu
  gRNA
cuagguguucacugcaccca

SEQ ID NO: 113395 - RNA, 20 nt, Artificial Sequence
  MKO10113395_B_Rnguu
  gRNA
gaaugucucaguauucucag

SEQ ID NO: 113396 - RNA, 20 nt, Artificial Sequence
  MKO10113396_B_Rnguu
  gRNA
cacauauaaggaaaccagua

SEQ ID NO: 113397 - RNA, 20 nt, Artificial Sequence
  MKO10113397_B_Rnh1
  gRNA
accgccaucacccaguucau

SEQ ID NO: 113398 - RNA, 20 nt, Artificial Sequence
  MKO10113398_B_Rnh1
  gRNA
ccgucaagccgcaguucuga

SEQ ID NO: 113399 - RNA, 20 nt, Artificial Sequence
  MKO10113399_B_Rnh1
  gRNA
aacaacgaccuccaugaacc

SEQ ID NO: 113400 - RNA, 20 nt, Artificial Sequence
  MKO10113400_B_Rnls
  gRNA
gaaguuaaugauccagcaau

SEQ ID NO: 113401 - RNA, 20 nt, Artificial Sequence
  MKO10113401_B_Rnls
  gRNA
agcucaguuuccgacagacc

SEQ ID NO: 113402 - RNA, 20 nt, Artificial Sequence
  MKO10113402_B_Rnls
  gRNA
auccauccccuccgcacacc

SEQ ID NO: 113403 - RNA, 20 nt, Artificial Sequence
  MKO10113403_B_Rnmtl1
  gRNA
acuccuugacguacuccaga

SEQ ID NO: 113404 - RNA, 20 nt, Artificial Sequence
  MKO10113404_B_Rnmtl1
  gRNA
cugcaacuggccgagaguac

SEQ ID NO: 113405 - RNA, 20 nt, Artificial Sequence
  MKO10113405_B_Rnmtl1
  gRNA
ucagaccuaguaacgccaca

SEQ ID NO: 113406 - RNA, 20 nt, Artificial Sequence
  MKO10113406_B_Rnmt
  gRNA
aacccgugacaucacuguuu

SEQ ID NO: 113407 - RNA, 20 nt, Artificial Sequence
  MKO10113407_B_Rnmt
  gRNA
ugcccacuauaaugagcuuc

SEQ ID NO: 113408 - RNA, 20 nt, Artificial Sequence
  MKO10113408_B_Rnmt
  gRNA
aagguggagauuugcucaag

SEQ ID NO: 113409 - RNA, 20 nt, Artificial Sequence
  MKO10113409_B_Rnpc3
  gRNA
cuccaucagcugaaacuucu

SEQ ID NO: 113410 - RNA, 20 nt, Artificial Sequence
  MKO10113410_B_Rnpc3
  gRNA
cucuagguuggaugacacug

SEQ ID NO: 113411 - RNA, 20 nt, Artificial Sequence
  MKO10113411_B_Rnpc3
  gRNA
uaaugaaaaagcagcaauaa

SEQ ID NO: 113412 - RNA, 20 nt, Artificial Sequence
  MKO10113412_B_Rnpepl1
  gRNA
gaugcggcgcugugcauagg

SEQ ID NO: 113413 - RNA, 20 nt, Artificial Sequence
  MKO10113413_B_Rnpepl1
  gRNA
agugcagcagagcgauuaua

SEQ ID NO: 113414 - RNA, 20 nt, Artificial Sequence
  MKO10113414_B_Rnpepl1
  gRNA
ugcacagcgccgcaucacca

SEQ ID NO: 113415 - RNA, 20 nt, Artificial Sequence
  MKO10113415_B_Rnpep
  gRNA
gaucucauggaugauaacgu

SEQ ID NO: 113416 - RNA, 20 nt, Artificial Sequence
  MKO10113416_B_Rnpep
  gRNA
gagccagaacuccccccagu

SEQ ID NO: 113417 - RNA, 20 nt, Artificial Sequence
  MKO10113417_B_Rnpep
  gRNA
agcagugaaaugcacguauu

SEQ ID NO: 113418 - RNA, 20 nt, Artificial Sequence
  MKO10113418_B_Rnps1
  gRNA
acgugcuggagcuuccugag

SEQ ID NO: 113419 - RNA, 20 nt, Artificial Sequence
  MKO10113419_B_Rnps1
  gRNA
guccagcuccaccuccagcu

SEQ ID NO: 113420 - RNA, 20 nt, Artificial Sequence
  MKO10113420_B_Rnps1
  gRNA
cuucucacuugacucuuuag

SEQ ID NO: 113421 - RNA, 20 nt, Artificial Sequence
  MKO10113421_B_Robo1
  gRNA
ucuuuccuccaucgaacugu

SEQ ID NO: 113422 - RNA, 20 nt, Artificial Sequence
  MKO10113422_B_Robo1
  gRNA
cacagucacugccaaauuac

SEQ ID NO: 113423 - RNA, 20 nt, Artificial Sequence
  MKO10113423_B_Robo1
  gRNA
aguaggcgaaccugcaguca

SEQ ID NO: 113424 - RNA, 20 nt, Artificial Sequence
  MKO10113424_B_Robo2
  gRNA
agcuguagaauuccguuguc

SEQ ID NO: 113425 - RNA, 20 nt, Artificial Sequence
  MKO10113425_B_Robo2
  gRNA
agcugaugaucucuaauacu

SEQ ID NO: 113426 - RNA, 20 nt, Artificial Sequence
  MKO10113426_B_Robo2
  gRNA
agcugcgacuaccacaucug

SEQ ID NO: 113427 - RNA, 20 nt, Artificial Sequence
  MKO10113427_B_Robo3
  gRNA
uauuggucuacgcagaaaug

SEQ ID NO: 113428 - RNA, 20 nt, Artificial Sequence
  MKO10113428_B_Robo3
  gRNA
aauggaaugugugcccccua

SEQ ID NO: 113429 - RNA, 20 nt, Artificial Sequence
  MKO10113429_B_Robo3
  gRNA
uaugugcguagccuccaaca

SEQ ID NO: 113430 - RNA, 20 nt, Artificial Sequence
  MKO10113430_B_Robo4
  gRNA
gucuuuccaccaugagaccg

SEQ ID NO: 113431 - RNA, 20 nt, Artificial Sequence
  MKO10113431_B_Robo4
  gRNA
cugugucccgagguuggauc

SEQ ID NO: 113432 - RNA, 20 nt, Artificial Sequence
  MKO10113432_B_Robo4
  gRNA
ccaagccugggccauccgug

SEQ ID NO: 113433 - RNA, 20 nt, Artificial Sequence
  MKO10113433_B_Rock1
  gRNA
uuaggauggauuggaugccc

SEQ ID NO: 113434 - RNA, 20 nt, Artificial Sequence
  MKO10113434_B_Rock1
  gRNA
acuaugacgugccugaaaaa

SEQ ID NO: 113435 - RNA, 20 nt, Artificial Sequence
  MKO10113435_B_Rock1
  gRNA
ccaucaccauguagagauac

SEQ ID NO: 113436 - RNA, 20 nt, Artificial Sequence
  MKO10113436_B_Rock2
  gRNA
uguacuccaucaccauguac

SEQ ID NO: 113437 - RNA, 20 nt, Artificial Sequence
  MKO10113437_B_Rock2
  gRNA
acaggauggcuuaaauuccu

SEQ ID NO: 113438 - RNA, 20 nt, Artificial Sequence
  MKO10113438_B_Rock2
  gRNA
aaaauccaaaucaaggacca

SEQ ID NO: 113439 - RNA, 20 nt, Artificial Sequence
  MKO10113439_B_Rogdi
  gRNA
cgcaggaggaggaguuucgc

SEQ ID NO: 113440 - RNA, 20 nt, Artificial Sequence
  MKO10113440_B_Rogdi
  gRNA
aguuguugcacuuggccuuc

SEQ ID NO: 113441 - RNA, 20 nt, Artificial Sequence
  MKO10113441_B_Rogdi
  gRNA
gagucagagucccuuucacc

SEQ ID NO: 113442 - RNA, 20 nt, Artificial Sequence
  MKO10113442_B_Rom1
  gRNA
aaccuaaaccucugggccca

SEQ ID NO: 113443 - RNA, 20 nt, Artificial Sequence
  MKO10113443_B_Rom1
  gRNA
ucugcaaauaccgcaaacca

SEQ ID NO: 113444 - RNA, 20 nt, Artificial Sequence
  MKO10113444_B_Rom1
  gRNA
gcgguauuugcagacagcgc

SEQ ID NO: 113445 - RNA, 20 nt, Artificial Sequence
  MKO10113445_B_Romo1
  gRNA
cuucgucauggguugcgcag

SEQ ID NO: 113446 - RNA, 20 nt, Artificial Sequence
  MKO10113446_B_Romo1
  gRNA
auggcggccggggcgcuguu

SEQ ID NO: 113447 - RNA, 20 nt, Artificial Sequence
  MKO10113447_B_Romo1
  gRNA
gcugggcugggacugcccgu

SEQ ID NO: 113448 - RNA, 20 nt, Artificial Sequence
  MKO10113448_B_Ropn1l
  gRNA
agcgcucggaugcagcuccc

SEQ ID NO: 113449 - RNA, 20 nt, Artificial Sequence
  MKO10113449_B_Ropn1l
  gRNA
agaaaagcucagaacgaucc

SEQ ID NO: 113450 - RNA, 20 nt, Artificial Sequence
  MKO10113450_B_Ropn1l
  gRNA
ccugaaaguccugcacaagc

SEQ ID NO: 113451 - RNA, 20 nt, Artificial Sequence
  MKO10113451_B_Ropn1
  gRNA
agcuccuuacccgagaaugc

SEQ ID NO: 113452 - RNA, 20 nt, Artificial Sequence
  MKO10113452_B_Ropn1
  gRNA
uucaccuugauuaagccauc

SEQ ID NO: 113453 - RNA, 20 nt, Artificial Sequence
  MKO10113453_B_Ropn1
  gRNA
cguucaucacacuguuaaac

SEQ ID NO: 113454 - RNA, 20 nt, Artificial Sequence
  MKO10113454_B_Ror1
  gRNA
acuucaagugaaaucgacaa

SEQ ID NO: 113455 - RNA, 20 nt, Artificial Sequence
  MKO10113455_B_Ror1
  gRNA
gaauaacaucacaacguccc

SEQ ID NO: 113456 - RNA, 20 nt, Artificial Sequence
  MKO10113456_B_Ror1
  gRNA
gauuucacuugaaguguucc

SEQ ID NO: 113457 - RNA, 20 nt, Artificial Sequence
  MKO10113457_B_Ror2
  gRNA
cgguugugcaagagccacga

SEQ ID NO: 113458 - RNA, 20 nt, Artificial Sequence
  MKO10113458_B_Ror2
  gRNA
cgcgaacuuacugaaaauug

SEQ ID NO: 113459 - RNA, 20 nt, Artificial Sequence
  MKO10113459_B_Ror2
  gRNA
agugggcuguccgguccauc

SEQ ID NO: 113460 - RNA, 20 nt, Artificial Sequence
  MKO10113460_B_Rora
  gRNA
aaaucgucaggaauccauua

SEQ ID NO: 113461 - RNA, 20 nt, Artificial Sequence
  MKO10113461_B_Rora
  gRNA
gaaaccgcugccagcauugu

SEQ ID NO: 113462 - RNA, 20 nt, Artificial Sequence
  MKO10113462_B_Rora
  gRNA
aucaaacaguucuucugacg

SEQ ID NO: 113463 - RNA, 20 nt, Artificial Sequence
  MKO10113463_B_Rorb
  gRNA
aaauccuccgggauccacua

SEQ ID NO: 113464 - RNA, 20 nt, Artificial Sequence
  MKO10113464_B_Rorb
  gRNA
aaucaaggcguaucaaagca

SEQ ID NO: 113465 - RNA, 20 nt, Artificial Sequence
  MKO10113465_B_Rorb
  gRNA
auggcagacccacaccuacg

SEQ ID NO: 113466 - RNA, 20 nt, Artificial Sequence
  MKO10113466_B_Rorc
  gRNA
gugaucccuugcaagaucug

SEQ ID NO: 113467 - RNA, 20 nt, Artificial Sequence
  MKO10113467_B_Rorc
  gRNA
auguaagugugucugcuccg

SEQ ID NO: 113468 - RNA, 20 nt, Artificial Sequence
  MKO10113468_B_Rorc
  gRNA
uaucaccugugaggggugca

SEQ ID NO: 113469 - RNA, 20 nt, Artificial Sequence
  MKO10113469_B_Ros1
  gRNA
auugcugcagccgaccucac

SEQ ID NO: 113470 - RNA, 20 nt, Artificial Sequence
  MKO10113470_B_Ros1
  gRNA
ugaacucaccucacaaaugg

SEQ ID NO: 113471 - RNA, 20 nt, Artificial Sequence
  MKO10113471_B_Ros1
  gRNA
gcauccauggaugucaguuu

SEQ ID NO: 113472 - RNA, 20 nt, Artificial Sequence
  MKO10113472_B_Rp1l1
  gRNA
cagccgaacuccgagcccga

SEQ ID NO: 113473 - RNA, 20 nt, Artificial Sequence
  MKO10113473_B_Rp1l1
  gRNA
aguuaucuagugugacugcg

SEQ ID NO: 113474 - RNA, 20 nt, Artificial Sequence
  MKO10113474_B_Rp1l1
  gRNA
gaacgaggccuucagauguc

SEQ ID NO: 113475 - RNA, 20 nt, Artificial Sequence
  MKO10113475_B_Rp1
  gRNA
aggaacaucagcacgccccg

SEQ ID NO: 113476 - RNA, 20 nt, Artificial Sequence
  MKO10113476_B_Rp1
  gRNA
ugcacacgaugagagauucc

SEQ ID NO: 113477 - RNA, 20 nt, Artificial Sequence
  MKO10113477_B_Rp1
  gRNA
cucucaucgugugcaccaga

SEQ ID NO: 113478 - RNA, 20 nt, Artificial Sequence
  MKO10113478_B_Rp2h
  gRNA
ugaaaacugaagacgcccaa

SEQ ID NO: 113479 - RNA, 20 nt, Artificial Sequence
  MKO10113479_B_Rp2h
  gRNA
gcuaucaacaucuccagaug

SEQ ID NO: 113480 - RNA, 20 nt, Artificial Sequence
  MKO10113480_B_Rp2h
  gRNA
ucuccacagaugguugguaa

SEQ ID NO: 113481 - RNA, 20 nt, Artificial Sequence
  MKO10113481_B_Rp9
  gRNA
ggcauccacaguccuuuagu

SEQ ID NO: 113482 - RNA, 20 nt, Artificial Sequence
  MKO10113482_B_Rp9
  gRNA
ucacucaccuuuauaaaccc

SEQ ID NO: 113483 - RNA, 20 nt, Artificial Sequence
  MKO10113483_B_Rp9
  gRNA
cucggaacuguucuaacuuc

SEQ ID NO: 113484 - RNA, 20 nt, Artificial Sequence
  MKO10113484_B_Rpa1
  gRNA
uucucaggucaugauacagc

SEQ ID NO: 113485 - RNA, 20 nt, Artificial Sequence
  MKO10113485_B_Rpa1
  gRNA
gcgcauaccugccgucuuuc

SEQ ID NO: 113486 - RNA, 20 nt, Artificial Sequence
  MKO10113486_B_Rpa1
  gRNA
cgguacuuacaaugaccugc

SEQ ID NO: 113487 - RNA, 20 nt, Artificial Sequence
  MKO10113487_B_Rpa2
  gRNA
gaaacauacgugaaagucgc

SEQ ID NO: 113488 - RNA, 20 nt, Artificial Sequence
  MKO10113488_B_Rpa2
  gRNA
ugccaguggugagaacgccg

SEQ ID NO: 113489 - RNA, 20 nt, Artificial Sequence
  MKO10113489_B_Rpa2
  gRNA
uguucgucaguggguugaca

SEQ ID NO: 113490 - RNA, 20 nt, Artificial Sequence
  MKO10113490_B_Rpa3
  gRNA
agcccuacagggaaaaacug

SEQ ID NO: 113491 - RNA, 20 nt, Artificial Sequence
  MKO10113491_B_Rpa3
  gRNA
cagcuuccccacgaagcaca

SEQ ID NO: 113492 - RNA, 20 nt, Artificial Sequence
  MKO10113492_B_Rpa3
  gRNA
uguuaccacaguauaucgac

SEQ ID NO: 113493 - RNA, 20 nt, Artificial Sequence
  MKO10113493_B_Rpain
  gRNA
ugugcugcaggacaucgagc

SEQ ID NO: 113494 - RNA, 20 nt, Artificial Sequence
  MKO10113494_B_Rpain
  gRNA
gcaccgcuuguuguacaagc

SEQ ID NO: 113495 - RNA, 20 nt, Artificial Sequence
  MKO10113495_B_Rpain
  gRNA
ccggcgugcuaccugcagcc

SEQ ID NO: 113496 - RNA, 20 nt, Artificial Sequence
  MKO10113496_B_Rpap1
  gRNA
cacagaccaaaucuagucac

SEQ ID NO: 113497 - RNA, 20 nt, Artificial Sequence
  MKO10113497_B_Rpap1
  gRNA
uaggugaaaccagcagcauc

SEQ ID NO: 113498 - RNA, 20 nt, Artificial Sequence
  MKO10113498_B_Rpap1
  gRNA
cccuuuccugugacuagauu

SEQ ID NO: 113499 - RNA, 20 nt, Artificial Sequence
  MKO10113499_B_Rpap2
  gRNA
cgguccaucaucaaacucug

SEQ ID NO: 113500 - RNA, 20 nt, Artificial Sequence
  MKO10113500_B_Rpap2
  gRNA
gaaauucgauauuucuguuu

SEQ ID NO: 113501 - RNA, 20 nt, Artificial Sequence
  MKO10113501_B_Rpap2
  gRNA
agauucccaaaacuccagua

SEQ ID NO: 113502 - RNA, 20 nt, Artificial Sequence
  MKO10113502_B_Rpap3
  gRNA
acgccaggcgaggugcagcu

SEQ ID NO: 113503 - RNA, 20 nt, Artificial Sequence
  MKO10113503_B_Rpap3
  gRNA
ggaugaagauggcauucgug

SEQ ID NO: 113504 - RNA, 20 nt, Artificial Sequence
  MKO10113504_B_Rpap3
  gRNA
cacccacgauucucuguccc

SEQ ID NO: 113505 - RNA, 20 nt, Artificial Sequence
  MKO10113505_B_Rpe65
  gRNA
cucgaacauaagcaucagug

SEQ ID NO: 113506 - RNA, 20 nt, Artificial Sequence
  MKO10113506_B_Rpe65
  gRNA
aguuucuuguagccaccagc

SEQ ID NO: 113507 - RNA, 20 nt, Artificial Sequence
  MKO10113507_B_Rpe65
  gRNA
ugaagucaaacuugugcaaa

SEQ ID NO: 113508 - RNA, 20 nt, Artificial Sequence
  MKO10113508_B_Rpe
  gRNA
ucgaccucuauauccaaagu

SEQ ID NO: 113509 - RNA, 20 nt, Artificial Sequence
  MKO10113509_B_Rpe
  gRNA
gaaagccuccgaaagcagcu

SEQ ID NO: 113510 - RNA, 20 nt, Artificial Sequence
  MKO10113510_B_Rpe
  gRNA
ucaauauaccuuucaucuug

SEQ ID NO: 113511 - RNA, 20 nt, Artificial Sequence
  MKO10113511_B_Rpf1
  gRNA
aaaucucuugcaaugcacug

SEQ ID NO: 113512 - RNA, 20 nt, Artificial Sequence
  MKO10113512_B_Rpf1
  gRNA
gaucuucauuaauaacgauc

SEQ ID NO: 113513 - RNA, 20 nt, Artificial Sequence
  MKO10113513_B_Rpf1
  gRNA
gacguugugauaagaaucuu

SEQ ID NO: 113514 - RNA, 20 nt, Artificial Sequence
  MKO10113514_B_Rpf2
  gRNA
aagaaugccaugcugauuaa

SEQ ID NO: 113515 - RNA, 20 nt, Artificial Sequence
  MKO10113515_B_Rpf2
  gRNA
gacacaaguacucagagaca

SEQ ID NO: 113516 - RNA, 20 nt, Artificial Sequence
  MKO10113516_B_Rpf2
  gRNA
aaauauuacaagaccauuug

SEQ ID NO: 113517 - RNA, 20 nt, Artificial Sequence
  MKO10113517_B_Rpgrip1l
  gRNA
acgcacagugaagacucgcc

SEQ ID NO: 113518 - RNA, 20 nt, Artificial Sequence
  MKO10113518_B_Rpgrip1l
  gRNA
gauagaagaguuagagcacu

SEQ ID NO: 113519 - RNA, 20 nt, Artificial Sequence
  MKO10113519_B_Rpgrip1l
  gRNA
ucuucagcuucgagaacagc

SEQ ID NO: 113520 - RNA, 20 nt, Artificial Sequence
  MKO10113520_B_Rpgrip1
  gRNA
ccuccaugaagagcccacgu

SEQ ID NO: 113521 - RNA, 20 nt, Artificial Sequence
  MKO10113521_B_Rpgrip1
  gRNA
cgccacauagucuuuaaaug

SEQ ID NO: 113522 - RNA, 20 nt, Artificial Sequence
  MKO10113522_B_Rpgrip1
  gRNA
guauggcugcgccugucauu

SEQ ID NO: 113523 - RNA, 20 nt, Artificial Sequence
  MKO10113523_B_Rpgr
  gRNA
aucaagccaacauguaucaa

SEQ ID NO: 113524 - RNA, 20 nt, Artificial Sequence
  MKO10113524_B_Rpgr
  gRNA
acugguggcguauaugcagc

SEQ ID NO: 113525 - RNA, 20 nt, Artificial Sequence
  MKO10113525_B_Rpgr
  gRNA
ucuagcucuuaagccugaga

SEQ ID NO: 113526 - RNA, 20 nt, Artificial Sequence
  MKO10113526_B_Rph3al
  gRNA
aggcuucccccggccagaag

SEQ ID NO: 113527 - RNA, 20 nt, Artificial Sequence
  MKO10113527_B_Rph3al
  gRNA
ccuccccgcagagcagacac

SEQ ID NO: 113528 - RNA, 20 nt, Artificial Sequence
  MKO10113528_B_Rph3al
  gRNA
gucugugcacacguaccaga

SEQ ID NO: 113529 - RNA, 20 nt, Artificial Sequence
  MKO10113529_B_Rph3a
  gRNA
auccuggagcacagaccgac

SEQ ID NO: 113530 - RNA, 20 nt, Artificial Sequence
  MKO10113530_B_Rph3a
  gRNA
cccaaugcguuccuguucca

SEQ ID NO: 113531 - RNA, 20 nt, Artificial Sequence
  MKO10113531_B_Rph3a
  gRNA
cagaucuugcagagccauac

SEQ ID NO: 113532 - RNA, 20 nt, Artificial Sequence
  MKO10113532_B_Rpia
  gRNA
cacuucgucagcaccaucga

SEQ ID NO: 113533 - RNA, 20 nt, Artificial Sequence
  MKO10113533_B_Rpia
  gRNA
aggcagcuuaucuugcagua

SEQ ID NO: 113534 - RNA, 20 nt, Artificial Sequence
  MKO10113534_B_Rpia
  gRNA
ugaccuggaucaacacccag

SEQ ID NO: 113535 - RNA, 20 nt, Artificial Sequence
  MKO10113535_B_Rpl10a
  gRNA
cucacgcgacacccuguacg

SEQ ID NO: 113536 - RNA, 20 nt, Artificial Sequence
  MKO10113536_B_Rpl10a
  gRNA
gagaaacguuuguccuucug

SEQ ID NO: 113537 - RNA, 20 nt, Artificial Sequence
  MKO10113537_B_Rpl10a
  gRNA
ugagcgccucgauguccaug

SEQ ID NO: 113538 - RNA, 20 nt, Artificial Sequence
  MKO10113538_B_Rpl10l
  gRNA
uuguccagaggaccucguuc

SEQ ID NO: 113539 - RNA, 20 nt, Artificial Sequence
  MKO10113539_B_Rpl10l
  gRNA
cgcagaugcgugcggccucc

SEQ ID NO: 113540 - RNA, 20 nt, Artificial Sequence
  MKO10113540_B_Rpl10l
  gRNA
cgaguaugagcagcucuccu

SEQ ID NO: 113541 - RNA, 20 nt, Artificial Sequence
  MKO10113541_B_Rpl10
  gRNA
uuaccugucagccccagcac

SEQ ID NO: 113542 - RNA, 20 nt, Artificial Sequence
  MKO10113542_B_Rpl10
  gRNA
ccaaagucucguuucugccg

SEQ ID NO: 113543 - RNA, 20 nt, Artificial Sequence
  MKO10113543_B_Rpl10
  gRNA
cauauucaucugacaccaua

SEQ ID NO: 113544 - RNA, 20 nt, Artificial Sequence
  MKO10113544_B_Rpl11
  gRNA
cacauaccacauagaagucc

SEQ ID NO: 113545 - RNA, 20 nt, Artificial Sequence
  MKO10113545_B_Rpl11
  gRNA
uucuggcacaggugcugggu

SEQ ID NO: 113546 - RNA, 20 nt, Artificial Sequence
  MKO10113546_B_Rpl11
  gRNA
cugcagcuagauacacuguc

SEQ ID NO: 113547 - RNA, 20 nt, Artificial Sequence
  MKO10113547_B_Rpl12
  gRNA
auaccugggccugucuguuc

SEQ ID NO: 113548 - RNA, 20 nt, Artificial Sequence
  MKO10113548_B_Rpl12
  gRNA
uucugcuucuuccugucucu

SEQ ID NO: 113549 - RNA, 20 nt, Artificial Sequence
  MKO10113549_B_Rpl12
  gRNA
ccugaucaucaaagcccuca

SEQ ID NO: 113550 - RNA, 20 nt, Artificial Sequence
  MKO10113550_B_Rpl13a
  gRNA
gcaaggcucaccuugucaua

SEQ ID NO: 113551 - RNA, 20 nt, Artificial Sequence
  MKO10113551_B_Rpl13a
  gRNA
uguccugacaguaaaguauc

SEQ ID NO: 113552 - RNA, 20 nt, Artificial Sequence
  MKO10113552_B_Rpl13a
  gRNA
agcguacgaccaccaccuuc

SEQ ID NO: 113553 - RNA, 20 nt, Artificial Sequence
  MKO10113553_B_Rpl13
  gRNA
uguccacuuacauuccggau

SEQ ID NO: 113554 - RNA, 20 nt, Artificial Sequence
  MKO10113554_B_Rpl13
  gRNA
cacucacccugagcuccucc

SEQ ID NO: 113555 - RNA, 20 nt, Artificial Sequence
  MKO10113555_B_Rpl13
  gRNA
acagaacugucucccuucuu

SEQ ID NO: 113556 - RNA, 20 nt, Artificial Sequence
  MKO10113556_B_Rpl14
  gRNA
uugcgaccagcuuuccagca

SEQ ID NO: 113557 - RNA, 20 nt, Artificial Sequence
  MKO10113557_B_Rpl14
  gRNA
agaaguauguccgaaaagcu

SEQ ID NO: 113558 - RNA, 20 nt, Artificial Sequence
  MKO10113558_B_Rpl14
  gRNA
aggcggauaucaauacgaaa

SEQ ID NO: 113559 - RNA, 20 nt, Artificial Sequence
  MKO10113559_B_Rpl15
  gRNA
cccagucuucgagcuuuauc

SEQ ID NO: 113560 - RNA, 20 nt, Artificial Sequence
  MKO10113560_B_Rpl15
  gRNA
aucacguguauuagcgguaa

SEQ ID NO: 113561 - RNA, 20 nt, Artificial Sequence
  MKO10113561_B_Rpl15
  gRNA
ugagaguccugaauuccuac

SEQ ID NO: 113562 - RNA, 20 nt, Artificial Sequence
  MKO10113562_B_Rpl17
  gRNA
caacuccaccauuauaccgc

SEQ ID NO: 113563 - RNA, 20 nt, Artificial Sequence
  MKO10113563_B_Rpl17
  gRNA
gaacacccgggaaacugccc

SEQ ID NO: 113564 - RNA, 20 nt, Artificial Sequence
  MKO10113564_B_Rpl17
  gRNA
cuguguccagccccacuguu

SEQ ID NO: 113565 - RNA, 20 nt, Artificial Sequence
  MKO10113565_B_Rpl18a
  gRNA
acguggaacugcuugacagc

SEQ ID NO: 113566 - RNA, 20 nt, Artificial Sequence
  MKO10113566_B_Rpl18a
  gRNA
ccccugcgugugaagaacuu

SEQ ID NO: 113567 - RNA, 20 nt, Artificial Sequence
  MKO10113567_B_Rpl18a
  gRNA
cugugugacugcaccagcag

SEQ ID NO: 113568 - RNA, 20 nt, Artificial Sequence
  MKO10113568_B_Rpl18
  gRNA
acucacuugguauggcugug

SEQ ID NO: 113569 - RNA, 20 nt, Artificial Sequence
  MKO10113569_B_Rpl18
  gRNA
cuaccugcggcugcuuguca

SEQ ID NO: 113570 - RNA, 20 nt, Artificial Sequence
  MKO10113570_B_Rpl18
  gRNA
uuaccuugacaagcagccgc

SEQ ID NO: 113571 - RNA, 20 nt, Artificial Sequence
  MKO10113571_B_Rpl19
  gRNA
uucuugcucagggaagagga

SEQ ID NO: 113572 - RNA, 20 nt, Artificial Sequence
  MKO10113572_B_Rpl19
  gRNA
guaugcucaggcuacagaag

SEQ ID NO: 113573 - RNA, 20 nt, Artificial Sequence
  MKO10113573_B_Rpl19
  gRNA
ccauaugccugcccuuccgu

SEQ ID NO: 113574 - RNA, 20 nt, Artificial Sequence
  MKO10113574_B_Rpl21
  gRNA
cuuguugacaaugaugccca

SEQ ID NO: 113575 - RNA, 20 nt, Artificial Sequence
  MKO10113575_B_Rpl21
  gRNA
ggaaugggcacuguucaaaa

SEQ ID NO: 113576 - RNA, 20 nt, Artificial Sequence
  MKO10113576_B_Rpl21
  gRNA
cuggcgcuucagcugcaccc

SEQ ID NO: 113577 - RNA, 20 nt, Artificial Sequence
  MKO10113577_B_Rpl22l1
  gRNA
guuaaagucaauggaaaaac

SEQ ID NO: 113578 - RNA, 20 nt, Artificial Sequence
  MKO10113578_B_Rpl22l1
  gRNA
caucuucaucuugacuaauc

SEQ ID NO: 113579 - RNA, 20 nt, Artificial Sequence
  MKO10113579_B_Rpl22l1
  gRNA
agaagaauaaucuccgugau

SEQ ID NO: 113580 - RNA, 20 nt, Artificial Sequence
  MKO10113580_B_Rpl22
  gRNA
auacuccuagaaaaagcuug

SEQ ID NO: 113581 - RNA, 20 nt, Artificial Sequence
  MKO10113581_B_Rpl22
  gRNA
ucugcaggagcaguuccucc

SEQ ID NO: 113582 - RNA, 20 nt, Artificial Sequence
  MKO10113582_B_Rpl22
  gRNA
ggggggcaaaaaaaagaagc

SEQ ID NO: 113583 - RNA, 20 nt, Artificial Sequence
  MKO10113583_B_Rpl23a
  gRNA
caaagccgaagccaaagcga

SEQ ID NO: 113584 - RNA, 20 nt, Artificial Sequence
  MKO10113584_B_Rpl23a
  gRNA
caucaaauucccacugacca

SEQ ID NO: 113585 - RNA, 20 nt, Artificial Sequence
  MKO10113585_B_Rpl23a
  gRNA
ccuuaucaggguauugacuu

SEQ ID NO: 113586 - RNA, 20 nt, Artificial Sequence
  MKO10113586_B_Rpl23
  gRNA
cguugucgaauuaccacugc

SEQ ID NO: 113587 - RNA, 20 nt, Artificial Sequence
  MKO10113587_B_Rpl23
  gRNA
caguugaucacagcuccgac

SEQ ID NO: 113588 - RNA, 20 nt, Artificial Sequence
  MKO10113588_B_Rpl23
  gRNA
cuuguauaucaucucuguga

SEQ ID NO: 113589 - RNA, 20 nt, Artificial Sequence
  MKO10113589_B_Rpl24
  gRNA
ucuuguguuuccuucuguag

SEQ ID NO: 113590 - RNA, 20 nt, Artificial Sequence
  MKO10113590_B_Rpl24
  gRNA
agucagcauuccuuuccaaa

SEQ ID NO: 113591 - RNA, 20 nt, Artificial Sequence
  MKO10113591_B_Rpl24
  gRNA
aaauuccaacgagccaucac

SEQ ID NO: 113592 - RNA, 20 nt, Artificial Sequence
  MKO10113592_B_Rpl26
  gRNA
accgaagcaagaaccgcaaa

SEQ ID NO: 113593 - RNA, 20 nt, Artificial Sequence
  MKO10113593_B_Rpl26
  gRNA
guuguucgcggacacuacaa

SEQ ID NO: 113594 - RNA, 20 nt, Artificial Sequence
  MKO10113594_B_Rpl26
  gRNA
ccuucuccuuuccuacuugu

SEQ ID NO: 113595 - RNA, 20 nt, Artificial Sequence
  MKO10113595_B_Rpl27a
  gRNA
auagggcuacuacaaaguuc

SEQ ID NO: 113596 - RNA, 20 nt, Artificial Sequence
  MKO10113596_B_Rpl27a
  gRNA
auuugucaaaguugauccug

SEQ ID NO: 113597 - RNA, 20 nt, Artificial Sequence
  MKO10113597_B_Rpl27a
  gRNA
gguaagcaccgcaagcaccc

SEQ ID NO: 113598 - RNA, 20 nt, Artificial Sequence
  MKO10113598_B_Rpl27
  gRNA
uuccuuucuagauacaagac

SEQ ID NO: 113599 - RNA, 20 nt, Artificial Sequence
  MKO10113599_B_Rpl27
  gRNA
aggcucaccuugugggcaug

SEQ ID NO: 113600 - RNA, 20 nt, Artificial Sequence
  MKO10113600_B_Rpl27
  gRNA
ccgcuccucaaacuugaccu

SEQ ID NO: 113601 - RNA, 20 nt, Artificial Sequence
  MKO10113601_B_Rpl28
  gRNA
ccauguccgcgcaucugcag

SEQ ID NO: 113602 - RNA, 20 nt, Artificial Sequence
  MKO10113602_B_Rpl28
  gRNA
uaccacgaccccuuugccau

SEQ ID NO: 113603 - RNA, 20 nt, Artificial Sequence
  MKO10113603_B_Rpl28
  gRNA
cgaaacuccuuccgcuacaa

SEQ ID NO: 113604 - RNA, 20 nt, Artificial Sequence
  MKO10113604_B_Rpl29
  gRNA
agguugaccccaaguuccug

SEQ ID NO: 113605 - RNA, 20 nt, Artificial Sequence
  MKO10113605_B_Rpl29
  gRNA
acucacugccuuugcauugu

SEQ ID NO: 113606 - RNA, 20 nt, Artificial Sequence
  MKO10113606_B_Rpl29
  gRNA
ugccauuucugugccauuug

SEQ ID NO: 113607 - RNA, 20 nt, Artificial Sequence
  MKO10113607_B_Rpl30
  gRNA
ccucaaagcuggacaguugu

SEQ ID NO: 113608 - RNA, 20 nt, Artificial Sequence
  MKO10113608_B_Rpl30
  gRNA
aauagaguacuaugccaugu

SEQ ID NO: 113609 - RNA, 20 nt, Artificial Sequence
  MKO10113609_B_Rpl30
  gRNA
uauuauugccacuguaguga

SEQ ID NO: 113610 - RNA, 20 nt, Artificial Sequence
  MKO10113610_B_Rpl31-ps12
  gRNA
gaauguugaugguguauucu

SEQ ID NO: 113611 - RNA, 20 nt, Artificial Sequence
  MKO10113611_B_Rpl31-ps12
  gRNA
cccaaacaagcucuacacgc

SEQ ID NO: 113612 - RNA, 20 nt, Artificial Sequence
  MKO10113612_B_Rpl31-ps12
  gRNA
ccaccuuguugauggcagaa

SEQ ID NO: 113613 - RNA, 20 nt, Artificial Sequence
  MKO10113613_B_Rpl31
  gRNA
gaugcgcuugugaauguuga

SEQ ID NO: 113614 - RNA, 20 nt, Artificial Sequence
  MKO10113614_B_Rpl31
  gRNA
gcuucaagaagcgugcuccu

SEQ ID NO: 113615 - RNA, 20 nt, Artificial Sequence
  MKO10113615_B_Rpl31
  gRNA
cuuguccagaaaacguaaug

SEQ ID NO: 113616 - RNA, 20 nt, Artificial Sequence
  MKO10113616_B_Rpl32
  gRNA
ccuccagcuccuugacauug

SEQ ID NO: 113617 - RNA, 20 nt, Artificial Sequence
  MKO10113617_B_Rpl32
  gRNA
uguagaaagagcagcacagc

SEQ ID NO: 113618 - RNA, 20 nt, Artificial Sequence
  MKO10113618_B_Rpl32
  gRNA
gagucaccaaucccaacgcc

SEQ ID NO: 113619 - RNA, 20 nt, Artificial Sequence
  MKO10113619_B_Rpl34-ps1
  gRNA
ucaccugucacggacacacu

SEQ ID NO: 113620 - RNA, 20 nt, Artificial Sequence
  MKO10113620_B_Rpl34-ps1
  gRNA
cucaccccucgaagucugcc

SEQ ID NO: 113621 - RNA, 20 nt, Artificial Sequence
  MKO10113621_B_Rpl34-ps1
  gRNA
aaucguugugaaagucuuga

SEQ ID NO: 113622 - RNA, 20 nt, Artificial Sequence
  MKO10113622_B_Rpl34
  gRNA
cucaccccucgaagucugcc

SEQ ID NO: 113623 - RNA, 20 nt, Artificial Sequence
  MKO10113623_B_Rpl34
  gRNA
aaucguugugaaagucuuga

SEQ ID NO: 113624 - RNA, 20 nt, Artificial Sequence
  MKO10113624_B_Rpl34
  gRNA
agcguuugacauaccgccgu

SEQ ID NO: 113625 - RNA, 20 nt, Artificial Sequence
  MKO10113625_B_Rpl35a
  gRNA
accagcaauacagugacucc

SEQ ID NO: 113626 - RNA, 20 nt, Artificial Sequence
  MKO10113626_B_Rpl35a
  gRNA
uaacagcaaguaugucugga

SEQ ID NO: 113627 - RNA, 20 nt, Artificial Sequence
  MKO10113627_B_Rpl35a
  gRNA
aguagaacuccguuucaucu

SEQ ID NO: 113628 - RNA, 20 nt, Artificial Sequence
  MKO10113628_B_Rpl35
  gRNA
agacucaaaaagaaaaccuc

SEQ ID NO: 113629 - RNA, 20 nt, Artificial Sequence
  MKO10113629_B_Rpl35
  gRNA
agacuagagccaugcgccgc

SEQ ID NO: 113630 - RNA, 20 nt, Artificial Sequence
  MKO10113630_B_Rpl35
  gRNA
uugacugcauacuugcgcag

SEQ ID NO: 113631 - RNA, 20 nt, Artificial Sequence
  MKO10113631_B_Rpl36al
  gRNA
caaagugacccaguauaaga

SEQ ID NO: 113632 - RNA, 20 nt, Artificial Sequence
  MKO10113632_B_Rpl36al
  gRNA
aaaaugcuugcaucucuuaa

SEQ ID NO: 113633 - RNA, 20 nt, Artificial Sequence
  MKO10113633_B_Rpl36al
  gRNA
aaggauucccuguaugccca

SEQ ID NO: 113634 - RNA, 20 nt, Artificial Sequence
  MKO10113634_B_Rpl36a
  gRNA
cauccucuuagaucugcagu

SEQ ID NO: 113635 - RNA, 20 nt, Artificial Sequence
  MKO10113635_B_Rpl36a
  gRNA
aaagaagauugugcugagac

SEQ ID NO: 113636 - RNA, 20 nt, Artificial Sequence
  MKO10113636_B_Rpl36a
  gRNA
cugcuuagaacuggaucacu

SEQ ID NO: 113637 - RNA, 20 nt, Artificial Sequence
  MKO10113637_B_Rpl36
  gRNA
ccaaacacaccaaguucgug

SEQ ID NO: 113638 - RNA, 20 nt, Artificial Sequence
  MKO10113638_B_Rpl36
  gRNA
gaggguucaucaauccuucu

SEQ ID NO: 113639 - RNA, 20 nt, Artificial Sequence
  MKO10113639_B_Rpl36
  gRNA
acauccgcgccaagagaaag

SEQ ID NO: 113640 - RNA, 20 nt, Artificial Sequence
  MKO10113640_B_Rpl37a
  gRNA
aagaugaagagacgagccgu

SEQ ID NO: 113641 - RNA, 20 nt, Artificial Sequence
  MKO10113641_B_Rpl37a
  gRNA
caguuccuucagucuucuga

SEQ ID NO: 113642 - RNA, 20 nt, Artificial Sequence
  MKO10113642_B_Rpl37a
  gRNA
gucugccaucagaagacuga

SEQ ID NO: 113643 - RNA, 20 nt, Artificial Sequence
  MKO10113643_B_Rpl37
  gRNA
cuuacacuuccucuugcgcu

SEQ ID NO: 113644 - RNA, 20 nt, Artificial Sequence
  MKO10113644_B_Rpl37
  gRNA
guuucggcguuguucccuca

SEQ ID NO: 113645 - RNA, 20 nt, Artificial Sequence
  MKO10113645_B_Rpl37
  gRNA
acgaagggaacgucauccuu

SEQ ID NO: 113646 - RNA, 20 nt, Artificial Sequence
  MKO10113646_B_Rpl38
  gRNA
uuccccagguuuggcaguga

SEQ ID NO: 113647 - RNA, 20 nt, Artificial Sequence
  MKO10113647_B_Rpl38
  gRNA
ugucaagaucaagaagaaca

SEQ ID NO: 113648 - RNA, 20 nt, Artificial Sequence
  MKO10113648_B_Rpl38
  gRNA
aggacuuucugcugacagcc

SEQ ID NO: 113649 - RNA, 20 nt, Artificial Sequence
  MKO10113649_B_Rpl39l
  gRNA
aaaaucgucccauuccacaa

SEQ ID NO: 113650 - RNA, 20 nt, Artificial Sequence
  MKO10113650_B_Rpl39l
  gRNA
aaaucauguacaacuccaag

SEQ ID NO: 113651 - RNA, 20 nt, Artificial Sequence
  MKO10113651_B_Rpl39l
  gRNA
uggcuucucacaagaccuuc

SEQ ID NO: 113652 - RNA, 20 nt, Artificial Sequence
  MKO10113652_B_Rpl39
  gRNA
agaacgaagcugggucugua

SEQ ID NO: 113653 - RNA, 20 nt, Artificial Sequence
  MKO10113653_B_Rpl39
  gRNA
ugaaaacugguaacaaaauc

SEQ ID NO: 113654 - RNA, 20 nt, Artificial Sequence
  MKO10113654_B_Rpl3l
  gRNA
uuacaggggugaccagucgc

SEQ ID NO: 113655 - RNA, 20 nt, Artificial Sequence
  MKO10113655_B_Rpl3l
  gRNA
cagcguguucagccagagug

SEQ ID NO: 113656 - RNA, 20 nt, Artificial Sequence
  MKO10113656_B_Rpl3l
  gRNA
ugacaucaauaaccucacuc

SEQ ID NO: 113657 - RNA, 20 nt, Artificial Sequence
  MKO10113657_B_Rpl3
  gRNA
auccuggccugucaacuucc

SEQ ID NO: 113658 - RNA, 20 nt, Artificial Sequence
  MKO10113658_B_Rpl3
  gRNA
ggugaacaagaaagaagucg

SEQ ID NO: 113659 - RNA, 20 nt, Artificial Sequence
  MKO10113659_B_Rpl3
  gRNA
cucagcaaauacagucuuga

SEQ ID NO: 113660 - RNA, 20 nt, Artificial Sequence
  MKO10113660_B_Rpl41
  gRNA
ggcggaagaagagaaugcgc

SEQ ID NO: 113661 - RNA, 20 nt, Artificial Sequence
  MKO10113661_B_Rpl41
  gRNA
agcgcaagagaagaaagaug

SEQ ID NO: 113662 - RNA, 20 nt, Artificial Sequence
  MKO10113662_B_Rpl4
  gRNA
gcccuaugccgucagugaau

SEQ ID NO: 113663 - RNA, 20 nt, Artificial Sequence
  MKO10113663_B_Rpl4
  gRNA
aaagaaaacagaugugucgu

SEQ ID NO: 113664 - RNA, 20 nt, Artificial Sequence
  MKO10113664_B_Rpl4
  gRNA
auacauuuccaaaggcaccc

SEQ ID NO: 113665 - RNA, 20 nt, Artificial Sequence
  MKO10113665_B_Rpl5
  gRNA
gccgccuucgaaaucucacu

SEQ ID NO: 113666 - RNA, 20 nt, Artificial Sequence
  MKO10113666_B_Rpl5
  gRNA
ugugaaaguugucaagaaua

SEQ ID NO: 113667 - RNA, 20 nt, Artificial Sequence
  MKO10113667_B_Rpl5
  gRNA
acgaacuaucauccuauauu

SEQ ID NO: 113668 - RNA, 20 nt, Artificial Sequence
  MKO10113668_B_Rpl6
  gRNA
cuuguccccaccaacuguuu

SEQ ID NO: 113669 - RNA, 20 nt, Artificial Sequence
  MKO10113669_B_Rpl6
  gRNA
agccacuguccagcugcuuc

SEQ ID NO: 113670 - RNA, 20 nt, Artificial Sequence
  MKO10113670_B_Rpl6
  gRNA
aguggcuugcugcuugugac

SEQ ID NO: 113671 - RNA, 20 nt, Artificial Sequence
  MKO10113671_B_Rpl7a
  gRNA
ccucaccugucugccugucc

SEQ ID NO: 113672 - RNA, 20 nt, Artificial Sequence
  MKO10113672_B_Rpl7a
  gRNA
cccgcuacaucagacugcag

SEQ ID NO: 113673 - RNA, 20 nt, Artificial Sequence
  MKO10113673_B_Rpl7a
  gRNA
cuuaccaaugccgaaguucu

SEQ ID NO: 113674 - RNA, 20 nt, Artificial Sequence
  MKO10113674_B_Rpl7l1
  gRNA
ucaggcaccuccaaagcacg

SEQ ID NO: 113675 - RNA, 20 nt, Artificial Sequence
  MKO10113675_B_Rpl7l1
  gRNA
cacguuucaagaugagcucc

SEQ ID NO: 113676 - RNA, 20 nt, Artificial Sequence
  MKO10113676_B_Rpl7l1
  gRNA
ucuuauuguuaaucuuugcu

SEQ ID NO: 113677 - RNA, 20 nt, Artificial Sequence
  MKO10113677_B_Rpl7
  gRNA
caacagagagaagaaaaaga

SEQ ID NO: 113678 - RNA, 20 nt, Artificial Sequence
  MKO10113678_B_Rpl7
  gRNA
ucagggcaaacuucuuccuc

SEQ ID NO: 113679 - RNA, 20 nt, Artificial Sequence
  MKO10113679_B_Rpl7
  gRNA
uaucaauggaguaagcccaa

SEQ ID NO: 113680 - RNA, 20 nt, Artificial Sequence
  MKO10113680_B_Rpl8
  gRNA
gggaucccgaaagacgacuu

SEQ ID NO: 113681 - RNA, 20 nt, Artificial Sequence
  MKO10113681_B_Rpl8
  gRNA
gcacggccagccuuuaagau

SEQ ID NO: 113682 - RNA, 20 nt, Artificial Sequence
  MKO10113682_B_Rpl8
  gRNA
gcguggaaccaaaacuguac

SEQ ID NO: 113683 - RNA, 20 nt, Artificial Sequence
  MKO10113683_B_Rpl9
  gRNA
agggcuuccgauacaagaug

SEQ ID NO: 113684 - RNA, 20 nt, Artificial Sequence
  MKO10113684_B_Rpl9
  gRNA
gucccuccgcagaguccccc

SEQ ID NO: 113685 - RNA, 20 nt, Artificial Sequence
  MKO10113685_B_Rpl9
  gRNA
guucugaacaugacugcaga

SEQ ID NO: 113686 - RNA, 20 nt, Artificial Sequence
  MKO10113686_B_Rplp0
  gRNA
cagauccgcaugucgcuccg

SEQ ID NO: 113687 - RNA, 20 nt, Artificial Sequence
  MKO10113687_B_Rplp0
  gRNA
caccuucccacuuacugaaa

SEQ ID NO: 113688 - RNA, 20 nt, Artificial Sequence
  MKO10113688_B_Rplp0
  gRNA
uuuaggugccagcugcugcu

SEQ ID NO: 113689 - RNA, 20 nt, Artificial Sequence
  MKO10113689_B_Rplp1
  gRNA
gauggagcagcaccaccagc

SEQ ID NO: 113690 - RNA, 20 nt, Artificial Sequence
  MKO10113690_B_Rplp1
  gRNA
aaugcccucauuaaagcagc

SEQ ID NO: 113691 - RNA, 20 nt, Artificial Sequence
  MKO10113691_B_Rplp1
  gRNA
gcucuggccaaugucaacau

SEQ ID NO: 113692 - RNA, 20 nt, Artificial Sequence
  MKO10113692_B_Rplp2
  gRNA
cauugaggaugucaucgcuc

SEQ ID NO: 113693 - RNA, 20 nt, Artificial Sequence
  MKO10113693_B_Rplp2
  gRNA
caggucaucagugagcugaa

SEQ ID NO: 113694 - RNA, 20 nt, Artificial Sequence
  MKO10113694_B_Rplp2
  gRNA
cuacgucgccucuuaccugc

SEQ ID NO: 113695 - RNA, 20 nt, Artificial Sequence
  MKO10113695_B_Rpn1
  gRNA
gucuauuaccgggaugagau

SEQ ID NO: 113696 - RNA, 20 nt, Artificial Sequence
  MKO10113696_B_Rpn1
  gRNA
uggaagacacacuacaucgu

SEQ ID NO: 113697 - RNA, 20 nt, Artificial Sequence
  MKO10113697_B_Rpn1
  gRNA
agugagauaccucgaugacc

SEQ ID NO: 113698 - RNA, 20 nt, Artificial Sequence
  MKO10113698_B_Rpn2
  gRNA
cgcugagugcugcaacugca

SEQ ID NO: 113699 - RNA, 20 nt, Artificial Sequence
  MKO10113699_B_Rpn2
  gRNA
gacaaucacugccagcgucc

SEQ ID NO: 113700 - RNA, 20 nt, Artificial Sequence
  MKO10113700_B_Rpn2
  gRNA
aucaagguuggacuugauga

SEQ ID NO: 113701 - RNA, 20 nt, Artificial Sequence
  MKO10113701_B_Rpp14
  gRNA
ugcuauugccagauaaugca

SEQ ID NO: 113702 - RNA, 20 nt, Artificial Sequence
  MKO10113702_B_Rpp14
  gRNA
caauagcagggaacaaguau

SEQ ID NO: 113703 - RNA, 20 nt, Artificial Sequence
  MKO10113703_B_Rpp14
  gRNA
acaguggucuggucaaauua

SEQ ID NO: 113704 - RNA, 20 nt, Artificial Sequence
  MKO10113704_B_Rpp21
  gRNA
caggccgaaagggacagcgc

SEQ ID NO: 113705 - RNA, 20 nt, Artificial Sequence
  MKO10113705_B_Rpp21
  gRNA
cuguccagcgcugucccuuu

SEQ ID NO: 113706 - RNA, 20 nt, Artificial Sequence
  MKO10113706_B_Rpp21
  gRNA
acagagcguccucuucacag

SEQ ID NO: 113707 - RNA, 20 nt, Artificial Sequence
  MKO10113707_B_Rpp25l
  gRNA
cuggcgcugggucguuugga

SEQ ID NO: 113708 - RNA, 20 nt, Artificial Sequence
  MKO10113708_B_Rpp25l
  gRNA
gcucuacagagccggcccuc

SEQ ID NO: 113709 - RNA, 20 nt, Artificial Sequence
  MKO10113709_B_Rpp25l
  gRNA
ggguugguagccacauucac

SEQ ID NO: 113710 - RNA, 20 nt, Artificial Sequence
  MKO10113710_B_Rpp25
  gRNA
ccuccuccgagcgcaccuua

SEQ ID NO: 113711 - RNA, 20 nt, Artificial Sequence
  MKO10113711_B_Rpp25
  gRNA
cucaggcugagaccgcuuag

SEQ ID NO: 113712 - RNA, 20 nt, Artificial Sequence
  MKO10113712_B_Rpp25
  gRNA
ugaccugguguaagcccgcc

SEQ ID NO: 113713 - RNA, 20 nt, Artificial Sequence
  MKO10113713_B_Rpp30
  gRNA
cugcaacaauaucauacagc

SEQ ID NO: 113714 - RNA, 20 nt, Artificial Sequence
  MKO10113714_B_Rpp30
  gRNA
caaucacauuguugacuuua

SEQ ID NO: 113715 - RNA, 20 nt, Artificial Sequence
  MKO10113715_B_Rpp30
  gRNA
uccagcucacuguaauguuu

SEQ ID NO: 113716 - RNA, 20 nt, Artificial Sequence
  MKO10113716_B_Rpp38
  gRNA
uccucgcuaaucucaauauc

SEQ ID NO: 113717 - RNA, 20 nt, Artificial Sequence
  MKO10113717_B_Rpp38
  gRNA
gguggacaccuguacacguc

SEQ ID NO: 113718 - RNA, 20 nt, Artificial Sequence
  MKO10113718_B_Rpp38
  gRNA
agcuguuuccugacguguac

SEQ ID NO: 113719 - RNA, 20 nt, Artificial Sequence
  MKO10113719_B_Rpp40
  gRNA
uuugauagaagcccacauuc

SEQ ID NO: 113720 - RNA, 20 nt, Artificial Sequence
  MKO10113720_B_Rpp40
  gRNA
acuguugcucuccuaccaaa

SEQ ID NO: 113721 - RNA, 20 nt, Artificial Sequence
  MKO10113721_B_Rpp40
  gRNA
agucauuuccauugaccuaa

SEQ ID NO: 113722 - RNA, 20 nt, Artificial Sequence
  MKO10113722_B_Rprd1a
  gRNA
aaucuuguaaugcucuaaca

SEQ ID NO: 113723 - RNA, 20 nt, Artificial Sequence
  MKO10113723_B_Rprd1a
  gRNA
aggcauucaagcauguuuca

SEQ ID NO: 113724 - RNA, 20 nt, Artificial Sequence
  MKO10113724_B_Rprd1a
  gRNA
guccccaagugagccaccac

SEQ ID NO: 113725 - RNA, 20 nt, Artificial Sequence
  MKO10113725_B_Rprd1b
  gRNA
ucuuggggagaguagcuucc

SEQ ID NO: 113726 - RNA, 20 nt, Artificial Sequence
  MKO10113726_B_Rprd1b
  gRNA
auguucagcaaucuuucuaa

SEQ ID NO: 113727 - RNA, 20 nt, Artificial Sequence
  MKO10113727_B_Rprd1b
  gRNA
ucuccccaagacccuucugc

SEQ ID NO: 113728 - RNA, 20 nt, Artificial Sequence
  MKO10113728_B_Rprd2
  gRNA
gauuucuuccacugcuuauu

SEQ ID NO: 113729 - RNA, 20 nt, Artificial Sequence
  MKO10113729_B_Rprd2
  gRNA
augucauacagaauuguaaa

SEQ ID NO: 113730 - RNA, 20 nt, Artificial Sequence
  MKO10113730_B_Rprd2
  gRNA
acaaacaaccgaauaagcag

SEQ ID NO: 113731 - RNA, 20 nt, Artificial Sequence
  MKO10113731_B_Rprml
  gRNA
gcgccacgcgcgacacccac

SEQ ID NO: 113732 - RNA, 20 nt, Artificial Sequence
  MKO10113732_B_Rprml
  gRNA
uucguccggcgccaguccug

SEQ ID NO: 113733 - RNA, 20 nt, Artificial Sequence
  MKO10113733_B_Rprml
  gRNA
ggcggcgcccacguccuugg

SEQ ID NO: 113734 - RNA, 20 nt, Artificial Sequence
  MKO10113734_B_Rprm
  gRNA
cgucggucaccaccgacgcc

SEQ ID NO: 113735 - RNA, 20 nt, Artificial Sequence
  MKO10113735_B_Rprm
  gRNA
acaggccagccacgucgguc

SEQ ID NO: 113736 - RNA, 20 nt, Artificial Sequence
  MKO10113736_B_Rprm
  gRNA
cagccuguacaucaugcgug

SEQ ID NO: 113737 - RNA, 20 nt, Artificial Sequence
  MKO10113737_B_Rps10
  gRNA
cugcagucucucaagucucg

SEQ ID NO: 113738 - RNA, 20 nt, Artificial Sequence
  MKO10113738_B_Rps10
  gRNA
cgaccugcaagauucacaag

SEQ ID NO: 113739 - RNA, 20 nt, Artificial Sequence
  MKO10113739_B_Rps10
  gRNA
gggcacagcgcuccuucugu

SEQ ID NO: 113740 - RNA, 20 nt, Artificial Sequence
  MKO10113740_B_Rps11
  gRNA
accagagucaccugaaacag

SEQ ID NO: 113741 - RNA, 20 nt, Artificial Sequence
  MKO10113741_B_Rps11
  gRNA
gacaagaaaugccccuucac

SEQ ID NO: 113742 - RNA, 20 nt, Artificial Sequence
  MKO10113742_B_Rps11
  gRNA
caccagacaggauccgaccu

SEQ ID NO: 113743 - RNA, 20 nt, Artificial Sequence
  MKO10113743_B_Rps12
  gRNA
ugagcccauguaugucaagc

SEQ ID NO: 113744 - RNA, 20 nt, Artificial Sequence
  MKO10113744_B_Rps12
  gRNA
guugaugacaacaagaaacu

SEQ ID NO: 113745 - RNA, 20 nt, Artificial Sequence
  MKO10113745_B_Rps12
  gRNA
cugcaaccaaccaccuuccg

SEQ ID NO: 113746 - RNA, 20 nt, Artificial Sequence
  MKO10113746_B_Rps13
  gRNA
uauacuuacuauuuccaauu

SEQ ID NO: 113747 - RNA, 20 nt, Artificial Sequence
  MKO10113747_B_Rps13
  gRNA
uuaccuuucuguuccucuca

SEQ ID NO: 113748 - RNA, 20 nt, Artificial Sequence
  MKO10113748_B_Rps13
  gRNA
guugacgucugacgacguga

SEQ ID NO: 113749 - RNA, 20 nt, Artificial Sequence
  MKO10113749_B_Rps14
  gRNA
cauauggagaggacucaucu

SEQ ID NO: 113750 - RNA, 20 nt, Artificial Sequence
  MKO10113750_B_Rps14
  gRNA
cucuccauaugcagccaugu

SEQ ID NO: 113751 - RNA, 20 nt, Artificial Sequence
  MKO10113751_B_Rps14
  gRNA
cagagcgagcaagagcucug

SEQ ID NO: 113752 - RNA, 20 nt, Artificial Sequence
  MKO10113752_B_Rps15a
  gRNA
cauggugcgaaugaauguuc

SEQ ID NO: 113753 - RNA, 20 nt, Artificial Sequence
  MKO10113753_B_Rps15a
  gRNA
aucauugaugaucacagagc

SEQ ID NO: 113754 - RNA, 20 nt, Artificial Sequence
  MKO10113754_B_Rps15a
  gRNA
ccuuguucaaccuuccugug

SEQ ID NO: 113755 - RNA, 20 nt, Artificial Sequence
  MKO10113755_B_Rps15
  gRNA
guugcuuccgccgaagacca

SEQ ID NO: 113756 - RNA, 20 nt, Artificial Sequence
  MKO10113756_B_Rps15
  gRNA
uuccgcaaguucaccuaccg

SEQ ID NO: 113757 - RNA, 20 nt, Artificial Sequence
  MKO10113757_B_Rps15
  gRNA
auuggccucggcuacuugag

SEQ ID NO: 113758 - RNA, 20 nt, Artificial Sequence
  MKO10113758_B_Rps16
  gRNA
ggacauguggcccaaauuua

SEQ ID NO: 113759 - RNA, 20 nt, Artificial Sequence
  MKO10113759_B_Rps16
  gRNA
cauccgacaguccaucucaa

SEQ ID NO: 113760 - RNA, 20 nt, Artificial Sequence
  MKO10113760_B_Rps16
  gRNA
cuuugagauggacugucgga

SEQ ID NO: 113761 - RNA, 20 nt, Artificial Sequence
  MKO10113761_B_Rps17
  gRNA
uugauagagaugccucucac

SEQ ID NO: 113762 - RNA, 20 nt, Artificial Sequence
  MKO10113762_B_Rps17
  gRNA
ucaggucucagcccuagauc

SEQ ID NO: 113763 - RNA, 20 nt, Artificial Sequence
  MKO10113763_B_Rps17
  gRNA
caggagcuucagcaucuccu

SEQ ID NO: 113764 - RNA, 20 nt, Artificial Sequence
  MKO10113764_B_Rps18
  gRNA
uuugaccucagggcgugggg

SEQ ID NO: 113765 - RNA, 20 nt, Artificial Sequence
  MKO10113765_B_Rps18
  gRNA
guacucaacaccaacaucga

SEQ ID NO: 113766 - RNA, 20 nt, Artificial Sequence
  MKO10113766_B_Rps18
  gRNA
cuucgccaucacugccauua

SEQ ID NO: 113767 - RNA, 20 nt, Artificial Sequence
  MKO10113767_B_Rps19bp1
  gRNA
acaugucggcggcguuagug

SEQ ID NO: 113768 - RNA, 20 nt, Artificial Sequence
  MKO10113768_B_Rps19bp1
  gRNA
ggagcuucuggcggcguccg

SEQ ID NO: 113769 - RNA, 20 nt, Artificial Sequence
  MKO10113769_B_Rps19bp1
  gRNA
aaaagccugugaucggcuag

SEQ ID NO: 113770 - RNA, 20 nt, Artificial Sequence
  MKO10113770_B_Rps19
  gRNA
uagaaccaguucucaucaua

SEQ ID NO: 113771 - RNA, 20 nt, Artificial Sequence
  MKO10113771_B_Rps19
  gRNA
ggaagcugaaaguccccgaa

SEQ ID NO: 113772 - RNA, 20 nt, Artificial Sequence
  MKO10113772_B_Rps19
  gRNA
ucuuagagccucugcugaaa

SEQ ID NO: 113773 - RNA, 20 nt, Artificial Sequence
  MKO10113773_B_Rps20
  gRNA
aacucccggcucaauacuga

SEQ ID NO: 113774 - RNA, 20 nt, Artificial Sequence
  MKO10113774_B_Rps20
  gRNA
ucuccagcgacuucacguug

SEQ ID NO: 113775 - RNA, 20 nt, Artificial Sequence
  MKO10113775_B_Rps20
  gRNA
acuaccagaaaaacaccuug

SEQ ID NO: 113776 - RNA, 20 nt, Artificial Sequence
  MKO10113776_B_Rps21
  gRNA
caaccgcaucauugcugcca

SEQ ID NO: 113777 - RNA, 20 nt, Artificial Sequence
  MKO10113777_B_Rps21
  gRNA
uuccaucagccuuagccaau

SEQ ID NO: 113778 - RNA, 20 nt, Artificial Sequence
  MKO10113778_B_Rps21
  gRNA
agaugauucuauucuccgau

SEQ ID NO: 113779 - RNA, 20 nt, Artificial Sequence
  MKO10113779_B_Rps23
  gRNA
ccccaaacggauuggccuuc

SEQ ID NO: 113780 - RNA, 20 nt, Artificial Sequence
  MKO10113780_B_Rps23
  gRNA
aacagccaaauucugccauc

SEQ ID NO: 113781 - RNA, 20 nt, Artificial Sequence
  MKO10113781_B_Rps23
  gRNA
uagagccaacagagaaacau

SEQ ID NO: 113782 - RNA, 20 nt, Artificial Sequence
  MKO10113782_B_Rps24
  gRNA
ucuguuuccucugaagcaga

SEQ ID NO: 113783 - RNA, 20 nt, Artificial Sequence
  MKO10113783_B_Rps24
  gRNA
gaccucccgaaaacagcgaa

SEQ ID NO: 113784 - RNA, 20 nt, Artificial Sequence
  MKO10113784_B_Rps24
  gRNA
acgcaagaacagaaugaaga

SEQ ID NO: 113785 - RNA, 20 nt, Artificial Sequence
  MKO10113785_B_Rps25
  gRNA
gacaagaagaagaaagaugc

SEQ ID NO: 113786 - RNA, 20 nt, Artificial Sequence
  MKO10113786_B_Rps25
  gRNA
cuuuacuaaggagcuccuga

SEQ ID NO: 113787 - RNA, 20 nt, Artificial Sequence
  MKO10113787_B_Rps25
  gRNA
caugcaucuucgccagcagc

SEQ ID NO: 113788 - RNA, 20 nt, Artificial Sequence
  MKO10113788_B_Rps26
  gRNA
gagcugugccauccauagca

SEQ ID NO: 113789 - RNA, 20 nt, Artificial Sequence
  MKO10113789_B_Rps26
  gRNA
cggccucuuuacaugggcuu

SEQ ID NO: 113790 - RNA, 20 nt, Artificial Sequence
  MKO10113790_B_Rps26
  gRNA
agauaugucccugacagcag

SEQ ID NO: 113791 - RNA, 20 nt, Artificial Sequence
  MKO10113791_B_Rps27a
  gRNA
gaauuccuccugaucagcag

SEQ ID NO: 113792 - RNA, 20 nt, Artificial Sequence
  MKO10113792_B_Rps27a
  gRNA
uguuguagucagacaaaguc

SEQ ID NO: 113793 - RNA, 20 nt, Artificial Sequence
  MKO10113793_B_Rps27a
  gRNA
ccucuuaugcuuguucuucu

SEQ ID NO: 113794 - RNA, 20 nt, Artificial Sequence
  MKO10113794_B_Rps27l
  gRNA
agaaaaaacauaagaagaaa

SEQ ID NO: 113795 - RNA, 20 nt, Artificial Sequence
  MKO10113795_B_Rps27l
  gRNA
aaagaaccacagucugugca

SEQ ID NO: 113796 - RNA, 20 nt, Artificial Sequence
  MKO10113796_B_Rps27l
  gRNA
acauccaugaaguaagaauu

SEQ ID NO: 113797 - RNA, 20 nt, Artificial Sequence
  MKO10113797_B_Rps27rt
  gRNA
gaaacacaagaaaaagcgcc

SEQ ID NO: 113798 - RNA, 20 nt, Artificial Sequence
  MKO10113798_B_Rps27rt
  gRNA
acaagacuaccguuugugca

SEQ ID NO: 113799 - RNA, 20 nt, Artificial Sequence
  MKO10113799_B_Rps27rt
  gRNA
gagccccaauuccuacuuua

SEQ ID NO: 113800 - RNA, 20 nt, Artificial Sequence
  MKO10113800_B_Rps27
  gRNA
aggaugcuauaaaaucacca

SEQ ID NO: 113801 - RNA, 20 nt, Artificial Sequence
  MKO10113801_B_Rps27
  gRNA
caaacgguagucuugugugu

SEQ ID NO: 113802 - RNA, 20 nt, Artificial Sequence
  MKO10113802_B_Rps27
  gRNA
ucagugcugcuuccuccuga

SEQ ID NO: 113803 - RNA, 20 nt, Artificial Sequence
  MKO10113803_B_Rps28
  gRNA
ucgcgugcagcccaucaagc

SEQ ID NO: 113804 - RNA, 20 nt, Artificial Sequence
  MKO10113804_B_Rps28
  gRNA
cgugcacugucccugcgaac

SEQ ID NO: 113805 - RNA, 20 nt, Artificial Sequence
  MKO10113805_B_Rps28
  gRNA
cuucucuuucugacuccaau

SEQ ID NO: 113806 - RNA, 20 nt, Artificial Sequence
  MKO10113806_B_Rps29
  gRNA
cgcgucugcuccaaccgcca

SEQ ID NO: 113807 - RNA, 20 nt, Artificial Sequence
  MKO10113807_B_Rps29
  gRNA
ucacccacggaaguucggcc

SEQ ID NO: 113808 - RNA, 20 nt, Artificial Sequence
  MKO10113808_B_Rps29
  gRNA
ggugacuccaguagagcugc

SEQ ID NO: 113809 - RNA, 20 nt, Artificial Sequence
  MKO10113809_B_Rps2
  gRNA
gcuaccugacucccgaccuc

SEQ ID NO: 113810 - RNA, 20 nt, Artificial Sequence
  MKO10113810_B_Rps2
  gRNA
gaauaccugauaaggagacu

SEQ ID NO: 113811 - RNA, 20 nt, Artificial Sequence
  MKO10113811_B_Rps2
  gRNA
guggauccccgucaccaagc

SEQ ID NO: 113812 - RNA, 20 nt, Artificial Sequence
  MKO10113812_B_Rps3a1
  gRNA
agucauuagucugcaccucu

SEQ ID NO: 113813 - RNA, 20 nt, Artificial Sequence
  MKO10113813_B_Rps3a1
  gRNA
gauguuccuaauauugaaca

SEQ ID NO: 113814 - RNA, 20 nt, Artificial Sequence
  MKO10113814_B_Rps3a1
  gRNA
cuccagccauguucaauauu

SEQ ID NO: 113815 - RNA, 20 nt, Artificial Sequence
  MKO10113815_B_Rps3
  gRNA
cuucccugaaggcagcguag

SEQ ID NO: 113816 - RNA, 20 nt, Artificial Sequence
  MKO10113816_B_Rps3
  gRNA
gucuuccaaagggccugcua

SEQ ID NO: 113817 - RNA, 20 nt, Artificial Sequence
  MKO10113817_B_Rps3
  gRNA
cuggcugaagauggcuacuc

SEQ ID NO: 113818 - RNA, 20 nt, Artificial Sequence
  MKO10113818_B_Rps4x
  gRNA
guguagcugcuccaaaacau

SEQ ID NO: 113819 - RNA, 20 nt, Artificial Sequence
  MKO10113819_B_Rps4x
  gRNA
uuauccagcauccaauguuu

SEQ ID NO: 113820 - RNA, 20 nt, Artificial Sequence
  MKO10113820_B_Rps4x
  gRNA
gucaucagcauugacaagac

SEQ ID NO: 113821 - RNA, 20 nt, Artificial Sequence
  MKO10113821_B_Rps5
  gRNA
uugugcuuugcggaagcgcu

SEQ ID NO: 113822 - RNA, 20 nt, Artificial Sequence
  MKO10113822_B_Rps5
  gRNA
cggcgauggucuugauguuc

SEQ ID NO: 113823 - RNA, 20 nt, Artificial Sequence
  MKO10113823_B_Rps5
  gRNA
gggaaaucagcgguuagacu

SEQ ID NO: 113824 - RNA, 20 nt, Artificial Sequence
  MKO10113824_B_Rps6ka1
  gRNA
ucaggucuuccugguacgca

SEQ ID NO: 113825 - RNA, 20 nt, Artificial Sequence
  MKO10113825_B_Rps6ka1
  gRNA
cucuaacucaccuuucagcg

SEQ ID NO: 113826 - RNA, 20 nt, Artificial Sequence
  MKO10113826_B_Rps6ka1
  gRNA
aucccaguuugagcuccuca

SEQ ID NO: 113827 - RNA, 20 nt, Artificial Sequence
  MKO10113827_B_Rps6ka2
  gRNA
ugaagaggucaccuccccgc

SEQ ID NO: 113828 - RNA, 20 nt, Artificial Sequence
  MKO10113828_B_Rps6ka2
  gRNA
uccacagccuuucagaccga

SEQ ID NO: 113829 - RNA, 20 nt, Artificial Sequence
  MKO10113829_B_Rps6ka2
  gRNA
gggacccuuaccuuucaagg

SEQ ID NO: 113830 - RNA, 20 nt, Artificial Sequence
  MKO10113830_B_Rps6ka3
  gRNA
ugcaaucacacaucauguga

SEQ ID NO: 113831 - RNA, 20 nt, Artificial Sequence
  MKO10113831_B_Rps6ka3
  gRNA
acagaauggacagcaaauua

SEQ ID NO: 113832 - RNA, 20 nt, Artificial Sequence
  MKO10113832_B_Rps6ka3
  gRNA
uuaaucuccuccucucccau

SEQ ID NO: 113833 - RNA, 20 nt, Artificial Sequence
  MKO10113833_B_Rps6ka4
  gRNA
ucacucccagacuacgugag

SEQ ID NO: 113834 - RNA, 20 nt, Artificial Sequence
  MKO10113834_B_Rps6ka4
  gRNA
cacaucguccuuacagacuu

SEQ ID NO: 113835 - RNA, 20 nt, Artificial Sequence
  MKO10113835_B_Rps6ka4
  gRNA
aggcugagguucgaguguau

SEQ ID NO: 113836 - RNA, 20 nt, Artificial Sequence
  MKO10113836_B_Rps6ka5
  gRNA
uucucuuuagccaacuuaac

SEQ ID NO: 113837 - RNA, 20 nt, Artificial Sequence
  MKO10113837_B_Rps6ka5
  gRNA
accuaagaugagaugaagcu

SEQ ID NO: 113838 - RNA, 20 nt, Artificial Sequence
  MKO10113838_B_Rps6ka5
  gRNA
cgaaaucugucagcaccaca

SEQ ID NO: 113839 - RNA, 20 nt, Artificial Sequence
  MKO10113839_B_Rps6ka6
  gRNA
gcgggagcaugaacgcaaag

SEQ ID NO: 113840 - RNA, 20 nt, Artificial Sequence
  MKO10113840_B_Rps6ka6
  gRNA
cuugagcaagucaaacugug

SEQ ID NO: 113841 - RNA, 20 nt, Artificial Sequence
  MKO10113841_B_Rps6ka6
  gRNA
aaccguugcugcguucuuca

SEQ ID NO: 113842 - RNA, 20 nt, Artificial Sequence
  MKO10113842_B_Rps6kb1
  gRNA
cauaugguccaacuccccca

SEQ ID NO: 113843 - RNA, 20 nt, Artificial Sequence
  MKO10113843_B_Rps6kb1
  gRNA
uuucaaguacgaaaaguaac

SEQ ID NO: 113844 - RNA, 20 nt, Artificial Sequence
  MKO10113844_B_Rps6kb1
  gRNA
cgaaguagcucaaaacauuc

SEQ ID NO: 113845 - RNA, 20 nt, Artificial Sequence
  MKO10113845_B_Rps6kb2
  gRNA
cagcagcccuuaauucgcca

SEQ ID NO: 113846 - RNA, 20 nt, Artificial Sequence
  MKO10113846_B_Rps6kb2
  gRNA
gacagagagcagcgugaacc

SEQ ID NO: 113847 - RNA, 20 nt, Artificial Sequence
  MKO10113847_B_Rps6kb2
  gRNA
caagauuguaugcagugcca

SEQ ID NO: 113848 - RNA, 20 nt, Artificial Sequence
  MKO10113848_B_Rps6kc1
  gRNA
cuauuucccccguuugcuaa

SEQ ID NO: 113849 - RNA, 20 nt, Artificial Sequence
  MKO10113849_B_Rps6kc1
  gRNA
aaggcguuggccggggaguc

SEQ ID NO: 113850 - RNA, 20 nt, Artificial Sequence
  MKO10113850_B_Rps6kc1
  gRNA
ggagcgacggcagugugcug

SEQ ID NO: 113851 - RNA, 20 nt, Artificial Sequence
  MKO10113851_B_Rps6kl1
  gRNA
cugaagggaugcagggucgu

SEQ ID NO: 113852 - RNA, 20 nt, Artificial Sequence
  MKO10113852_B_Rps6kl1
  gRNA
ccccacaguugaccccaaca

SEQ ID NO: 113853 - RNA, 20 nt, Artificial Sequence
  MKO10113853_B_Rps6kl1
  gRNA
uggaggaaccuucaucguga

SEQ ID NO: 113854 - RNA, 20 nt, Artificial Sequence
  MKO10113854_B_Rps6
  gRNA
aacaucuccuuccccgccac

SEQ ID NO: 113855 - RNA, 20 nt, Artificial Sequence
  MKO10113855_B_Rps6
  gRNA
cucuucaccaagagcaucag

SEQ ID NO: 113856 - RNA, 20 nt, Artificial Sequence
  MKO10113856_B_Rps6
  gRNA
uuccucucuccaguucuccu

SEQ ID NO: 113857 - RNA, 20 nt, Artificial Sequence
  MKO10113857_B_Rps7
  gRNA
uccccaggcgcugcucgagc

SEQ ID NO: 113858 - RNA, 20 nt, Artificial Sequence
  MKO10113858_B_Rps7
  gRNA
ccgcagcugcgccuugagau

SEQ ID NO: 113859 - RNA, 20 nt, Artificial Sequence
  MKO10113859_B_Rps7
  gRNA
ggauucugcccaagccaacc

SEQ ID NO: 113860 - RNA, 20 nt, Artificial Sequence
  MKO10113860_B_Rps8
  gRNA
uuucauucagacuccugagg

SEQ ID NO: 113861 - RNA, 20 nt, Artificial Sequence
  MKO10113861_B_Rps8
  gRNA
cuacuuacacucagagcccc

SEQ ID NO: 113862 - RNA, 20 nt, Artificial Sequence
  MKO10113862_B_Rps8
  gRNA
uuccagcagggcaagcuucu

SEQ ID NO: 113863 - RNA, 20 nt, Artificial Sequence
  MKO10113863_B_Rps9
  gRNA
acacaccuucaaacagacgc

SEQ ID NO: 113864 - RNA, 20 nt, Artificial Sequence
  MKO10113864_B_Rps9
  gRNA
ucgagacgcgacuucucgaa

SEQ ID NO: 113865 - RNA, 20 nt, Artificial Sequence
  MKO10113865_B_Rps9
  gRNA
gcuguugacgcuagacgaga

SEQ ID NO: 113866 - RNA, 20 nt, Artificial Sequence
  MKO10113866_B_Rpsa
  gRNA
acaaaccuggccaguguucc

SEQ ID NO: 113867 - RNA, 20 nt, Artificial Sequence
  MKO10113867_B_Rpsa
  gRNA
aaaaaacuagauugagaagg

SEQ ID NO: 113868 - RNA, 20 nt, Artificial Sequence
  MKO10113868_B_Rpsa
  gRNA
ucuacaucauaaaccugaag

SEQ ID NO: 113869 - RNA, 20 nt, Artificial Sequence
  MKO10113869_B_Rptn
  gRNA
uagcauucucaacguaagca

SEQ ID NO: 113870 - RNA, 20 nt, Artificial Sequence
  MKO10113870_B_Rptn
  gRNA
gacucauauguugaacaauc

SEQ ID NO: 113871 - RNA, 20 nt, Artificial Sequence
  MKO10113871_B_Rptn
  gRNA
caugauauucagcauagucc

SEQ ID NO: 113872 - RNA, 20 nt, Artificial Sequence
  MKO10113872_B_Rptor
  gRNA
gcaccccguggccauuguag

SEQ ID NO: 113873 - RNA, 20 nt, Artificial Sequence
  MKO10113873_B_Rptor
  gRNA
guggucuucaccacauccgg

SEQ ID NO: 113874 - RNA, 20 nt, Artificial Sequence
  MKO10113874_B_Rptor
  gRNA
ccagcauuccagccgagcac

SEQ ID NO: 113875 - RNA, 20 nt, Artificial Sequence
  MKO10113875_B_Rpusd1
  gRNA
cuggaacacggccuauaugc

SEQ ID NO: 113876 - RNA, 20 nt, Artificial Sequence
  MKO10113876_B_Rpusd1
  gRNA
uaagucaggucacccacgau

SEQ ID NO: 113877 - RNA, 20 nt, Artificial Sequence
  MKO10113877_B_Rpusd1
  gRNA
cacugcagugcacacgaagc

SEQ ID NO: 113878 - RNA, 20 nt, Artificial Sequence
  MKO10113878_B_Rpusd2
  gRNA
cgagugccgaguguugcgac

SEQ ID NO: 113879 - RNA, 20 nt, Artificial Sequence
  MKO10113879_B_Rpusd2
  gRNA
cugcaugcccuccgcuauaa

SEQ ID NO: 113880 - RNA, 20 nt, Artificial Sequence
  MKO10113880_B_Rpusd2
  gRNA
gcuagcugagaacaacgaug

SEQ ID NO: 113881 - RNA, 20 nt, Artificial Sequence
  MKO10113881_B_Rpusd3
  gRNA
gcuccugguguucgagcccc

SEQ ID NO: 113882 - RNA, 20 nt, Artificial Sequence
  MKO10113882_B_Rpusd3
  gRNA
ucaccgcuccagcaagcaca

SEQ ID NO: 113883 - RNA, 20 nt, Artificial Sequence
  MKO10113883_B_Rpusd3
  gRNA
gcuggagaggagcacaaguc

SEQ ID NO: 113884 - RNA, 20 nt, Artificial Sequence
  MKO10113884_B_Rpusd4
  gRNA
agucguggauauccccauca

SEQ ID NO: 113885 - RNA, 20 nt, Artificial Sequence
  MKO10113885_B_Rpusd4
  gRNA
ugccuacaaaccccguucag

SEQ ID NO: 113886 - RNA, 20 nt, Artificial Sequence
  MKO10113886_B_Rpusd4
  gRNA
gcuguccccaaguuaccguc

SEQ ID NO: 113887 - RNA, 20 nt, Artificial Sequence
  MKO10113887_B_Rqcd1
  gRNA
gccuacugcacuagcccaag

SEQ ID NO: 113888 - RNA, 20 nt, Artificial Sequence
  MKO10113888_B_Rqcd1
  gRNA
cauugcaaacucuguuagac

SEQ ID NO: 113889 - RNA, 20 nt, Artificial Sequence
  MKO10113889_B_Rqcd1
  gRNA
cccucugugucugcgcauca

SEQ ID NO: 113890 - RNA, 20 nt, Artificial Sequence
  MKO10113890_B_Rrad
  gRNA
caagaaggccaaacgcuuuc

SEQ ID NO: 113891 - RNA, 20 nt, Artificial Sequence
  MKO10113891_B_Rrad
  gRNA
gaugacguaugcauccccca

SEQ ID NO: 113892 - RNA, 20 nt, Artificial Sequence
  MKO10113892_B_Rrad
  gRNA
ggcaagcuggcacucggcga

SEQ ID NO: 113893 - RNA, 20 nt, Artificial Sequence
  MKO10113893_B_Rraga
  gRNA
gcacucccacguccgauucu

SEQ ID NO: 113894 - RNA, 20 nt, Artificial Sequence
  MKO10113894_B_Rraga
  gRNA
uacaucaaacacguacguga

SEQ ID NO: 113895 - RNA, 20 nt, Artificial Sequence
  MKO10113895_B_Rraga
  gRNA
gcauuauuaccaaucguguc

SEQ ID NO: 113896 - RNA, 20 nt, Artificial Sequence
  MKO10113896_B_Rragb
  gRNA
aacagagucuacgagagagu

SEQ ID NO: 113897 - RNA, 20 nt, Artificial Sequence
  MKO10113897_B_Rragb
  gRNA
cuuacccaccacaaucccac

SEQ ID NO: 113898 - RNA, 20 nt, Artificial Sequence
  MKO10113898_B_Rragb
  gRNA
uaauuugaagacuauguaua

SEQ ID NO: 113899 - RNA, 20 nt, Artificial Sequence
  MKO10113899_B_Rragc
  gRNA
ucauaagacugcauauccac

SEQ ID NO: 113900 - RNA, 20 nt, Artificial Sequence
  MKO10113900_B_Rragc
  gRNA
gaagaucauuucguagucaa

SEQ ID NO: 113901 - RNA, 20 nt, Artificial Sequence
  MKO10113901_B_Rragc
  gRNA
cauuccacaacugcccacuu

SEQ ID NO: 113902 - RNA, 20 nt, Artificial Sequence
  MKO10113902_B_Rragd
  gRNA
gaucccacagcucccgacgc

SEQ ID NO: 113903 - RNA, 20 nt, Artificial Sequence
  MKO10113903_B_Rragd
  gRNA
aacgaugaccucgcugaugc

SEQ ID NO: 113904 - RNA, 20 nt, Artificial Sequence
  MKO10113904_B_Rragd
  gRNA
aucgacaucucuuguauuua

SEQ ID NO: 113905 - RNA, 20 nt, Artificial Sequence
  MKO10113905_B_Rras2
  gRNA
ugaucgaugaccgagcugcc

SEQ ID NO: 113906 - RNA, 20 nt, Artificial Sequence
  MKO10113906_B_Rras2
  gRNA
ccgugacugagaagaccaac

SEQ ID NO: 113907 - RNA, 20 nt, Artificial Sequence
  MKO10113907_B_Rras2
  gRNA
ccaugagagagcaauacaug

SEQ ID NO: 113908 - RNA, 20 nt, Artificial Sequence
  MKO10113908_B_Rras
  gRNA
ucaccucugccugucguuaa

SEQ ID NO: 113909 - RNA, 20 nt, Artificial Sequence
  MKO10113909_B_Rras
  gRNA
acugcgucugaaugucgaug

SEQ ID NO: 113910 - RNA, 20 nt, Artificial Sequence
  MKO10113910_B_Rras
  gRNA
agaucuggagaaccagcgcc

SEQ ID NO: 113911 - RNA, 20 nt, Artificial Sequence
  MKO10113911_B_Rrbp1
  gRNA
uguggucuuuggcggguuua

SEQ ID NO: 113912 - RNA, 20 nt, Artificial Sequence
  MKO10113912_B_Rrbp1
  gRNA
ccgucgccaagagcaagcua

SEQ ID NO: 113913 - RNA, 20 nt, Artificial Sequence
  MKO10113913_B_Rrbp1
  gRNA
gaguucccuuagcuugcucu

SEQ ID NO: 113914 - RNA, 20 nt, Artificial Sequence
  MKO10113914_B_Rreb1
  gRNA
gacaaccgccugcgcuucag

SEQ ID NO: 113915 - RNA, 20 nt, Artificial Sequence
  MKO10113915_B_Rreb1
  gRNA
uuccuucugccaauccgauu

SEQ ID NO: 113916 - RNA, 20 nt, Artificial Sequence
  MKO10113916_B_Rreb1
  gRNA
ucccacagauacugcaugcg

SEQ ID NO: 113917 - RNA, 20 nt, Artificial Sequence
  MKO10113917_B_Rrh
  gRNA
gucucagggaccgacugacg

SEQ ID NO: 113918 - RNA, 20 nt, Artificial Sequence
  MKO10113918_B_Rrh
  gRNA
accuacaucagggcaacuga

SEQ ID NO: 113919 - RNA, 20 nt, Artificial Sequence
  MKO10113919_B_Rrh
  gRNA
ccccuauauccgugaaagcc

SEQ ID NO: 113920 - RNA, 20 nt, Artificial Sequence
  MKO10113920_B_Rrm1
  gRNA
ugaccccacuauauaggccu

SEQ ID NO: 113921 - RNA, 20 nt, Artificial Sequence
  MKO10113921_B_Rrm1
  gRNA
cgaauccagaaacucuguua

SEQ ID NO: 113922 - RNA, 20 nt, Artificial Sequence
  MKO10113922_B_Rrm1
  gRNA
cucaacacucgacauuguua

SEQ ID NO: 113923 - RNA, 20 nt, Artificial Sequence
  MKO10113923_B_Rrm2b
  gRNA
uuguacauucuccagauauc

SEQ ID NO: 113924 - RNA, 20 nt, Artificial Sequence
  MKO10113924_B_Rrm2b
  gRNA
uuggaaagaugacgaaccgu

SEQ ID NO: 113925 - RNA, 20 nt, Artificial Sequence
  MKO10113925_B_Rrm2b
  gRNA
uucauuuacaauuccaucac

SEQ ID NO: 113926 - RNA, 20 nt, Artificial Sequence
  MKO10113926_B_Rrm2
  gRNA
cgaugggaaagacaacgaag

SEQ ID NO: 113927 - RNA, 20 nt, Artificial Sequence
  MKO10113927_B_Rrm2
  gRNA
uucccagugcugaauauccu

SEQ ID NO: 113928 - RNA, 20 nt, Artificial Sequence
  MKO10113928_B_Rrm2
  gRNA
gccuacuaaccccagcguug

SEQ ID NO: 113929 - RNA, 20 nt, Artificial Sequence
  MKO10113929_B_Rrn3
  gRNA
aggaugaccagaucauuaac

SEQ ID NO: 113930 - RNA, 20 nt, Artificial Sequence
  MKO10113930_B_Rrn3
  gRNA
gcugucugauccugauauaa

SEQ ID NO: 113931 - RNA, 20 nt, Artificial Sequence
  MKO10113931_B_Rrn3
  gRNA
uucaucucuagagauugccc

SEQ ID NO: 113932 - RNA, 20 nt, Artificial Sequence
  MKO10113932_B_Rrnad1
  gRNA
uggacugaacccaccacagc

SEQ ID NO: 113933 - RNA, 20 nt, Artificial Sequence
  MKO10113933_B_Rrnad1
  gRNA
cugagcccacauccacaacu

SEQ ID NO: 113934 - RNA, 20 nt, Artificial Sequence
  MKO10113934_B_Rrnad1
  gRNA
ccagugcuucuugccaugag

SEQ ID NO: 113935 - RNA, 20 nt, Artificial Sequence
  MKO10113935_B_Rrp12
  gRNA
augucugcgcaggcgagcag

SEQ ID NO: 113936 - RNA, 20 nt, Artificial Sequence
  MKO10113936_B_Rrp12
  gRNA
acacucaccgcuucaggaca

SEQ ID NO: 113937 - RNA, 20 nt, Artificial Sequence
  MKO10113937_B_Rrp12
  gRNA
acugacccaucggagagcag

SEQ ID NO: 113938 - RNA, 20 nt, Artificial Sequence
  MKO10113938_B_Rrp15
  gRNA
ucucgcagaaucuuccaccc

SEQ ID NO: 113939 - RNA, 20 nt, Artificial Sequence
  MKO10113939_B_Rrp15
  gRNA
ggucccagcacucgacucug

SEQ ID NO: 113940 - RNA, 20 nt, Artificial Sequence
  MKO10113940_B_Rrp15
  gRNA
acaaguaggaacaguccugc

SEQ ID NO: 113941 - RNA, 20 nt, Artificial Sequence
  MKO10113941_B_Rrp1b
  gRNA
gcagcuggacaaguacuaca

SEQ ID NO: 113942 - RNA, 20 nt, Artificial Sequence
  MKO10113942_B_Rrp1b
  gRNA
cauccacguuguaaacagcu

SEQ ID NO: 113943 - RNA, 20 nt, Artificial Sequence
  MKO10113943_B_Rrp1b
  gRNA
gcaggacgagccccuucugc

SEQ ID NO: 113944 - RNA, 20 nt, Artificial Sequence
  MKO10113944_B_Rrp1
  gRNA
gcaggacaagccccuccagc

SEQ ID NO: 113945 - RNA, 20 nt, Artificial Sequence
  MKO10113945_B_Rrp1
  gRNA
cagccuucagugacucacuu

SEQ ID NO: 113946 - RNA, 20 nt, Artificial Sequence
  MKO10113946_B_Rrp1
  gRNA
uguguccuagcucaugagga

SEQ ID NO: 113947 - RNA, 20 nt, Artificial Sequence
  MKO10113947_B_Rrp36
  gRNA
ugguccucaccggugcuuau

SEQ ID NO: 113948 - RNA, 20 nt, Artificial Sequence
  MKO10113948_B_Rrp36
  gRNA
cucggauaucauucaggaac

SEQ ID NO: 113949 - RNA, 20 nt, Artificial Sequence
  MKO10113949_B_Rrp36
  gRNA
uauccgagccaaagagaagc

SEQ ID NO: 113950 - RNA, 20 nt, Artificial Sequence
  MKO10113950_B_Rrp7a
  gRNA
acucuuaccugugugcagua

SEQ ID NO: 113951 - RNA, 20 nt, Artificial Sequence
  MKO10113951_B_Rrp7a
  gRNA
gaaccugaagggcccauugc

SEQ ID NO: 113952 - RNA, 20 nt, Artificial Sequence
  MKO10113952_B_Rrp7a
  gRNA
gggcuuucagguagcuuaug

SEQ ID NO: 113953 - RNA, 20 nt, Artificial Sequence
  MKO10113953_B_Rrp8
  gRNA
ugcuuccagagcccguaaug

SEQ ID NO: 113954 - RNA, 20 nt, Artificial Sequence
  MKO10113954_B_Rrp8
  gRNA
gcaaaucgagugcuaaaaac

SEQ ID NO: 113955 - RNA, 20 nt, Artificial Sequence
  MKO10113955_B_Rrp8
  gRNA
uccggacacuugaagcuagg

SEQ ID NO: 113956 - RNA, 20 nt, Artificial Sequence
  MKO10113956_B_Rrp9
  gRNA
ccagcgauucugagagcgag

SEQ ID NO: 113957 - RNA, 20 nt, Artificial Sequence
  MKO10113957_B_Rrp9
  gRNA
guugcagaagucgguggcca

SEQ ID NO: 113958 - RNA, 20 nt, Artificial Sequence
  MKO10113958_B_Rrp9
  gRNA
aacucuaccuugaacaacuc

SEQ ID NO: 113959 - RNA, 20 nt, Artificial Sequence
  MKO10113959_B_Rrs1
  gRNA
cacucgccucgucccacacg

SEQ ID NO: 113960 - RNA, 20 nt, Artificial Sequence
  MKO10113960_B_Rrs1
  gRNA
cgucgccggaggccgagcug

SEQ ID NO: 113961 - RNA, 20 nt, Artificial Sequence
  MKO10113961_B_Rrs1
  gRNA
gccugggagcgccgacccca

SEQ ID NO: 113962 - RNA, 20 nt, Artificial Sequence
  MKO10113962_B_Rs1
  gRNA
uaccagcccacauacugcuc

SEQ ID NO: 113963 - RNA, 20 nt, Artificial Sequence
  MKO10113963_B_Rs1
  gRNA
cgacucaacagucaagguuu

SEQ ID NO: 113964 - RNA, 20 nt, Artificial Sequence
  MKO10113964_B_Rs1
  gRNA
accuccuuagacuguauucc

SEQ ID NO: 113965 - RNA, 20 nt, Artificial Sequence
  MKO10113965_B_Rsad1
  gRNA
acucagccagcgacgcuuua

SEQ ID NO: 113966 - RNA, 20 nt, Artificial Sequence
  MKO10113966_B_Rsad1
  gRNA
gggcgcucaguacccauaac

SEQ ID NO: 113967 - RNA, 20 nt, Artificial Sequence
  MKO10113967_B_Rsad1
  gRNA
ggggaccgugcggaauugcc

SEQ ID NO: 113968 - RNA, 20 nt, Artificial Sequence
  MKO10113968_B_Rsad2
  gRNA
ccaaccuucugguuagauuc

SEQ ID NO: 113969 - RNA, 20 nt, Artificial Sequence
  MKO10113969_B_Rsad2
  gRNA
aguauucaccccuguccuga

SEQ ID NO: 113970 - RNA, 20 nt, Artificial Sequence
  MKO10113970_B_Rsad2
  gRNA
ucugugagcauagugagcaa

SEQ ID NO: 113971 - RNA, 20 nt, Artificial Sequence
  MKO10113971_B_Rsbn1l
  gRNA
gcgauaagaauaaccuuaga

SEQ ID NO: 113972 - RNA, 20 nt, Artificial Sequence
  MKO10113972_B_Rsbn1l
  gRNA
uccuggacguacccacauga

SEQ ID NO: 113973 - RNA, 20 nt, Artificial Sequence
  MKO10113973_B_Rsbn1l
  gRNA
gacuuuggcauaucagccac

SEQ ID NO: 113974 - RNA, 20 nt, Artificial Sequence
  MKO10113974_B_Rsbn1
  gRNA
gacuuuggcauaucugcugu

SEQ ID NO: 113975 - RNA, 20 nt, Artificial Sequence
  MKO10113975_B_Rsbn1
  gRNA
uaugcguuagcaauagugca

SEQ ID NO: 113976 - RNA, 20 nt, Artificial Sequence
  MKO10113976_B_Rsbn1
  gRNA
gcaagaauaucgggugcccc

SEQ ID NO: 113977 - RNA, 20 nt, Artificial Sequence
  MKO10113977_B_Rsc1a1
  gRNA
acagagcgagcgagacucgu

SEQ ID NO: 113978 - RNA, 20 nt, Artificial Sequence
  MKO10113978_B_Rsc1a1
  gRNA
uggugccggcuucacucugc

SEQ ID NO: 113979 - RNA, 20 nt, Artificial Sequence
  MKO10113979_B_Rsc1a1
  gRNA
uggguugccccguaguggau

SEQ ID NO: 113980 - RNA, 20 nt, Artificial Sequence
  MKO10113980_B_Rsf1
  gRNA
gucaagaguuuaacaguacc

SEQ ID NO: 113981 - RNA, 20 nt, Artificial Sequence
  MKO10113981_B_Rsf1
  gRNA
augcaaacuagcacucuuaa

SEQ ID NO: 113982 - RNA, 20 nt, Artificial Sequence
  MKO10113982_B_Rsf1
  gRNA
ucgggaaagccccacccuag

SEQ ID NO: 113983 - RNA, 20 nt, Artificial Sequence
  MKO10113983_B_Rsg1
  gRNA
guucagccgggagcacucuc

SEQ ID NO: 113984 - RNA, 20 nt, Artificial Sequence
  MKO10113984_B_Rsg1
  gRNA
acagucgcuggccuucagcu

SEQ ID NO: 113985 - RNA, 20 nt, Artificial Sequence
  MKO10113985_B_Rsg1
  gRNA
uacuauaggcacuuccaggc

SEQ ID NO: 113986 - RNA, 20 nt, Artificial Sequence
  MKO10113986_B_Rsl1d1
  gRNA
gauacaucgguuaaucucuu

SEQ ID NO: 113987 - RNA, 20 nt, Artificial Sequence
  MKO10113987_B_Rsl1d1
  gRNA
aaaaugccucccuaugugug

SEQ ID NO: 113988 - RNA, 20 nt, Artificial Sequence
  MKO10113988_B_Rsl1d1
  gRNA
uagaaaccuucugucuguuc

SEQ ID NO: 113989 - RNA, 20 nt, Artificial Sequence
  MKO10113989_B_Rsl1
  gRNA
ccuugucucuucauguccca

SEQ ID NO: 113990 - RNA, 20 nt, Artificial Sequence
  MKO10113990_B_Rsl1
  gRNA
accuucuugucagagacaac

SEQ ID NO: 113991 - RNA, 20 nt, Artificial Sequence
  MKO10113991_B_Rsl1
  gRNA
uccaguugucucugacaaga

SEQ ID NO: 113992 - RNA, 20 nt, Artificial Sequence
  MKO10113992_B_Rsl24d1
  gRNA
gaagaagagaaacccacgca

SEQ ID NO: 113993 - RNA, 20 nt, Artificial Sequence
  MKO10113993_B_Rsl24d1
  gRNA
ugaaauaccagcgugagcug

SEQ ID NO: 113994 - RNA, 20 nt, Artificial Sequence
  MKO10113994_B_Rsl24d1
  gRNA
agagaucaaacagaagcgcc

SEQ ID NO: 113995 - RNA, 20 nt, Artificial Sequence
  MKO10113995_B_Rslcan18
  gRNA
guaccugcucacaguugagc

SEQ ID NO: 113996 - RNA, 20 nt, Artificial Sequence
  MKO10113996_B_Rslcan18
  gRNA
gcuccugcucaacugugagc

SEQ ID NO: 113997 - RNA, 20 nt, Artificial Sequence
  MKO10113997_B_Rslcan18
  gRNA
agacuccuaucagcaucagu

SEQ ID NO: 113998 - RNA, 20 nt, Artificial Sequence
  MKO10113998_B_Rsph1
  gRNA
uccuucauauguguccccgu

SEQ ID NO: 113999 - RNA, 20 nt, Artificial Sequence
  MKO10113999_B_Rsph1
  gRNA
gucaacaaugacaccuacac

SEQ ID NO: 114000 - RNA, 20 nt, Artificial Sequence
  MKO10114000_B_Rsph1
  gRNA
cuggauagauaaaggugccu

SEQ ID NO: 114001 - RNA, 20 nt, Artificial Sequence
  MKO10114001_B_Rsph3a
  gRNA
agagcuucagcgacagcagc

SEQ ID NO: 114002 - RNA, 20 nt, Artificial Sequence
  MKO10114002_B_Rsph3a
  gRNA
ugcacuguaccucuccuccc

SEQ ID NO: 114003 - RNA, 20 nt, Artificial Sequence
  MKO10114003_B_Rsph3a
  gRNA
ucgcauaguugaagucgaca

SEQ ID NO: 114004 - RNA, 20 nt, Artificial Sequence
  MKO10114004_B_Rsph3b
  gRNA
cacaugcuuucugcccucca

SEQ ID NO: 114005 - RNA, 20 nt, Artificial Sequence
  MKO10114005_B_Rsph3b
  gRNA
ucgcauaguugaagucgaca

SEQ ID NO: 114006 - RNA, 20 nt, Artificial Sequence
  MKO10114006_B_Rsph3b
  gRNA
ugcacuguaccucuccuccc

SEQ ID NO: 114007 - RNA, 20 nt, Artificial Sequence
  MKO10114007_B_Rsph4a
  gRNA
acuuccugcucuauguaguc

SEQ ID NO: 114008 - RNA, 20 nt, Artificial Sequence
  MKO10114008_B_Rsph4a
  gRNA
cuguccuucgcuccaaucuu

SEQ ID NO: 114009 - RNA, 20 nt, Artificial Sequence
  MKO10114009_B_Rsph4a
  gRNA
ggauucagaauauacccucu

SEQ ID NO: 114010 - RNA, 20 nt, Artificial Sequence
  MKO10114010_B_Rsph6a
  gRNA
guucucgcaacaggguuacc

SEQ ID NO: 114011 - RNA, 20 nt, Artificial Sequence
  MKO10114011_B_Rsph6a
  gRNA
ggggccuaugccuacgccac

SEQ ID NO: 114012 - RNA, 20 nt, Artificial Sequence
  MKO10114012_B_Rsph6a
  gRNA
ggcguacuugccaguggcgu

SEQ ID NO: 114013 - RNA, 20 nt, Artificial Sequence
  MKO10114013_B_Rsph9
  gRNA
uagcuacagccuugucaauc

SEQ ID NO: 114014 - RNA, 20 nt, Artificial Sequence
  MKO10114014_B_Rsph9
  gRNA
uuagcucguacuuccacuuc

SEQ ID NO: 114015 - RNA, 20 nt, Artificial Sequence
  MKO10114015_B_Rsph9
  gRNA
cuucaaagguccgauugaca

SEQ ID NO: 114016 - RNA, 20 nt, Artificial Sequence
  MKO10114016_B_Rspo1
  gRNA
augcaagaucgagcacugug

SEQ ID NO: 114017 - RNA, 20 nt, Artificial Sequence
  MKO10114017_B_Rspo1
  gRNA
uugcgggcaucaaaguaucc

SEQ ID NO: 114018 - RNA, 20 nt, Artificial Sequence
  MKO10114018_B_Rspo1
  gRNA
uuagcggcuguagagcccuc

SEQ ID NO: 114019 - RNA, 20 nt, Artificial Sequence
  MKO10114019_B_Rspo2
  gRNA
gacgcauuccuucucuucga

SEQ ID NO: 114020 - RNA, 20 nt, Artificial Sequence
  MKO10114020_B_Rspo2
  gRNA
cgguguccauaauacccuga

SEQ ID NO: 114021 - RNA, 20 nt, Artificial Sequence
  MKO10114021_B_Rspo2
  gRNA
gguucacucugucuguagcg

SEQ ID NO: 114022 - RNA, 20 nt, Artificial Sequence
  MKO10114022_B_Rspo3
  gRNA
acuccauggacuccauucac

SEQ ID NO: 114023 - RNA, 20 nt, Artificial Sequence
  MKO10114023_B_Rspo3
  gRNA
acccuucugggcaacuguca

SEQ ID NO: 114024 - RNA, 20 nt, Artificial Sequence
  MKO10114024_B_Rspo3
  gRNA
cauugagaccccagaccagc

SEQ ID NO: 114025 - RNA, 20 nt, Artificial Sequence
  MKO10114025_B_Rspo4
  gRNA
ccaacuuccuguccuuacgc

SEQ ID NO: 114026 - RNA, 20 nt, Artificial Sequence
  MKO10114026_B_Rspo4
  gRNA
gugcgagagcuguuucagcc

SEQ ID NO: 114027 - RNA, 20 nt, Artificial Sequence
  MKO10114027_B_Rspo4
  gRNA
ugccuucacggcggaugaag

SEQ ID NO: 114028 - RNA, 20 nt, Artificial Sequence
  MKO10114028_B_Rspry1
  gRNA
uuuacuuagcccaggaauac

SEQ ID NO: 114029 - RNA, 20 nt, Artificial Sequence
  MKO10114029_B_Rspry1
  gRNA
gaauaacucuaauuaaagac

SEQ ID NO: 114030 - RNA, 20 nt, Artificial Sequence
  MKO10114030_B_Rspry1
  gRNA
uguuuggcugagaaacuagc

SEQ ID NO: 114031 - RNA, 20 nt, Artificial Sequence
  MKO10114031_B_Rsrc1
  gRNA
caauugguccuugaagcugc

SEQ ID NO: 114032 - RNA, 20 nt, Artificial Sequence
  MKO10114032_B_Rsrc1
  gRNA
gauucuggaaacaucaaagc

SEQ ID NO: 114033 - RNA, 20 nt, Artificial Sequence
  MKO10114033_B_Rsrc1
  gRNA
aaaacuuaccagcagcuuca

SEQ ID NO: 114034 - RNA, 20 nt, Artificial Sequence
  MKO10114034_B_Rsrc2
  gRNA
agcccuagaaaagacaucac

SEQ ID NO: 114035 - RNA, 20 nt, Artificial Sequence
  MKO10114035_B_Rsrc2
  gRNA
cacggggcagaagucacuca

SEQ ID NO: 114036 - RNA, 20 nt, Artificial Sequence
  MKO10114036_B_Rsrc2
  gRNA
cucagacuugugucucuuag

SEQ ID NO: 114037 - RNA, 20 nt, Artificial Sequence
  MKO10114037_B_Rsu1
  gRNA
uucuucaguuccgcuacauu

SEQ ID NO: 114038 - RNA, 20 nt, Artificial Sequence
  MKO10114038_B_Rsu1
  gRNA
ucuagcccacaucacacaac

SEQ ID NO: 114039 - RNA, 20 nt, Artificial Sequence
  MKO10114039_B_Rsu1
  gRNA
ccaauacucacccaagguuc

SEQ ID NO: 114040 - RNA, 20 nt, Artificial Sequence
  MKO10114040_B_Rtbdn
  gRNA
gggcuccuugaaguuguccc

SEQ ID NO: 114041 - RNA, 20 nt, Artificial Sequence
  MKO10114041_B_Rtbdn
  gRNA
ggccacaaauaaaaucugcu

SEQ ID NO: 114042 - RNA, 20 nt, Artificial Sequence
  MKO10114042_B_Rtbdn
  gRNA
gugccccgcagcucucuaga

SEQ ID NO: 114043 - RNA, 20 nt, Artificial Sequence
  MKO10114043_B_Ruca
  gRNA
gcgcgugcagaagauccgcg

SEQ ID NO: 114044 - RNA, 20 nt, Artificial Sequence
  MKO10114044_B_Ruca
  gRNA
uuaauugugacauuaaaacg

SEQ ID NO: 114045 - RNA, 20 nt, Artificial Sequence
  MKO10114045_B_Ruca
  gRNA
gaaaugguucgugauuugug

SEQ ID NO: 114046 - RNA, 20 nt, Artificial Sequence
  MKO10114046_B_Rucb
  gRNA
ugacucacaugaacuauucc

SEQ ID NO: 114047 - RNA, 20 nt, Artificial Sequence
  MKO10114047_B_Rucb
  gRNA
uacaucgcucucaucuaaau

SEQ ID NO: 114048 - RNA, 20 nt, Artificial Sequence
  MKO10114048_B_Rucb
  gRNA
cucagggucauucauaucaa

SEQ ID NO: 114049 - RNA, 20 nt, Artificial Sequence
  MKO10114049_B_Rtdr1
  gRNA
ggccacucuggacgauaccc

SEQ ID NO: 114050 - RNA, 20 nt, Artificial Sequence
  MKO10114050_B_Rtdr1
  gRNA
ggccuugagcaagcuuaaug

SEQ ID NO: 114051 - RNA, 20 nt, Artificial Sequence
  MKO10114051_B_Rtdr1
  gRNA
gauucucccggcagaggguc

SEQ ID NO: 114052 - RNA, 20 nt, Artificial Sequence
  MKO10114052_B_Rtel1
  gRNA
aucucggagauguuguugcc

SEQ ID NO: 114053 - RNA, 20 nt, Artificial Sequence
  MKO10114053_B_Rtel1
  gRNA
aauccacugucacaccauuc

SEQ ID NO: 114054 - RNA, 20 nt, Artificial Sequence
  MKO10114054_B_Rtel1
  gRNA
ccagcccuacccaugccaac

SEQ ID NO: 114055 - RNA, 20 nt, Artificial Sequence
  MKO10114055_B_Rtf1
  gRNA
ccuccuuauaguggacauuu

SEQ ID NO: 114056 - RNA, 20 nt, Artificial Sequence
  MKO10114056_B_Rtf1
  gRNA
gaagaagcugacacagauuc

SEQ ID NO: 114057 - RNA, 20 nt, Artificial Sequence
  MKO10114057_B_Rtf1
  gRNA
ggcccgacuggagcagauga

SEQ ID NO: 114058 - RNA, 20 nt, Artificial Sequence
  MKO10114058_B_Rtfdc1
  gRNA
ugugccggccauucaucucc

SEQ ID NO: 114059 - RNA, 20 nt, Artificial Sequence
  MKO10114059_B_Rtfdc1
  gRNA
uccauaccugccaagcucac

SEQ ID NO: 114060 - RNA, 20 nt, Artificial Sequence
  MKO10114060_B_Rtfdc1
  gRNA
aucgcacaucagaagcauca

SEQ ID NO: 114061 - RNA, 20 nt, Artificial Sequence
  MKO10114061_B_Rtkn2
  gRNA
agaggaaagaucgcccuguc

SEQ ID NO: 114062 - RNA, 20 nt, Artificial Sequence
  MKO10114062_B_Rtkn2
  gRNA
gggagcucagguguuugaca

SEQ ID NO: 114063 - RNA, 20 nt, Artificial Sequence
  MKO10114063_B_Rtkn2
  gRNA
cagggcgaucuuuccucugc

SEQ ID NO: 114064 - RNA, 20 nt, Artificial Sequence
  MKO10114064_B_Rtkn
  gRNA
uccucccagaccugcaccgc

SEQ ID NO: 114065 - RNA, 20 nt, Artificial Sequence
  MKO10114065_B_Rtkn
  gRNA
guuccccaaucugcagcagc

SEQ ID NO: 114066 - RNA, 20 nt, Artificial Sequence
  MKO10114066_B_Rtkn
  gRNA
gcucagcacuccccuugccg

SEQ ID NO: 114067 - RNA, 20 nt, Artificial Sequence
  MKO10114067_B_Rtl1
  gRNA
caauuggcaaugaacccguc

SEQ ID NO: 114068 - RNA, 20 nt, Artificial Sequence
  MKO10114068_B_Rtl1
  gRNA
cgcgcccaagaagcguagcc

SEQ ID NO: 114069 - RNA, 20 nt, Artificial Sequence
  MKO10114069_B_Rtl1
  gRNA
accccacgaugagguucaua

SEQ ID NO: 114070 - RNA, 20 nt, Artificial Sequence
  MKO10114070_B_Rtn1
  gRNA
ugugagcgucguugccuacc

SEQ ID NO: 114071 - RNA, 20 nt, Artificial Sequence
  MKO10114071_B_Rtn1
  gRNA
uacguuggcgcgcucuucaa

SEQ ID NO: 114072 - RNA, 20 nt, Artificial Sequence
  MKO10114072_B_Rtn1
  gRNA
uguuguguacguuaagcacc

SEQ ID NO: 114073 - RNA, 20 nt, Artificial Sequence
  MKO10114073_B_Rtn2
  gRNA
gaagaaaugccguagcugug

SEQ ID NO: 114074 - RNA, 20 nt, Artificial Sequence
  MKO10114074_B_Rtn2
  gRNA
aagagucaagccguugaaga

SEQ ID NO: 114075 - RNA, 20 nt, Artificial Sequence
  MKO10114075_B_Rtn2
  gRNA
ccuucuguacagacaacauc

SEQ ID NO: 114076 - RNA, 20 nt, Artificial Sequence
  MKO10114076_B_Rtn3
  gRNA
cggaagggccuacuuggaug

SEQ ID NO: 114077 - RNA, 20 nt, Artificial Sequence
  MKO10114077_B_Rtn3
  gRNA
caacuacaugaaugcugcga

SEQ ID NO: 114078 - RNA, 20 nt, Artificial Sequence
  MKO10114078_B_Rtn3
  gRNA
acugaucaugcugcucucuc

SEQ ID NO: 114079 - RNA, 20 nt, Artificial Sequence
  MKO10114079_B_Rtn4ip1
  gRNA
acgcuucauauuuagggcug

SEQ ID NO: 114080 - RNA, 20 nt, Artificial Sequence
  MKO10114080_B_Rtn4ip1
  gRNA
acaucccgacccagagucag

SEQ ID NO: 114081 - RNA, 20 nt, Artificial Sequence
  MKO10114081_B_Rtn4ip1
  gRNA
cacucucucagaauuuguug

SEQ ID NO: 114082 - RNA, 20 nt, Artificial Sequence
  MKO10114082_B_Rtn4rl1
  gRNA
ccugcgcgacccccgagcug

SEQ ID NO: 114083 - RNA, 20 nt, Artificial Sequence
  MKO10114083_B_Rtn4rl1
  gRNA
ccgcagcucgggggucgcgc

SEQ ID NO: 114084 - RNA, 20 nt, Artificial Sequence
  MKO10114084_B_Rtn4rl1
  gRNA
ugcccaccgcacgacccaag

SEQ ID NO: 114085 - RNA, 20 nt, Artificial Sequence
  MKO10114085_B_Rtn4rl2
  gRNA
gcccgacaccuuccaggguc

SEQ ID NO: 114086 - RNA, 20 nt, Artificial Sequence
  MKO10114086_B_Rtn4rl2
  gRNA
gucgagacaagaugcugccc

SEQ ID NO: 114087 - RNA, 20 nt, Artificial Sequence
  MKO10114087_B_Rtn4rl2
  gRNA
cccuaccuugcagcaggcgc

SEQ ID NO: 114088 - RNA, 20 nt, Artificial Sequence
  MKO10114088_B_Rtn4r
  gRNA
cugggucccggccuauuccg

SEQ ID NO: 114089 - RNA, 20 nt, Artificial Sequence
  MKO10114089_B_Rtn4r
  gRNA
acgucccuugagggcguuuc

SEQ ID NO: 114090 - RNA, 20 nt, Artificial Sequence
  MKO10114090_B_Rtn4r
  gRNA
cccaggccguggaacguggu

SEQ ID NO: 114091 - RNA, 20 nt, Artificial Sequence
  MKO10114091_B_Rtn4
  gRNA
uaguuguugaccuccuguac

SEQ ID NO: 114092 - RNA, 20 nt, Artificial Sequence
  MKO10114092_B_Rtn4
  gRNA
ugauuuaguugauucccuga

SEQ ID NO: 114093 - RNA, 20 nt, Artificial Sequence
  MKO10114093_B_Rtn4
  gRNA
aucugaaguugccauaucag

SEQ ID NO: 114094 - RNA, 20 nt, Artificial Sequence
  MKO10114094_B_Rtp1
  gRNA
gggccaacacauugugcuug

SEQ ID NO: 114095 - RNA, 20 nt, Artificial Sequence
  MKO10114095_B_Rtp1
  gRNA
caaggcucagcgcgcugguu

SEQ ID NO: 114096 - RNA, 20 nt, Artificial Sequence
  MKO10114096_B_Rtp1
  gRNA
aggccucgcagaacucuccg

SEQ ID NO: 114097 - RNA, 20 nt, Artificial Sequence
  MKO10114097_B_Rtp2
  gRNA
augagcucccagcuguccgc

SEQ ID NO: 114098 - RNA, 20 nt, Artificial Sequence
  MKO10114098_B_Rtp2
  gRNA
accgcauccacguagccagc

SEQ ID NO: 114099 - RNA, 20 nt, Artificial Sequence
  MKO10114099_B_Rtp2
  gRNA
guaacacugcucgcgcagac

SEQ ID NO: 114100 - RNA, 20 nt, Artificial Sequence
  MKO10114100_B_Rtp3
  gRNA
ucuucucacaccaccgcaug

SEQ ID NO: 114101 - RNA, 20 nt, Artificial Sequence
  MKO10114101_B_Rtp3
  gRNA
agaugcccaacuucgagagc

SEQ ID NO: 114102 - RNA, 20 nt, Artificial Sequence
  MKO10114102_B_Rtp3
  gRNA
gaagguucuugucugguaug

SEQ ID NO: 114103 - RNA, 20 nt, Artificial Sequence
  MKO10114103_B_Rtp4
  gRNA
gauaagaacauuguaccaga

SEQ ID NO: 114104 - RNA, 20 nt, Artificial Sequence
  MKO10114104_B_Rtp4
  gRNA
uauucccaaaauccguauuc

SEQ ID NO: 114105 - RNA, 20 nt, Artificial Sequence
  MKO10114105_B_Rtp4
  gRNA
cucacccaaagaugcauucg

SEQ ID NO: 114106 - RNA, 20 nt, Artificial Sequence
  MKO10114106_B_Ruun
  gRNA
cccugaucuccgccagcuga

SEQ ID NO: 114107 - RNA, 20 nt, Artificial Sequence
  MKO10114107_B_Ruun
  gRNA
guauacacacccgcuggccc

SEQ ID NO: 114108 - RNA, 20 nt, Artificial Sequence
  MKO10114108_B_Ruun
  gRNA
caacaaccugaagucuuaac

SEQ ID NO: 114109 - RNA, 20 nt, Artificial Sequence
  MKO10114109_B_Rufy1
  gRNA
cagauauagcuaccaguguc

SEQ ID NO: 114110 - RNA, 20 nt, Artificial Sequence
  MKO10114110_B_Rufy1
  gRNA
ggagcugcuuguugucuaug

SEQ ID NO: 114111 - RNA, 20 nt, Artificial Sequence
  MKO10114111_B_Rufy1
  gRNA
acuccagucugcccuuagcc

SEQ ID NO: 114112 - RNA, 20 nt, Artificial Sequence
  MKO10114112_B_Rufy2
  gRNA
cacgcucuagcacggccaag

SEQ ID NO: 114113 - RNA, 20 nt, Artificial Sequence
  MKO10114113_B_Rufy2
  gRNA
ugcguugcuuaauuauccag

SEQ ID NO: 114114 - RNA, 20 nt, Artificial Sequence
  MKO10114114_B_Rufy2
  gRNA
gaggagggagccgugauugu

SEQ ID NO: 114115 - RNA, 20 nt, Artificial Sequence
  MKO10114115_B_Rufy3
  gRNA
ucugaaucuggggcggaccc

SEQ ID NO: 114116 - RNA, 20 nt, Artificial Sequence
  MKO10114116_B_Rufy3
  gRNA
gcgaguguaaaagaccuccc

SEQ ID NO: 114117 - RNA, 20 nt, Artificial Sequence
  MKO10114117_B_Rufy3
  gRNA
caccuuucaagccguguuuc

SEQ ID NO: 114118 - RNA, 20 nt, Artificial Sequence
  MKO10114118_B_Rufy4
  gRNA
aguugaaggcaacuccauug

SEQ ID NO: 114119 - RNA, 20 nt, Artificial Sequence
  MKO10114119_B_Rufy4
  gRNA
uaccuccucuggaaaaccuu

SEQ ID NO: 114120 - RNA, 20 nt, Artificial Sequence
  MKO10114120_B_Rufy4
  gRNA
cccgcuguuccagucccagc

SEQ ID NO: 114121 - RNA, 20 nt, Artificial Sequence
  MKO10114121_B_Rundc1
  gRNA
acguugacgaagcuccucag

SEQ ID NO: 114122 - RNA, 20 nt, Artificial Sequence
  MKO10114122_B_Rundc1
  gRNA
ugacucccugccgcaguccg

SEQ ID NO: 114123 - RNA, 20 nt, Artificial Sequence
  MKO10114123_B_Rundc1
  gRNA
aggugggaaucggcuccacc

SEQ ID NO: 114124 - RNA, 20 nt, Artificial Sequence
  MKO10114124_B_Rundc3a
  gRNA
auccucagccaccgauuuaa

SEQ ID NO: 114125 - RNA, 20 nt, Artificial Sequence
  MKO10114125_B_Rundc3a
  gRNA
ccgacauacgcuucuccauc

SEQ ID NO: 114126 - RNA, 20 nt, Artificial Sequence
  MKO10114126_B_Rundc3a
  gRNA
ccugauggagaagcguaugu

SEQ ID NO: 114127 - RNA, 20 nt, Artificial Sequence
  MKO10114127_B_Rundc3b
  gRNA
gacucaaugcuauugacuuc

SEQ ID NO: 114128 - RNA, 20 nt, Artificial Sequence
  MKO10114128_B_Rundc3b
  gRNA
cugugaagacccugauugau

SEQ ID NO: 114129 - RNA, 20 nt, Artificial Sequence
  MKO10114129_B_Rundc3b
  gRNA
auauagucccagaagcuacg

SEQ ID NO: 114130 - RNA, 20 nt, Artificial Sequence
  MKO10114130_B_Runx1t1
  gRNA
ggcgcucccucaccgccuaa

SEQ ID NO: 114131 - RNA, 20 nt, Artificial Sequence
  MKO10114131_B_Runx1t1
  gRNA
guuuggcuagccuugcgcag

SEQ ID NO: 114132 - RNA, 20 nt, Artificial Sequence
  MKO10114132_B_Runx1t1
  gRNA
gacugcgucuucacauccac

SEQ ID NO: 114133 - RNA, 20 nt, Artificial Sequence
  MKO10114133_B_Runx1
  gRNA
ucggugcgcacuagcucgcc

SEQ ID NO: 114134 - RNA, 20 nt, Artificial Sequence
  MKO10114134_B_Runx1
  gRNA
cggauuuguaaagacgguga

SEQ ID NO: 114135 - RNA, 20 nt, Artificial Sequence
  MKO10114135_B_Runx1
  gRNA
gggcuuacuugagagucgac

SEQ ID NO: 114136 - RNA, 20 nt, Artificial Sequence
  MKO10114136_B_Runx2
  gRNA
aaaucucagaucguugaacc

SEQ ID NO: 114137 - RNA, 20 nt, Artificial Sequence
  MKO10114137_B_Runx2
  gRNA
ccucaucccaguaugagagu

SEQ ID NO: 114138 - RNA, 20 nt, Artificial Sequence
  MKO10114138_B_Runx2
  gRNA
ucugaucgccucagugauuu

SEQ ID NO: 114139 - RNA, 20 nt, Artificial Sequence
  MKO10114139_B_Runx3
  gRNA
gaaucgaaggucguugaacc

SEQ ID NO: 114140 - RNA, 20 nt, Artificial Sequence
  MKO10114140_B_Runx3
  gRNA
agcacuuacgucgggguucc

SEQ ID NO: 114141 - RNA, 20 nt, Artificial Sequence
  MKO10114141_B_Runx3
  gRNA
uaccuaccaccgagccauca

SEQ ID NO: 114142 - RNA, 20 nt, Artificial Sequence
  MKO10114142_B_Rusc1
  gRNA
gauagcugucagcgcuucag

SEQ ID NO: 114143 - RNA, 20 nt, Artificial Sequence
  MKO10114143_B_Rusc1
  gRNA
uuccggaaggaccucaucac

SEQ ID NO: 114144 - RNA, 20 nt, Artificial Sequence
  MKO10114144_B_Rusc1
  gRNA
gguauugaccacccucugcc

SEQ ID NO: 114145 - RNA, 20 nt, Artificial Sequence
  MKO10114145_B_Rusc2
  gRNA
cauucagccggcaauucaga

SEQ ID NO: 114146 - RNA, 20 nt, Artificial Sequence
  MKO10114146_B_Rusc2
  gRNA
gaccucgcggccaucgcccc

SEQ ID NO: 114147 - RNA, 20 nt, Artificial Sequence
  MKO10114147_B_Rusc2
  gRNA
ugucagcauaccuucacgcc

SEQ ID NO: 114148 - RNA, 20 nt, Artificial Sequence
  MKO10114148_B_Ruvbl1
  gRNA
cacacucaccuucagcuguu

SEQ ID NO: 114149 - RNA, 20 nt, Artificial Sequence
  MKO10114149_B_Ruvbl1
  gRNA
auuaaucaaaagcaagaaaa

SEQ ID NO: 114150 - RNA, 20 nt, Artificial Sequence
  MKO10114150_B_Ruvbl1
  gRNA
cuuggcccuugcuauugcuc

SEQ ID NO: 114151 - RNA, 20 nt, Artificial Sequence
  MKO10114151_B_Ruvbl2
  gRNA
gcaccacgccagcugcacgc

SEQ ID NO: 114152 - RNA, 20 nt, Artificial Sequence
  MKO10114152_B_Ruvbl2
  gRNA
gcucgauucuugucacaucu

SEQ ID NO: 114153 - RNA, 20 nt, Artificial Sequence
  MKO10114153_B_Ruvbl2
  gRNA
ucacuugauccggacaccaa

SEQ ID NO: 114154 - RNA, 20 nt, Artificial Sequence
  MKO10114154_B_Rwdd1
  gRNA
cuucaccauuacugugacau

SEQ ID NO: 114155 - RNA, 20 nt, Artificial Sequence
  MKO10114155_B_Rwdd1
  gRNA
ucauaaaguggagucucauc

SEQ ID NO: 114156 - RNA, 20 nt, Artificial Sequence
  MKO10114156_B_Rwdd1
  gRNA
uuucuugaacagcugucacg

SEQ ID NO: 114157 - RNA, 20 nt, Artificial Sequence
  MKO10114157_B_Rwdd2a
  gRNA
ugucaucacgcuccaaauug

SEQ ID NO: 114158 - RNA, 20 nt, Artificial Sequence
  MKO10114158_B_Rwdd2a
  gRNA
ggaguaauuccucaaacgaa

SEQ ID NO: 114159 - RNA, 20 nt, Artificial Sequence
  MKO10114159_B_Rwdd2a
  gRNA
agaacacauuccuccgcaug

SEQ ID NO: 114160 - RNA, 20 nt, Artificial Sequence
  MKO10114160_B_Rwdd2b
  gRNA
cagaggaucucgcuuucacg

SEQ ID NO: 114161 - RNA, 20 nt, Artificial Sequence
  MKO10114161_B_Rwdd2b
  gRNA
ccgcuguccuuccauuccgc

SEQ ID NO: 114162 - RNA, 20 nt, Artificial Sequence
  MKO10114162_B_Rwdd2b
  gRNA
uccugcccgaaauuacagug

SEQ ID NO: 114163 - RNA, 20 nt, Artificial Sequence
  MKO10114163_B_Rwdd3
  gRNA
gcucaacaucucccacucgu

SEQ ID NO: 114164 - RNA, 20 nt, Artificial Sequence
  MKO10114164_B_Rwdd3
  gRNA
caaaaggaauucggagcugc

SEQ ID NO: 114165 - RNA, 20 nt, Artificial Sequence
  MKO10114165_B_Rwdd3
  gRNA
gcucuucucagaguguguac

SEQ ID NO: 114166 - RNA, 20 nt, Artificial Sequence
  MKO10114166_B_Rwdd4a
  gRNA
gauaugaccggagcugucug

SEQ ID NO: 114167 - RNA, 20 nt, Artificial Sequence
  MKO10114167_B_Rwdd4a
  gRNA
gacauacccgcagacagcuc

SEQ ID NO: 114168 - RNA, 20 nt, Artificial Sequence
  MKO10114168_B_Rwdd4a
  gRNA
gccuguagccaauaucaucu

SEQ ID NO: 114169 - RNA, 20 nt, Artificial Sequence
  MKO10114169_B_Rxfp1
  gRNA
cugcgggaaccgagcugaug

SEQ ID NO: 114170 - RNA, 20 nt, Artificial Sequence
  MKO10114170_B_Rxfp1
  gRNA
uacuuacauuacagucacau

SEQ ID NO: 114171 - RNA, 20 nt, Artificial Sequence
  MKO10114171_B_Rxfp1
  gRNA
uucggaaguuucugccucaa

SEQ ID NO: 114172 - RNA, 20 nt, Artificial Sequence
  MKO10114172_B_Rxfp2
  gRNA
accauauuuggcacagucca

SEQ ID NO: 114173 - RNA, 20 nt, Artificial Sequence
  MKO10114173_B_Rxfp2
  gRNA
caucccacaggugacacuag

SEQ ID NO: 114174 - RNA, 20 nt, Artificial Sequence
  MKO10114174_B_Rxfp2
  gRNA
uaucugcugaagaccuugac

SEQ ID NO: 114175 - RNA, 20 nt, Artificial Sequence
  MKO10114175_B_Rxfp3
  gRNA
ugacugggaacgcguacacu

SEQ ID NO: 114176 - RNA, 20 nt, Artificial Sequence
  MKO10114176_B_Rxfp3
  gRNA
cccaguaaaccgcgcugaug

SEQ ID NO: 114177 - RNA, 20 nt, Artificial Sequence
  MKO10114177_B_Rxfp3
  gRNA
cugcagcgacgcauugccgc

SEQ ID NO: 114178 - RNA, 20 nt, Artificial Sequence
  MKO10114178_B_Rxfp4
  gRNA
cgauacucagugcugugauu

SEQ ID NO: 114179 - RNA, 20 nt, Artificial Sequence
  MKO10114179_B_Rxfp4
  gRNA
gacucccaagggcacgauga

SEQ ID NO: 114180 - RNA, 20 nt, Artificial Sequence
  MKO10114180_B_Rxfp4
  gRNA
aaugauaccuacaaguccau

SEQ ID NO: 114181 - RNA, 20 nt, Artificial Sequence
  MKO10114181_B_Rxra
  gRNA
aagccgccacuaggccucaa

SEQ ID NO: 114182 - RNA, 20 nt, Artificial Sequence
  MKO10114182_B_Rxra
  gRNA
gguagcggcaguacugacac

SEQ ID NO: 114183 - RNA, 20 nt, Artificial Sequence
  MKO10114183_B_Rxra
  gRNA
gaaccuugaggacgccauug

SEQ ID NO: 114184 - RNA, 20 nt, Artificial Sequence
  MKO10114184_B_Rxrb
  gRNA
ccccggaccccuaagaccgg

SEQ ID NO: 114185 - RNA, 20 nt, Artificial Sequence
  MKO10114185_B_Rxrb
  gRNA
ccaccccacagcgguucagg

SEQ ID NO: 114186 - RNA, 20 nt, Artificial Sequence
  MKO10114186_B_Rxrb
  gRNA
uccaaugccacccccgccac

SEQ ID NO: 114187 - RNA, 20 nt, Artificial Sequence
  MKO10114187_B_Rxrg
  gRNA
ugcguuuggcccacucaacg

SEQ ID NO: 114188 - RNA, 20 nt, Artificial Sequence
  MKO10114188_B_Rxrg
  gRNA
acuucugguagcgacaguac

SEQ ID NO: 114189 - RNA, 20 nt, Artificial Sequence
  MKO10114189_B_Rxrg
  gRNA
aggaccaggucauucuacuc

SEQ ID NO: 114190 - RNA, 20 nt, Artificial Sequence
  MKO10114190_B_Rybp
  gRNA
accagcugagaauugaugcg

SEQ ID NO: 114191 - RNA, 20 nt, Artificial Sequence
  MKO10114191_B_Rybp
  gRNA
caggccccggcugaagaaug

SEQ ID NO: 114192 - RNA, 20 nt, Artificial Sequence
  MKO10114192_B_Rybp
  gRNA
gcgaaacaaaccacaccuca

SEQ ID NO: 114193 - RNA, 20 nt, Artificial Sequence
  MKO10114193_B_Ryk
  gRNA
cgugagccucuaccugagcg

SEQ ID NO: 114194 - RNA, 20 nt, Artificial Sequence
  MKO10114194_B_Ryk
  gRNA
uagccacaaaguugucuacu

SEQ ID NO: 114195 - RNA, 20 nt, Artificial Sequence
  MKO10114195_B_Ryk
  gRNA
ggcgcaccucguccucgcuc

SEQ ID NO: 114196 - RNA, 20 nt, Artificial Sequence
  MKO10114196_B_Ryr1
  gRNA
gugcagcgccacggugcuca

SEQ ID NO: 114197 - RNA, 20 nt, Artificial Sequence
  MKO10114197_B_Ryr1
  gRNA
cugacagaccugcgcguugc

SEQ ID NO: 114198 - RNA, 20 nt, Artificial Sequence
  MKO10114198_B_Ryr1
  gRNA
ccauacgacugugugcgugc

SEQ ID NO: 114199 - RNA, 20 nt, Artificial Sequence
  MKO10114199_B_Ryr2
  gRNA
agaacagcagaagcugugcu

SEQ ID NO: 114200 - RNA, 20 nt, Artificial Sequence
  MKO10114200_B_Ryr2
  gRNA
cuuucugcaggaugaugagg

SEQ ID NO: 114201 - RNA, 20 nt, Artificial Sequence
  MKO10114201_B_Ryr2
  gRNA
gucuaucugcaccuuugugc

SEQ ID NO: 114202 - RNA, 20 nt, Artificial Sequence
  MKO10114202_B_Ryr3
  gRNA
uucccgcagaccuacaucaa

SEQ ID NO: 114203 - RNA, 20 nt, Artificial Sequence
  MKO10114203_B_Ryr3
  gRNA
aucugucugggaucuugacg

SEQ ID NO: 114204 - RNA, 20 nt, Artificial Sequence
  MKO10114204_B_Ryr3
  gRNA
caggcgauucccaagucccu

SEQ ID NO: 114205 - RNA, 20 nt, Artificial Sequence
  MKO10114205_B_S100a10
  gRNA
uuagaaucaaaaggacccuc

SEQ ID NO: 114206 - RNA, 20 nt, Artificial Sequence
  MKO10114206_B_S100a10
  gRNA
cgacaaagaccacuugacaa

SEQ ID NO: 114207 - RNA, 20 nt, Artificial Sequence
  MKO10114207_B_S100a10
  gRNA
ccagagcuuucuaucacuag

SEQ ID NO: 114208 - RNA, 20 nt, Artificial Sequence
  MKO10114208_B_S100a11
  gRNA
cauccuucccgcuguacuuu

SEQ ID NO: 114209 - RNA, 20 nt, Artificial Sequence
  MKO10114209_B_S100a11
  gRNA
aagaggauuagauucgcuuc

SEQ ID NO: 114210 - RNA, 20 nt, Artificial Sequence
  MKO10114210_B_S100a11
  gRNA
uuccuucaugaacacagagc

SEQ ID NO: 114211 - RNA, 20 nt, Artificial Sequence
  MKO10114211_B_S100a13
  gRNA
cuaccaaccuugagcaaaug

SEQ ID NO: 114212 - RNA, 20 nt, Artificial Sequence
  MKO10114212_B_S100a13
  gRNA
agugaauacuggagacugau

SEQ ID NO: 114213 - RNA, 20 nt, Artificial Sequence
  MKO10114213_B_S100a13
  gRNA
acagcaagcuuuacuucuuc

SEQ ID NO: 114214 - RNA, 20 nt, Artificial Sequence
  MKO10114214_B_S100a14
  gRNA
uacccgccacagaguauuua

SEQ ID NO: 114215 - RNA, 20 nt, Artificial Sequence
  MKO10114215_B_S100a14
  gRNA
caggaacgaugggacagugu

SEQ ID NO: 114216 - RNA, 20 nt, Artificial Sequence
  MKO10114216_B_S100a14
  gRNA
cccugcugagcuucgagacc

SEQ ID NO: 114217 - RNA, 20 nt, Artificial Sequence
  MKO10114217_B_S100a16
  gRNA
auauguauccaagcacagcc

SEQ ID NO: 114218 - RNA, 20 nt, Artificial Sequence
  MKO10114218_B_S100a16
  gRNA
gaugagguuggccauggggc

SEQ ID NO: 114219 - RNA, 20 nt, Artificial Sequence
  MKO10114219_B_S100a16
  gRNA
ugacaagcucauccagaacc

SEQ ID NO: 114220 - RNA, 20 nt, Artificial Sequence
  MKO10114220_B_S100a1
  gRNA
ccacagcaucugcauccuuc

SEQ ID NO: 114221 - RNA, 20 nt, Artificial Sequence
  MKO10114221_B_S100a1
  gRNA
caauguguuccaugcccauu

SEQ ID NO: 114222 - RNA, 20 nt, Artificial Sequence
  MKO10114222_B_S100a1
  gRNA
cagaaaguucaguuuguagc

SEQ ID NO: 114223 - RNA, 20 nt, Artificial Sequence
  MKO10114223_B_S100a2
  gRNA
gagccucucguccucuugac

SEQ ID NO: 114224 - RNA, 20 nt, Artificial Sequence
  MKO10114224_B_S100a2
  gRNA
cagcgcuccacuaccugccg

SEQ ID NO: 114225 - RNA, 20 nt, Artificial Sequence
  MKO10114225_B_S100a2
  gRNA
ggagcgcuggggaccccuca

SEQ ID NO: 114226 - RNA, 20 nt, Artificial Sequence
  MKO10114226_B_S100a3
  gRNA
acaacuccuugagcuccgac

SEQ ID NO: 114227 - RNA, 20 nt, Artificial Sequence
  MKO10114227_B_S100a3
  gRNA
auuuauuguagucacacucc

SEQ ID NO: 114228 - RNA, 20 nt, Artificial Sequence
  MKO10114228_B_S100a3
  gRNA
cacagcgcccugcauacucc

SEQ ID NO: 114229 - RNA, 20 nt, Artificial Sequence
  MKO10114229_B_S100a4
  gRNA
ugaggagucuucacuucuuc

SEQ ID NO: 114230 - RNA, 20 nt, Artificial Sequence
  MKO10114230_B_S100a4
  gRNA
ccucuuugccugaguauuug

SEQ ID NO: 114231 - RNA, 20 nt, Artificial Sequence
  MKO10114231_B_S100a4
  gRNA
uccaccuuccacaaauacuc

SEQ ID NO: 114232 - RNA, 20 nt, Artificial Sequence
  MKO10114232_B_S100a5
  gRNA
guagcaagcugacccugagu

SEQ ID NO: 114233 - RNA, 20 nt, Artificial Sequence
  MKO10114233_B_S100a5
  gRNA
cgaccaggagauugacuuca

SEQ ID NO: 114234 - RNA, 20 nt, Artificial Sequence
  MKO10114234_B_S100a5
  gRNA
acuccuugaagucaaucucc

SEQ ID NO: 114235 - RNA, 20 nt, Artificial Sequence
  MKO10114235_B_S100a6
  gRNA
gauggccacgagaaggccaa

SEQ ID NO: 114236 - RNA, 20 nt, Artificial Sequence
  MKO10114236_B_S100a6
  gRNA
ucaggccauuggccuucucg

SEQ ID NO: 114237 - RNA, 20 nt, Artificial Sequence
  MKO10114237_B_S100a6
  gRNA
ugcaggaugcugaaauugca

SEQ ID NO: 114238 - RNA, 20 nt, Artificial Sequence
  MKO10114238_B_S100a7a
  gRNA
gauggaagcaguguaugauu

SEQ ID NO: 114239 - RNA, 20 nt, Artificial Sequence
  MKO10114239_B_S100a7a
  gRNA
aguagugugcacacaacugc

SEQ ID NO: 114240 - RNA, 20 nt, Artificial Sequence
  MKO10114240_B_S100a7a
  gRNA
ccagcuugcccaagauguac

SEQ ID NO: 114241 - RNA, 20 nt, Artificial Sequence
  MKO10114241_B_S100a8
  gRNA
aauugugguagacaucaaug

SEQ ID NO: 114242 - RNA, 20 nt, Artificial Sequence
  MKO10114242_B_S100a8
  gRNA
ccuugcgauggugauaaaag

SEQ ID NO: 114243 - RNA, 20 nt, Artificial Sequence
  MKO10114243_B_S100a8
  gRNA
cgaaaacuuguucagagaau

SEQ ID NO: 114244 - RNA, 20 nt, Artificial Sequence
  MKO10114244_B_S100a9
  gRNA
acaccuuccaucaauacucu

SEQ ID NO: 114245 - RNA, 20 nt, Artificial Sequence
  MKO10114245_B_S100a9
  gRNA
caaagcucagcugauugucc

SEQ ID NO: 114246 - RNA, 20 nt, Artificial Sequence
  MKO10114246_B_S100a9
  gRNA
cuuccuuccuagaguauuga

SEQ ID NO: 114247 - RNA, 20 nt, Artificial Sequence
  MKO10114247_B_S100b
  gRNA
gugcuugucacccucucgcc

SEQ ID NO: 114248 - RNA, 20 nt, Artificial Sequence
  MKO10114248_B_S100b
  gRNA
ggacaaagugauggagacgc

SEQ ID NO: 114249 - RNA, 20 nt, Artificial Sequence
  MKO10114249_B_S100b
  gRNA
caacgagcucucucacuucc

SEQ ID NO: 114250 - RNA, 20 nt, Artificial Sequence
  MKO10114250_B_S100g
  gRNA
uuuaaggagcuggauaagaa

SEQ ID NO: 114251 - RNA, 20 nt, Artificial Sequence
  MKO10114251_B_S100g
  gRNA
ugcacucaccuucaggaggc

SEQ ID NO: 114252 - RNA, 20 nt, Artificial Sequence
  MKO10114252_B_S100g
  gRNA
agaguuccccagccuccuga

SEQ ID NO: 114253 - RNA, 20 nt, Artificial Sequence
  MKO10114253_B_S100pbp
  gRNA
uuaccuugguuagagucccc

SEQ ID NO: 114254 - RNA, 20 nt, Artificial Sequence
  MKO10114254_B_S100pbp
  gRNA
uauggacuguaggagaaguc

SEQ ID NO: 114255 - RNA, 20 nt, Artificial Sequence
  MKO10114255_B_S100pbp
  gRNA
cuguucuacaaacuagaacc

SEQ ID NO: 114256 - RNA, 20 nt, Artificial Sequence
  MKO10114256_B_S100z
  gRNA
cgccaauaaagacaacgaag

SEQ ID NO: 114257 - RNA, 20 nt, Artificial Sequence
  MKO10114257_B_S100z
  gRNA
cgcccuccuugcaagaguac

SEQ ID NO: 114258 - RNA, 20 nt, Artificial Sequence
  MKO10114258_B_S100z
  gRNA
ccaugauucgcaucuuccac

SEQ ID NO: 114259 - RNA, 20 nt, Artificial Sequence
  MKO10114259_B_S1pr1
  gRNA
gacguuuccagacgacauaa

SEQ ID NO: 114260 - RNA, 20 nt, Artificial Sequence
  MKO10114260_B_S1pr1
  gRNA
auuugcaacaagauacgauc

SEQ ID NO: 114261 - RNA, 20 nt, Artificial Sequence
  MKO10114261_B_S1pr1
  gRNA
guugaacaucggggcggaga

SEQ ID NO: 114262 - RNA, 20 nt, Artificial Sequence
  MKO10114262_B_S1pr2
  gRNA
cucugaguauaagccgccca

SEQ ID NO: 114263 - RNA, 20 nt, Artificial Sequence
  MKO10114263_B_S1pr2
  gRNA
gacgcuagcccugcucaaga

SEQ ID NO: 114264 - RNA, 20 nt, Artificial Sequence
  MKO10114264_B_S1pr2
  gRNA
cuacgccacguauagaugac

SEQ ID NO: 114265 - RNA, 20 nt, Artificial Sequence
  MKO10114265_B_S1pr3
  gRNA
uuacgauuacguggggaaac

SEQ ID NO: 114266 - RNA, 20 nt, Artificial Sequence
  MKO10114266_B_S1pr3
  gRNA
uauccucuuccucaucgacg

SEQ ID NO: 114267 - RNA, 20 nt, Artificial Sequence
  MKO10114267_B_S1pr3
  gRNA
cuagacagccgcacaccaac

SEQ ID NO: 114268 - RNA, 20 nt, Artificial Sequence
  MKO10114268_B_S1pr4
  gRNA
cggagugggccucggugauc

SEQ ID NO: 114269 - RNA, 20 nt, Artificial Sequence
  MKO10114269_B_S1pr4
  gRNA
cugccugacccggaucaccg

SEQ ID NO: 114270 - RNA, 20 nt, Artificial Sequence
  MKO10114270_B_S1pr4
  gRNA
ggcucggaccacucuaaaga

SEQ ID NO: 114271 - RNA, 20 nt, Artificial Sequence
  MKO10114271_B_S1pr5
  gRNA
ucacgcgcaaaccaaagcgc

SEQ ID NO: 114272 - RNA, 20 nt, Artificial Sequence
  MKO10114272_B_S1pr5
  gRNA
cgccagcgugcgagcgcgac

SEQ ID NO: 114273 - RNA, 20 nt, Artificial Sequence
  MKO10114273_B_S1pr5
  gRNA
ccugcuucguacccuuagcg

SEQ ID NO: 114274 - RNA, 20 nt, Artificial Sequence
  MKO10114274_B_Saa1
  gRNA
cugacaugaaggaagcuaac

SEQ ID NO: 114275 - RNA, 20 nt, Artificial Sequence
  MKO10114275_B_Saa1
  gRNA
caaaugaaaaaaacccucca

SEQ ID NO: 114276 - RNA, 20 nt, Artificial Sequence
  MKO10114276_B_Saa1
  gRNA
gaugaagcuacucaccagcc

SEQ ID NO: 114277 - RNA, 20 nt, Artificial Sequence
  MKO10114277_B_Saa2
  gRNA
augcaggggcuggagacaug

SEQ ID NO: 114278 - RNA, 20 nt, Artificial Sequence
  MKO10114278_B_Saa2
  gRNA
uaaaugaaaaaaacccucca

SEQ ID NO: 114279 - RNA, 20 nt, Artificial Sequence
  MKO10114279_B_Saa2
  gRNA
gaugaagcuacucaccagcc

SEQ ID NO: 114280 - RNA, 20 nt, Artificial Sequence
  MKO10114280_B_Saa3
  gRNA
gaccagcuucuuucaugaac

SEQ ID NO: 114281 - RNA, 20 nt, Artificial Sequence
  MKO10114281_B_Saa3
  gRNA
aucuuuggcugucaacuccc

SEQ ID NO: 114282 - RNA, 20 nt, Artificial Sequence
  MKO10114282_B_Saa3
  gRNA
ccugaugacuuuagcagccc

SEQ ID NO: 114283 - RNA, 20 nt, Artificial Sequence
  MKO10114283_B_Saa4
  gRNA
gaacuacgaggcccaacaga

SEQ ID NO: 114284 - RNA, 20 nt, Artificial Sequence
  MKO10114284_B_Saa4
  gRNA
auggcugguauucauucuuc

SEQ ID NO: 114285 - RNA, 20 nt, Artificial Sequence
  MKO10114285_B_Saa4
  gRNA
agccaucaccacugacuccc

SEQ ID NO: 114286 - RNA, 20 nt, Artificial Sequence
  MKO10114286_B_Saal1
  gRNA
agcacucccaugaauauguc

SEQ ID NO: 114287 - RNA, 20 nt, Artificial Sequence
  MKO10114287_B_Saal1
  gRNA
cuuaccugcaaguuuccagc

SEQ ID NO: 114288 - RNA, 20 nt, Artificial Sequence
  MKO10114288_B_Saal1
  gRNA
aagauugucacaccugaaag

SEQ ID NO: 114289 - RNA, 20 nt, Artificial Sequence
  MKO10114289_B_Sac3d1
  gRNA
caacagccaacgccgccuga

SEQ ID NO: 114290 - RNA, 20 nt, Artificial Sequence
  MKO10114290_B_Sac3d1
  gRNA
cgcggacgcagcgacagugc

SEQ ID NO: 114291 - RNA, 20 nt, Artificial Sequence
  MKO10114291_B_Sac3d1
  gRNA
cgagcgccgccugcaccgac

SEQ ID NO: 114292 - RNA, 20 nt, Artificial Sequence
  MKO10114292_B_Sacm1l
  gRNA
guugcacuugacugauauuc

SEQ ID NO: 114293 - RNA, 20 nt, Artificial Sequence
  MKO10114293_B_Sacm1l
  gRNA
cauugaccgaguguccacag

SEQ ID NO: 114294 - RNA, 20 nt, Artificial Sequence
  MKO10114294_B_Sacm1l
  gRNA
accugcaagggugaccucug

SEQ ID NO: 114295 - RNA, 20 nt, Artificial Sequence
  MKO10114295_B_Sacs
  gRNA
uuuguaaaccuucaaucaaa

SEQ ID NO: 114296 - RNA, 20 nt, Artificial Sequence
  MKO10114296_B_Sacs
  gRNA
ucuccaaucuugauccaauc

SEQ ID NO: 114297 - RNA, 20 nt, Artificial Sequence
  MKO10114297_B_Sacs
  gRNA
auauaaaaauuuaaccucug

SEQ ID NO: 114298 - RNA, 20 nt, Artificial Sequence
  MKO10114298_B_Sae1
  gRNA
aauugccaagaaucuuaucc

SEQ ID NO: 114299 - RNA, 20 nt, Artificial Sequence
  MKO10114299_B_Sae1
  gRNA
uaccuguucgugguccagca

SEQ ID NO: 114300 - RNA, 20 nt, Artificial Sequence
  MKO10114300_B_Sae1
  gRNA
augcucuccaagauucgcaa

SEQ ID NO: 114301 - RNA, 20 nt, Artificial Sequence
  MKO10114301_B_Safb2
  gRNA
cacucaccagaguuacuuua

SEQ ID NO: 114302 - RNA, 20 nt, Artificial Sequence
  MKO10114302_B_Safb2
  gRNA
uucccaucaggcauuuaagg

SEQ ID NO: 114303 - RNA, 20 nt, Artificial Sequence
  MKO10114303_B_Safb2
  gRNA
ccaacacaccugcccauauc

SEQ ID NO: 114304 - RNA, 20 nt, Artificial Sequence
  MKO10114304_B_Safb
  gRNA
aucugacuucaccaugcugc

SEQ ID NO: 114305 - RNA, 20 nt, Artificial Sequence
  MKO10114305_B_Safb
  gRNA
ccaucauauccaugucuugc

SEQ ID NO: 114306 - RNA, 20 nt, Artificial Sequence
  MKO10114306_B_Safb
  gRNA
gcaacaagaagaugccuaag

SEQ ID NO: 114307 - RNA, 20 nt, Artificial Sequence
  MKO10114307_B_Sag
  gRNA
ucugcaggugaccaucuacc

SEQ ID NO: 114308 - RNA, 20 nt, Artificial Sequence
  MKO10114308_B_Sag
  gRNA
aacuuaccuugccuacaucc

SEQ ID NO: 114309 - RNA, 20 nt, Artificial Sequence
  MKO10114309_B_Sag
  gRNA
acuuaccuacaggcucuacu

SEQ ID NO: 114310 - RNA, 20 nt, Artificial Sequence
  MKO10114310_B_Sall1
  gRNA
uuugagccagcaugucgcgg

SEQ ID NO: 114311 - RNA, 20 nt, Artificial Sequence
  MKO10114311_B_Sall1
  gRNA
cuuccguuucacccgcuucg

SEQ ID NO: 114312 - RNA, 20 nt, Artificial Sequence
  MKO10114312_B_Sall1
  gRNA
aacagcaccccugcacgccg

SEQ ID NO: 114313 - RNA, 20 nt, Artificial Sequence
  MKO10114313_B_Sall2
  gRNA
cacaguccgagauuaacugu

SEQ ID NO: 114314 - RNA, 20 nt, Artificial Sequence
  MKO10114314_B_Sall2
  gRNA
cuccucugcgccccgaccag

SEQ ID NO: 114315 - RNA, 20 nt, Artificial Sequence
  MKO10114315_B_Sall2
  gRNA
cccaucaagccagcgcaaac

SEQ ID NO: 114316 - RNA, 20 nt, Artificial Sequence
  MKO10114316_B_Sall3
  gRNA
gaucgugcacgacgaugagc

SEQ ID NO: 114317 - RNA, 20 nt, Artificial Sequence
  MKO10114317_B_Sall3
  gRNA
aacaaugcacccgcgaggcg

SEQ ID NO: 114318 - RNA, 20 nt, Artificial Sequence
  MKO10114318_B_Sall3
  gRNA
ccacagcaaggcuaucgcac

SEQ ID NO: 114319 - RNA, 20 nt, Artificial Sequence
  MKO10114319_B_Sall4
  gRNA
ggcugugcucggauaaaugu

SEQ ID NO: 114320 - RNA, 20 nt, Artificial Sequence
  MKO10114320_B_Sall4
  gRNA
cugguguuuggccaugccgu

SEQ ID NO: 114321 - RNA, 20 nt, Artificial Sequence
  MKO10114321_B_Sall4
  gRNA
ccaacaauaacuccgcccgc

SEQ ID NO: 114322 - RNA, 20 nt, Artificial Sequence
  MKO10114322_B_Samd10
  gRNA
cagcuaggacauguuuccga

SEQ ID NO: 114323 - RNA, 20 nt, Artificial Sequence
  MKO10114323_B_Samd10
  gRNA
gccccuccucacgaaccugc

SEQ ID NO: 114324 - RNA, 20 nt, Artificial Sequence
  MKO10114324_B_Samd10
  gRNA
caccaggcaccagccucacg

SEQ ID NO: 114325 - RNA, 20 nt, Artificial Sequence
  MKO10114325_B_Samd11
  gRNA
ucccgagcuagagucuacaa

SEQ ID NO: 114326 - RNA, 20 nt, Artificial Sequence
  MKO10114326_B_Samd11
  gRNA
ccacuaccaucagcuuaugu

SEQ ID NO: 114327 - RNA, 20 nt, Artificial Sequence
  MKO10114327_B_Samd11
  gRNA
auccucuacaggcgaccugu

SEQ ID NO: 114328 - RNA, 20 nt, Artificial Sequence
  MKO10114328_B_Samd12
  gRNA
gccacuugcagacauccugc

SEQ ID NO: 114329 - RNA, 20 nt, Artificial Sequence
  MKO10114329_B_Samd12
  gRNA
uuauggagaacacuccaccg

SEQ ID NO: 114330 - RNA, 20 nt, Artificial Sequence
  MKO10114330_B_Samd12
  gRNA
cuucuucccgcacuuucagu

SEQ ID NO: 114331 - RNA, 20 nt, Artificial Sequence
  MKO10114331_B_Samd14
  gRNA
gcuggcacugucucguagcc

SEQ ID NO: 114332 - RNA, 20 nt, Artificial Sequence
  MKO10114332_B_Samd14
  gRNA
agucuucuuguccaagccga

SEQ ID NO: 114333 - RNA, 20 nt, Artificial Sequence
  MKO10114333_B_Samd14
  gRNA
aacgggaaggccggugucuc

SEQ ID NO: 114334 - RNA, 20 nt, Artificial Sequence
  MKO10114334_B_Samd1
  gRNA
cacuggccuauccauucgcc

SEQ ID NO: 114335 - RNA, 20 nt, Artificial Sequence
  MKO10114335_B_Samd1
  gRNA
ugucggcuucuccuugcgcc

SEQ ID NO: 114336 - RNA, 20 nt, Artificial Sequence
  MKO10114336_B_Samd1
  gRNA
ucaacuuacggacagccaaa

SEQ ID NO: 114337 - RNA, 20 nt, Artificial Sequence
  MKO10114337_B_Samd3
  gRNA
ggucagcguggauguaucug

SEQ ID NO: 114338 - RNA, 20 nt, Artificial Sequence
  MKO10114338_B_Samd3
  gRNA
cggcuggauacaaagauguc

SEQ ID NO: 114339 - RNA, 20 nt, Artificial Sequence
  MKO10114339_B_Samd3
  gRNA
acuuaggugagcuagucccc

SEQ ID NO: 114340 - RNA, 20 nt, Artificial Sequence
  MKO10114340_B_Samd4b
  gRNA
ccaggggccugugggcucgu

SEQ ID NO: 114341 - RNA, 20 nt, Artificial Sequence
  MKO10114341_B_Samd4b
  gRNA
ucagauucaccugcgacucu

SEQ ID NO: 114342 - RNA, 20 nt, Artificial Sequence
  MKO10114342_B_Samd4b
  gRNA
cuccagccggaacacuuucc

SEQ ID NO: 114343 - RNA, 20 nt, Artificial Sequence
  MKO10114343_B_Samd4
  gRNA
cuaacccaggacaucaucga

SEQ ID NO: 114344 - RNA, 20 nt, Artificial Sequence
  MKO10114344_B_Samd4
  gRNA
accgcagcgcacuagccaug

SEQ ID NO: 114345 - RNA, 20 nt, Artificial Sequence
  MKO10114345_B_Samd4
  gRNA
ggcccucacugagugucaac

SEQ ID NO: 114346 - RNA, 20 nt, Artificial Sequence
  MKO10114346_B_Samd5
  gRNA
aauccacaggucccaauggc

SEQ ID NO: 114347 - RNA, 20 nt, Artificial Sequence
  MKO10114347_B_Samd5
  gRNA
acaguacgcugaguccuucg

SEQ ID NO: 114348 - RNA, 20 nt, Artificial Sequence
  MKO10114348_B_Samd5
  gRNA
cgcgggagccagcaccccga

SEQ ID NO: 114349 - RNA, 20 nt, Artificial Sequence
  MKO10114349_B_Samd7
  gRNA
ugguugucuaccucaauguc

SEQ ID NO: 114350 - RNA, 20 nt, Artificial Sequence
  MKO10114350_B_Samd7
  gRNA
ugggcauagucugagcagcc

SEQ ID NO: 114351 - RNA, 20 nt, Artificial Sequence
  MKO10114351_B_Samd7
  gRNA
uuuaccaccugaacccauaa

SEQ ID NO: 114352 - RNA, 20 nt, Artificial Sequence
  MKO10114352_B_Samd8
  gRNA
acaggucaauccuucugcga

SEQ ID NO: 114353 - RNA, 20 nt, Artificial Sequence
  MKO10114353_B_Samd8
  gRNA
gacuacagagccuucgcaga

SEQ ID NO: 114354 - RNA, 20 nt, Artificial Sequence
  MKO10114354_B_Samd8
  gRNA
cauuccaaagccgcuccaga

SEQ ID NO: 114355 - RNA, 20 nt, Artificial Sequence
  MKO10114355_B_Samd9l
  gRNA
acugaaaaggucuugaucgc

SEQ ID NO: 114356 - RNA, 20 nt, Artificial Sequence
  MKO10114356_B_Samd9l
  gRNA
ucuugaacucucuaucccgu

SEQ ID NO: 114357 - RNA, 20 nt, Artificial Sequence
  MKO10114357_B_Samd9l
  gRNA
cauccuugaaucgauccuuc

SEQ ID NO: 114358 - RNA, 20 nt, Artificial Sequence
  MKO10114358_B_Samhd1
  gRNA
gacuguguucgaagcgauug

SEQ ID NO: 114359 - RNA, 20 nt, Artificial Sequence
  MKO10114359_B_Samhd1
  gRNA
uuccaagacaauaaaaucgc

SEQ ID NO: 114360 - RNA, 20 nt, Artificial Sequence
  MKO10114360_B_Samhd1
  gRNA
uccgagacugacucagcugc

SEQ ID NO: 114361 - RNA, 20 nt, Artificial Sequence
  MKO10114361_B_Samm50
  gRNA
gacgggcaguuacaacacca

SEQ ID NO: 114362 - RNA, 20 nt, Artificial Sequence
  MKO10114362_B_Samm50
  gRNA
ggugaagaugcccugcccaa

SEQ ID NO: 114363 - RNA, 20 nt, Artificial Sequence
  MKO10114363_B_Samm50
  gRNA
ccacuugucuaaaaauuccu

SEQ ID NO: 114364 - RNA, 20 nt, Artificial Sequence
  MKO10114364_B_Samsn1
  gRNA
aagacuguccauagagucgc

SEQ ID NO: 114365 - RNA, 20 nt, Artificial Sequence
  MKO10114365_B_Samsn1
  gRNA
uuacagcgcagcagcaguuu

SEQ ID NO: 114366 - RNA, 20 nt, Artificial Sequence
  MKO10114366_B_Samsn1
  gRNA
aaaaucugaugacucaauug

SEQ ID NO: 114367 - RNA, 20 nt, Artificial Sequence
  MKO10114367_B_Samt1
  gRNA
acacagaaaaccagaaccac

SEQ ID NO: 114368 - RNA, 20 nt, Artificial Sequence
  MKO10114368_B_Samt1
  gRNA
aacaagcaaacauuuaacug

SEQ ID NO: 114369 - RNA, 20 nt, Artificial Sequence
  MKO10114369_B_Samt1
  gRNA
ucaaaauggcccauacuacc

SEQ ID NO: 114370 - RNA, 20 nt, Artificial Sequence
  MKO10114370_B_Samt2
  gRNA
caucuucagauuugcaggau

SEQ ID NO: 114371 - RNA, 20 nt, Artificial Sequence
  MKO10114371_B_Samt2
  gRNA
guaccauuauuucugugacc

SEQ ID NO: 114372 - RNA, 20 nt, Artificial Sequence
  MKO10114372_B_Samt2
  gRNA
uagcacacuaucugaaucuc

SEQ ID NO: 114373 - RNA, 20 nt, Artificial Sequence
  MKO10114373_B_Samt3
  gRNA
gcacauuuguuuccgugagc

SEQ ID NO: 114374 - RNA, 20 nt, Artificial Sequence
  MKO10114374_B_Samt3
  gRNA
uagcugucaggaccccuauu

SEQ ID NO: 114375 - RNA, 20 nt, Artificial Sequence
  MKO10114375_B_Samt3
  gRNA
ggccguaaaggucuacaaca

SEQ ID NO: 114376 - RNA, 20 nt, Artificial Sequence
  MKO10114376_B_Samt4
  gRNA
acugcuaauacccaaaacua

SEQ ID NO: 114377 - RNA, 20 nt, Artificial Sequence
  MKO10114377_B_Samt4
  gRNA
ccauugccagcaaucaaugc

SEQ ID NO: 114378 - RNA, 20 nt, Artificial Sequence
  MKO10114378_B_Samt4
  gRNA
caaguucucuaccuuaguuu

SEQ ID NO: 114379 - RNA, 20 nt, Artificial Sequence
  MKO10114379_B_Sap130
  gRNA
guaaccugcccgggaacuuu

SEQ ID NO: 114380 - RNA, 20 nt, Artificial Sequence
  MKO10114380_B_Sap130
  gRNA
gacuguaguuacuuuagagc

SEQ ID NO: 114381 - RNA, 20 nt, Artificial Sequence
  MKO10114381_B_Sap130
  gRNA
gcuagggcccacgugcuccc

SEQ ID NO: 114382 - RNA, 20 nt, Artificial Sequence
  MKO10114382_B_Sap18
  gRNA
uucugcagaguuaaggagau

SEQ ID NO: 114383 - RNA, 20 nt, Artificial Sequence
  MKO10114383_B_Sap18
  gRNA
uagaucugcagcucgcucga

SEQ ID NO: 114384 - RNA, 20 nt, Artificial Sequence
  MKO10114384_B_Sap18
  gRNA
agaccugcccgcuccugcug

SEQ ID NO: 114385 - RNA, 20 nt, Artificial Sequence
  MKO10114385_B_Sap25
  gRNA
augcacagagggcgacauga

SEQ ID NO: 114386 - RNA, 20 nt, Artificial Sequence
  MKO10114386_B_Sap25
  gRNA
ucacaguacgucuuucuccc

SEQ ID NO: 114387 - RNA, 20 nt, Artificial Sequence
  MKO10114387_B_Sap25
  gRNA
uaaugcaggaccucggcugg

SEQ ID NO: 114388 - RNA, 20 nt, Artificial Sequence
  MKO10114388_B_Sap30bp
  gRNA
uaaccauccucaucaccccc

SEQ ID NO: 114389 - RNA, 20 nt, Artificial Sequence
  MKO10114389_B_Sap30bp
  gRNA
guugcgaacccuuucagaaa

SEQ ID NO: 114390 - RNA, 20 nt, Artificial Sequence
  MKO10114390_B_Sap30bp
  gRNA
accuuugggucaucagccuc

SEQ ID NO: 114391 - RNA, 20 nt, Artificial Sequence
  MKO10114391_B_Sap30l
  gRNA
cgagcgcugcguccggcccg

SEQ ID NO: 114392 - RNA, 20 nt, Artificial Sequence
  MKO10114392_B_Sap30l
  gRNA
uccagagcguccgaaauaaa

SEQ ID NO: 114393 - RNA, 20 nt, Artificial Sequence
  MKO10114393_B_Sap30l
  gRNA
agggaugucagcaucgugcu

SEQ ID NO: 114394 - RNA, 20 nt, Artificial Sequence
  MKO10114394_B_Sap30
  gRNA
cuccuagugaacaccacugu

SEQ ID NO: 114395 - RNA, 20 nt, Artificial Sequence
  MKO10114395_B_Sap30
  gRNA
ugaguagaugaaacauguua

SEQ ID NO: 114396 - RNA, 20 nt, Artificial Sequence
  MKO10114396_B_Sap30
  gRNA
ucaggacaucgacacuccag

SEQ ID NO: 114397 - RNA, 20 nt, Artificial Sequence
  MKO10114397_B_Sapcd1
  gRNA
cacuguucugcugcuaccac

SEQ ID NO: 114398 - RNA, 20 nt, Artificial Sequence
  MKO10114398_B_Sapcd1
  gRNA
ccugguucgcagaccggcug

SEQ ID NO: 114399 - RNA, 20 nt, Artificial Sequence
  MKO10114399_B_Sapcd1
  gRNA
cugaugccccucugcuaacc

SEQ ID NO: 114400 - RNA, 20 nt, Artificial Sequence
  MKO10114400_B_Sapcd2
  gRNA
ccgggccaccuccuguacuu

SEQ ID NO: 114401 - RNA, 20 nt, Artificial Sequence
  MKO10114401_B_Sapcd2
  gRNA
gagguugcugcccaaaguac

SEQ ID NO: 114402 - RNA, 20 nt, Artificial Sequence
  MKO10114402_B_Sapcd2
  gRNA
ggccccgugccaucaucucc

SEQ ID NO: 114403 - RNA, 20 nt, Artificial Sequence
  MKO10114403_B_Sar1a
  gRNA
cguacagcccaaauauuuca

SEQ ID NO: 114404 - RNA, 20 nt, Artificial Sequence
  MKO10114404_B_Sar1a
  gRNA
ucagaagaacugacaauugc

SEQ ID NO: 114405 - RNA, 20 nt, Artificial Sequence
  MKO10114405_B_Sar1a
  gRNA
aacuuacugggauggagugu

SEQ ID NO: 114406 - RNA, 20 nt, Artificial Sequence
  MKO10114406_B_Sar1b
  gRNA
ucagaagagcuuacuauugc

SEQ ID NO: 114407 - RNA, 20 nt, Artificial Sequence
  MKO10114407_B_Sar1b
  gRNA
ucguaaccucucuucacuga

SEQ ID NO: 114408 - RNA, 20 nt, Artificial Sequence
  MKO10114408_B_Sar1b
  gRNA
uaaacugguauuccuuggau

SEQ ID NO: 114409 - RNA, 20 nt, Artificial Sequence
  MKO10114409_B_Sardh
  gRNA
gcaaguggugagccgugauc

SEQ ID NO: 114410 - RNA, 20 nt, Artificial Sequence
  MKO10114410_B_Sardh
  gRNA
aggucguccacguucaucag

SEQ ID NO: 114411 - RNA, 20 nt, Artificial Sequence
  MKO10114411_B_Sardh
  gRNA
cgacuuuggagugcggcggg

SEQ ID NO: 114412 - RNA, 20 nt, Artificial Sequence
  MKO10114412_B_Sarm1
  gRNA
gggucucgcgaagugucgcc

SEQ ID NO: 114413 - RNA, 20 nt, Artificial Sequence
  MKO10114413_B_Sarm1
  gRNA
uccgggcacugucagccgau

SEQ ID NO: 114414 - RNA, 20 nt, Artificial Sequence
  MKO10114414_B_Sarm1
  gRNA
cucuacgaauggcaccacgu

SEQ ID NO: 114415 - RNA, 20 nt, Artificial Sequence
  MKO10114415_B_Sarnp
  gRNA
agaauacuuacuucagucug

SEQ ID NO: 114416 - RNA, 20 nt, Artificial Sequence
  MKO10114416_B_Sarnp
  gRNA
agcaaaugaagaagauguac

SEQ ID NO: 114417 - RNA, 20 nt, Artificial Sequence
  MKO10114417_B_Sarnp
  gRNA
cauagaacugccuguuaaag

SEQ ID NO: 114418 - RNA, 20 nt, Artificial Sequence
  MKO10114418_B_Sars2
  gRNA
agaggcagugcgggcccugc

SEQ ID NO: 114419 - RNA, 20 nt, Artificial Sequence
  MKO10114419_B_Sars2
  gRNA
ccguguggugggugaaaagc

SEQ ID NO: 114420 - RNA, 20 nt, Artificial Sequence
  MKO10114420_B_Sars2
  gRNA
gccuggcucucgucccccac

SEQ ID NO: 114421 - RNA, 20 nt, Artificial Sequence
  MKO10114421_B_Sars
  gRNA
gcagaagguucccaaucucg

SEQ ID NO: 114422 - RNA, 20 nt, Artificial Sequence
  MKO10114422_B_Sars
  gRNA
ucgaaauucagcacguucuc

SEQ ID NO: 114423 - RNA, 20 nt, Artificial Sequence
  MKO10114423_B_Sars
  gRNA
cagcuagcgcgucugcagug

SEQ ID NO: 114424 - RNA, 20 nt, Artificial Sequence
  MKO10114424_B_Sart1
  gRNA
caguaaacuccgagcaaagu

SEQ ID NO: 114425 - RNA, 20 nt, Artificial Sequence
  MKO10114425_B_Sart1
  gRNA
cuuaacagcauugaccucca

SEQ ID NO: 114426 - RNA, 20 nt, Artificial Sequence
  MKO10114426_B_Sart1
  gRNA
ugccucaucccucagcauug

SEQ ID NO: 114427 - RNA, 20 nt, Artificial Sequence
  MKO10114427_B_Sart3
  gRNA
gagcucuucccccugaccga

SEQ ID NO: 114428 - RNA, 20 nt, Artificial Sequence
  MKO10114428_B_Sart3
  gRNA
ccugcacaugacgaaaggcc

SEQ ID NO: 114429 - RNA, 20 nt, Artificial Sequence
  MKO10114429_B_Sart3
  gRNA
cagcuggcgaucccacugua

SEQ ID NO: 114430 - RNA, 20 nt, Artificial Sequence
  MKO10114430_B_Sash1
  gRNA
cacucaccacauccaggucc

SEQ ID NO: 114431 - RNA, 20 nt, Artificial Sequence
  MKO10114431_B_Sash1
  gRNA
gccccacgucacuucagcug

SEQ ID NO: 114432 - RNA, 20 nt, Artificial Sequence
  MKO10114432_B_Sash1
  gRNA
cgucuucugaguuugauuua

SEQ ID NO: 114433 - RNA, 20 nt, Artificial Sequence
  MKO10114433_B_Sash3
  gRNA
acgcuccuccugcucaguaa

SEQ ID NO: 114434 - RNA, 20 nt, Artificial Sequence
  MKO10114434_B_Sash3
  gRNA
cuuucuacagggagacacgc

SEQ ID NO: 114435 - RNA, 20 nt, Artificial Sequence
  MKO10114435_B_Sash3
  gRNA
ucauuucccgaaccaugaac

SEQ ID NO: 114436 - RNA, 20 nt, Artificial Sequence
  MKO10114436_B_Sass6
  gRNA
uugucuccacuacguuuaaa

SEQ ID NO: 114437 - RNA, 20 nt, Artificial Sequence
  MKO10114437_B_Sass6
  gRNA
guauaaccuuguuauaucug

SEQ ID NO: 114438 - RNA, 20 nt, Artificial Sequence
  MKO10114438_B_Sass6
  gRNA
ggaaagcuaagaaguccacc

SEQ ID NO: 114439 - RNA, 20 nt, Artificial Sequence
  MKO10114439_B_Sau1
  gRNA
uuuccuuuaggcuuugguau

SEQ ID NO: 114440 - RNA, 20 nt, Artificial Sequence
  MKO10114440_B_Sau1
  gRNA
ucagggguccagugcucuuu

SEQ ID NO: 114441 - RNA, 20 nt, Artificial Sequence
  MKO10114441_B_Sau1
  gRNA
acuggcuaaauaugaauaca

SEQ ID NO: 114442 - RNA, 20 nt, Artificial Sequence
  MKO10114442_B_Sau2
  gRNA
uuuauagcucugcgagcaga

SEQ ID NO: 114443 - RNA, 20 nt, Artificial Sequence
  MKO10114443_B_Sau2
  gRNA
gcagagauuaucccagcacc

SEQ ID NO: 114444 - RNA, 20 nt, Artificial Sequence
  MKO10114444_B_Sau2
  gRNA
cuucacugaucuucaccuga

SEQ ID NO: 114445 - RNA, 20 nt, Artificial Sequence
  MKO10114445_B_Saub1
  gRNA
agauaugaaccagaguucgu

SEQ ID NO: 114446 - RNA, 20 nt, Artificial Sequence
  MKO10114446_B_Saub1
  gRNA
gcaacgccaucucuaucagc

SEQ ID NO: 114447 - RNA, 20 nt, Artificial Sequence
  MKO10114447_B_Saub1
  gRNA
auaguacgugcuguucacaa

SEQ ID NO: 114448 - RNA, 20 nt, Artificial Sequence
  MKO10114448_B_Saub2
  gRNA
agacgccccugaugcgacug

SEQ ID NO: 114449 - RNA, 20 nt, Artificial Sequence
  MKO10114449_B_Saub2
  gRNA
ugcgcaggaauaaucaagcu

SEQ ID NO: 114450 - RNA, 20 nt, Artificial Sequence
  MKO10114450_B_Saub2
  gRNA
cgaacucagcgugcucuucu

SEQ ID NO: 114451 - RNA, 20 nt, Artificial Sequence
  MKO10114451_B_Saul1
  gRNA
caugcugaagaagcuaaguc

SEQ ID NO: 114452 - RNA, 20 nt, Artificial Sequence
  MKO10114452_B_Saul1
  gRNA
caggaacuggcuucuuauga

SEQ ID NO: 114453 - RNA, 20 nt, Artificial Sequence
  MKO10114453_B_Saul1
  gRNA
accugauucugucuguucac

SEQ ID NO: 114454 - RNA, 20 nt, Artificial Sequence
  MKO10114454_B_Sav1
  gRNA
gcagauugugaaguuguacg

SEQ ID NO: 114455 - RNA, 20 nt, Artificial Sequence
  MKO10114455_B_Sav1
  gRNA
acuccuuuaccucggagcac

SEQ ID NO: 114456 - RNA, 20 nt, Artificial Sequence
  MKO10114456_B_Sav1
  gRNA
agaacgucuugccaugcugc

SEQ ID NO: 114457 - RNA, 20 nt, Artificial Sequence
  MKO10114457_B_Saysd1
  gRNA
aguccacguucaaggauagg

SEQ ID NO: 114458 - RNA, 20 nt, Artificial Sequence
  MKO10114458_B_Saysd1
  gRNA
agccaaccccgccaucgcuc

SEQ ID NO: 114459 - RNA, 20 nt, Artificial Sequence
  MKO10114459_B_Saysd1
  gRNA
aguuccgggaggcccgcaaa

SEQ ID NO: 114460 - RNA, 20 nt, Artificial Sequence
  MKO10114460_B_Sbds
  gRNA
ccugcuugcagauuucaguc

SEQ ID NO: 114461 - RNA, 20 nt, Artificial Sequence
  MKO10114461_B_Sbds
  gRNA
agugcucagucugaaggacg

SEQ ID NO: 114462 - RNA, 20 nt, Artificial Sequence
  MKO10114462_B_Sbds
  gRNA
gaagaccucaucagugcauu

SEQ ID NO: 114463 - RNA, 20 nt, Artificial Sequence
  MKO10114463_B_Sbf1
  gRNA
ggaggacaacccuuuccccc

SEQ ID NO: 114464 - RNA, 20 nt, Artificial Sequence
  MKO10114464_B_Sbf1
  gRNA
ccuccucacccugaacacuu

SEQ ID NO: 114465 - RNA, 20 nt, Artificial Sequence
  MKO10114465_B_Sbf1
  gRNA
ucucagaguugaugucagua

SEQ ID NO: 114466 - RNA, 20 nt, Artificial Sequence
  MKO10114466_B_Sbf2
  gRNA
uguuggcuguuuccgcucuc

SEQ ID NO: 114467 - RNA, 20 nt, Artificial Sequence
  MKO10114467_B_Sbf2
  gRNA
ggaugacacgccuuucccac

SEQ ID NO: 114468 - RNA, 20 nt, Artificial Sequence
  MKO10114468_B_Sbf2
  gRNA
cuuaccaauucaauucccug

SEQ ID NO: 114469 - RNA, 20 nt, Artificial Sequence
  MKO10114469_B_Sbk1
  gRNA
agcgcugacccuacgcacac

SEQ ID NO: 114470 - RNA, 20 nt, Artificial Sequence
  MKO10114470_B_Sbk1
  gRNA
cgcuggcagccagugugcgu

SEQ ID NO: 114471 - RNA, 20 nt, Artificial Sequence
  MKO10114471_B_Sbk1
  gRNA
ccccagcaggugcauacucc

SEQ ID NO: 114472 - RNA, 20 nt, Artificial Sequence
  MKO10114472_B_Sbk2
  gRNA
cgcgucaagcugacagacuu

SEQ ID NO: 114473 - RNA, 20 nt, Artificial Sequence
  MKO10114473_B_Sbk2
  gRNA
aagcaauccacuucccuccg

SEQ ID NO: 114474 - RNA, 20 nt, Artificial Sequence
  MKO10114474_B_Sbk2
  gRNA
cuuccuguaugaguucugcg

SEQ ID NO: 114475 - RNA, 20 nt, Artificial Sequence
  MKO10114475_B_Sbk3
  gRNA
cgcugcgucucuucacaucc

SEQ ID NO: 114476 - RNA, 20 nt, Artificial Sequence
  MKO10114476_B_Sbk3
  gRNA
agucccuucggaggagcuua

SEQ ID NO: 114477 - RNA, 20 nt, Artificial Sequence
  MKO10114477_B_Sbk3
  gRNA
gcaaacuggucccagggugc

SEQ ID NO: 114478 - RNA, 20 nt, Artificial Sequence
  MKO10114478_B_Sbno1
  gRNA
auucagcacaaacguuguag

SEQ ID NO: 114479 - RNA, 20 nt, Artificial Sequence
  MKO10114479_B_Sbno1
  gRNA
ccuaguucuaaugcacuaag

SEQ ID NO: 114480 - RNA, 20 nt, Artificial Sequence
  MKO10114480_B_Sbno1
  gRNA
ccugcagcugaugucaguaa

SEQ ID NO: 114481 - RNA, 20 nt, Artificial Sequence
  MKO10114481_B_Sbno2
  gRNA
auucucggcuccugaagacc

SEQ ID NO: 114482 - RNA, 20 nt, Artificial Sequence
  MKO10114482_B_Sbno2
  gRNA
accgacuccugcacuguccu

SEQ ID NO: 114483 - RNA, 20 nt, Artificial Sequence
  MKO10114483_B_Sbno2
  gRNA
caagagcagcgacuuuccuc

SEQ ID NO: 114484 - RNA, 20 nt, Artificial Sequence
  MKO10114484_B_Sbpl
  gRNA
ccugaggguucaggacccag

SEQ ID NO: 114485 - RNA, 20 nt, Artificial Sequence
  MKO10114485_B_Sbpl
  gRNA
gauguccuggggaaugcugc

SEQ ID NO: 114486 - RNA, 20 nt, Artificial Sequence
  MKO10114486_B_Sbpl
  gRNA
acuugccagcagcauucccc

SEQ ID NO: 114487 - RNA, 20 nt, Artificial Sequence
  MKO10114487_B_Sbp
  gRNA
caugcugcuguugcugacuu

SEQ ID NO: 114488 - RNA, 20 nt, Artificial Sequence
  MKO10114488_B_Sbp
  gRNA
acuugccagcagcauucccc

SEQ ID NO: 114489 - RNA, 20 nt, Artificial Sequence
  MKO10114489_B_Sbp
  gRNA
gauguccuggggaaugcugc

SEQ ID NO: 114490 - RNA, 20 nt, Artificial Sequence
  MKO10114490_B_Sbsn
  gRNA
guagcccacgacaucaacag

SEQ ID NO: 114491 - RNA, 20 nt, Artificial Sequence
  MKO10114491_B_Sbsn
  gRNA
ggcggguacggaggccagca

SEQ ID NO: 114492 - RNA, 20 nt, Artificial Sequence
  MKO10114492_B_Sbsn
  gRNA
ggcaucaguuuagggcaugg

SEQ ID NO: 114493 - RNA, 20 nt, Artificial Sequence
  MKO10114493_B_Sbspon
  gRNA
agcccaccacgcgugugcgc

SEQ ID NO: 114494 - RNA, 20 nt, Artificial Sequence
  MKO10114494_B_Sbspon
  gRNA
gauacugcauccaucgaguc

SEQ ID NO: 114495 - RNA, 20 nt, Artificial Sequence
  MKO10114495_B_Sbspon
  gRNA
ucagaaaucagacucuucgc

SEQ ID NO: 114496 - RNA, 20 nt, Artificial Sequence
  MKO10114496_B_Sc4mol
  gRNA
accaaguucagcggguugag

SEQ ID NO: 114497 - RNA, 20 nt, Artificial Sequence
  MKO10114497_B_Sc4mol
  gRNA
gauaaaccagaaaccuucga

SEQ ID NO: 114498 - RNA, 20 nt, Artificial Sequence
  MKO10114498_B_Sc4mol
  gRNA
uaaaguccaucacgaguuuc

SEQ ID NO: 114499 - RNA, 20 nt, Artificial Sequence
  MKO10114499_B_Sc5d
  gRNA
gauguuguccucgggccacg

SEQ ID NO: 114500 - RNA, 20 nt, Artificial Sequence
  MKO10114500_B_Sc5d
  gRNA
agcaaacucuacgaugacau

SEQ ID NO: 114501 - RNA, 20 nt, Artificial Sequence
  MKO10114501_B_Sc5d
  gRNA
uucggguuccccagaucuua

SEQ ID NO: 114502 - RNA, 20 nt, Artificial Sequence
  MKO10114502_B_Scaf11
  gRNA
aaccaacuuccuucccuaac

SEQ ID NO: 114503 - RNA, 20 nt, Artificial Sequence
  MKO10114503_B_Scaf11
  gRNA
uggcuucuuguccaaucgau

SEQ ID NO: 114504 - RNA, 20 nt, Artificial Sequence
  MKO10114504_B_Scaf11
  gRNA
cuguuaugugaaagaucuga

SEQ ID NO: 114505 - RNA, 20 nt, Artificial Sequence
  MKO10114505_B_Scaf1
  gRNA
uggggucccugucaccgaug

SEQ ID NO: 114506 - RNA, 20 nt, Artificial Sequence
  MKO10114506_B_Scaf1
  gRNA
ggccucauaccuuuaucauu

SEQ ID NO: 114507 - RNA, 20 nt, Artificial Sequence
  MKO10114507_B_Scaf1
  gRNA
ggcagcagcgccuccaucgu

SEQ ID NO: 114508 - RNA, 20 nt, Artificial Sequence
  MKO10114508_B_Scaf4
  gRNA
agcugcuaucaaagcuauua

SEQ ID NO: 114509 - RNA, 20 nt, Artificial Sequence
  MKO10114509_B_Scaf4
  gRNA
gcaguguaagccagaauaua

SEQ ID NO: 114510 - RNA, 20 nt, Artificial Sequence
  MKO10114510_B_Scaf4
  gRNA
uuuaguaaugagaaucaucu

SEQ ID NO: 114511 - RNA, 20 nt, Artificial Sequence
  MKO10114511_B_Scaf8
  gRNA
cccaguugucacgccuguuu

SEQ ID NO: 114512 - RNA, 20 nt, Artificial Sequence
  MKO10114512_B_Scaf8
  gRNA
acucaccuuaauagcuuuga

SEQ ID NO: 114513 - RNA, 20 nt, Artificial Sequence
  MKO10114513_B_Scaf8
  gRNA
aaaaaugacccaaauuacaa

SEQ ID NO: 114514 - RNA, 20 nt, Artificial Sequence
  MKO10114514_B_Scai
  gRNA
ggcuugaagcgguggcaaau

SEQ ID NO: 114515 - RNA, 20 nt, Artificial Sequence
  MKO10114515_B_Scai
  gRNA
ugcugaagaugacaucccac

SEQ ID NO: 114516 - RNA, 20 nt, Artificial Sequence
  MKO10114516_B_Scai
  gRNA
aagcaguggcaguccuacuu

SEQ ID NO: 114517 - RNA, 20 nt, Artificial Sequence
  MKO10114517_B_Scamp1
  gRNA
acauaagcuucaccgucuuc

SEQ ID NO: 114518 - RNA, 20 nt, Artificial Sequence
  MKO10114518_B_Scamp1
  gRNA
gagcaguucagcuugagcca

SEQ ID NO: 114519 - RNA, 20 nt, Artificial Sequence
  MKO10114519_B_Scamp1
  gRNA
ggauacuaccaugcuggcuc

SEQ ID NO: 114520 - RNA, 20 nt, Artificial Sequence
  MKO10114520_B_Scamp2
  gRNA
ucgcuccuugcguuccagcu

SEQ ID NO: 114521 - RNA, 20 nt, Artificial Sequence
  MKO10114521_B_Scamp2
  gRNA
accagcacagccaacgcccc

SEQ ID NO: 114522 - RNA, 20 nt, Artificial Sequence
  MKO10114522_B_Scamp2
  gRNA
cugagcaguaccuggggcgu

SEQ ID NO: 114523 - RNA, 20 nt, Artificial Sequence
  MKO10114523_B_Scamp3
  gRNA
agaacugcagcaugucgccc

SEQ ID NO: 114524 - RNA, 20 nt, Artificial Sequence
  MKO10114524_B_Scamp3
  gRNA
cuacggcuccuacagcaccc

SEQ ID NO: 114525 - RNA, 20 nt, Artificial Sequence
  MKO10114525_B_Scamp3
  gRNA
uuacagcucgacagaacaac

SEQ ID NO: 114526 - RNA, 20 nt, Artificial Sequence
  MKO10114526_B_Scamp4
  gRNA
cuucucugaugagauccccg

SEQ ID NO: 114527 - RNA, 20 nt, Artificial Sequence
  MKO10114527_B_Scamp4
  gRNA
gcuucucgggcuggggcgca

SEQ ID NO: 114528 - RNA, 20 nt, Artificial Sequence
  MKO10114528_B_Scamp4
  gRNA
uuccuuguccgcccuuguga

SEQ ID NO: 114529 - RNA, 20 nt, Artificial Sequence
  MKO10114529_B_Scamp5
  gRNA
caccuugcuccuacgucugc

SEQ ID NO: 114530 - RNA, 20 nt, Artificial Sequence
  MKO10114530_B_Scamp5
  gRNA
ccaagcgccucuacuaccuc

SEQ ID NO: 114531 - RNA, 20 nt, Artificial Sequence
  MKO10114531_B_Scamp5
  gRNA
ggaugucugccucgaagucu

SEQ ID NO: 114532 - RNA, 20 nt, Artificial Sequence
  MKO10114532_B_Scand1
  gRNA
guucaaagcugcgggcgcgc

SEQ ID NO: 114533 - RNA, 20 nt, Artificial Sequence
  MKO10114533_B_Scand1
  gRNA
ccuacgcugacgccgcccug

SEQ ID NO: 114534 - RNA, 20 nt, Artificial Sequence
  MKO10114534_B_Scand1
  gRNA
cggugaugcgcacguccgcg

SEQ ID NO: 114535 - RNA, 20 nt, Artificial Sequence
  MKO10114535_B_Scaper
  gRNA
cauagauuucaucuacugcc

SEQ ID NO: 114536 - RNA, 20 nt, Artificial Sequence
  MKO10114536_B_Scaper
  gRNA
ggaaaaccgaaaugucaaac

SEQ ID NO: 114537 - RNA, 20 nt, Artificial Sequence
  MKO10114537_B_Scaper
  gRNA
uuuccaccaguuugacauuu

SEQ ID NO: 114538 - RNA, 20 nt, Artificial Sequence
  MKO10114538_B_Scap
  gRNA
gcaguaugugggugcccccg

SEQ ID NO: 114539 - RNA, 20 nt, Artificial Sequence
  MKO10114539_B_Scap
  gRNA
gggggcgaguaacccuucac

SEQ ID NO: 114540 - RNA, 20 nt, Artificial Sequence
  MKO10114540_B_Scap
  gRNA
augcucgggacagaggugac

SEQ ID NO: 114541 - RNA, 20 nt, Artificial Sequence
  MKO10114541_B_Scara3
  gRNA
ucuucuggcagcgguugcag

SEQ ID NO: 114542 - RNA, 20 nt, Artificial Sequence
  MKO10114542_B_Scara3
  gRNA
uguccucgucuucaccagcc

SEQ ID NO: 114543 - RNA, 20 nt, Artificial Sequence
  MKO10114543_B_Scara3
  gRNA
cacaagcuucuuauuauaga

SEQ ID NO: 114544 - RNA, 20 nt, Artificial Sequence
  MKO10114544_B_Scara5
  gRNA
caaagauggagccguuguca

SEQ ID NO: 114545 - RNA, 20 nt, Artificial Sequence
  MKO10114545_B_Scara5
  gRNA
cccgcccgccguuugugaca

SEQ ID NO: 114546 - RNA, 20 nt, Artificial Sequence
  MKO10114546_B_Scara5
  gRNA
ucagggccaccgggacccaa

SEQ ID NO: 114547 - RNA, 20 nt, Artificial Sequence
  MKO10114547_B_Scarb1
  gRNA
ccaggggggcucgauauuga

SEQ ID NO: 114548 - RNA, 20 nt, Artificial Sequence
  MKO10114548_B_Scarb1
  gRNA
caacgacaccguguccuucg

SEQ ID NO: 114549 - RNA, 20 nt, Artificial Sequence
  MKO10114549_B_Scarb1
  gRNA
uuccagccugacaagucgca

SEQ ID NO: 114550 - RNA, 20 nt, Artificial Sequence
  MKO10114550_B_Scarb2
  gRNA
guuuagggagcuccggaaca

SEQ ID NO: 114551 - RNA, 20 nt, Artificial Sequence
  MKO10114551_B_Scarb2
  gRNA
gggacucaccuguaggugua

SEQ ID NO: 114552 - RNA, 20 nt, Artificial Sequence
  MKO10114552_B_Scarb2
  gRNA
agguagagggggcuucuccc

SEQ ID NO: 114553 - RNA, 20 nt, Artificial Sequence
  MKO10114553_B_Scarf1
  gRNA
gcuccccaagccggcagcgg

SEQ ID NO: 114554 - RNA, 20 nt, Artificial Sequence
  MKO10114554_B_Scarf1
  gRNA
auccagguuuacaccgacag

SEQ ID NO: 114555 - RNA, 20 nt, Artificial Sequence
  MKO10114555_B_Scarf1
  gRNA
gcgugaagccgggccucugu

SEQ ID NO: 114556 - RNA, 20 nt, Artificial Sequence
  MKO10114556_B_Scarf2
  gRNA
ggcgaaugccgcugccgaca

SEQ ID NO: 114557 - RNA, 20 nt, Artificial Sequence
  MKO10114557_B_Scarf2
  gRNA
cgcugcccacccugccgcga

SEQ ID NO: 114558 - RNA, 20 nt, Artificial Sequence
  MKO10114558_B_Scarf2
  gRNA
uccuuuacagcggugugcga

SEQ ID NO: 114559 - RNA, 20 nt, Artificial Sequence
  MKO10114559_B_Sccpdh
  gRNA
aagcuuguccucaacugcgu

SEQ ID NO: 114560 - RNA, 20 nt, Artificial Sequence
  MKO10114560_B_Sccpdh
  gRNA
acaaguuguauugacaucug

SEQ ID NO: 114561 - RNA, 20 nt, Artificial Sequence
  MKO10114561_B_Sccpdh
  gRNA
agcuuccugacaauaaauac

SEQ ID NO: 114562 - RNA, 20 nt, Artificial Sequence
  MKO10114562_B_Scd1
  gRNA
gcgcugcucaccgaagaggc

SEQ ID NO: 114563 - RNA, 20 nt, Artificial Sequence
  MKO10114563_B_Scd1
  gRNA
cuacuacaugaccagcgcuc

SEQ ID NO: 114564 - RNA, 20 nt, Artificial Sequence
  MKO10114564_B_Scd1
  gRNA
ggcugugaugcccagagcgc

SEQ ID NO: 114565 - RNA, 20 nt, Artificial Sequence
  MKO10114565_B_Scd2
  gRNA
ucuauaugaccccaccuauc

SEQ ID NO: 114566 - RNA, 20 nt, Artificial Sequence
  MKO10114566_B_Scd2
  gRNA
gugcugcucaccgaagagac

SEQ ID NO: 114567 - RNA, 20 nt, Artificial Sequence
  MKO10114567_B_Scd2
  gRNA
cagccggggcucaucgccug

SEQ ID NO: 114568 - RNA, 20 nt, Artificial Sequence
  MKO10114568_B_Scd3
  gRNA
ggcgugccuuguacguucug

SEQ ID NO: 114569 - RNA, 20 nt, Artificial Sequence
  MKO10114569_B_Scd3
  gRNA
accaucacagcgccucccuc

SEQ ID NO: 114570 - RNA, 20 nt, Artificial Sequence
  MKO10114570_B_Scd3
  gRNA
caaugaugaggaagauccgc

SEQ ID NO: 114571 - RNA, 20 nt, Artificial Sequence
  MKO10114571_B_Scd4
  gRNA
uuagaagcacagcauaccgc

SEQ ID NO: 114572 - RNA, 20 nt, Artificial Sequence
  MKO10114572_B_Scd4
  gRNA
gacaggaguauucuacaacg

SEQ ID NO: 114573 - RNA, 20 nt, Artificial Sequence
  MKO10114573_B_Scd4
  gRNA
ccggauaucuucugccugga

SEQ ID NO: 114574 - RNA, 20 nt, Artificial Sequence
  MKO10114574_B_Scel
  gRNA
ugacagaucugaagagcgcc

SEQ ID NO: 114575 - RNA, 20 nt, Artificial Sequence
  MKO10114575_B_Scel
  gRNA
gcauguccucagaucuguac

SEQ ID NO: 114576 - RNA, 20 nt, Artificial Sequence
  MKO10114576_B_Scel
  gRNA
uucaggacgugaacaaaaga

SEQ ID NO: 114577 - RNA, 20 nt, Artificial Sequence
  MKO10114577_B_Scfd1
  gRNA
ugcgauuucaagaaguaaac

SEQ ID NO: 114578 - RNA, 20 nt, Artificial Sequence
  MKO10114578_B_Scfd1
  gRNA
ccucauguuaaaaacaguac

SEQ ID NO: 114579 - RNA, 20 nt, Artificial Sequence
  MKO10114579_B_Scfd1
  gRNA
aaauauugacagacugugcc

SEQ ID NO: 114580 - RNA, 20 nt, Artificial Sequence
  MKO10114580_B_Scfd2
  gRNA
acgagaggaguguuucgccg

SEQ ID NO: 114581 - RNA, 20 nt, Artificial Sequence
  MKO10114581_B_Scfd2
  gRNA
ccugcccaucaagaugagua

SEQ ID NO: 114582 - RNA, 20 nt, Artificial Sequence
  MKO10114582_B_Scfd2
  gRNA
ggaaguucggagacaucuag

SEQ ID NO: 114583 - RNA, 20 nt, Artificial Sequence
  MKO10114583_B_Scg2
  gRNA
gccucuaccauaccacgacc

SEQ ID NO: 114584 - RNA, 20 nt, Artificial Sequence
  MKO10114584_B_Scg2
  gRNA
agaagaagagcagcucgagc

SEQ ID NO: 114585 - RNA, 20 nt, Artificial Sequence
  MKO10114585_B_Scg2
  gRNA
ccuugguagggauuguaguc

SEQ ID NO: 114586 - RNA, 20 nt, Artificial Sequence
  MKO10114586_B_Scg3
  gRNA
aucaaacggggggcuucuua

SEQ ID NO: 114587 - RNA, 20 nt, Artificial Sequence
  MKO10114587_B_Scg3
  gRNA
cacuuaauucucuauuaugc

SEQ ID NO: 114588 - RNA, 20 nt, Artificial Sequence
  MKO10114588_B_Scg3
  gRNA
auuaaaaaggcauucccuuc

SEQ ID NO: 114589 - RNA, 20 nt, Artificial Sequence
  MKO10114589_B_Scg5
  gRNA
agucaacucugccacuaugu

SEQ ID NO: 114590 - RNA, 20 nt, Artificial Sequence
  MKO10114590_B_Scg5
  gRNA
caaccucuuuccuuguagau

SEQ ID NO: 114591 - RNA, 20 nt, Artificial Sequence
  MKO10114591_B_Scg5
  gRNA
agucauguucuggaucaaaa

SEQ ID NO: 114592 - RNA, 20 nt, Artificial Sequence
  MKO10114592_B_Scgb1a1
  gRNA
cuuaaaucuugcuuacacag

SEQ ID NO: 114593 - RNA, 20 nt, Artificial Sequence
  MKO10114593_B_Scgb1a1
  gRNA
cuguccaucugcugcagcuc

SEQ ID NO: 114594 - RNA, 20 nt, Artificial Sequence
  MKO10114594_B_Scgb1a1
  gRNA
auacccucccacaagagacc

SEQ ID NO: 114595 - RNA, 20 nt, Artificial Sequence
  MKO10114595_B_Scgb1b19
  gRNA
accauuaucaugaagcuugc

SEQ ID NO: 114596 - RNA, 20 nt, Artificial Sequence
  MKO10114596_B_Scgb1b19
  gRNA
aguuguagccaucaacauag

SEQ ID NO: 114597 - RNA, 20 nt, Artificial Sequence
  MKO10114597_B_Scgb1b19
  gRNA
gcccugcuccuccugacuuc

SEQ ID NO: 114598 - RNA, 20 nt, Artificial Sequence
  MKO10114598_B_Scgb1b20
  gRNA
uaucuugucuuccucuguca

SEQ ID NO: 114599 - RNA, 20 nt, Artificial Sequence
  MKO10114599_B_Scgb1b20
  gRNA
cauuugcccagcuauaaaag

SEQ ID NO: 114600 - RNA, 20 nt, Artificial Sequence
  MKO10114600_B_Scgb1b20
  gRNA
accauuaucaugaagcuugc

SEQ ID NO: 114601 - RNA, 20 nt, Artificial Sequence
  MKO10114601_B_Scgb1b24
  gRNA
gcugcccugcuccugcauuc

SEQ ID NO: 114602 - RNA, 20 nt, Artificial Sequence
  MKO10114602_B_Scgb1b24
  gRNA
caaagacgauccugaaauac

SEQ ID NO: 114603 - RNA, 20 nt, Artificial Sequence
  MKO10114603_B_Scgb1b24
  gRNA
cauuugcccagcuauaaaac

SEQ ID NO: 114604 - RNA, 20 nt, Artificial Sequence
  MKO10114604_B_Scgb1b27
  gRNA
gagagcaccagugagcuuca

SEQ ID NO: 114605 - RNA, 20 nt, Artificial Sequence
  MKO10114605_B_Scgb1b27
  gRNA
ugccugugccuugucuuccu

SEQ ID NO: 114606 - RNA, 20 nt, Artificial Sequence
  MKO10114606_B_Scgb1b27
  gRNA
gauguacccaucaacauguc

SEQ ID NO: 114607 - RNA, 20 nt, Artificial Sequence
  MKO10114607_B_Scgb1b29
  gRNA
cauuugcccagcuauaaaag

SEQ ID NO: 114608 - RNA, 20 nt, Artificial Sequence
  MKO10114608_B_Scgb1b29
  gRNA
aguuguagccaucaacauag

SEQ ID NO: 114609 - RNA, 20 nt, Artificial Sequence
  MKO10114609_B_Scgb1b29
  gRNA
gcccugcuccuccugacuuc

SEQ ID NO: 114610 - RNA, 20 nt, Artificial Sequence
  MKO10114610_B_Scgb1b2
  gRNA
aaaauuaccaugaagcucac

SEQ ID NO: 114611 - RNA, 20 nt, Artificial Sequence
  MKO10114611_B_Scgb1b2
  gRNA
agauguagccaucaacauaa

SEQ ID NO: 114612 - RNA, 20 nt, Artificial Sequence
  MKO10114612_B_Scgb1b2
  gRNA
acauaauuaacauacucuuc

SEQ ID NO: 114613 - RNA, 20 nt, Artificial Sequence
  MKO10114613_B_Scgb1b30
  gRNA
ucuuugcagaauaaaguaac

SEQ ID NO: 114614 - RNA, 20 nt, Artificial Sequence
  MKO10114614_B_Scgb1b30
  gRNA
accauuaccaugaagcuaac

SEQ ID NO: 114615 - RNA, 20 nt, Artificial Sequence
  MKO10114615_B_Scgb1b30
  gRNA
gagagcaccaguuagcuuca

SEQ ID NO: 114616 - RNA, 20 nt, Artificial Sequence
  MKO10114616_B_Scgb1b3
  gRNA
guacucaacauacucuucug

SEQ ID NO: 114617 - RNA, 20 nt, Artificial Sequence
  MKO10114617_B_Scgb1b3
  gRNA
aguuguagccaucaacauag

SEQ ID NO: 114618 - RNA, 20 nt, Artificial Sequence
  MKO10114618_B_Scgb1b3
  gRNA
acccaccucccccugaaguc

SEQ ID NO: 114619 - RNA, 20 nt, Artificial Sequence
  MKO10114619_B_Scgb1b7
  gRNA
cauuugcccagcuauaaaag

SEQ ID NO: 114620 - RNA, 20 nt, Artificial Sequence
  MKO10114620_B_Scgb1b7
  gRNA
aguuguagccaucaacauag

SEQ ID NO: 114621 - RNA, 20 nt, Artificial Sequence
  MKO10114621_B_Scgb1b7
  gRNA
gcccugcuccuccugacuuc

SEQ ID NO: 114622 - RNA, 20 nt, Artificial Sequence
  MKO10114622_B_Scgb1c1
  gRNA
acuuaccacagacgcagagc

SEQ ID NO: 114623 - RNA, 20 nt, Artificial Sequence
  MKO10114623_B_Scgb1c1
  gRNA
gcaagugcuagaugcucaag

SEQ ID NO: 114624 - RNA, 20 nt, Artificial Sequence
  MKO10114624_B_Scgb1c1
  gRNA
accaguugcuccuuaugcac

SEQ ID NO: 114625 - RNA, 20 nt, Artificial Sequence
  MKO10114625_B_Scgb2b12
  gRNA
cagaagaaguauccccuuca

SEQ ID NO: 114626 - RNA, 20 nt, Artificial Sequence
  MKO10114626_B_Scgb2b12
  gRNA
gaaggggauacuucuucugc

SEQ ID NO: 114627 - RNA, 20 nt, Artificial Sequence
  MKO10114627_B_Scgb2b12
  gRNA
uggucgccagcccagaaugc

SEQ ID NO: 114628 - RNA, 20 nt, Artificial Sequence
  MKO10114628_B_Scgb2b15
  gRNA
cugcaguagcauugaauguc

SEQ ID NO: 114629 - RNA, 20 nt, Artificial Sequence
  MKO10114629_B_Scgb2b15
  gRNA
ccauauuagacuauauuucc

SEQ ID NO: 114630 - RNA, 20 nt, Artificial Sequence
  MKO10114630_B_Scgb2b15
  gRNA
caucuacucuccuaauagcc

SEQ ID NO: 114631 - RNA, 20 nt, Artificial Sequence
  MKO10114631_B_Scgb2b17
  gRNA
cugcaguagcauugaauguc

SEQ ID NO: 114632 - RNA, 20 nt, Artificial Sequence
  MKO10114632_B_Scgb2b17
  gRNA
ccauauuagacuauauuucc

SEQ ID NO: 114633 - RNA, 20 nt, Artificial Sequence
  MKO10114633_B_Scgb2b17
  gRNA
caucuacucuccuaauagcc

SEQ ID NO: 114634 - RNA, 20 nt, Artificial Sequence
  MKO10114634_B_Scgb2b19
  gRNA
cagaagaaguguccccuuca

SEQ ID NO: 114635 - RNA, 20 nt, Artificial Sequence
  MKO10114635_B_Scgb2b19
  gRNA
uggucgccagcccagaaugc

SEQ ID NO: 114636 - RNA, 20 nt, Artificial Sequence
  MKO10114636_B_Scgb2b19
  gRNA
ucuaagagacugaaugauga

SEQ ID NO: 114637 - RNA, 20 nt, Artificial Sequence
  MKO10114637_B_Scgb2b20
  gRNA
cagaagaaguguccccuuca

SEQ ID NO: 114638 - RNA, 20 nt, Artificial Sequence
  MKO10114638_B_Scgb2b20
  gRNA
ccugaaugccugucauacua

SEQ ID NO: 114639 - RNA, 20 nt, Artificial Sequence
  MKO10114639_B_Scgb2b20
  gRNA
caucuauucuccuaauagcu

SEQ ID NO: 114640 - RNA, 20 nt, Artificial Sequence
  MKO10114640_B_Scgb2b24
  gRNA
gaggacauuaccaaaauuug

SEQ ID NO: 114641 - RNA, 20 nt, Artificial Sequence
  MKO10114641_B_Scgb2b24
  gRNA
cagcucuccaaucaucagca

SEQ ID NO: 114642 - RNA, 20 nt, Artificial Sequence
  MKO10114642_B_Scgb2b24
  gRNA
cuugcugaugauuggagagc

SEQ ID NO: 114643 - RNA, 20 nt, Artificial Sequence
  MKO10114643_B_Scgb2b26
  gRNA
acuucuaauggauauuugac

SEQ ID NO: 114644 - RNA, 20 nt, Artificial Sequence
  MKO10114644_B_Scgb2b26
  gRNA
cuugcuggugauuggagagc

SEQ ID NO: 114645 - RNA, 20 nt, Artificial Sequence
  MKO10114645_B_Scgb2b26
  gRNA
cagcucuccaaucaccagca

SEQ ID NO: 114646 - RNA, 20 nt, Artificial Sequence
  MKO10114646_B_Scgb2b27
  gRNA
cgaagauucuguaaacaaaa

SEQ ID NO: 114647 - RNA, 20 nt, Artificial Sequence
  MKO10114647_B_Scgb2b27
  gRNA
gaaggggacacuucuucugc

SEQ ID NO: 114648 - RNA, 20 nt, Artificial Sequence
  MKO10114648_B_Scgb2b27
  gRNA
cagcucuccagucaccagca

SEQ ID NO: 114649 - RNA, 20 nt, Artificial Sequence
  MKO10114649_B_Scgb2b2
  gRNA
uacucuucagcucagaaugc

SEQ ID NO: 114650 - RNA, 20 nt, Artificial Sequence
  MKO10114650_B_Scgb2b2
  gRNA
cagcucuccagucaccagca

SEQ ID NO: 114651 - RNA, 20 nt, Artificial Sequence
  MKO10114651_B_Scgb2b2
  gRNA
gaaggggacacuucuucugc

SEQ ID NO: 114652 - RNA, 20 nt, Artificial Sequence
  MKO10114652_B_Scgb2b3
  gRNA
uaagugugauuaccaagaaa

SEQ ID NO: 114653 - RNA, 20 nt, Artificial Sequence
  MKO10114653_B_Scgb2b3
  gRNA
uaacuucuacauccauuucu

SEQ ID NO: 114654 - RNA, 20 nt, Artificial Sequence
  MKO10114654_B_Scgb2b3
  gRNA
uuccuggugauuggagagcu

SEQ ID NO: 114655 - RNA, 20 nt, Artificial Sequence
  MKO10114655_B_Scgb2b7
  gRNA
cagaagaaguguccccuuca

SEQ ID NO: 114656 - RNA, 20 nt, Artificial Sequence
  MKO10114656_B_Scgb2b7
  gRNA
ccugaaugccugucauacua

SEQ ID NO: 114657 - RNA, 20 nt, Artificial Sequence
  MKO10114657_B_Scgb2b7
  gRNA
caucuauucuccuaauagcu

SEQ ID NO: 114658 - RNA, 20 nt, Artificial Sequence
  MKO10114658_B_Scgb3a1
  gRNA
uaauguccccacaaucagca

SEQ ID NO: 114659 - RNA, 20 nt, Artificial Sequence
  MKO10114659_B_Scgb3a1
  gRNA
caggggguccugacaauguu

SEQ ID NO: 114660 - RNA, 20 nt, Artificial Sequence
  MKO10114660_B_Scgb3a1
  gRNA
caccuuucuagugcucugug

SEQ ID NO: 114661 - RNA, 20 nt, Artificial Sequence
  MKO10114661_B_Scgb3a2
  gRNA
auagauaccagcuucauagc

SEQ ID NO: 114662 - RNA, 20 nt, Artificial Sequence
  MKO10114662_B_Scgb3a2
  gRNA
aaagaaggauuugcucacuc

SEQ ID NO: 114663 - RNA, 20 nt, Artificial Sequence
  MKO10114663_B_Scgb3a2
  gRNA
aucuuucugcuggugaccau

SEQ ID NO: 114664 - RNA, 20 nt, Artificial Sequence
  MKO10114664_B_Scgn
  gRNA
gaguuuccaggcgaaagaac

SEQ ID NO: 114665 - RNA, 20 nt, Artificial Sequence
  MKO10114665_B_Scgn
  gRNA
aucuucagauaagaacauac

SEQ ID NO: 114666 - RNA, 20 nt, Artificial Sequence
  MKO10114666_B_Scgn
  gRNA
ugccagcaaaugaucaaaga

SEQ ID NO: 114667 - RNA, 20 nt, Artificial Sequence
  MKO10114667_B_Schip1
  gRNA
gcugcuuacaagaucagcga

SEQ ID NO: 114668 - RNA, 20 nt, Artificial Sequence
  MKO10114668_B_Schip1
  gRNA
cucggaagcuucuuugacga

SEQ ID NO: 114669 - RNA, 20 nt, Artificial Sequence
  MKO10114669_B_Schip1
  gRNA
cgaugcagaugacaguaaga

SEQ ID NO: 114670 - RNA, 20 nt, Artificial Sequence
  MKO10114670_B_Scimp
  gRNA
cuguacuuaccuaggucucc

SEQ ID NO: 114671 - RNA, 20 nt, Artificial Sequence
  MKO10114671_B_Scimp
  gRNA
cucccacagcaaugaguugg

SEQ ID NO: 114672 - RNA, 20 nt, Artificial Sequence
  MKO10114672_B_Scimp
  gRNA
gccaccugcagacacaguac

SEQ ID NO: 114673 - RNA, 20 nt, Artificial Sequence
  MKO10114673_B_Scin
  gRNA
gaaaagacuucugcacguga

SEQ ID NO: 114674 - RNA, 20 nt, Artificial Sequence
  MKO10114674_B_Scin
  gRNA
cagacgcucauauuuguugc

SEQ ID NO: 114675 - RNA, 20 nt, Artificial Sequence
  MKO10114675_B_Scin
  gRNA
uuggcauccgggacaaugag

SEQ ID NO: 114676 - RNA, 20 nt, Artificial Sequence
  MKO10114676_B_Sclt1
  gRNA
uuucagagacccaacuaugc

SEQ ID NO: 114677 - RNA, 20 nt, Artificial Sequence
  MKO10114677_B_Sclt1
  gRNA
uagacucaauaaaugagcaa

SEQ ID NO: 114678 - RNA, 20 nt, Artificial Sequence
  MKO10114678_B_Sclt1
  gRNA
uuauagaacagcauguccaa

SEQ ID NO: 114679 - RNA, 20 nt, Artificial Sequence
  MKO10114679_B_Scly
  gRNA
gaugauagguggaaagcccc

SEQ ID NO: 114680 - RNA, 20 nt, Artificial Sequence
  MKO10114680_B_Scly
  gRNA
ucuagagcccgaagucaucc

SEQ ID NO: 114681 - RNA, 20 nt, Artificial Sequence
  MKO10114681_B_Scly
  gRNA
cucuuccaggaaggucuaua

SEQ ID NO: 114682 - RNA, 20 nt, Artificial Sequence
  MKO10114682_B_Scmh1
  gRNA
gccuguccauugcuucaagc

SEQ ID NO: 114683 - RNA, 20 nt, Artificial Sequence
  MKO10114683_B_Scmh1
  gRNA
uucggcugaaugccuccucu

SEQ ID NO: 114684 - RNA, 20 nt, Artificial Sequence
  MKO10114684_B_Scmh1
  gRNA
gaccuucccugcuccaucau

SEQ ID NO: 114685 - RNA, 20 nt, Artificial Sequence
  MKO10114685_B_Scml2
  gRNA
uaguacacguaguaagaaca

SEQ ID NO: 114686 - RNA, 20 nt, Artificial Sequence
  MKO10114686_B_Scml2
  gRNA
ggagauguauuacagccacc

SEQ ID NO: 114687 - RNA, 20 nt, Artificial Sequence
  MKO10114687_B_Scml2
  gRNA
ggaguggagcauuugauuau

SEQ ID NO: 114688 - RNA, 20 nt, Artificial Sequence
  MKO10114688_B_Scml4
  gRNA
aggguuggugcgggaaccac

SEQ ID NO: 114689 - RNA, 20 nt, Artificial Sequence
  MKO10114689_B_Scml4
  gRNA
cgaugcucccgggaaaaggc

SEQ ID NO: 114690 - RNA, 20 nt, Artificial Sequence
  MKO10114690_B_Scml4
  gRNA
aggugacgacgaaccuccag

SEQ ID NO: 114691 - RNA, 20 nt, Artificial Sequence
  MKO10114691_B_Scn10a
  gRNA
cacuguuguuuacaccuucg

SEQ ID NO: 114692 - RNA, 20 nt, Artificial Sequence
  MKO10114692_B_Scn10a
  gRNA
guuacucacucgaguuucuc

SEQ ID NO: 114693 - RNA, 20 nt, Artificial Sequence
  MKO10114693_B_Scn10a
  gRNA
guucuagacauucauagugu

SEQ ID NO: 114694 - RNA, 20 nt, Artificial Sequence
  MKO10114694_B_Scn11a
  gRNA
cacucgggaauguuacugcu

SEQ ID NO: 114695 - RNA, 20 nt, Artificial Sequence
  MKO10114695_B_Scn11a
  gRNA
gaucaucaacuguauguuca

SEQ ID NO: 114696 - RNA, 20 nt, Artificial Sequence
  MKO10114696_B_Scn11a
  gRNA
uuuccuaccuccgagauccu

SEQ ID NO: 114697 - RNA, 20 nt, Artificial Sequence
  MKO10114697_B_Scn1a
  gRNA
guuucuagguacaccuucac

SEQ ID NO: 114698 - RNA, 20 nt, Artificial Sequence
  MKO10114698_B_Scn1a
  gRNA
aaaacuauuucagucauucc

SEQ ID NO: 114699 - RNA, 20 nt, Artificial Sequence
  MKO10114699_B_Scn1a
  gRNA
ugaaggguguuaaaauguac

SEQ ID NO: 114700 - RNA, 20 nt, Artificial Sequence
  MKO10114700_B_Scn1b
  gRNA
gcaccucauucucauagcgu

SEQ ID NO: 114701 - RNA, 20 nt, Artificial Sequence
  MKO10114701_B_Scn1b
  gRNA
caugauguacgugcucauug

SEQ ID NO: 114702 - RNA, 20 nt, Artificial Sequence
  MKO10114702_B_Scn1b
  gRNA
accagcgcuauucagccacc

SEQ ID NO: 114703 - RNA, 20 nt, Artificial Sequence
  MKO10114703_B_Scn2a1
  gRNA
ugugaaauccagccaguucc

SEQ ID NO: 114704 - RNA, 20 nt, Artificial Sequence
  MKO10114704_B_Scn2a1
  gRNA
ugaagggaguuaaaauguac

SEQ ID NO: 114705 - RNA, 20 nt, Artificial Sequence
  MKO10114705_B_Scn2a1
  gRNA
aaaauuagcuauuaagauuu

SEQ ID NO: 114706 - RNA, 20 nt, Artificial Sequence
  MKO10114706_B_Scn2b
  gRNA
uaaugaucuucauucggaac

SEQ ID NO: 114707 - RNA, 20 nt, Artificial Sequence
  MKO10114707_B_Scn2b
  gRNA
cuccacgguggcggucaucg

SEQ ID NO: 114708 - RNA, 20 nt, Artificial Sequence
  MKO10114708_B_Scn2b
  gRNA
gugacuuccaugcuccgccc

SEQ ID NO: 114709 - RNA, 20 nt, Artificial Sequence
  MKO10114709_B_Scn3a
  gRNA
ucacauuucuucgugaccca

SEQ ID NO: 114710 - RNA, 20 nt, Artificial Sequence
  MKO10114710_B_Scn3a
  gRNA
ucuacauucuucguccaguc

SEQ ID NO: 114711 - RNA, 20 nt, Artificial Sequence
  MKO10114711_B_Scn3a
  gRNA
uaguggaguuaaaauauaca

SEQ ID NO: 114712 - RNA, 20 nt, Artificial Sequence
  MKO10114712_B_Scn3b
  gRNA
caucaugauuuccgagacca

SEQ ID NO: 114713 - RNA, 20 nt, Artificial Sequence
  MKO10114713_B_Scn3b
  gRNA
uacccucuucagugacucgc

SEQ ID NO: 114714 - RNA, 20 nt, Artificial Sequence
  MKO10114714_B_Scn3b
  gRNA
gggagaagacuucaccuccg

SEQ ID NO: 114715 - RNA, 20 nt, Artificial Sequence
  MKO10114715_B_Scn4a
  gRNA
gcgggcccugaaaaccauca

SEQ ID NO: 114716 - RNA, 20 nt, Artificial Sequence
  MKO10114716_B_Scn4a
  gRNA
ucacauuccuccgagacccc

SEQ ID NO: 114717 - RNA, 20 nt, Artificial Sequence
  MKO10114717_B_Scn4a
  gRNA
gcaccuugauagccacccgc

SEQ ID NO: 114718 - RNA, 20 nt, Artificial Sequence
  MKO10114718_B_Scn4b
  gRNA
cacggugacucucaucaucc

SEQ ID NO: 114719 - RNA, 20 nt, Artificial Sequence
  MKO10114719_B_Scn4b
  gRNA
ugaugaucgaaucacccuag

SEQ ID NO: 114720 - RNA, 20 nt, Artificial Sequence
  MKO10114720_B_Scn4b
  gRNA
aacacagagaacggguugcc

SEQ ID NO: 114721 - RNA, 20 nt, Artificial Sequence
  MKO10114721_B_Scn5a
  gRNA
gugacucccgggugaaccua

SEQ ID NO: 114722 - RNA, 20 nt, Artificial Sequence
  MKO10114722_B_Scn5a
  gRNA
uucacagccgcucugcgcac

SEQ ID NO: 114723 - RNA, 20 nt, Artificial Sequence
  MKO10114723_B_Scn5a
  gRNA
ggaggaaggugaacgcaugc

SEQ ID NO: 114724 - RNA, 20 nt, Artificial Sequence
  MKO10114724_B_Scn7a
  gRNA
cccugcaggaauacuuugcu

SEQ ID NO: 114725 - RNA, 20 nt, Artificial Sequence
  MKO10114725_B_Scn7a
  gRNA
gccaguuccaaagaucccca

SEQ ID NO: 114726 - RNA, 20 nt, Artificial Sequence
  MKO10114726_B_Scn7a
  gRNA
cauuucuuaccgugguucaa

SEQ ID NO: 114727 - RNA, 20 nt, Artificial Sequence
  MKO10114727_B_Scn8a
  gRNA
gccgucuaugcagaaaccuc

SEQ ID NO: 114728 - RNA, 20 nt, Artificial Sequence
  MKO10114728_B_Scn8a
  gRNA
uaauagcuauucuucuuauc

SEQ ID NO: 114729 - RNA, 20 nt, Artificial Sequence
  MKO10114729_B_Scn8a
  gRNA
uguuacuuacuccacauucu

SEQ ID NO: 114730 - RNA, 20 nt, Artificial Sequence
  MKO10114730_B_Scn9a
  gRNA
caugauuagcaugcugaaua

SEQ ID NO: 114731 - RNA, 20 nt, Artificial Sequence
  MKO10114731_B_Scn9a
  gRNA
ccaugagcaacccuccagau

SEQ ID NO: 114732 - RNA, 20 nt, Artificial Sequence
  MKO10114732_B_Scn9a
  gRNA
uuaauagauauucuucugag

SEQ ID NO: 114733 - RNA, 20 nt, Artificial Sequence
  MKO10114733_B_Scnm1
  gRNA
agcaucagugccucguccuc

SEQ ID NO: 114734 - RNA, 20 nt, Artificial Sequence
  MKO10114734_B_Scnm1
  gRNA
uucaauucguucugcugucu

SEQ ID NO: 114735 - RNA, 20 nt, Artificial Sequence
  MKO10114735_B_Scnm1
  gRNA
gaagacagaaagcaaaacug

SEQ ID NO: 114736 - RNA, 20 nt, Artificial Sequence
  MKO10114736_B_Scnn1a
  gRNA
ccaccaucauccauaaaagc

SEQ ID NO: 114737 - RNA, 20 nt, Artificial Sequence
  MKO10114737_B_Scnn1a
  gRNA
uucuaccagacauacucauc

SEQ ID NO: 114738 - RNA, 20 nt, Artificial Sequence
  MKO10114738_B_Scnn1a
  gRNA
cagggugauggugcacgguc

SEQ ID NO: 114739 - RNA, 20 nt, Artificial Sequence
  MKO10114739_B_Scnn1b
  gRNA
aacugagugguacauccugc

SEQ ID NO: 114740 - RNA, 20 nt, Artificial Sequence
  MKO10114740_B_Scnn1b
  gRNA
gcaggaacugagacgucuau

SEQ ID NO: 114741 - RNA, 20 nt, Artificial Sequence
  MKO10114741_B_Scnn1b
  gRNA
auguagcaguugccauaauc

SEQ ID NO: 114742 - RNA, 20 nt, Artificial Sequence
  MKO10114742_B_Scnn1g
  gRNA
uccccacgucuucgaugaaa

SEQ ID NO: 114743 - RNA, 20 nt, Artificial Sequence
  MKO10114743_B_Scnn1g
  gRNA
cuauucugccgaagaacugc

SEQ ID NO: 114744 - RNA, 20 nt, Artificial Sequence
  MKO10114744_B_Scnn1g
  gRNA
augggauguccugugaugcc

SEQ ID NO: 114745 - RNA, 20 nt, Artificial Sequence
  MKO10114745_B_Sco1
  gRNA
caaaaccgacaaggacuacc

SEQ ID NO: 114746 - RNA, 20 nt, Artificial Sequence
  MKO10114746_B_Sco1
  gRNA
gccagucaaaccaaccaauu

SEQ ID NO: 114747 - RNA, 20 nt, Artificial Sequence
  MKO10114747_B_Sco1
  gRNA
agcauugggaagccuuuacu

SEQ ID NO: 114748 - RNA, 20 nt, Artificial Sequence
  MKO10114748_B_Sco2
  gRNA
agaucguagagaguauacgu

SEQ ID NO: 114749 - RNA, 20 nt, Artificial Sequence
  MKO10114749_B_Sco2
  gRNA
ugcauagaaauucccgacac

SEQ ID NO: 114750 - RNA, 20 nt, Artificial Sequence
  MKO10114750_B_Sco2
  gRNA
ccugcugcgaccauaguaau

SEQ ID NO: 114751 - RNA, 20 nt, Artificial Sequence
  MKO10114751_B_Scoc
  gRNA
ucuaaccuucaagugugugu

SEQ ID NO: 114752 - RNA, 20 nt, Artificial Sequence
  MKO10114752_B_Scoc
  gRNA
caagaugaugaaugcugaca

SEQ ID NO: 114753 - RNA, 20 nt, Artificial Sequence
  MKO10114753_B_Scoc
  gRNA
ugcaagaguagaugcaguua

SEQ ID NO: 114754 - RNA, 20 nt, Artificial Sequence
  MKO10114754_B_Scp2d1
  gRNA
cgaucccagguacauguccc

SEQ ID NO: 114755 - RNA, 20 nt, Artificial Sequence
  MKO10114755_B_Scp2d1
  gRNA
uggaccauugaccucaagaa

SEQ ID NO: 114756 - RNA, 20 nt, Artificial Sequence
  MKO10114756_B_Scp2d1
  gRNA
cucccacuucuuugaugugu

SEQ ID NO: 114757 - RNA, 20 nt, Artificial Sequence
  MKO10114757_B_Scp2
  gRNA
auagauagcccucugcccac

SEQ ID NO: 114758 - RNA, 20 nt, Artificial Sequence
  MKO10114758_B_Scp2
  gRNA
guguucuaguucaugaagcc

SEQ ID NO: 114759 - RNA, 20 nt, Artificial Sequence
  MKO10114759_B_Scp2
  gRNA
cucaagagacuauccugaua

SEQ ID NO: 114760 - RNA, 20 nt, Artificial Sequence
  MKO10114760_B_Scpep1
  gRNA
cacaacagaugccuacgcaa

SEQ ID NO: 114761 - RNA, 20 nt, Artificial Sequence
  MKO10114761_B_Scpep1
  gRNA
uuucaggaucugccaucgac

SEQ ID NO: 114762 - RNA, 20 nt, Artificial Sequence
  MKO10114762_B_Scpep1
  gRNA
caucaguguagaacuuuaca

SEQ ID NO: 114763 - RNA, 20 nt, Artificial Sequence
  MKO10114763_B_Scrg1
  gRNA
auccccugcaacaaccacug

SEQ ID NO: 114764 - RNA, 20 nt, Artificial Sequence
  MKO10114764_B_Scrg1
  gRNA
cuuuagcaacuuucuguagc

SEQ ID NO: 114765 - RNA, 20 nt, Artificial Sequence
  MKO10114765_B_Scrg1
  gRNA
aaguaccacagauuucauca

SEQ ID NO: 114766 - RNA, 20 nt, Artificial Sequence
  MKO10114766_B_Scrib
  gRNA
cuaacacuuaccuagacagg

SEQ ID NO: 114767 - RNA, 20 nt, Artificial Sequence
  MKO10114767_B_Scrib
  gRNA
ucagugacaacgagauccag

SEQ ID NO: 114768 - RNA, 20 nt, Artificial Sequence
  MKO10114768_B_Scrib
  gRNA
gaguuccagggucaccagau

SEQ ID NO: 114769 - RNA, 20 nt, Artificial Sequence
  MKO10114769_B_Scrn1
  gRNA
ccguguauccacuacuucac

SEQ ID NO: 114770 - RNA, 20 nt, Artificial Sequence
  MKO10114770_B_Scrn1
  gRNA
uucaggcuuggcuuagaacg

SEQ ID NO: 114771 - RNA, 20 nt, Artificial Sequence
  MKO10114771_B_Scrn1
  gRNA
ucucaaucgaccaagucccc

SEQ ID NO: 114772 - RNA, 20 nt, Artificial Sequence
  MKO10114772_B_Scrn2
  gRNA
ccuccaguguaccuauaucg

SEQ ID NO: 114773 - RNA, 20 nt, Artificial Sequence
  MKO10114773_B_Scrn2
  gRNA
uuggcagccuccaugcgcac

SEQ ID NO: 114774 - RNA, 20 nt, Artificial Sequence
  MKO10114774_B_Scrn2
  gRNA
aggcugccaaggcccgcuuc

SEQ ID NO: 114775 - RNA, 20 nt, Artificial Sequence
  MKO10114775_B_Scrn3
  gRNA
ccaagguggaaacugcgcag

SEQ ID NO: 114776 - RNA, 20 nt, Artificial Sequence
  MKO10114776_B_Scrn3
  gRNA
aggacaacagcauauguuuc

SEQ ID NO: 114777 - RNA, 20 nt, Artificial Sequence
  MKO10114777_B_Scrn3
  gRNA
uuguccuuagucgcccagcu

SEQ ID NO: 114778 - RNA, 20 nt, Artificial Sequence
  MKO10114778_B_Scrt1
  gRNA
ggagugcgacugcaagauaa

SEQ ID NO: 114779 - RNA, 20 nt, Artificial Sequence
  MKO10114779_B_Scrt1
  gRNA
gcuagcgccgcccuugaagc

SEQ ID NO: 114780 - RNA, 20 nt, Artificial Sequence
  MKO10114780_B_Scrt1
  gRNA
gcgcgugccgccccgacuag

SEQ ID NO: 114781 - RNA, 20 nt, Artificial Sequence
  MKO10114781_B_Scrt2
  gRNA
gcgggugccaggcagcacgu

SEQ ID NO: 114782 - RNA, 20 nt, Artificial Sequence
  MKO10114782_B_Scrt2
  gRNA
gcgcgaagcucuugucgcac

SEQ ID NO: 114783 - RNA, 20 nt, Artificial Sequence
  MKO10114783_B_Scrt2
  gRNA
ucgggcacuugcgcgccagc

SEQ ID NO: 114784 - RNA, 20 nt, Artificial Sequence
  MKO10114784_B_Scur
  gRNA
gccauucauguugaccccac

SEQ ID NO: 114785 - RNA, 20 nt, Artificial Sequence
  MKO10114785_B_Scur
  gRNA
gccuguggggucaacaugaa

SEQ ID NO: 114786 - RNA, 20 nt, Artificial Sequence
  MKO10114786_B_Scur
  gRNA
cuccgaagagaagaaggcgc

SEQ ID NO: 114787 - RNA, 20 nt, Artificial Sequence
  MKO10114787_B_Scu
  gRNA
gaacgaucaacagcagaccu

SEQ ID NO: 114788 - RNA, 20 nt, Artificial Sequence
  MKO10114788_B_Scu
  gRNA
ggaaaacucaccaguccugu

SEQ ID NO: 114789 - RNA, 20 nt, Artificial Sequence
  MKO10114789_B_Scu
  gRNA
gccuggcacuguccugcaag

SEQ ID NO: 114790 - RNA, 20 nt, Artificial Sequence
  MKO10114790_B_Scube1
  gRNA
accuacgugugcaguccuuc

SEQ ID NO: 114791 - RNA, 20 nt, Artificial Sequence
  MKO10114791_B_Scube1
  gRNA
ccccacaggagccguggacg

SEQ ID NO: 114792 - RNA, 20 nt, Artificial Sequence
  MKO10114792_B_Scube1
  gRNA
aucugccgggagacgcccaa

SEQ ID NO: 114793 - RNA, 20 nt, Artificial Sequence
  MKO10114793_B_Scube2
  gRNA
acuugcauucaccgcucaga

SEQ ID NO: 114794 - RNA, 20 nt, Artificial Sequence
  MKO10114794_B_Scube2
  gRNA
gcagcguugccugugaaugc

SEQ ID NO: 114795 - RNA, 20 nt, Artificial Sequence
  MKO10114795_B_Scube2
  gRNA
uacaagugcucuugcaagcc

SEQ ID NO: 114796 - RNA, 20 nt, Artificial Sequence
  MKO10114796_B_Scube3
  gRNA
auugccugugaaugccgccc

SEQ ID NO: 114797 - RNA, 20 nt, Artificial Sequence
  MKO10114797_B_Scube3
  gRNA
uacgagugccauugcagaga

SEQ ID NO: 114798 - RNA, 20 nt, Artificial Sequence
  MKO10114798_B_Scube3
  gRNA
ccaucugccagaauacccca

SEQ ID NO: 114799 - RNA, 20 nt, Artificial Sequence
  MKO10114799_B_Scx
  gRNA
caaagaccgugacagaaaga

SEQ ID NO: 114800 - RNA, 20 nt, Artificial Sequence
  MKO10114800_B_Scx
  gRNA
cauucgcugugugccgcugc

SEQ ID NO: 114801 - RNA, 20 nt, Artificial Sequence
  MKO10114801_B_Scx
  gRNA
cgcugaacgcagcauggcga

SEQ ID NO: 114802 - RNA, 20 nt, Artificial Sequence
  MKO10114802_B_Scyl1
  gRNA
cccaaaaguacgucccaacc

SEQ ID NO: 114803 - RNA, 20 nt, Artificial Sequence
  MKO10114803_B_Scyl1
  gRNA
ucaugaagccaccgggugcc

SEQ ID NO: 114804 - RNA, 20 nt, Artificial Sequence
  MKO10114804_B_Scyl1
  gRNA
uuaccuucccaggguugcgc

SEQ ID NO: 114805 - RNA, 20 nt, Artificial Sequence
  MKO10114805_B_Scyl2
  gRNA
gccaguuuagccaauguucu

SEQ ID NO: 114806 - RNA, 20 nt, Artificial Sequence
  MKO10114806_B_Scyl2
  gRNA
aucaagcaacccuucugaac

SEQ ID NO: 114807 - RNA, 20 nt, Artificial Sequence
  MKO10114807_B_Scyl2
  gRNA
aguuuauaauccuugauguc

SEQ ID NO: 114808 - RNA, 20 nt, Artificial Sequence
  MKO10114808_B_Scyl3
  gRNA
cucaccucuggcguggccug

SEQ ID NO: 114809 - RNA, 20 nt, Artificial Sequence
  MKO10114809_B_Scyl3
  gRNA
augcugggucucuuacugac

SEQ ID NO: 114810 - RNA, 20 nt, Artificial Sequence
  MKO10114810_B_Scyl3
  gRNA
caucacucacucugucauga

SEQ ID NO: 114811 - RNA, 20 nt, Artificial Sequence
  MKO10114811_B_Sdad1
  gRNA
ccuuccgcaggagcuugucg

SEQ ID NO: 114812 - RNA, 20 nt, Artificial Sequence
  MKO10114812_B_Sdad1
  gRNA
gcugccacgacaagcuccug

SEQ ID NO: 114813 - RNA, 20 nt, Artificial Sequence
  MKO10114813_B_Sdad1
  gRNA
uaacuugaaaaucuccauau

SEQ ID NO: 114814 - RNA, 20 nt, Artificial Sequence
  MKO10114814_B_Sdc1
  gRNA
gugccgccacccuccacacg

SEQ ID NO: 114815 - RNA, 20 nt, Artificial Sequence
  MKO10114815_B_Sdc1
  gRNA
uuucugguaggcaccgccau

SEQ ID NO: 114816 - RNA, 20 nt, Artificial Sequence
  MKO10114816_B_Sdc1
  gRNA
cacucccuaggugucauugc

SEQ ID NO: 114817 - RNA, 20 nt, Artificial Sequence
  MKO10114817_B_Sdc2
  gRNA
gcuuugugucuucaacguca

SEQ ID NO: 114818 - RNA, 20 nt, Artificial Sequence
  MKO10114818_B_Sdc2
  gRNA
ggggaagcagcacuagugag

SEQ ID NO: 114819 - RNA, 20 nt, Artificial Sequence
  MKO10114819_B_Sdc2
  gRNA
ccuugacaauagcuccauug

SEQ ID NO: 114820 - RNA, 20 nt, Artificial Sequence
  MKO10114820_B_Sdc3
  gRNA
guacgugacgcuugccugcu

SEQ ID NO: 114821 - RNA, 20 nt, Artificial Sequence
  MKO10114821_B_Sdc3
  gRNA
ggccgagcugcccgaaucga

SEQ ID NO: 114822 - RNA, 20 nt, Artificial Sequence
  MKO10114822_B_Sdc3
  gRNA
uuucuccacagccgugaucg

SEQ ID NO: 114823 - RNA, 20 nt, Artificial Sequence
  MKO10114823_B_Sdc4
  gRNA
cuccccgacgacgaagaugc

SEQ ID NO: 114824 - RNA, 20 nt, Artificial Sequence
  MKO10114824_B_Sdc4
  gRNA
uccuacugcagcucugaucg

SEQ ID NO: 114825 - RNA, 20 nt, Artificial Sequence
  MKO10114825_B_Sdc4
  gRNA
cccugaagugauugagcccu

SEQ ID NO: 114826 - RNA, 20 nt, Artificial Sequence
  MKO10114826_B_Sdcbp2
  gRNA
gaccagauccugcaaauuga

SEQ ID NO: 114827 - RNA, 20 nt, Artificial Sequence
  MKO10114827_B_Sdcbp2
  gRNA
auaccuacauugucacuauc

SEQ ID NO: 114828 - RNA, 20 nt, Artificial Sequence
  MKO10114828_B_Sdcbp2
  gRNA
ucgugggugaggcucugccc

SEQ ID NO: 114829 - RNA, 20 nt, Artificial Sequence
  MKO10114829_B_Sdcbp
  gRNA
cauccaccagaacaaaugcu

SEQ ID NO: 114830 - RNA, 20 nt, Artificial Sequence
  MKO10114830_B_Sdcbp
  gRNA
uccagagcucucucaauaca

SEQ ID NO: 114831 - RNA, 20 nt, Artificial Sequence
  MKO10114831_B_Sdcbp
  gRNA
cccauguauugagagagcuc

SEQ ID NO: 114832 - RNA, 20 nt, Artificial Sequence
  MKO10114832_B_Sdccag3
  gRNA
cgcugagugacaccgacucc

SEQ ID NO: 114833 - RNA, 20 nt, Artificial Sequence
  MKO10114833_B_Sdccag3
  gRNA
caccagccgaauuuacccaa

SEQ ID NO: 114834 - RNA, 20 nt, Artificial Sequence
  MKO10114834_B_Sdccag3
  gRNA
gauguaccuuuggguaaauu

SEQ ID NO: 114835 - RNA, 20 nt, Artificial Sequence
  MKO10114835_B_Sdccag8
  gRNA
guugcgucaacaaacaaaua

SEQ ID NO: 114836 - RNA, 20 nt, Artificial Sequence
  MKO10114836_B_Sdccag8
  gRNA
caacuggugaaugcuucuau

SEQ ID NO: 114837 - RNA, 20 nt, Artificial Sequence
  MKO10114837_B_Sdccag8
  gRNA
auugagggagcaaacauucc

SEQ ID NO: 114838 - RNA, 20 nt, Artificial Sequence
  MKO10114838_B_Sde2
  gRNA
cugccucugguagucgggac

SEQ ID NO: 114839 - RNA, 20 nt, Artificial Sequence
  MKO10114839_B_Sde2
  gRNA
ucaccagucccgacuaccag

SEQ ID NO: 114840 - RNA, 20 nt, Artificial Sequence
  MKO10114840_B_Sde2
  gRNA
acggccuaacaagucaaaaa

SEQ ID NO: 114841 - RNA, 20 nt, Artificial Sequence
  MKO10114841_B_Sdf2l1
  gRNA
gugccaaugcucacaacacg

SEQ ID NO: 114842 - RNA, 20 nt, Artificial Sequence
  MKO10114842_B_Sdf2l1
  gRNA
cuguggacaguccgauguuc

SEQ ID NO: 114843 - RNA, 20 nt, Artificial Sequence
  MKO10114843_B_Sdf2l1
  gRNA
gcgggauguggggcgcgagc

SEQ ID NO: 114844 - RNA, 20 nt, Artificial Sequence
  MKO10114844_B_Sdf2
  gRNA
augggcugcccgcauuugau

SEQ ID NO: 114845 - RNA, 20 nt, Artificial Sequence
  MKO10114845_B_Sdf2
  gRNA
gccuucaccuucuucgccaa

SEQ ID NO: 114846 - RNA, 20 nt, Artificial Sequence
  MKO10114846_B_Sdf2
  gRNA
cgucugacacacaucaacac

SEQ ID NO: 114847 - RNA, 20 nt, Artificial Sequence
  MKO10114847_B_Sdf4
  gRNA
cugauugacucuaaccauga

SEQ ID NO: 114848 - RNA, 20 nt, Artificial Sequence
  MKO10114848_B_Sdf4
  gRNA
acucguccucagucagcagc

SEQ ID NO: 114849 - RNA, 20 nt, Artificial Sequence
  MKO10114849_B_Sdf4
  gRNA
gccaagacauugaugacaac

SEQ ID NO: 114850 - RNA, 20 nt, Artificial Sequence
  MKO10114850_B_Sdhaf1
  gRNA
uggguaccuucgugcgcccg

SEQ ID NO: 114851 - RNA, 20 nt, Artificial Sequence
  MKO10114851_B_Sdhaf1
  gRNA
cgcgggugcgggccgaguuc

SEQ ID NO: 114852 - RNA, 20 nt, Artificial Sequence
  MKO10114852_B_Sdhaf1
  gRNA
auacucgauacgcagcacgu

SEQ ID NO: 114853 - RNA, 20 nt, Artificial Sequence
  MKO10114853_B_Sdhaf2
  gRNA
uuaacgagccuagcaaugac

SEQ ID NO: 114854 - RNA, 20 nt, Artificial Sequence
  MKO10114854_B_Sdhaf2
  gRNA
gagacugcgugccccagauc

SEQ ID NO: 114855 - RNA, 20 nt, Artificial Sequence
  MKO10114855_B_Sdhaf2
  gRNA
uugaaaucccuuugccuccg

SEQ ID NO: 114856 - RNA, 20 nt, Artificial Sequence
  MKO10114856_B_Sdha
  gRNA
gauuucuacucaauacccag

SEQ ID NO: 114857 - RNA, 20 nt, Artificial Sequence
  MKO10114857_B_Sdha
  gRNA
gggagguaucaaugcugcuc

SEQ ID NO: 114858 - RNA, 20 nt, Artificial Sequence
  MKO10114858_B_Sdha
  gRNA
gcaggcuugcgagcugcauu

SEQ ID NO: 114859 - RNA, 20 nt, Artificial Sequence
  MKO10114859_B_Sdhb
  gRNA
auacucuggcgugcacacgc

SEQ ID NO: 114860 - RNA, 20 nt, Artificial Sequence
  MKO10114860_B_Sdhb
  gRNA
ucuugcgccaugaacaucaa

SEQ ID NO: 114861 - RNA, 20 nt, Artificial Sequence
  MKO10114861_B_Sdhb
  gRNA
uuccgaagaucuuguagaga

SEQ ID NO: 114862 - RNA, 20 nt, Artificial Sequence
  MKO10114862_B_Sdhc
  gRNA
uccagagccucgguggcaaa

SEQ ID NO: 114863 - RNA, 20 nt, Artificial Sequence
  MKO10114863_B_Sdhc
  gRNA
cuuacuuguagauagucaaa

SEQ ID NO: 114864 - RNA, 20 nt, Artificial Sequence
  MKO10114864_B_Sdhc
  gRNA
ugauacaaagcugagcauuc

SEQ ID NO: 114865 - RNA, 20 nt, Artificial Sequence
  MKO10114865_B_Sdhd
  gRNA
cagcucuccuacuccgaagc

SEQ ID NO: 114866 - RNA, 20 nt, Artificial Sequence
  MKO10114866_B_Sdhd
  gRNA
aacacugacaacccucucac

SEQ ID NO: 114867 - RNA, 20 nt, Artificial Sequence
  MKO10114867_B_Sdhd
  gRNA
cauggcgguucucuuaaagc

SEQ ID NO: 114868 - RNA, 20 nt, Artificial Sequence
  MKO10114868_B_Sdk1
  gRNA
cguugcaccguauuucaaaa

SEQ ID NO: 114869 - RNA, 20 nt, Artificial Sequence
  MKO10114869_B_Sdk1
  gRNA
ucucuaaaccacgucacuug

SEQ ID NO: 114870 - RNA, 20 nt, Artificial Sequence
  MKO10114870_B_Sdk1
  gRNA
gcccccaaccucaagugacg

SEQ ID NO: 114871 - RNA, 20 nt, Artificial Sequence
  MKO10114871_B_Sdk2
  gRNA
uaaccgccugcacguaguag

SEQ ID NO: 114872 - RNA, 20 nt, Artificial Sequence
  MKO10114872_B_Sdk2
  gRNA
acaacaaucgggagcugacc

SEQ ID NO: 114873 - RNA, 20 nt, Artificial Sequence
  MKO10114873_B_Sdk2
  gRNA
gugggaucuugcguccguca

SEQ ID NO: 114874 - RNA, 20 nt, Artificial Sequence
  MKO10114874_B_Sdpr
  gRNA
ggccauccgagacaacucgc

SEQ ID NO: 114875 - RNA, 20 nt, Artificial Sequence
  MKO10114875_B_Sdpr
  gRNA
cugugaacgaacccuccucg

SEQ ID NO: 114876 - RNA, 20 nt, Artificial Sequence
  MKO10114876_B_Sdpr
  gRNA
cacucucauagcgcaccugc

SEQ ID NO: 114877 - RNA, 20 nt, Artificial Sequence
  MKO10114877_B_Sdr16c5
  gRNA
gccaugauugcuaacaacca

SEQ ID NO: 114878 - RNA, 20 nt, Artificial Sequence
  MKO10114878_B_Sdr16c5
  gRNA
uccuacucuguuaccaauuc

SEQ ID NO: 114879 - RNA, 20 nt, Artificial Sequence
  MKO10114879_B_Sdr16c5
  gRNA
ugguuguuagcaaucauggc

SEQ ID NO: 114880 - RNA, 20 nt, Artificial Sequence
  MKO10114880_B_Sdr16c6
  gRNA
gagagacucggcaaagccaa

SEQ ID NO: 114881 - RNA, 20 nt, Artificial Sequence
  MKO10114881_B_Sdr16c6
  gRNA
ggguagguuaaagaagaagu

SEQ ID NO: 114882 - RNA, 20 nt, Artificial Sequence
  MKO10114882_B_Sdr16c6
  gRNA
caaugcaacauaugcaaacu

SEQ ID NO: 114883 - RNA, 20 nt, Artificial Sequence
  MKO10114883_B_Sdr39u1
  gRNA
auauccucaacccucugcga

SEQ ID NO: 114884 - RNA, 20 nt, Artificial Sequence
  MKO10114884_B_Sdr39u1
  gRNA
cgaaacugcgcacccaccuc

SEQ ID NO: 114885 - RNA, 20 nt, Artificial Sequence
  MKO10114885_B_Sdr39u1
  gRNA
gcccuguugaccuucgcaga

SEQ ID NO: 114886 - RNA, 20 nt, Artificial Sequence
  MKO10114886_B_Sdr42e1
  gRNA
gaggaaaccguccucaucac

SEQ ID NO: 114887 - RNA, 20 nt, Artificial Sequence
  MKO10114887_B_Sdr42e1
  gRNA
aagccgucuccacgucagcg

SEQ ID NO: 114888 - RNA, 20 nt, Artificial Sequence
  MKO10114888_B_Sdr42e1
  gRNA
ccacguggacaaacucaacc

SEQ ID NO: 114889 - RNA, 20 nt, Artificial Sequence
  MKO10114889_B_Sdr9c7
  gRNA
ccacgccagcguuguucacc

SEQ ID NO: 114890 - RNA, 20 nt, Artificial Sequence
  MKO10114890_B_Sdr9c7
  gRNA
ggccguguggcuauauucgg

SEQ ID NO: 114891 - RNA, 20 nt, Artificial Sequence
  MKO10114891_B_Sdr9c7
  gRNA
acuccucuccguagcuaucc

SEQ ID NO: 114892 - RNA, 20 nt, Artificial Sequence
  MKO10114892_B_Sdsl
  gRNA
cggggcgcacaguuucaauu

SEQ ID NO: 114893 - RNA, 20 nt, Artificial Sequence
  MKO10114893_B_Sdsl
  gRNA
ggugcccucugggagcacga

SEQ ID NO: 114894 - RNA, 20 nt, Artificial Sequence
  MKO10114894_B_Sdsl
  gRNA
agccuuaccauauaagggga

SEQ ID NO: 114895 - RNA, 20 nt, Artificial Sequence
  MKO10114895_B_Sds
  gRNA
ggggaaauguacacccaacc

SEQ ID NO: 114896 - RNA, 20 nt, Artificial Sequence
  MKO10114896_B_Sds
  gRNA
cacagacagcacgauagccc

SEQ ID NO: 114897 - RNA, 20 nt, Artificial Sequence
  MKO10114897_B_Sds
  gRNA
ccuuugaugacccucucauc

SEQ ID NO: 114898 - RNA, 20 nt, Artificial Sequence
  MKO10114898_B_Sebox
  gRNA
cgauggcugagguauagaua

SEQ ID NO: 114899 - RNA, 20 nt, Artificial Sequence
  MKO10114899_B_Sebox
  gRNA
ucaccuggagaugccuccac

SEQ ID NO: 114900 - RNA, 20 nt, Artificial Sequence
  MKO10114900_B_Sebox
  gRNA
cagcuccauggccaguccug

SEQ ID NO: 114901 - RNA, 20 nt, Artificial Sequence
  MKO10114901_B_Sec11a
  gRNA
ucuccucggcacuaaugauc

SEQ ID NO: 114902 - RNA, 20 nt, Artificial Sequence
  MKO10114902_B_Sec11a
  gRNA
uaccugagcaccacuacaau

SEQ ID NO: 114903 - RNA, 20 nt, Artificial Sequence
  MKO10114903_B_Sec11a
  gRNA
aauaaugcuguugaugaccg

SEQ ID NO: 114904 - RNA, 20 nt, Artificial Sequence
  MKO10114904_B_Sec11c
  gRNA
aauaaugaagucgaugauag

SEQ ID NO: 114905 - RNA, 20 nt, Artificial Sequence
  MKO10114905_B_Sec11c
  gRNA
ugcuguuccucacgaauuuc

SEQ ID NO: 114906 - RNA, 20 nt, Artificial Sequence
  MKO10114906_B_Sec11c
  gRNA
auggugaccaugccaacaua

SEQ ID NO: 114907 - RNA, 20 nt, Artificial Sequence
  MKO10114907_B_Sec13
  gRNA
ucaugacuauggccugaucc

SEQ ID NO: 114908 - RNA, 20 nt, Artificial Sequence
  MKO10114908_B_Sec13
  gRNA
ccacagugaacucuguuugc

SEQ ID NO: 114909 - RNA, 20 nt, Artificial Sequence
  MKO10114909_B_Sec13
  gRNA
uacaaucauguccucaugag

SEQ ID NO: 114910 - RNA, 20 nt, Artificial Sequence
  MKO10114910_B_Sec14l1
  gRNA
ccguguaacagcaguguucg

SEQ ID NO: 114911 - RNA, 20 nt, Artificial Sequence
  MKO10114911_B_Sec14l1
  gRNA
aagugcgaucucgagaauuc

SEQ ID NO: 114912 - RNA, 20 nt, Artificial Sequence
  MKO10114912_B_Sec14l1
  gRNA
gugucacuguccacgaacau

SEQ ID NO: 114913 - RNA, 20 nt, Artificial Sequence
  MKO10114913_B_Sec14l2
  gRNA
ccucaccucggagccaucga

SEQ ID NO: 114914 - RNA, 20 nt, Artificial Sequence
  MKO10114914_B_Sec14l2
  gRNA
augacuacuuccuccuucga

SEQ ID NO: 114915 - RNA, 20 nt, Artificial Sequence
  MKO10114915_B_Sec14l2
  gRNA
acauugacaaaaucaucagc

SEQ ID NO: 114916 - RNA, 20 nt, Artificial Sequence
  MKO10114916_B_Sec14l3
  gRNA
acguucacagucccucaucu

SEQ ID NO: 114917 - RNA, 20 nt, Artificial Sequence
  MKO10114917_B_Sec14l3
  gRNA
ucaguuccgagaaaaugucc

SEQ ID NO: 114918 - RNA, 20 nt, Artificial Sequence
  MKO10114918_B_Sec14l3
  gRNA
uuucuguaggucaaaguucc

SEQ ID NO: 114919 - RNA, 20 nt, Artificial Sequence
  MKO10114919_B_Sec14l4
  gRNA
cugucuggcuaugacuacga

SEQ ID NO: 114920 - RNA, 20 nt, Artificial Sequence
  MKO10114920_B_Sec14l4
  gRNA
cacagacuuugauacgcuuc

SEQ ID NO: 114921 - RNA, 20 nt, Artificial Sequence
  MKO10114921_B_Sec14l4
  gRNA
accuggaccagauccugacg

SEQ ID NO: 114922 - RNA, 20 nt, Artificial Sequence
  MKO10114922_B_Sec14l5
  gRNA
gguggggaagcgcuucucgu

SEQ ID NO: 114923 - RNA, 20 nt, Artificial Sequence
  MKO10114923_B_Sec14l5
  gRNA
ugccccgcggcugcugcgga

SEQ ID NO: 114924 - RNA, 20 nt, Artificial Sequence
  MKO10114924_B_Sec14l5
  gRNA
cuuuggcuuugaaagcacgu

SEQ ID NO: 114925 - RNA, 20 nt, Artificial Sequence
  MKO10114925_B_Sec16a
  gRNA
auagugacuugcacgggagc

SEQ ID NO: 114926 - RNA, 20 nt, Artificial Sequence
  MKO10114926_B_Sec16a
  gRNA
gucuguaacgaggcucauac

SEQ ID NO: 114927 - RNA, 20 nt, Artificial Sequence
  MKO10114927_B_Sec16a
  gRNA
auccucgcaccugggaccgg

SEQ ID NO: 114928 - RNA, 20 nt, Artificial Sequence
  MKO10114928_B_Sec16b
  gRNA
cuucuccagcagcacgaguc

SEQ ID NO: 114929 - RNA, 20 nt, Artificial Sequence
  MKO10114929_B_Sec16b
  gRNA
guacaugacagcugcccccg

SEQ ID NO: 114930 - RNA, 20 nt, Artificial Sequence
  MKO10114930_B_Sec16b
  gRNA
gucucgguauggauucuuac

SEQ ID NO: 114931 - RNA, 20 nt, Artificial Sequence
  MKO10114931_B_Sec1
  gRNA
agugaugcucuuccggcacc

SEQ ID NO: 114932 - RNA, 20 nt, Artificial Sequence
  MKO10114932_B_Sec1
  gRNA
ccaugccacccgagacugcg

SEQ ID NO: 114933 - RNA, 20 nt, Artificial Sequence
  MKO10114933_B_Sec1
  gRNA
gcuccugucccacgcagucu

SEQ ID NO: 114934 - RNA, 20 nt, Artificial Sequence
  MKO10114934_B_Sec22a
  gRNA
gagcuccacauaaaagacua

SEQ ID NO: 114935 - RNA, 20 nt, Artificial Sequence
  MKO10114935_B_Sec22a
  gRNA
gcugaucccaguucacacau

SEQ ID NO: 114936 - RNA, 20 nt, Artificial Sequence
  MKO10114936_B_Sec22a
  gRNA
cuguaguuucauuagcucuc

SEQ ID NO: 114937 - RNA, 20 nt, Artificial Sequence
  MKO10114937_B_Sec22b
  gRNA
ucuaucuaagaaauaccgcc

SEQ ID NO: 114938 - RNA, 20 nt, Artificial Sequence
  MKO10114938_B_Sec22b
  gRNA
guccccuacccgauguaccu

SEQ ID NO: 114939 - RNA, 20 nt, Artificial Sequence
  MKO10114939_B_Sec22b
  gRNA
ucuacauugauagccgugcu

SEQ ID NO: 114940 - RNA, 20 nt, Artificial Sequence
  MKO10114940_B_Sec22c
  gRNA
augaagccggugacagcccu

SEQ ID NO: 114941 - RNA, 20 nt, Artificial Sequence
  MKO10114941_B_Sec22c
  gRNA
ugcacccaccuggacgaugc

SEQ ID NO: 114942 - RNA, 20 nt, Artificial Sequence
  MKO10114942_B_Sec22c
  gRNA
uuucuaagccacucuucauc

SEQ ID NO: 114943 - RNA, 20 nt, Artificial Sequence
  MKO10114943_B_Sec23a
  gRNA
cccccuuaccugcaguuguu

SEQ ID NO: 114944 - RNA, 20 nt, Artificial Sequence
  MKO10114944_B_Sec23a
  gRNA
ucagauaucccagcauaugu

SEQ ID NO: 114945 - RNA, 20 nt, Artificial Sequence
  MKO10114945_B_Sec23a
  gRNA
uaguuuccaccuacauaugc

SEQ ID NO: 114946 - RNA, 20 nt, Artificial Sequence
  MKO10114946_B_Sec23b
  gRNA
aacuggggcaucaauucagc

SEQ ID NO: 114947 - RNA, 20 nt, Artificial Sequence
  MKO10114947_B_Sec23b
  gRNA
cuccugagguugagcagguc

SEQ ID NO: 114948 - RNA, 20 nt, Artificial Sequence
  MKO10114948_B_Sec23b
  gRNA
agccagaccugcucaaccuc

SEQ ID NO: 114949 - RNA, 20 nt, Artificial Sequence
  MKO10114949_B_Sec23ip
  gRNA
ucugcaggccgaguauaaaa

SEQ ID NO: 114950 - RNA, 20 nt, Artificial Sequence
  MKO10114950_B_Sec23ip
  gRNA
uguaccuuuaugaccgcaug

SEQ ID NO: 114951 - RNA, 20 nt, Artificial Sequence
  MKO10114951_B_Sec23ip
  gRNA
guacagcgucucacuucagu

SEQ ID NO: 114952 - RNA, 20 nt, Artificial Sequence
  MKO10114952_B_Sec24a
  gRNA
auuacgucaaaugccaauaa

SEQ ID NO: 114953 - RNA, 20 nt, Artificial Sequence
  MKO10114953_B_Sec24a
  gRNA
gcgcuguucugguagccugg

SEQ ID NO: 114954 - RNA, 20 nt, Artificial Sequence
  MKO10114954_B_Sec24a
  gRNA
ccccaaaacaagccgaagug

SEQ ID NO: 114955 - RNA, 20 nt, Artificial Sequence
  MKO10114955_B_Sec24b
  gRNA
ggauacuacggagcuugacu

SEQ ID NO: 114956 - RNA, 20 nt, Artificial Sequence
  MKO10114956_B_Sec24b
  gRNA
gucaucagcuuccgaugaug

SEQ ID NO: 114957 - RNA, 20 nt, Artificial Sequence
  MKO10114957_B_Sec24b
  gRNA
ugaugacaagggagucgcug

SEQ ID NO: 114958 - RNA, 20 nt, Artificial Sequence
  MKO10114958_B_Sec24c
  gRNA
aauuaugagagcccauaccc

SEQ ID NO: 114959 - RNA, 20 nt, Artificial Sequence
  MKO10114959_B_Sec24c
  gRNA
gagccguauggaccagaauu

SEQ ID NO: 114960 - RNA, 20 nt, Artificial Sequence
  MKO10114960_B_Sec24c
  gRNA
uuaccauagcccaacccaga

SEQ ID NO: 114961 - RNA, 20 nt, Artificial Sequence
  MKO10114961_B_Sec24d
  gRNA
gggcgcgacuccucagagcc

SEQ ID NO: 114962 - RNA, 20 nt, Artificial Sequence
  MKO10114962_B_Sec24d
  gRNA
ggugcacagaugucuuaccc

SEQ ID NO: 114963 - RNA, 20 nt, Artificial Sequence
  MKO10114963_B_Sec24d
  gRNA
ugccacacuauugacaggug

SEQ ID NO: 114964 - RNA, 20 nt, Artificial Sequence
  MKO10114964_B_Sec31a
  gRNA
ccucauaagauggauuccaa

SEQ ID NO: 114965 - RNA, 20 nt, Artificial Sequence
  MKO10114965_B_Sec31a
  gRNA
gcuaugcagcugauaucuuc

SEQ ID NO: 114966 - RNA, 20 nt, Artificial Sequence
  MKO10114966_B_Sec31a
  gRNA
cugcacuuacccuguuacug

SEQ ID NO: 114967 - RNA, 20 nt, Artificial Sequence
  MKO10114967_B_Sec31b
  gRNA
uccuccaccagcaauaaccc

SEQ ID NO: 114968 - RNA, 20 nt, Artificial Sequence
  MKO10114968_B_Sec31b
  gRNA
auucacacagggcaaucucc

SEQ ID NO: 114969 - RNA, 20 nt, Artificial Sequence
  MKO10114969_B_Sec31b
  gRNA
gagccccucaccugugacuu

SEQ ID NO: 114970 - RNA, 20 nt, Artificial Sequence
  MKO10114970_B_Sec61a1
  gRNA
gugauucuggccucuaacag

SEQ ID NO: 114971 - RNA, 20 nt, Artificial Sequence
  MKO10114971_B_Sec61a1
  gRNA
gggcuccauugaagagagcu

SEQ ID NO: 114972 - RNA, 20 nt, Artificial Sequence
  MKO10114972_B_Sec61a1
  gRNA
ugccuuccagauucaguuua

SEQ ID NO: 114973 - RNA, 20 nt, Artificial Sequence
  MKO10114973_B_Sec61a2
  gRNA
guuauucuugcauccaacag

SEQ ID NO: 114974 - RNA, 20 nt, Artificial Sequence
  MKO10114974_B_Sec61a2
  gRNA
ucugguagaacugcacagaa

SEQ ID NO: 114975 - RNA, 20 nt, Artificial Sequence
  MKO10114975_B_Sec61a2
  gRNA
aguauacuuacuuuccuuuc

SEQ ID NO: 114976 - RNA, 20 nt, Artificial Sequence
  MKO10114976_B_Sec61b
  gRNA
uacagaaaaaaugccagcug

SEQ ID NO: 114977 - RNA, 20 nt, Artificial Sequence
  MKO10114977_B_Sec61b
  gRNA
cagccggguccaacgcccag

SEQ ID NO: 114978 - RNA, 20 nt, Artificial Sequence
  MKO10114978_B_Sec61b
  gRNA
agaagacucaucaccagcac

SEQ ID NO: 114979 - RNA, 20 nt, Artificial Sequence
  MKO10114979_B_Sec61g
  gRNA
uuacacaauaauguuauuaa

SEQ ID NO: 114980 - RNA, 20 nt, Artificial Sequence
  MKO10114980_B_Sec61g
  gRNA
ggaucagguaaugcaguuug

SEQ ID NO: 114981 - RNA, 20 nt, Artificial Sequence
  MKO10114981_B_Sec61g
  gRNA
agaauuccagaagauugcca

SEQ ID NO: 114982 - RNA, 20 nt, Artificial Sequence
  MKO10114982_B_Sec62
  gRNA
acaguugaaucgaagauauu

SEQ ID NO: 114983 - RNA, 20 nt, Artificial Sequence
  MKO10114983_B_Sec62
  gRNA
uguuuguaggaggaaacucc

SEQ ID NO: 114984 - RNA, 20 nt, Artificial Sequence
  MKO10114984_B_Sec62
  gRNA
agaaaaacuugaucaucaug

SEQ ID NO: 114985 - RNA, 20 nt, Artificial Sequence
  MKO10114985_B_Sec63
  gRNA
uccuuaugaaguacuaaauu

SEQ ID NO: 114986 - RNA, 20 nt, Artificial Sequence
  MKO10114986_B_Sec63
  gRNA
accacaccuugaggcccauc

SEQ ID NO: 114987 - RNA, 20 nt, Artificial Sequence
  MKO10114987_B_Sec63
  gRNA
cuuaaauaucauccagauaa

SEQ ID NO: 114988 - RNA, 20 nt, Artificial Sequence
  MKO10114988_B_Secisbp2l
  gRNA
caaacggguagcaaguaauc

SEQ ID NO: 114989 - RNA, 20 nt, Artificial Sequence
  MKO10114989_B_Secisbp2l
  gRNA
caccgagcguccaaaucagc

SEQ ID NO: 114990 - RNA, 20 nt, Artificial Sequence
  MKO10114990_B_Secisbp2l
  gRNA
gcgcacguucauggucccag

SEQ ID NO: 114991 - RNA, 20 nt, Artificial Sequence
  MKO10114991_B_Secisbp2
  gRNA
ugacaaugcggugcccugug

SEQ ID NO: 114992 - RNA, 20 nt, Artificial Sequence
  MKO10114992_B_Secisbp2
  gRNA
caaacugcucucaguucgag

SEQ ID NO: 114993 - RNA, 20 nt, Artificial Sequence
  MKO10114993_B_Secisbp2
  gRNA
cuuggcuguagucguacugc

SEQ ID NO: 114994 - RNA, 20 nt, Artificial Sequence
  MKO10114994_B_Secum1a
  gRNA
guagauaaacguaaugaauc

SEQ ID NO: 114995 - RNA, 20 nt, Artificial Sequence
  MKO10114995_B_Secum1a
  gRNA
gauguaaagagcguaguguc

SEQ ID NO: 114996 - RNA, 20 nt, Artificial Sequence
  MKO10114996_B_Secum1a
  gRNA
guagggauagcaggcacuga

SEQ ID NO: 114997 - RNA, 20 nt, Artificial Sequence
  MKO10114997_B_Secum1b
  gRNA
aucuucaaucaaacgccucc

SEQ ID NO: 114998 - RNA, 20 nt, Artificial Sequence
  MKO10114998_B_Secum1b
  gRNA
accgauuccugugaugauga

SEQ ID NO: 114999 - RNA, 20 nt, Artificial Sequence
  MKO10114999_B_Secum1b
  gRNA
gccuacucuguaacauccuc

SEQ ID NO: 115000 - RNA, 20 nt, Artificial Sequence
  MKO10115000_B_Seh1l
  gRNA
caacaucagacccauauguu

SEQ ID NO: 115001 - RNA, 20 nt, Artificial Sequence
  MKO10115001_B_Seh1l
  gRNA
uacuauaccaucugcugaac

SEQ ID NO: 115002 - RNA, 20 nt, Artificial Sequence
  MKO10115002_B_Seh1l
  gRNA
aucacuucccacagcgauca

SEQ ID NO: 115003 - RNA, 20 nt, Artificial Sequence
  MKO10115003_B_Sel1l2
  gRNA
agaagugaaugucaccacac

SEQ ID NO: 115004 - RNA, 20 nt, Artificial Sequence
  MKO10115004_B_Sel1l2
  gRNA
aagaaaaguaucacagauga

SEQ ID NO: 115005 - RNA, 20 nt, Artificial Sequence
  MKO10115005_B_Sel1l2
  gRNA
caacauaaguuaaaaauaaa

SEQ ID NO: 115006 - RNA, 20 nt, Artificial Sequence
  MKO10115006_B_Sel1l3
  gRNA
auucaaaugcaucucgucaa

SEQ ID NO: 115007 - RNA, 20 nt, Artificial Sequence
  MKO10115007_B_Sel1l3
  gRNA
cauugaacgagauauccagu

SEQ ID NO: 115008 - RNA, 20 nt, Artificial Sequence
  MKO10115008_B_Sel1l3
  gRNA
uuauuuacuccauuauugcg

SEQ ID NO: 115009 - RNA, 20 nt, Artificial Sequence
  MKO10115009_B_Sel1l
  gRNA
agcaacuacuuugcccgugg

SEQ ID NO: 115010 - RNA, 20 nt, Artificial Sequence
  MKO10115010_B_Sel1l
  gRNA
aguacuuaccuuggaaucua

SEQ ID NO: 115011 - RNA, 20 nt, Artificial Sequence
  MKO10115011_B_Sel1l
  gRNA
ccagucuugacugccauuga

SEQ ID NO: 115012 - RNA, 20 nt, Artificial Sequence
  MKO10115012_B_Selenbp1
  gRNA
ggacaugccuugugcaacuu

SEQ ID NO: 115013 - RNA, 20 nt, Artificial Sequence
  MKO10115013_B_Selenbp1
  gRNA
cacugaagccccggauuauu

SEQ ID NO: 115014 - RNA, 20 nt, Artificial Sequence
  MKO10115014_B_Selenbp1
  gRNA
caucuccucccgcaucuacg

SEQ ID NO: 115015 - RNA, 20 nt, Artificial Sequence
  MKO10115015_B_Selenbp2
  gRNA
caccgaagccccggauuauu

SEQ ID NO: 115016 - RNA, 20 nt, Artificial Sequence
  MKO10115016_B_Selenbp2
  gRNA
ggauaugccuugugcaacuu

SEQ ID NO: 115017 - RNA, 20 nt, Artificial Sequence
  MKO10115017_B_Selenbp2
  gRNA
gggcuucggugccuguguuc

SEQ ID NO: 115018 - RNA, 20 nt, Artificial Sequence
  MKO10115018_B_Sele
  gRNA
aacauucaccgaguuacuac

SEQ ID NO: 115019 - RNA, 20 nt, Artificial Sequence
  MKO10115019_B_Sele
  gRNA
aacgugcaugucguguucca

SEQ ID NO: 115020 - RNA, 20 nt, Artificial Sequence
  MKO10115020_B_Sele
  gRNA
gucccgcugacaguaugcac

SEQ ID NO: 115021 - RNA, 20 nt, Artificial Sequence
  MKO10115021_B_Selk
  gRNA
caagaugugaagaaaagaag

SEQ ID NO: 115022 - RNA, 20 nt, Artificial Sequence
  MKO10115022_B_Selk
  gRNA
cuuccucauccaccagccau

SEQ ID NO: 115023 - RNA, 20 nt, Artificial Sequence
  MKO10115023_B_Selk
  gRNA
aggaaacccuccacgaagaa

SEQ ID NO: 115024 - RNA, 20 nt, Artificial Sequence
  MKO10115024_B_Sell
  gRNA
guguccagacccacagcuuc

SEQ ID NO: 115025 - RNA, 20 nt, Artificial Sequence
  MKO10115025_B_Sell
  gRNA
agucacucaccuuggcagau

SEQ ID NO: 115026 - RNA, 20 nt, Artificial Sequence
  MKO10115026_B_Sell
  gRNA
agugguccagugugagccuu

SEQ ID NO: 115027 - RNA, 20 nt, Artificial Sequence
  MKO10115027_B_Selm
  gRNA
gcucggcuucuaccgcaagu

SEQ ID NO: 115028 - RNA, 20 nt, Artificial Sequence
  MKO10115028_B_Selm
  gRNA
ucggcuuaacagcacgaguu

SEQ ID NO: 115029 - RNA, 20 nt, Artificial Sequence
  MKO10115029_B_Selm
  gRNA
auacuacaguugaauguccu

SEQ ID NO: 115030 - RNA, 20 nt, Artificial Sequence
  MKO10115030_B_Selo
  gRNA
acuaucgacuauggacccuu

SEQ ID NO: 115031 - RNA, 20 nt, Artificial Sequence
  MKO10115031_B_Selo
  gRNA
ugucaguguugagcacgcca

SEQ ID NO: 115032 - RNA, 20 nt, Artificial Sequence
  MKO10115032_B_Selo
  gRNA
gacacuuguggccaaacuuc

SEQ ID NO: 115033 - RNA, 20 nt, Artificial Sequence
  MKO10115033_B_Selplg
  gRNA
ucuguguuauacguauaguc

SEQ ID NO: 115034 - RNA, 20 nt, Artificial Sequence
  MKO10115034_B_Selplg
  gRNA
cgagaugcagaucaucuccg

SEQ ID NO: 115035 - RNA, 20 nt, Artificial Sequence
  MKO10115035_B_Selplg
  gRNA
aguuccgcacuggguacaug

SEQ ID NO: 115036 - RNA, 20 nt, Artificial Sequence
  MKO10115036_B_Selp
  gRNA
uggucucgaugcacuccccu

SEQ ID NO: 115037 - RNA, 20 nt, Artificial Sequence
  MKO10115037_B_Selp
  gRNA
aagacuccggagugugaucc

SEQ ID NO: 115038 - RNA, 20 nt, Artificial Sequence
  MKO10115038_B_Selp
  gRNA
gccucaccguauucacacuc

SEQ ID NO: 115039 - RNA, 20 nt, Artificial Sequence
  MKO10115039_B_Selrc1
  gRNA
cuaccaaugcuaccgcgaga

SEQ ID NO: 115040 - RNA, 20 nt, Artificial Sequence
  MKO10115040_B_Selrc1
  gRNA
acgcacuacccaaauguuag

SEQ ID NO: 115041 - RNA, 20 nt, Artificial Sequence
  MKO10115041_B_Selrc1
  gRNA
uggugacagcuguuacaagc

SEQ ID NO: 115042 - RNA, 20 nt, Artificial Sequence
  MKO10115042_B_Selt
  gRNA
gucuucaaacuaguauuaau

SEQ ID NO: 115043 - RNA, 20 nt, Artificial Sequence
  MKO10115043_B_Selt
  gRNA
auacuaguuugaagacugac

SEQ ID NO: 115044 - RNA, 20 nt, Artificial Sequence
  MKO10115044_B_Selt
  gRNA
cuagguuuaugcauguauga

SEQ ID NO: 115045 - RNA, 20 nt, Artificial Sequence
  MKO10115045_B_Sema3a
  gRNA
ucucuccuuguguaagauac

SEQ ID NO: 115046 - RNA, 20 nt, Artificial Sequence
  MKO10115046_B_Sema3a
  gRNA
gaacggaguagacuauaugu

SEQ ID NO: 115047 - RNA, 20 nt, Artificial Sequence
  MKO10115047_B_Sema3a
  gRNA
uacuccguucuucauccaga

SEQ ID NO: 115048 - RNA, 20 nt, Artificial Sequence
  MKO10115048_B_Sema3b
  gRNA
ucgggcugccucggugcugg

SEQ ID NO: 115049 - RNA, 20 nt, Artificial Sequence
  MKO10115049_B_Sema3b
  gRNA
gcagguccgcuccagccuga

SEQ ID NO: 115050 - RNA, 20 nt, Artificial Sequence
  MKO10115050_B_Sema3b
  gRNA
cuucacgaaguucaugcacu

SEQ ID NO: 115051 - RNA, 20 nt, Artificial Sequence
  MKO10115051_B_Sema3c
  gRNA
aucgacucuaagugugaauc

SEQ ID NO: 115052 - RNA, 20 nt, Artificial Sequence
  MKO10115052_B_Sema3c
  gRNA
cguacucaccuguaugucug

SEQ ID NO: 115053 - RNA, 20 nt, Artificial Sequence
  MKO10115053_B_Sema3c
  gRNA
auauucuguagucuaacugc

SEQ ID NO: 115054 - RNA, 20 nt, Artificial Sequence
  MKO10115054_B_Sema3d
  gRNA
gccugcugcaaaagaacgag

SEQ ID NO: 115055 - RNA, 20 nt, Artificial Sequence
  MKO10115055_B_Sema3d
  gRNA
gagaggggcauacugcuccu

SEQ ID NO: 115056 - RNA, 20 nt, Artificial Sequence
  MKO10115056_B_Sema3d
  gRNA
uccuucugaugaacccaaaa

SEQ ID NO: 115057 - RNA, 20 nt, Artificial Sequence
  MKO10115057_B_Sema3e
  gRNA
auggugcccgacucugauga

SEQ ID NO: 115058 - RNA, 20 nt, Artificial Sequence
  MKO10115058_B_Sema3e
  gRNA
guaucaagaacggcucuuug

SEQ ID NO: 115059 - RNA, 20 nt, Artificial Sequence
  MKO10115059_B_Sema3e
  gRNA
uguuguagugaugcaaaacc

SEQ ID NO: 115060 - RNA, 20 nt, Artificial Sequence
  MKO10115060_B_Sema3f
  gRNA
ggaccaugaccgcauguaug

SEQ ID NO: 115061 - RNA, 20 nt, Artificial Sequence
  MKO10115061_B_Sema3f
  gRNA
augugcaccuaugugaaccg

SEQ ID NO: 115062 - RNA, 20 nt, Artificial Sequence
  MKO10115062_B_Sema3f
  gRNA
gcaggauuacaucuucuacc

SEQ ID NO: 115063 - RNA, 20 nt, Artificial Sequence
  MKO10115063_B_Sema3g
  gRNA
aagggucggcugggcucaug

SEQ ID NO: 115064 - RNA, 20 nt, Artificial Sequence
  MKO10115064_B_Sema3g
  gRNA
cgacucaccucccggggguc

SEQ ID NO: 115065 - RNA, 20 nt, Artificial Sequence
  MKO10115065_B_Sema3g
  gRNA
gaagguggaauguguccgca

SEQ ID NO: 115066 - RNA, 20 nt, Artificial Sequence
  MKO10115066_B_Sema4a
  gRNA
guugcccaucuugauagaca

SEQ ID NO: 115067 - RNA, 20 nt, Artificial Sequence
  MKO10115067_B_Sema4a
  gRNA
gaguagcauuguaagagacc

SEQ ID NO: 115068 - RNA, 20 nt, Artificial Sequence
  MKO10115068_B_Sema4a
  gRNA
caugaccuugucuaucaaga

SEQ ID NO: 115069 - RNA, 20 nt, Artificial Sequence
  MKO10115069_B_Sema4b
  gRNA
gcugaaggcggccgugccac

SEQ ID NO: 115070 - RNA, 20 nt, Artificial Sequence
  MKO10115070_B_Sema4b
  gRNA
cuuuacuuuagcccaagaug

SEQ ID NO: 115071 - RNA, 20 nt, Artificial Sequence
  MKO10115071_B_Sema4b
  gRNA
aacuuacaauguaagcacac

SEQ ID NO: 115072 - RNA, 20 nt, Artificial Sequence
  MKO10115072_B_Sema4c
  gRNA
uuuauaugugggggcccgag

SEQ ID NO: 115073 - RNA, 20 nt, Artificial Sequence
  MKO10115073_B_Sema4c
  gRNA
ccacucacccacaaggaguc

SEQ ID NO: 115074 - RNA, 20 nt, Artificial Sequence
  MKO10115074_B_Sema4c
  gRNA
caauccucagaucucuuggg

SEQ ID NO: 115075 - RNA, 20 nt, Artificial Sequence
  MKO10115075_B_Sema4d
  gRNA
ccaugacugauguguagcug

SEQ ID NO: 115076 - RNA, 20 nt, Artificial Sequence
  MKO10115076_B_Sema4d
  gRNA
uuuguccucacucaucagca

SEQ ID NO: 115077 - RNA, 20 nt, Artificial Sequence
  MKO10115077_B_Sema4d
  gRNA
cuugacauccuucaaguuuc

SEQ ID NO: 115078 - RNA, 20 nt, Artificial Sequence
  MKO10115078_B_Sema4f
  gRNA
cauuggcaauggcgagaauc

SEQ ID NO: 115079 - RNA, 20 nt, Artificial Sequence
  MKO10115079_B_Sema4f
  gRNA
ugggcaccgagcgggggacg

SEQ ID NO: 115080 - RNA, 20 nt, Artificial Sequence
  MKO10115080_B_Sema4f
  gRNA
cuuaccggagaugggcagcg

SEQ ID NO: 115081 - RNA, 20 nt, Artificial Sequence
  MKO10115081_B_Sema4g
  gRNA
caucuugccuacuaguuucg

SEQ ID NO: 115082 - RNA, 20 nt, Artificial Sequence
  MKO10115082_B_Sema4g
  gRNA
uuucccuccucgaaacuagu

SEQ ID NO: 115083 - RNA, 20 nt, Artificial Sequence
  MKO10115083_B_Sema4g
  gRNA
gugcccgugacauaagagau

SEQ ID NO: 115084 - RNA, 20 nt, Artificial Sequence
  MKO10115084_B_Sema5a
  gRNA
uacauacgagugcucuuagu

SEQ ID NO: 115085 - RNA, 20 nt, Artificial Sequence
  MKO10115085_B_Sema5a
  gRNA
uuacagcaagggcaaaucga

SEQ ID NO: 115086 - RNA, 20 nt, Artificial Sequence
  MKO10115086_B_Sema5a
  gRNA
gugugacgaagccaccaaga

SEQ ID NO: 115087 - RNA, 20 nt, Artificial Sequence
  MKO10115087_B_Sema5b
  gRNA
guacgaguccugauuguuuc

SEQ ID NO: 115088 - RNA, 20 nt, Artificial Sequence
  MKO10115088_B_Sema5b
  gRNA
uaccgcacaugaacaccuuc

SEQ ID NO: 115089 - RNA, 20 nt, Artificial Sequence
  MKO10115089_B_Sema5b
  gRNA
cgccaaugucucccuccuuc

SEQ ID NO: 115090 - RNA, 20 nt, Artificial Sequence
  MKO10115090_B_Sema6a
  gRNA
gaacccucuacguugcugcu

SEQ ID NO: 115091 - RNA, 20 nt, Artificial Sequence
  MKO10115091_B_Sema6a
  gRNA
cuauaucaacaguauaaaua

SEQ ID NO: 115092 - RNA, 20 nt, Artificial Sequence
  MKO10115092_B_Sema6a
  gRNA
aggcugacguagacacaugc

SEQ ID NO: 115093 - RNA, 20 nt, Artificial Sequence
  MKO10115093_B_Sema6b
  gRNA
cacacuguaauuggcgcaga

SEQ ID NO: 115094 - RNA, 20 nt, Artificial Sequence
  MKO10115094_B_Sema6b
  gRNA
ccacggagcugcgauaucag

SEQ ID NO: 115095 - RNA, 20 nt, Artificial Sequence
  MKO10115095_B_Sema6b
  gRNA
caucgaugugugucgaauga

SEQ ID NO: 115096 - RNA, 20 nt, Artificial Sequence
  MKO10115096_B_Sema6c
  gRNA
agagauuccugaccuugaac

SEQ ID NO: 115097 - RNA, 20 nt, Artificial Sequence
  MKO10115097_B_Sema6c
  gRNA
auauggagaacugugcaguc

SEQ ID NO: 115098 - RNA, 20 nt, Artificial Sequence
  MKO10115098_B_Sema6c
  gRNA
ggaggggcuggugcccaaca

SEQ ID NO: 115099 - RNA, 20 nt, Artificial Sequence
  MKO10115099_B_Sema6d
  gRNA
ugcugcgauucguugccuga

SEQ ID NO: 115100 - RNA, 20 nt, Artificial Sequence
  MKO10115100_B_Sema6d
  gRNA
gcuuaaucuagaagcugacg

SEQ ID NO: 115101 - RNA, 20 nt, Artificial Sequence
  MKO10115101_B_Sema6d
  gRNA
cgagaaaauugugcuaugaa

SEQ ID NO: 115102 - RNA, 20 nt, Artificial Sequence
  MKO10115102_B_Sema7a
  gRNA
caagcucaccgugcgcacag

SEQ ID NO: 115103 - RNA, 20 nt, Artificial Sequence
  MKO10115103_B_Sema7a
  gRNA
ucauggaaaagcacggugug

SEQ ID NO: 115104 - RNA, 20 nt, Artificial Sequence
  MKO10115104_B_Sema7a
  gRNA
gguaaugggcugcuggucug

SEQ ID NO: 115105 - RNA, 20 nt, Artificial Sequence
  MKO10115105_B_Senp1
  gRNA
ccgacgacaugacccacucc

SEQ ID NO: 115106 - RNA, 20 nt, Artificial Sequence
  MKO10115106_B_Senp1
  gRNA
uaucguccagauuaucacuc

SEQ ID NO: 115107 - RNA, 20 nt, Artificial Sequence
  MKO10115107_B_Senp1
  gRNA
acccaccgcccgccacaguc

SEQ ID NO: 115108 - RNA, 20 nt, Artificial Sequence
  MKO10115108_B_Senp2
  gRNA
uacaaugcugccaguuuauu

SEQ ID NO: 115109 - RNA, 20 nt, Artificial Sequence
  MKO10115109_B_Senp2
  gRNA
aguaccuaaucuuggccuuu

SEQ ID NO: 115110 - RNA, 20 nt, Artificial Sequence
  MKO10115110_B_Senp2
  gRNA
cugaugagaucccagccaaa

SEQ ID NO: 115111 - RNA, 20 nt, Artificial Sequence
  MKO10115111_B_Senp3
  gRNA
agacagucccccaaaaccau

SEQ ID NO: 115112 - RNA, 20 nt, Artificial Sequence
  MKO10115112_B_Senp3
  gRNA
ugaagacucacucugcacac

SEQ ID NO: 115113 - RNA, 20 nt, Artificial Sequence
  MKO10115113_B_Senp3
  gRNA
gaugaauuccuucaaacuua

SEQ ID NO: 115114 - RNA, 20 nt, Artificial Sequence
  MKO10115114_B_Senp5
  gRNA
gcagaacugguugaaugacc

SEQ ID NO: 115115 - RNA, 20 nt, Artificial Sequence
  MKO10115115_B_Senp5
  gRNA
uauguaaggauuccuagaug

SEQ ID NO: 115116 - RNA, 20 nt, Artificial Sequence
  MKO10115116_B_Senp5
  gRNA
uuuaacuccauuauagccuu

SEQ ID NO: 115117 - RNA, 20 nt, Artificial Sequence
  MKO10115117_B_Senp6
  gRNA
caugcucacucacagacgcc

SEQ ID NO: 115118 - RNA, 20 nt, Artificial Sequence
  MKO10115118_B_Senp6
  gRNA
ucuacucaguguagaagaug

SEQ ID NO: 115119 - RNA, 20 nt, Artificial Sequence
  MKO10115119_B_Senp6
  gRNA
uggauagaucagaaucuaag

SEQ ID NO: 115120 - RNA, 20 nt, Artificial Sequence
  MKO10115120_B_Senp7
  gRNA
cauaccuucuguaaaucagc

SEQ ID NO: 115121 - RNA, 20 nt, Artificial Sequence
  MKO10115121_B_Senp7
  gRNA
augcugucaacagaugucga

SEQ ID NO: 115122 - RNA, 20 nt, Artificial Sequence
  MKO10115122_B_Senp7
  gRNA
aucaccagcugauuuacaga

SEQ ID NO: 115123 - RNA, 20 nt, Artificial Sequence
  MKO10115123_B_Senp8
  gRNA
auccagggguucaaggaaca

SEQ ID NO: 115124 - RNA, 20 nt, Artificial Sequence
  MKO10115124_B_Senp8
  gRNA
ucauagcuguucucuugagc

SEQ ID NO: 115125 - RNA, 20 nt, Artificial Sequence
  MKO10115125_B_Senp8
  gRNA
aguagcugcagcggggacuc

SEQ ID NO: 115126 - RNA, 20 nt, Artificial Sequence
  MKO10115126_B_Sephs1
  gRNA
gacaauaugcugaugcuccu

SEQ ID NO: 115127 - RNA, 20 nt, Artificial Sequence
  MKO10115127_B_Sephs1
  gRNA
gauaggauaaauguaaucug

SEQ ID NO: 115128 - RNA, 20 nt, Artificial Sequence
  MKO10115128_B_Sephs1
  gRNA
ccgugacacccauugcauaa

SEQ ID NO: 115129 - RNA, 20 nt, Artificial Sequence
  MKO10115129_B_Sephs2
  gRNA
aagcucgucagccgccagcu

SEQ ID NO: 115130 - RNA, 20 nt, Artificial Sequence
  MKO10115130_B_Sephs2
  gRNA
gguagaacuucaauaacgcg

SEQ ID NO: 115131 - RNA, 20 nt, Artificial Sequence
  MKO10115131_B_Sephs2
  gRNA
agaccagcccgccgggccca

SEQ ID NO: 115132 - RNA, 20 nt, Artificial Sequence
  MKO10115132_B_Sepn1
  gRNA
cagcccugguggauuauccc

SEQ ID NO: 115133 - RNA, 20 nt, Artificial Sequence
  MKO10115133_B_Sepn1
  gRNA
ccagcaggaaucggcauuaa

SEQ ID NO: 115134 - RNA, 20 nt, Artificial Sequence
  MKO10115134_B_Sepn1
  gRNA
ccggacugauguacauaucc

SEQ ID NO: 115135 - RNA, 20 nt, Artificial Sequence
  MKO10115135_B_Sepp1
  gRNA
cauuaagaucgcuuacugug

SEQ ID NO: 115136 - RNA, 20 nt, Artificial Sequence
  MKO10115136_B_Sepp1
  gRNA
ugaucuccuauguaccacuc

SEQ ID NO: 115137 - RNA, 20 nt, Artificial Sequence
  MKO10115137_B_Sepp1
  gRNA
cagcucaccugucauagaug

SEQ ID NO: 115138 - RNA, 20 nt, Artificial Sequence
  MKO10115138_B_Sepsecs
  gRNA
ucgucgagcaaccaaagcag

SEQ ID NO: 115139 - RNA, 20 nt, Artificial Sequence
  MKO10115139_B_Sepsecs
  gRNA
caggacuucuggucuauccg

SEQ ID NO: 115140 - RNA, 20 nt, Artificial Sequence
  MKO10115140_B_Sepsecs
  gRNA
ccaaguauaucauauggcca

SEQ ID NO: 115141 - RNA, 20 nt, Artificial Sequence
  MKO10115141_B_Sepw1
  gRNA
gaaguugguccacuccaaga

SEQ ID NO: 115142 - RNA, 20 nt, Artificial Sequence
  MKO10115142_B_Sepw1
  gRNA
acucacaauguccaggcauc

SEQ ID NO: 115143 - RNA, 20 nt, Artificial Sequence
  MKO10115143_B_Sepw1
  gRNA
aagcuagaacaugaguuccc

SEQ ID NO: 115144 - RNA, 20 nt, Artificial Sequence
  MKO10115144_B_Serac1
  gRNA
cgguugucuaaccugucuac

SEQ ID NO: 115145 - RNA, 20 nt, Artificial Sequence
  MKO10115145_B_Serac1
  gRNA
guacucacggauauuucucc

SEQ ID NO: 115146 - RNA, 20 nt, Artificial Sequence
  MKO10115146_B_Serac1
  gRNA
ugcacaaagcuccuguagac

SEQ ID NO: 115147 - RNA, 20 nt, Artificial Sequence
  MKO10115147_B_Serbp1
  gRNA
ggcgauggauuugauucucg

SEQ ID NO: 115148 - RNA, 20 nt, Artificial Sequence
  MKO10115148_B_Serbp1
  gRNA
cugaagcaugaggacaaacg

SEQ ID NO: 115149 - RNA, 20 nt, Artificial Sequence
  MKO10115149_B_Serbp1
  gRNA
agguagcggcucucacaacu

SEQ ID NO: 115150 - RNA, 20 nt, Artificial Sequence
  MKO10115150_B_Serf1
  gRNA
cugccucucagagaaagcag

SEQ ID NO: 115151 - RNA, 20 nt, Artificial Sequence
  MKO10115151_B_Serf1
  gRNA
uagcaaagggaaaagaaaag

SEQ ID NO: 115152 - RNA, 20 nt, Artificial Sequence
  MKO10115152_B_Serf2
  gRNA
cagcagaaagcccaucaucu

SEQ ID NO: 115153 - RNA, 20 nt, Artificial Sequence
  MKO10115153_B_Serf2
  gRNA
aagggaaagcgccgagauga

SEQ ID NO: 115154 - RNA, 20 nt, Artificial Sequence
  MKO10115154_B_Serf2
  gRNA
ucugcuucuucauguucuuc

SEQ ID NO: 115155 - RNA, 20 nt, Artificial Sequence
  MKO10115155_B_Sergef
  gRNA
gugauuaccuguaguggcua

SEQ ID NO: 115156 - RNA, 20 nt, Artificial Sequence
  MKO10115156_B_Sergef
  gRNA
gcaacuuggccuuggccaua

SEQ ID NO: 115157 - RNA, 20 nt, Artificial Sequence
  MKO10115157_B_Sergef
  gRNA
accaucugcaagccucuccg

SEQ ID NO: 115158 - RNA, 20 nt, Artificial Sequence
  MKO10115158_B_Serhl
  gRNA
acucaccaaaacuguggccc

SEQ ID NO: 115159 - RNA, 20 nt, Artificial Sequence
  MKO10115159_B_Serhl
  gRNA
aaugagccugucaaaggagu

SEQ ID NO: 115160 - RNA, 20 nt, Artificial Sequence
  MKO10115160_B_Serhl
  gRNA
guggaaucaguucacccucc

SEQ ID NO: 115161 - RNA, 20 nt, Artificial Sequence
  MKO10115161_B_Serinc1
  gRNA
acagcaguugcaauuaucau

SEQ ID NO: 115162 - RNA, 20 nt, Artificial Sequence
  MKO10115162_B_Serinc1
  gRNA
ugaaucguggguugaaaaaa

SEQ ID NO: 115163 - RNA, 20 nt, Artificial Sequence
  MKO10115163_B_Serinc1
  gRNA
ccuugaucauuaguaaagag

SEQ ID NO: 115164 - RNA, 20 nt, Artificial Sequence
  MKO10115164_B_Serinc2
  gRNA
ggcgccuucuacaucccuga

SEQ ID NO: 115165 - RNA, 20 nt, Artificial Sequence
  MKO10115165_B_Serinc2
  gRNA
agacagcgcggaaacccagc

SEQ ID NO: 115166 - RNA, 20 nt, Artificial Sequence
  MKO10115166_B_Serinc2
  gRNA
cgcccacagugauacccaca

SEQ ID NO: 115167 - RNA, 20 nt, Artificial Sequence
  MKO10115167_B_Serinc3
  gRNA
aaggucccgugccucuguag

SEQ ID NO: 115168 - RNA, 20 nt, Artificial Sequence
  MKO10115168_B_Serinc3
  gRNA
ugaauuauggguaaaucgaa

SEQ ID NO: 115169 - RNA, 20 nt, Artificial Sequence
  MKO10115169_B_Serinc3
  gRNA
cccguugugcacugcugcuc

SEQ ID NO: 115170 - RNA, 20 nt, Artificial Sequence
  MKO10115170_B_Serinc4
  gRNA
gugcuaugugcccaccuguu

SEQ ID NO: 115171 - RNA, 20 nt, Artificial Sequence
  MKO10115171_B_Serinc4
  gRNA
gcucuacauccuccuccacg

SEQ ID NO: 115172 - RNA, 20 nt, Artificial Sequence
  MKO10115172_B_Serinc4
  gRNA
accuuaccaauucuuguucc

SEQ ID NO: 115173 - RNA, 20 nt, Artificial Sequence
  MKO10115173_B_Serinc5
  gRNA
gcgguguacagagucugcuu

SEQ ID NO: 115174 - RNA, 20 nt, Artificial Sequence
  MKO10115174_B_Serinc5
  gRNA
cucaggagcguucuucauuc

SEQ ID NO: 115175 - RNA, 20 nt, Artificial Sequence
  MKO10115175_B_Serinc5
  gRNA
gaagaacgcuccugagcaca

SEQ ID NO: 115176 - RNA, 20 nt, Artificial Sequence
  MKO10115176_B_Serp1
  gRNA
uccagauuauucaaaguauc

SEQ ID NO: 115177 - RNA, 20 nt, Artificial Sequence
  MKO10115177_B_Serp1
  gRNA
agcaagaacauaacucagcg

SEQ ID NO: 115178 - RNA, 20 nt, Artificial Sequence
  MKO10115178_B_Serp1
  gRNA
uccugauacuuugaauaauc

SEQ ID NO: 115179 - RNA, 20 nt, Artificial Sequence
  MKO10115179_B_Serp2
  gRNA
gccagcagccauggcccaac

SEQ ID NO: 115180 - RNA, 20 nt, Artificial Sequence
  MKO10115180_B_Serp2
  gRNA
caagaagagaaauauccugu

SEQ ID NO: 115181 - RNA, 20 nt, Artificial Sequence
  MKO10115181_B_Serp2
  gRNA
ugugcuucucguuagccauc

SEQ ID NO: 115182 - RNA, 20 nt, Artificial Sequence
  MKO10115182_B_Serpina10
  gRNA
gcucgugcaucucauaccuc

SEQ ID NO: 115183 - RNA, 20 nt, Artificial Sequence
  MKO10115183_B_Serpina10
  gRNA
gacuuacccuggacaccuga

SEQ ID NO: 115184 - RNA, 20 nt, Artificial Sequence
  MKO10115184_B_Serpina10
  gRNA
guccaggaugcuccuauuuc

SEQ ID NO: 115185 - RNA, 20 nt, Artificial Sequence
  MKO10115185_B_Serpina11
  gRNA
gccagcacccgccuaucaca

SEQ ID NO: 115186 - RNA, 20 nt, Artificial Sequence
  MKO10115186_B_Serpina11
  gRNA
aauuuccgcaacuuacaacc

SEQ ID NO: 115187 - RNA, 20 nt, Artificial Sequence
  MKO10115187_B_Serpina11
  gRNA
cuucucguucauguccacga

SEQ ID NO: 115188 - RNA, 20 nt, Artificial Sequence
  MKO10115188_B_Serpina12
  gRNA
uguuguaaguagacgagaug

SEQ ID NO: 115189 - RNA, 20 nt, Artificial Sequence
  MKO10115189_B_Serpina12
  gRNA
augcuccuuuauuacccacu

SEQ ID NO: 115190 - RNA, 20 nt, Artificial Sequence
  MKO10115190_B_Serpina12
  gRNA
auucgacccaaaacagacca

SEQ ID NO: 115191 - RNA, 20 nt, Artificial Sequence
  MKO10115191_B_Serpina1a
  gRNA
uaaagagaauguaauuugcc

SEQ ID NO: 115192 - RNA, 20 nt, Artificial Sequence
  MKO10115192_B_Serpina1a
  gRNA
auucgauccugagaacacug

SEQ ID NO: 115193 - RNA, 20 nt, Artificial Sequence
  MKO10115193_B_Serpina1a
  gRNA
uuccccagacuguccaucuc

SEQ ID NO: 115194 - RNA, 20 nt, Artificial Sequence
  MKO10115194_B_Serpina1b
  gRNA
ucuccucugugauuccagag

SEQ ID NO: 115195 - RNA, 20 nt, Artificial Sequence
  MKO10115195_B_Serpina1b
  gRNA
caaguuauagucuccagaga

SEQ ID NO: 115196 - RNA, 20 nt, Artificial Sequence
  MKO10115196_B_Serpina1b
  gRNA
guaggguggucauuuaugug

SEQ ID NO: 115197 - RNA, 20 nt, Artificial Sequence
  MKO10115197_B_Serpina1c
  gRNA
cacucagagcccccucuuug

SEQ ID NO: 115198 - RNA, 20 nt, Artificial Sequence
  MKO10115198_B_Serpina1c
  gRNA
aaaugacucccuccaucuca

SEQ ID NO: 115199 - RNA, 20 nt, Artificial Sequence
  MKO10115199_B_Serpina1c
  gRNA
uaaagagaauguaauuugcc

SEQ ID NO: 115200 - RNA, 20 nt, Artificial Sequence
  MKO10115200_B_Serpina1d
  gRNA
ggguggucgaagcgcacgau

SEQ ID NO: 115201 - RNA, 20 nt, Artificial Sequence
  MKO10115201_B_Serpina1d
  gRNA
gcacaucaagcaugcccgag

SEQ ID NO: 115202 - RNA, 20 nt, Artificial Sequence
  MKO10115202_B_Serpina1d
  gRNA
auccccagacuguccaucuc

SEQ ID NO: 115203 - RNA, 20 nt, Artificial Sequence
  MKO10115203_B_Serpina1e
  gRNA
cagcucccgguauagacuga

SEQ ID NO: 115204 - RNA, 20 nt, Artificial Sequence
  MKO10115204_B_Serpina1e
  gRNA
auugcagcacgcucuccagc

SEQ ID NO: 115205 - RNA, 20 nt, Artificial Sequence
  MKO10115205_B_Serpina1e
  gRNA
uaagcaagcugaguuccacg

SEQ ID NO: 115206 - RNA, 20 nt, Artificial Sequence
  MKO10115206_B_Serpina1f
  gRNA
cggagauccacaaguguuuc

SEQ ID NO: 115207 - RNA, 20 nt, Artificial Sequence
  MKO10115207_B_Serpina1f
  gRNA
uuaccacucugccuaaaaag

SEQ ID NO: 115208 - RNA, 20 nt, Artificial Sequence
  MKO10115208_B_Serpina1f
  gRNA
cuuccuacaggugguaagua

SEQ ID NO: 115209 - RNA, 20 nt, Artificial Sequence
  MKO10115209_B_Serpina3a
  gRNA
caggacagauucccgccauc

SEQ ID NO: 115210 - RNA, 20 nt, Artificial Sequence
  MKO10115210_B_Serpina3a
  gRNA
uaacauccagcgcagccugg

SEQ ID NO: 115211 - RNA, 20 nt, Artificial Sequence
  MKO10115211_B_Serpina3a
  gRNA
ccauggauguguuccuaugc

SEQ ID NO: 115212 - RNA, 20 nt, Artificial Sequence
  MKO10115212_B_Serpina3b
  gRNA
uaacucugaugacacguuca

SEQ ID NO: 115213 - RNA, 20 nt, Artificial Sequence
  MKO10115213_B_Serpina3b
  gRNA
ugauaaccuugcccauuaca

SEQ ID NO: 115214 - RNA, 20 nt, Artificial Sequence
  MKO10115214_B_Serpina3b
  gRNA
auaaggagaacuuggguaag

SEQ ID NO: 115215 - RNA, 20 nt, Artificial Sequence
  MKO10115215_B_Serpina3c
  gRNA
caaggaccugauagugucuc

SEQ ID NO: 115216 - RNA, 20 nt, Artificial Sequence
  MKO10115216_B_Serpina3c
  gRNA
gucuuaccugagacacuauc

SEQ ID NO: 115217 - RNA, 20 nt, Artificial Sequence
  MKO10115217_B_Serpina3c
  gRNA
uguccuguugaaccacagac

SEQ ID NO: 115218 - RNA, 20 nt, Artificial Sequence
  MKO10115218_B_Serpina3f
  gRNA
cagugccauguucauccucc

SEQ ID NO: 115219 - RNA, 20 nt, Artificial Sequence
  MKO10115219_B_Serpina3f
  gRNA
ugauugcagacaggucagcc

SEQ ID NO: 115220 - RNA, 20 nt, Artificial Sequence
  MKO10115220_B_Serpina3f
  gRNA
gcccagaugucacccuggga

SEQ ID NO: 115221 - RNA, 20 nt, Artificial Sequence
  MKO10115221_B_Serpina3g
  gRNA
aagaucaaggaacucaucuc

SEQ ID NO: 115222 - RNA, 20 nt, Artificial Sequence
  MKO10115222_B_Serpina3g
  gRNA
gcccagaugucacccuggga

SEQ ID NO: 115223 - RNA, 20 nt, Artificial Sequence
  MKO10115223_B_Serpina3g
  gRNA
acuucccugaugcccaacuc

SEQ ID NO: 115224 - RNA, 20 nt, Artificial Sequence
  MKO10115224_B_Serpina3i
  gRNA
gacugccguguuccuuucca

SEQ ID NO: 115225 - RNA, 20 nt, Artificial Sequence
  MKO10115225_B_Serpina3i
  gRNA
aacuaacuacacccuacuuc

SEQ ID NO: 115226 - RNA, 20 nt, Artificial Sequence
  MKO10115226_B_Serpina3i
  gRNA
uacucacauugcccucuuca

SEQ ID NO: 115227 - RNA, 20 nt, Artificial Sequence
  MKO10115227_B_Serpina3j
  gRNA
accacucucaccguuaaaga

SEQ ID NO: 115228 - RNA, 20 nt, Artificial Sequence
  MKO10115228_B_Serpina3j
  gRNA
guguuaagguuaacaacugu

SEQ ID NO: 115229 - RNA, 20 nt, Artificial Sequence
  MKO10115229_B_Serpina3j
  gRNA
acuuagcaucacaauugccu

SEQ ID NO: 115230 - RNA, 20 nt, Artificial Sequence
  MKO10115230_B_Serpina3k
  gRNA
cuacuugggguuauugacuu

SEQ ID NO: 115231 - RNA, 20 nt, Artificial Sequence
  MKO10115231_B_Serpina3k
  gRNA
ugcacgccacuuccgugaug

SEQ ID NO: 115232 - RNA, 20 nt, Artificial Sequence
  MKO10115232_B_Serpina3k
  gRNA
agcacgauagcuccucauca

SEQ ID NO: 115233 - RNA, 20 nt, Artificial Sequence
  MKO10115233_B_Serpina3m
  gRNA
cacacgccacuuccgugaug

SEQ ID NO: 115234 - RNA, 20 nt, Artificial Sequence
  MKO10115234_B_Serpina3m
  gRNA
ucacuugggguuagugacuu

SEQ ID NO: 115235 - RNA, 20 nt, Artificial Sequence
  MKO10115235_B_Serpina3m
  gRNA
gccaaugugagacugucauc

SEQ ID NO: 115236 - RNA, 20 nt, Artificial Sequence
  MKO10115236_B_Serpina3n
  gRNA
guccaagaagaccaugacaa

SEQ ID NO: 115237 - RNA, 20 nt, Artificial Sequence
  MKO10115237_B_Serpina3n
  gRNA
ugggacaaauuugacuccag

SEQ ID NO: 115238 - RNA, 20 nt, Artificial Sequence
  MKO10115238_B_Serpina3n
  gRNA
cugugucaaagaucauuauc

SEQ ID NO: 115239 - RNA, 20 nt, Artificial Sequence
  MKO10115239_B_Serpina5
  gRNA
gcgauggcauugccuugaua

SEQ ID NO: 115240 - RNA, 20 nt, Artificial Sequence
  MKO10115240_B_Serpina5
  gRNA
gauggugcacaaauccauga

SEQ ID NO: 115241 - RNA, 20 nt, Artificial Sequence
  MKO10115241_B_Serpina5
  gRNA
caccucagacaacuugauau

SEQ ID NO: 115242 - RNA, 20 nt, Artificial Sequence
  MKO10115242_B_Serpina6
  gRNA
aguaacuaauguugccugac

SEQ ID NO: 115243 - RNA, 20 nt, Artificial Sequence
  MKO10115243_B_Serpina6
  gRNA
gacacuuaccguuaauguca

SEQ ID NO: 115244 - RNA, 20 nt, Artificial Sequence
  MKO10115244_B_Serpina6
  gRNA
gcuccauguguacuugucaa

SEQ ID NO: 115245 - RNA, 20 nt, Artificial Sequence
  MKO10115245_B_Serpina7
  gRNA
agaacaauacuaucauuacg

SEQ ID NO: 115246 - RNA, 20 nt, Artificial Sequence
  MKO10115246_B_Serpina7
  gRNA
ucccgugacagaauuacaac

SEQ ID NO: 115247 - RNA, 20 nt, Artificial Sequence
  MKO10115247_B_Serpina7
  gRNA
acaccuccagaaucuguguu

SEQ ID NO: 115248 - RNA, 20 nt, Artificial Sequence
  MKO10115248_B_Serpina9
  gRNA
cagaccgagucguuugcuuu

SEQ ID NO: 115249 - RNA, 20 nt, Artificial Sequence
  MKO10115249_B_Serpina9
  gRNA
cgagguacucgaagcccaug

SEQ ID NO: 115250 - RNA, 20 nt, Artificial Sequence
  MKO10115250_B_Serpina9
  gRNA
ccuugagcggacuauaaguu

SEQ ID NO: 115251 - RNA, 20 nt, Artificial Sequence
  MKO10115251_B_Serpinb10
  gRNA
acguucuuaaaacagcuaac

SEQ ID NO: 115252 - RNA, 20 nt, Artificial Sequence
  MKO10115252_B_Serpinb10
  gRNA
ucaggaaggagaucaacucc

SEQ ID NO: 115253 - RNA, 20 nt, Artificial Sequence
  MKO10115253_B_Serpinb10
  gRNA
uuaagaacguaagaauuucc

SEQ ID NO: 115254 - RNA, 20 nt, Artificial Sequence
  MKO10115254_B_Serpinb11
  gRNA
agcguugcuaacagaaucua

SEQ ID NO: 115255 - RNA, 20 nt, Artificial Sequence
  MKO10115255_B_Serpinb11
  gRNA
aaaaucaacaguuugcagcu

SEQ ID NO: 115256 - RNA, 20 nt, Artificial Sequence
  MKO10115256_B_Serpinb11
  gRNA
aaagacgaaaaauucuucug

SEQ ID NO: 115257 - RNA, 20 nt, Artificial Sequence
  MKO10115257_B_Serpinb12
  gRNA
guugaauucucucucccacu

SEQ ID NO: 115258 - RNA, 20 nt, Artificial Sequence
  MKO10115258_B_Serpinb12
  gRNA
aucuuauuacacuuuaagua

SEQ ID NO: 115259 - RNA, 20 nt, Artificial Sequence
  MKO10115259_B_Serpinb12
  gRNA
aguggcagccaagcaauuga

SEQ ID NO: 115260 - RNA, 20 nt, Artificial Sequence
  MKO10115260_B_Serpinb13
  gRNA
augaccugaucauaagcaac

SEQ ID NO: 115261 - RNA, 20 nt, Artificial Sequence
  MKO10115261_B_Serpinb13
  gRNA
uagguacuuuacacugaaca

SEQ ID NO: 115262 - RNA, 20 nt, Artificial Sequence
  MKO10115262_B_Serpinb13
  gRNA
gcagcauuuacaaaaucaac

SEQ ID NO: 115263 - RNA, 20 nt, Artificial Sequence
  MKO10115263_B_Serpinb1a
  gRNA
ccacauucccuuaaaguaga

SEQ ID NO: 115264 - RNA, 20 nt, Artificial Sequence
  MKO10115264_B_Serpinb1a
  gRNA
guuugcucacuucagcauuc

SEQ ID NO: 115265 - RNA, 20 nt, Artificial Sequence
  MKO10115265_B_Serpinb1a
  gRNA
cgaguccacgggucuuaaga

SEQ ID NO: 115266 - RNA, 20 nt, Artificial Sequence
  MKO10115266_B_Serpinb1b
  gRNA
acuuacaggaaggaaauugu

SEQ ID NO: 115267 - RNA, 20 nt, Artificial Sequence
  MKO10115267_B_Serpinb1b
  gRNA
gacugcugaagugagcaagc

SEQ ID NO: 115268 - RNA, 20 nt, Artificial Sequence
  MKO10115268_B_Serpinb1b
  gRNA
gaaaauguacagugcugacu

SEQ ID NO: 115269 - RNA, 20 nt, Artificial Sequence
  MKO10115269_B_Serpinb1c
  gRNA
acugcugaagugagcaagcg

SEQ ID NO: 115270 - RNA, 20 nt, Artificial Sequence
  MKO10115270_B_Serpinb1c
  gRNA
cugccacauucccuugaaau

SEQ ID NO: 115271 - RNA, 20 nt, Artificial Sequence
  MKO10115271_B_Serpinb1c
  gRNA
acuuacaggaaggaaguugu

SEQ ID NO: 115272 - RNA, 20 nt, Artificial Sequence
  MKO10115272_B_Serpinb2
  gRNA
ucuaacaaauaaucccccug

SEQ ID NO: 115273 - RNA, 20 nt, Artificial Sequence
  MKO10115273_B_Serpinb2
  gRNA
uagcuucuucagcacauuca

SEQ ID NO: 115274 - RNA, 20 nt, Artificial Sequence
  MKO10115274_B_Serpinb2
  gRNA
gaaagugcaaacaagcuguu

SEQ ID NO: 115275 - RNA, 20 nt, Artificial Sequence
  MKO10115275_B_Serpinb3a
  gRNA
gaaaaacuuaccuggacaaa

SEQ ID NO: 115276 - RNA, 20 nt, Artificial Sequence
  MKO10115276_B_Serpinb3a
  gRNA
auuuguuuggcuuucuaccc

SEQ ID NO: 115277 - RNA, 20 nt, Artificial Sequence
  MKO10115277_B_Serpinb3a
  gRNA
ucaagcuaacguggaaucac

SEQ ID NO: 115278 - RNA, 20 nt, Artificial Sequence
  MKO10115278_B_Serpinb3b
  gRNA
gaaaaacuuaccuggagaaa

SEQ ID NO: 115279 - RNA, 20 nt, Artificial Sequence
  MKO10115279_B_Serpinb3b
  gRNA
gcgaaaagaagauuaauucc

SEQ ID NO: 115280 - RNA, 20 nt, Artificial Sequence
  MKO10115280_B_Serpinb3b
  gRNA
caaugaugauuaugaccuga

SEQ ID NO: 115281 - RNA, 20 nt, Artificial Sequence
  MKO10115281_B_Serpinb3c
  gRNA
ucaugcuaacguggaaucac

SEQ ID NO: 115282 - RNA, 20 nt, Artificial Sequence
  MKO10115282_B_Serpinb3c
  gRNA
gugaaaagaagauuaauuuc

SEQ ID NO: 115283 - RNA, 20 nt, Artificial Sequence
  MKO10115283_B_Serpinb3c
  gRNA
caaugaugauuaugaccuga

SEQ ID NO: 115284 - RNA, 20 nt, Artificial Sequence
  MKO10115284_B_Serpinb3d
  gRNA
guacaacuuaccuggagaaa

SEQ ID NO: 115285 - RNA, 20 nt, Artificial Sequence
  MKO10115285_B_Serpinb3d
  gRNA
auaccagagaagaaaaguuu

SEQ ID NO: 115286 - RNA, 20 nt, Artificial Sequence
  MKO10115286_B_Serpinb3d
  gRNA
uuaccuugcaggaaaaauca

SEQ ID NO: 115287 - RNA, 20 nt, Artificial Sequence
  MKO10115287_B_Serpinb5
  gRNA
ucaaauuaacagcuccauua

SEQ ID NO: 115288 - RNA, 20 nt, Artificial Sequence
  MKO10115288_B_Serpinb5
  gRNA
cugccuacuuuguuggaaag

SEQ ID NO: 115289 - RNA, 20 nt, Artificial Sequence
  MKO10115289_B_Serpinb5
  gRNA
agugacuguuugaaacccaa

SEQ ID NO: 115290 - RNA, 20 nt, Artificial Sequence
  MKO10115290_B_Serpinb6a
  gRNA
uugauuucaggcacuugcuu

SEQ ID NO: 115291 - RNA, 20 nt, Artificial Sequence
  MKO10115291_B_Serpinb6a
  gRNA
cacugcuagccagauggcuc

SEQ ID NO: 115292 - RNA, 20 nt, Artificial Sequence
  MKO10115292_B_Serpinb6a
  gRNA
cuuauccccgaagagccugu

SEQ ID NO: 115293 - RNA, 20 nt, Artificial Sequence
  MKO10115293_B_Serpinb6b
  gRNA
aaugccuuucaaugucacca

SEQ ID NO: 115294 - RNA, 20 nt, Artificial Sequence
  MKO10115294_B_Serpinb6b
  gRNA
aguaaauucaaacacuccac

SEQ ID NO: 115295 - RNA, 20 nt, Artificial Sequence
  MKO10115295_B_Serpinb6b
  gRNA
cccgacagcacaucaacgcc

SEQ ID NO: 115296 - RNA, 20 nt, Artificial Sequence
  MKO10115296_B_Serpinb6c
  gRNA
cucagcgaagugaacaagac

SEQ ID NO: 115297 - RNA, 20 nt, Artificial Sequence
  MKO10115297_B_Serpinb6c
  gRNA
caaguucuaugaagcagaga

SEQ ID NO: 115298 - RNA, 20 nt, Artificial Sequence
  MKO10115298_B_Serpinb6c
  gRNA
cccgacagcacaucaacacc

SEQ ID NO: 115299 - RNA, 20 nt, Artificial Sequence
  MKO10115299_B_Serpinb6d
  gRNA
agugaauucaaacacuagac

SEQ ID NO: 115300 - RNA, 20 nt, Artificial Sequence
  MKO10115300_B_Serpinb6d
  gRNA
aucaaagaccugcuaucucc

SEQ ID NO: 115301 - RNA, 20 nt, Artificial Sequence
  MKO10115301_B_Serpinb6d
  gRNA
guucagcuuauucccagcau

SEQ ID NO: 115302 - RNA, 20 nt, Artificial Sequence
  MKO10115302_B_Serpinb6e
  gRNA
gaagugaacaagacugacac

SEQ ID NO: 115303 - RNA, 20 nt, Artificial Sequence
  MKO10115303_B_Serpinb6e
  gRNA
cucagcucuuugucaguaua

SEQ ID NO: 115304 - RNA, 20 nt, Artificial Sequence
  MKO10115304_B_Serpinb6e
  gRNA
auacagugaauucaaacacu

SEQ ID NO: 115305 - RNA, 20 nt, Artificial Sequence
  MKO10115305_B_Serpinb7
  gRNA
ugacauaaacucaucucaua

SEQ ID NO: 115306 - RNA, 20 nt, Artificial Sequence
  MKO10115306_B_Serpinb7
  gRNA
aaacuuauacaaugcuaaag

SEQ ID NO: 115307 - RNA, 20 nt, Artificial Sequence
  MKO10115307_B_Serpinb7
  gRNA
uuuaacauaccaucaagaca

SEQ ID NO: 115308 - RNA, 20 nt, Artificial Sequence
  MKO10115308_B_Serpinb8
  gRNA
gcaugccucucguguacuuu

SEQ ID NO: 115309 - RNA, 20 nt, Artificial Sequence
  MKO10115309_B_Serpinb8
  gRNA
gcgagaucagugcuuucauc

SEQ ID NO: 115310 - RNA, 20 nt, Artificial Sequence
  MKO10115310_B_Serpinb8
  gRNA
uaauuucagcgagaaguguc

SEQ ID NO: 115311 - RNA, 20 nt, Artificial Sequence
  MKO10115311_B_Serpinb9b
  gRNA
agcuggcaacucauccacaa

SEQ ID NO: 115312 - RNA, 20 nt, Artificial Sequence
  MKO10115312_B_Serpinb9b
  gRNA
uugcugauaaugcccuauga

SEQ ID NO: 115313 - RNA, 20 nt, Artificial Sequence
  MKO10115313_B_Serpinb9b
  gRNA
auucugaccuucagucuguu

SEQ ID NO: 115314 - RNA, 20 nt, Artificial Sequence
  MKO10115314_B_Serpinb9c
  gRNA
guucucugcaaagagccuau

SEQ ID NO: 115315 - RNA, 20 nt, Artificial Sequence
  MKO10115315_B_Serpinb9c
  gRNA
ucaggauauugagaauccac

SEQ ID NO: 115316 - RNA, 20 nt, Artificial Sequence
  MKO10115316_B_Serpinb9c
  gRNA
gagccacuugacaacaauuc

SEQ ID NO: 115317 - RNA, 20 nt, Artificial Sequence
  MKO10115317_B_Serpinb9d
  gRNA
cugauguccacacccuuauc

SEQ ID NO: 115318 - RNA, 20 nt, Artificial Sequence
  MKO10115318_B_Serpinb9d
  gRNA
uaaauucuaucacucugaga

SEQ ID NO: 115319 - RNA, 20 nt, Artificial Sequence
  MKO10115319_B_Serpinb9d
  gRNA
cccagaugaagauguccauc

SEQ ID NO: 115320 - RNA, 20 nt, Artificial Sequence
  MKO10115320_B_Serpinb9e
  gRNA
cgugguccuacucccagauc

SEQ ID NO: 115321 - RNA, 20 nt, Artificial Sequence
  MKO10115321_B_Serpinb9e
  gRNA
uuucuuaccuuuagucuguu

SEQ ID NO: 115322 - RNA, 20 nt, Artificial Sequence
  MKO10115322_B_Serpinb9e
  gRNA
cccagaugaagauguccauc

SEQ ID NO: 115323 - RNA, 20 nt, Artificial Sequence
  MKO10115323_B_Serpinb9f
  gRNA
uaaauucuaccacucugaga

SEQ ID NO: 115324 - RNA, 20 nt, Artificial Sequence
  MKO10115324_B_Serpinb9f
  gRNA
ccuuaccuuguuuaucuuaa

SEQ ID NO: 115325 - RNA, 20 nt, Artificial Sequence
  MKO10115325_B_Serpinb9f
  gRNA
acucaguuaauucacagacc

SEQ ID NO: 115326 - RNA, 20 nt, Artificial Sequence
  MKO10115326_B_Serpinb9g
  gRNA
cuucuuaccauuagucuguu

SEQ ID NO: 115327 - RNA, 20 nt, Artificial Sequence
  MKO10115327_B_Serpinb9g
  gRNA
uaaauucuaccacucugaga

SEQ ID NO: 115328 - RNA, 20 nt, Artificial Sequence
  MKO10115328_B_Serpinb9g
  gRNA
ccuuaccuuguuuaucuuaa

SEQ ID NO: 115329 - RNA, 20 nt, Artificial Sequence
  MKO10115329_B_Serpinb9
  gRNA
cgccugcaccuccuucacau

SEQ ID NO: 115330 - RNA, 20 nt, Artificial Sequence
  MKO10115330_B_Serpinb9
  gRNA
cagaaaguacucucuuagag

SEQ ID NO: 115331 - RNA, 20 nt, Artificial Sequence
  MKO10115331_B_Serpinb9
  gRNA
cuaagagaguacuuucuguc

SEQ ID NO: 115332 - RNA, 20 nt, Artificial Sequence
  MKO10115332_B_Serpinc1
  gRNA
uugugcauuuaccgcucccc

SEQ ID NO: 115333 - RNA, 20 nt, Artificial Sequence
  MKO10115333_B_Serpinc1
  gRNA
gcuaugcagaugucguccac

SEQ ID NO: 115334 - RNA, 20 nt, Artificial Sequence
  MKO10115334_B_Serpinc1
  gRNA
cagggcagugagcucguuaa

SEQ ID NO: 115335 - RNA, 20 nt, Artificial Sequence
  MKO10115335_B_Serpind1
  gRNA
uuuccuugcggcaaaugacc

SEQ ID NO: 115336 - RNA, 20 nt, Artificial Sequence
  MKO10115336_B_Serpind1
  gRNA
agggacggucgacagugaau

SEQ ID NO: 115337 - RNA, 20 nt, Artificial Sequence
  MKO10115337_B_Serpind1
  gRNA
uucauucccgauagcuuccg

SEQ ID NO: 115338 - RNA, 20 nt, Artificial Sequence
  MKO10115338_B_Serpine1
  gRNA
gcugaguucaccacccccga

SEQ ID NO: 115339 - RNA, 20 nt, Artificial Sequence
  MKO10115339_B_Serpine1
  gRNA
ugacauguuuagugcaaccc

SEQ ID NO: 115340 - RNA, 20 nt, Artificial Sequence
  MKO10115340_B_Serpine1
  gRNA
ccagauuuaucaucaaugac

SEQ ID NO: 115341 - RNA, 20 nt, Artificial Sequence
  MKO10115341_B_Serpine2
  gRNA
cuaccaagaccauugauagc

SEQ ID NO: 115342 - RNA, 20 nt, Artificial Sequence
  MKO10115342_B_Serpine2
  gRNA
aaauaaagacauugugaccg

SEQ ID NO: 115343 - RNA, 20 nt, Artificial Sequence
  MKO10115343_B_Serpine2
  gRNA
agugcugaagaagaucaaca

SEQ ID NO: 115344 - RNA, 20 nt, Artificial Sequence
  MKO10115344_B_Serpine3
  gRNA
auguuccgguuugcaugaac

SEQ ID NO: 115345 - RNA, 20 nt, Artificial Sequence
  MKO10115345_B_Serpine3
  gRNA
uguucuagagcuguuguacc

SEQ ID NO: 115346 - RNA, 20 nt, Artificial Sequence
  MKO10115346_B_Serpine3
  gRNA
ggggagaaacacauccauuc

SEQ ID NO: 115347 - RNA, 20 nt, Artificial Sequence
  MKO10115347_B_Serpinf1
  gRNA
gacagcaggacguugcccgu

SEQ ID NO: 115348 - RNA, 20 nt, Artificial Sequence
  MKO10115348_B_Serpinf1
  gRNA
ccuugaaguaagccacgcca

SEQ ID NO: 115349 - RNA, 20 nt, Artificial Sequence
  MKO10115349_B_Serpinf1
  gRNA
cucgagaaagacgacccucc

SEQ ID NO: 115350 - RNA, 20 nt, Artificial Sequence
  MKO10115350_B_Serpinf2
  gRNA
accuuucugcagguauauuc

SEQ ID NO: 115351 - RNA, 20 nt, Artificial Sequence
  MKO10115351_B_Serpinf2
  gRNA
uguccugucaccccuuagug

SEQ ID NO: 115352 - RNA, 20 nt, Artificial Sequence
  MKO10115352_B_Serpinf2
  gRNA
gugaccaugcuacccucaag

SEQ ID NO: 115353 - RNA, 20 nt, Artificial Sequence
  MKO10115353_B_Serping1
  gRNA
cucguuggcuacuuuaccca

SEQ ID NO: 115354 - RNA, 20 nt, Artificial Sequence
  MKO10115354_B_Serping1
  gRNA
gaguagcguaaaguacccug

SEQ ID NO: 115355 - RNA, 20 nt, Artificial Sequence
  MKO10115355_B_Serping1
  gRNA
cuacaguacugcccucuacc

SEQ ID NO: 115356 - RNA, 20 nt, Artificial Sequence
  MKO10115356_B_Serpinh1
  gRNA
cgcugagaagcugcgcgaug

SEQ ID NO: 115357 - RNA, 20 nt, Artificial Sequence
  MKO10115357_B_Serpinh1
  gRNA
caacuacuaugacgacgaga

SEQ ID NO: 115358 - RNA, 20 nt, Artificial Sequence
  MKO10115358_B_Serpinh1
  gRNA
cgcucugauuaucucgcacc

SEQ ID NO: 115359 - RNA, 20 nt, Artificial Sequence
  MKO10115359_B_Serpini1
  gRNA
guagauaccaccagccucau

SEQ ID NO: 115360 - RNA, 20 nt, Artificial Sequence
  MKO10115360_B_Serpini1
  gRNA
ucuccuuguugauacaucau

SEQ ID NO: 115361 - RNA, 20 nt, Artificial Sequence
  MKO10115361_B_Serpini1
  gRNA
gcaaauuugacugccauguc

SEQ ID NO: 115362 - RNA, 20 nt, Artificial Sequence
  MKO10115362_B_Serpini2
  gRNA
agacacgagcaucgaagaag

SEQ ID NO: 115363 - RNA, 20 nt, Artificial Sequence
  MKO10115363_B_Serpini2
  gRNA
agugcccucuaccuucaaga

SEQ ID NO: 115364 - RNA, 20 nt, Artificial Sequence
  MKO10115364_B_Serpini2
  gRNA
ucacaaugaauccuucuuga

SEQ ID NO: 115365 - RNA, 20 nt, Artificial Sequence
  MKO10115365_B_Seruad1
  gRNA
aacuccgccucauccaacuc

SEQ ID NO: 115366 - RNA, 20 nt, Artificial Sequence
  MKO10115366_B_Seruad1
  gRNA
gugagauccccccgauggag

SEQ ID NO: 115367 - RNA, 20 nt, Artificial Sequence
  MKO10115367_B_Seruad1
  gRNA
gguccggcucgcucugccgc

SEQ ID NO: 115368 - RNA, 20 nt, Artificial Sequence
  MKO10115368_B_Seruad2
  gRNA
cuccgccuuggaugagaucg

SEQ ID NO: 115369 - RNA, 20 nt, Artificial Sequence
  MKO10115369_B_Seruad2
  gRNA
agacacccuggauggaccgu

SEQ ID NO: 115370 - RNA, 20 nt, Artificial Sequence
  MKO10115370_B_Seruad2
  gRNA
uguagugcuuccgaggucac

SEQ ID NO: 115371 - RNA, 20 nt, Artificial Sequence
  MKO10115371_B_Seruad3
  gRNA
ccugggacacgaucucauuc

SEQ ID NO: 115372 - RNA, 20 nt, Artificial Sequence
  MKO10115372_B_Seruad3
  gRNA
agcccugcuccgaaucucuc

SEQ ID NO: 115373 - RNA, 20 nt, Artificial Sequence
  MKO10115373_B_Seruad3
  gRNA
cagggagcuagauacaucca

SEQ ID NO: 115374 - RNA, 20 nt, Artificial Sequence
  MKO10115374_B_Seruad4
  gRNA
uugccggguaccaaacacua

SEQ ID NO: 115375 - RNA, 20 nt, Artificial Sequence
  MKO10115375_B_Seruad4
  gRNA
uuaccacaggaucacauuac

SEQ ID NO: 115376 - RNA, 20 nt, Artificial Sequence
  MKO10115376_B_Seruad4
  gRNA
ccucuugaaguaugugaccu

SEQ ID NO: 115377 - RNA, 20 nt, Artificial Sequence
  MKO10115377_B_Sertm1
  gRNA
cucuuccagcuccucguacc

SEQ ID NO: 115378 - RNA, 20 nt, Artificial Sequence
  MKO10115378_B_Sertm1
  gRNA
aaagaacucccagcgucacu

SEQ ID NO: 115379 - RNA, 20 nt, Artificial Sequence
  MKO10115379_B_Sertm1
  gRNA
gaguucuuucaccaaccuag

SEQ ID NO: 115380 - RNA, 20 nt, Artificial Sequence
  MKO10115380_B_Sesn1
  gRNA
aguccagagauucauugcga

SEQ ID NO: 115381 - RNA, 20 nt, Artificial Sequence
  MKO10115381_B_Sesn1
  gRNA
cacuaggacacggaccaagc

SEQ ID NO: 115382 - RNA, 20 nt, Artificial Sequence
  MKO10115382_B_Sesn1
  gRNA
ggauaacaucacauuaguga

SEQ ID NO: 115383 - RNA, 20 nt, Artificial Sequence
  MKO10115383_B_Sesn2
  gRNA
ccacccgcccugaggacauc

SEQ ID NO: 115384 - RNA, 20 nt, Artificial Sequence
  MKO10115384_B_Sesn2
  gRNA
cggacuaccuuagcagcuuc

SEQ ID NO: 115385 - RNA, 20 nt, Artificial Sequence
  MKO10115385_B_Sesn2
  gRNA
cagccacucggggucaccgc

SEQ ID NO: 115386 - RNA, 20 nt, Artificial Sequence
  MKO10115386_B_Sesn3
  gRNA
gccugagcuagugcacgccg

SEQ ID NO: 115387 - RNA, 20 nt, Artificial Sequence
  MKO10115387_B_Sesn3
  gRNA
cgcugaguggcugaauggcu

SEQ ID NO: 115388 - RNA, 20 nt, Artificial Sequence
  MKO10115388_B_Sesn3
  gRNA
gugucucaaccccugacaag

SEQ ID NO: 115389 - RNA, 20 nt, Artificial Sequence
  MKO10115389_B_Sestd1
  gRNA
auuaucuacucagcauucca

SEQ ID NO: 115390 - RNA, 20 nt, Artificial Sequence
  MKO10115390_B_Sestd1
  gRNA
uauguaacgcgucaacuuau

SEQ ID NO: 115391 - RNA, 20 nt, Artificial Sequence
  MKO10115391_B_Sestd1
  gRNA
acagaauguuguuccagccg

SEQ ID NO: 115392 - RNA, 20 nt, Artificial Sequence
  MKO10115392_B_Setbp1
  gRNA
gcagcccucacaguucgaug

SEQ ID NO: 115393 - RNA, 20 nt, Artificial Sequence
  MKO10115393_B_Setbp1
  gRNA
agagauaacacgggugcuga

SEQ ID NO: 115394 - RNA, 20 nt, Artificial Sequence
  MKO10115394_B_Setbp1
  gRNA
agcagcacacaguaagagcg

SEQ ID NO: 115395 - RNA, 20 nt, Artificial Sequence
  MKO10115395_B_Setd1a
  gRNA
cuguguccgaggaagaccgu

SEQ ID NO: 115396 - RNA, 20 nt, Artificial Sequence
  MKO10115396_B_Setd1a
  gRNA
ggacucaaaguauacccccg

SEQ ID NO: 115397 - RNA, 20 nt, Artificial Sequence
  MKO10115397_B_Setd1a
  gRNA
ccccgcacucgaaagcaccu

SEQ ID NO: 115398 - RNA, 20 nt, Artificial Sequence
  MKO10115398_B_Setd1b
  gRNA
ggucugagggguguaccggc

SEQ ID NO: 115399 - RNA, 20 nt, Artificial Sequence
  MKO10115399_B_Setd1b
  gRNA
gcagaucgaugaguucuacg

SEQ ID NO: 115400 - RNA, 20 nt, Artificial Sequence
  MKO10115400_B_Setd1b
  gRNA
gauugugagcgagacccugc

SEQ ID NO: 115401 - RNA, 20 nt, Artificial Sequence
  MKO10115401_B_Setd2
  gRNA
aguuccucucgauguccaaa

SEQ ID NO: 115402 - RNA, 20 nt, Artificial Sequence
  MKO10115402_B_Setd2
  gRNA
aucgucuccucaugauugaa

SEQ ID NO: 115403 - RNA, 20 nt, Artificial Sequence
  MKO10115403_B_Setd2
  gRNA
cuggggcuuaagggcugcua

SEQ ID NO: 115404 - RNA, 20 nt, Artificial Sequence
  MKO10115404_B_Setd3
  gRNA
acuucccugaucuaaugaaa

SEQ ID NO: 115405 - RNA, 20 nt, Artificial Sequence
  MKO10115405_B_Setd3
  gRNA
ugaaaacggggcuucugucg

SEQ ID NO: 115406 - RNA, 20 nt, Artificial Sequence
  MKO10115406_B_Setd3
  gRNA
acagucauuaguaacuuucg

SEQ ID NO: 115407 - RNA, 20 nt, Artificial Sequence
  MKO10115407_B_Setd4
  gRNA
gcuucgaaucacaguguccg

SEQ ID NO: 115408 - RNA, 20 nt, Artificial Sequence
  MKO10115408_B_Setd4
  gRNA
uuaguacccgccagcuuucc

SEQ ID NO: 115409 - RNA, 20 nt, Artificial Sequence
  MKO10115409_B_Setd4
  gRNA
acugugauucgaagcucccu

SEQ ID NO: 115410 - RNA, 20 nt, Artificial Sequence
  MKO10115410_B_Setd5
  gRNA
aucccucguucugaccugaa

SEQ ID NO: 115411 - RNA, 20 nt, Artificial Sequence
  MKO10115411_B_Setd5
  gRNA
cccucuuuaggggaaugagc

SEQ ID NO: 115412 - RNA, 20 nt, Artificial Sequence
  MKO10115412_B_Setd5
  gRNA
ggaagguuauuagacuucau

SEQ ID NO: 115413 - RNA, 20 nt, Artificial Sequence
  MKO10115413_B_Setd6
  gRNA
uaaugccaaucuagaguacu

SEQ ID NO: 115414 - RNA, 20 nt, Artificial Sequence
  MKO10115414_B_Setd6
  gRNA
ggcgcugcuccacgagcucc

SEQ ID NO: 115415 - RNA, 20 nt, Artificial Sequence
  MKO10115415_B_Setd6
  gRNA
ggcgcgcugcagagccuguc

SEQ ID NO: 115416 - RNA, 20 nt, Artificial Sequence
  MKO10115416_B_Setd7
  gRNA
gugacagugcagaacccgug

SEQ ID NO: 115417 - RNA, 20 nt, Artificial Sequence
  MKO10115417_B_Setd7
  gRNA
cuucauugacuuccccgacg

SEQ ID NO: 115418 - RNA, 20 nt, Artificial Sequence
  MKO10115418_B_Setd7
  gRNA
gucuggaaggagagcaucgc

SEQ ID NO: 115419 - RNA, 20 nt, Artificial Sequence
  MKO10115419_B_Setd8
  gRNA
agcccugaaaaagucccuca

SEQ ID NO: 115420 - RNA, 20 nt, Artificial Sequence
  MKO10115420_B_Setd8
  gRNA
gaacucgguugcccaucaug

SEQ ID NO: 115421 - RNA, 20 nt, Artificial Sequence
  MKO10115421_B_Setd8
  gRNA
agcgcuucguauaacguucc

SEQ ID NO: 115422 - RNA, 20 nt, Artificial Sequence
  MKO10115422_B_Setdb1
  gRNA
cagaacuccaaaagaccaga

SEQ ID NO: 115423 - RNA, 20 nt, Artificial Sequence
  MKO10115423_B_Setdb1
  gRNA
caaagcauguccucccuccc

SEQ ID NO: 115424 - RNA, 20 nt, Artificial Sequence
  MKO10115424_B_Setdb1
  gRNA
ucugcagagucagcugcagc

SEQ ID NO: 115425 - RNA, 20 nt, Artificial Sequence
  MKO10115425_B_Setdb2
  gRNA
ggaguugucacaugaugcag

SEQ ID NO: 115426 - RNA, 20 nt, Artificial Sequence
  MKO10115426_B_Setdb2
  gRNA
cauuuacuagauucauugcu

SEQ ID NO: 115427 - RNA, 20 nt, Artificial Sequence
  MKO10115427_B_Setdb2
  gRNA
ucuucuguuucagugaaugu

SEQ ID NO: 115428 - RNA, 20 nt, Artificial Sequence
  MKO10115428_B_Setmar
  gRNA
agaccauaaaugucugcgga

SEQ ID NO: 115429 - RNA, 20 nt, Artificial Sequence
  MKO10115429_B_Setmar
  gRNA
acgaugacaauuuaugccuu

SEQ ID NO: 115430 - RNA, 20 nt, Artificial Sequence
  MKO10115430_B_Setmar
  gRNA
ccacaguaacaaggcuuucg

SEQ ID NO: 115431 - RNA, 20 nt, Artificial Sequence
  MKO10115431_B_Setx
  gRNA
agaugacuauuaugacuuac

SEQ ID NO: 115432 - RNA, 20 nt, Artificial Sequence
  MKO10115432_B_Setx
  gRNA
agccauggauucacuguugc

SEQ ID NO: 115433 - RNA, 20 nt, Artificial Sequence
  MKO10115433_B_Setx
  gRNA
cauguuguugacuauucuug

SEQ ID NO: 115434 - RNA, 20 nt, Artificial Sequence
  MKO10115434_B_Set
  gRNA
aauguuguuacccaaaaauu

SEQ ID NO: 115435 - RNA, 20 nt, Artificial Sequence
  MKO10115435_B_Set
  gRNA
aaauucugucacuucaacuc

SEQ ID NO: 115436 - RNA, 20 nt, Artificial Sequence
  MKO10115436_B_Set
  gRNA
uccagauuuccauuugauuu

SEQ ID NO: 115437 - RNA, 20 nt, Artificial Sequence
  MKO10115437_B_Sez6l2
  gRNA
cauguccuuacccucaaucc

SEQ ID NO: 115438 - RNA, 20 nt, Artificial Sequence
  MKO10115438_B_Sez6l2
  gRNA
ccuuccgcagcaaagcccca

SEQ ID NO: 115439 - RNA, 20 nt, Artificial Sequence
  MKO10115439_B_Sez6l2
  gRNA
agucgccauggggacuccca

SEQ ID NO: 115440 - RNA, 20 nt, Artificial Sequence
  MKO10115440_B_Sez6l
  gRNA
cagcagccccgguagcccgc

SEQ ID NO: 115441 - RNA, 20 nt, Artificial Sequence
  MKO10115441_B_Sez6l
  gRNA
cggugugagcuucuccgacc

SEQ ID NO: 115442 - RNA, 20 nt, Artificial Sequence
  MKO10115442_B_Sez6l
  gRNA
gcugcucuccauccgaggag

SEQ ID NO: 115443 - RNA, 20 nt, Artificial Sequence
  MKO10115443_B_Sez6
  gRNA
caggaacgacugguuagcca

SEQ ID NO: 115444 - RNA, 20 nt, Artificial Sequence
  MKO10115444_B_Sez6
  gRNA
uaaagacggggcgguugucc

SEQ ID NO: 115445 - RNA, 20 nt, Artificial Sequence
  MKO10115445_B_Sez6
  gRNA
acagucacaucuccauacgc

SEQ ID NO: 115446 - RNA, 20 nt, Artificial Sequence
  MKO10115446_B_Sf1
  gRNA
ugaaccaaucuacaacagcg

SEQ ID NO: 115447 - RNA, 20 nt, Artificial Sequence
  MKO10115447_B_Sf1
  gRNA
augccuacaguuauaccccc

SEQ ID NO: 115448 - RNA, 20 nt, Artificial Sequence
  MKO10115448_B_Sf1
  gRNA
gcccagcuuacccagcggcg

SEQ ID NO: 115449 - RNA, 20 nt, Artificial Sequence
  MKO10115449_B_Sf3a1
  gRNA
accugguccaaaacuucucg

SEQ ID NO: 115450 - RNA, 20 nt, Artificial Sequence
  MKO10115450_B_Sf3a1
  gRNA
ucgacgauguuccugaccuc

SEQ ID NO: 115451 - RNA, 20 nt, Artificial Sequence
  MKO10115451_B_Sf3a1
  gRNA
ccaugccuacuaccgccaca

SEQ ID NO: 115452 - RNA, 20 nt, Artificial Sequence
  MKO10115452_B_Sf3a2
  gRNA
cagggcccggcgagcugcca

SEQ ID NO: 115453 - RNA, 20 nt, Artificial Sequence
  MKO10115453_B_Sf3a2
  gRNA
ccucauuguuaugcagaguc

SEQ ID NO: 115454 - RNA, 20 nt, Artificial Sequence
  MKO10115454_B_Sf3a2
  gRNA
cccaccucaccuggaacagc

SEQ ID NO: 115455 - RNA, 20 nt, Artificial Sequence
  MKO10115455_B_Sf3a3
  gRNA
ccucauuugggugcuuccga

SEQ ID NO: 115456 - RNA, 20 nt, Artificial Sequence
  MKO10115456_B_Sf3a3
  gRNA
gagggauuuguaugaugaua

SEQ ID NO: 115457 - RNA, 20 nt, Artificial Sequence
  MKO10115457_B_Sf3a3
  gRNA
uccucaaauuccacugacau

SEQ ID NO: 115458 - RNA, 20 nt, Artificial Sequence
  MKO10115458_B_Sf3b1
  gRNA
uuuguauucaucuucccgau

SEQ ID NO: 115459 - RNA, 20 nt, Artificial Sequence
  MKO10115459_B_Sf3b1
  gRNA
uucucgcauaacauccaugu

SEQ ID NO: 115460 - RNA, 20 nt, Artificial Sequence
  MKO10115460_B_Sf3b1
  gRNA
gcgagaacaacauuugacua

SEQ ID NO: 115461 - RNA, 20 nt, Artificial Sequence
  MKO10115461_B_Sf3b2
  gRNA
ucacccacucgaagaggugg

SEQ ID NO: 115462 - RNA, 20 nt, Artificial Sequence
  MKO10115462_B_Sf3b2
  gRNA
ugcagucccucggccgccuc

SEQ ID NO: 115463 - RNA, 20 nt, Artificial Sequence
  MKO10115463_B_Sf3b2
  gRNA
ucuucuucugacagcgccac

SEQ ID NO: 115464 - RNA, 20 nt, Artificial Sequence
  MKO10115464_B_Sf3b3
  gRNA
acaccagaguguucgcuuug

SEQ ID NO: 115465 - RNA, 20 nt, Artificial Sequence
  MKO10115465_B_Sf3b3
  gRNA
gagcagauuagcacuccacu

SEQ ID NO: 115466 - RNA, 20 nt, Artificial Sequence
  MKO10115466_B_Sf3b3
  gRNA
gaaccacaugauuuaagcca

SEQ ID NO: 115467 - RNA, 20 nt, Artificial Sequence
  MKO10115467_B_Sf3b4
  gRNA
ggggugcaucggcaaacagc

SEQ ID NO: 115468 - RNA, 20 nt, Artificial Sequence
  MKO10115468_B_Sf3b4
  gRNA
ccucgggggggcaugcccau

SEQ ID NO: 115469 - RNA, 20 nt, Artificial Sequence
  MKO10115469_B_Sf3b4
  gRNA
uacgauacuuucagcgccuu

SEQ ID NO: 115470 - RNA, 20 nt, Artificial Sequence
  MKO10115470_B_Sf3b5
  gRNA
cuuguccgcgggcggcccgc

SEQ ID NO: 115471 - RNA, 20 nt, Artificial Sequence
  MKO10115471_B_Sf3b5
  gRNA
gcgggcuuugcucucguucu

SEQ ID NO: 115472 - RNA, 20 nt, Artificial Sequence
  MKO10115472_B_Sf3b5
  gRNA
gccacgccgacaccaccaag

SEQ ID NO: 115473 - RNA, 20 nt, Artificial Sequence
  MKO10115473_B_Sfi1
  gRNA
gagugacucccucuagagcc

SEQ ID NO: 115474 - RNA, 20 nt, Artificial Sequence
  MKO10115474_B_Sfi1
  gRNA
cacagagcuuccacucccuc

SEQ ID NO: 115475 - RNA, 20 nt, Artificial Sequence
  MKO10115475_B_Sfi1
  gRNA
ugagcagaaaauauuacaga

SEQ ID NO: 115476 - RNA, 20 nt, Artificial Sequence
  MKO10115476_B_Sfmbt1
  gRNA
accaguguucaaaaccguca

SEQ ID NO: 115477 - RNA, 20 nt, Artificial Sequence
  MKO10115477_B_Sfmbt1
  gRNA
aaagcuggccucuaccccau

SEQ ID NO: 115478 - RNA, 20 nt, Artificial Sequence
  MKO10115478_B_Sfmbt1
  gRNA
gaggaccacaggcuccuauc

SEQ ID NO: 115479 - RNA, 20 nt, Artificial Sequence
  MKO10115479_B_Sfmbt2
  gRNA
uuccucauccgugaauugac

SEQ ID NO: 115480 - RNA, 20 nt, Artificial Sequence
  MKO10115480_B_Sfmbt2
  gRNA
uccgagaaccagucaauuca

SEQ ID NO: 115481 - RNA, 20 nt, Artificial Sequence
  MKO10115481_B_Sfmbt2
  gRNA
cuucagcuggggagacuauu

SEQ ID NO: 115482 - RNA, 20 nt, Artificial Sequence
  MKO10115482_B_Sfn
  gRNA
uuccguagcuuacaagaacg

SEQ ID NO: 115483 - RNA, 20 nt, Artificial Sequence
  MKO10115483_B_Sfn
  gRNA
cgacaccguacucggccugc

SEQ ID NO: 115484 - RNA, 20 nt, Artificial Sequence
  MKO10115484_B_Sfn
  gRNA
gccuaccaaccccauccgcc

SEQ ID NO: 115485 - RNA, 20 nt, Artificial Sequence
  MKO10115485_B_Sfpq
  gRNA
gugccaugcugagcaaaacg

SEQ ID NO: 115486 - RNA, 20 nt, Artificial Sequence
  MKO10115486_B_Sfpq
  gRNA
ucgucaucuaacuguucaag

SEQ ID NO: 115487 - RNA, 20 nt, Artificial Sequence
  MKO10115487_B_Sfpq
  gRNA
gacuccucgcccagucauug

SEQ ID NO: 115488 - RNA, 20 nt, Artificial Sequence
  MKO10115488_B_Sfr1
  gRNA
cacgugugaaucuaagucgu

SEQ ID NO: 115489 - RNA, 20 nt, Artificial Sequence
  MKO10115489_B_Sfr1
  gRNA
ucaccccauucgaauaguuc

SEQ ID NO: 115490 - RNA, 20 nt, Artificial Sequence
  MKO10115490_B_Sfr1
  gRNA
caccugccguuccucagacc

SEQ ID NO: 115491 - RNA, 20 nt, Artificial Sequence
  MKO10115491_B_Sfrp1
  gRNA
cgacaacgaguugaagucag

SEQ ID NO: 115492 - RNA, 20 nt, Artificial Sequence
  MKO10115492_B_Sfrp1
  gRNA
ugcugacagccauucacaag

SEQ ID NO: 115493 - RNA, 20 nt, Artificial Sequence
  MKO10115493_B_Sfrp1
  gRNA
uuucuugucccacuugugaa

SEQ ID NO: 115494 - RNA, 20 nt, Artificial Sequence
  MKO10115494_B_Sfrp2
  gRNA
cacgccguucagcuuguaaa

SEQ ID NO: 115495 - RNA, 20 nt, Artificial Sequence
  MKO10115495_B_Sfrp2
  gRNA
gucguugucguccucauucu

SEQ ID NO: 115496 - RNA, 20 nt, Artificial Sequence
  MKO10115496_B_Sfrp2
  gRNA
uuugcaggcuucacacaccu

SEQ ID NO: 115497 - RNA, 20 nt, Artificial Sequence
  MKO10115497_B_Sfrp4
  gRNA
uugcaaugaggucacaacug

SEQ ID NO: 115498 - RNA, 20 nt, Artificial Sequence
  MKO10115498_B_Sfrp4
  gRNA
gacuguaaacgucugagccc

SEQ ID NO: 115499 - RNA, 20 nt, Artificial Sequence
  MKO10115499_B_Sfrp4
  gRNA
cugagcaaaaacuacagcua

SEQ ID NO: 115500 - RNA, 20 nt, Artificial Sequence
  MKO10115500_B_Sfrp5
  gRNA
ggucaugggccgcaaaguag

SEQ ID NO: 115501 - RNA, 20 nt, Artificial Sequence
  MKO10115501_B_Sfrp5
  gRNA
gcacagcgcugauggccuca

SEQ ID NO: 115502 - RNA, 20 nt, Artificial Sequence
  MKO10115502_B_Sfrp5
  gRNA
cgcugugcuccaucucacac

SEQ ID NO: 115503 - RNA, 20 nt, Artificial Sequence
  MKO10115503_B_Sfrs18
  gRNA
ggaacaauguccauugggcc

SEQ ID NO: 115504 - RNA, 20 nt, Artificial Sequence
  MKO10115504_B_Sfrs18
  gRNA
cuuccagccuggauucguga

SEQ ID NO: 115505 - RNA, 20 nt, Artificial Sequence
  MKO10115505_B_Sfrs18
  gRNA
uacgaugcuuugcuguccug

SEQ ID NO: 115506 - RNA, 20 nt, Artificial Sequence
  MKO10115506_B_Sfswap
  gRNA
ucccugcuugcauacgaagu

SEQ ID NO: 115507 - RNA, 20 nt, Artificial Sequence
  MKO10115507_B_Sfswap
  gRNA
gcugccguaagugaacccua

SEQ ID NO: 115508 - RNA, 20 nt, Artificial Sequence
  MKO10115508_B_Sfswap
  gRNA
uuaugacccgucagagccca

SEQ ID NO: 115509 - RNA, 20 nt, Artificial Sequence
  MKO10115509_B_Sft2d1
  gRNA
uaugacaaaccacuucaacc

SEQ ID NO: 115510 - RNA, 20 nt, Artificial Sequence
  MKO10115510_B_Sft2d1
  gRNA
caucccugaguuucaacacc

SEQ ID NO: 115511 - RNA, 20 nt, Artificial Sequence
  MKO10115511_B_Sft2d1
  gRNA
uuacccugugugcugcucug

SEQ ID NO: 115512 - RNA, 20 nt, Artificial Sequence
  MKO10115512_B_Sft2d2
  gRNA
guaacaucaugucaauuggg

SEQ ID NO: 115513 - RNA, 20 nt, Artificial Sequence
  MKO10115513_B_Sft2d2
  gRNA
cuucaucgcaugcuuugcuc

SEQ ID NO: 115514 - RNA, 20 nt, Artificial Sequence
  MKO10115514_B_Sft2d2
  gRNA
ucuuaguaccgucuuccuca

SEQ ID NO: 115515 - RNA, 20 nt, Artificial Sequence
  MKO10115515_B_Sft2d3
  gRNA
ccgucagcaccguacugcgc

SEQ ID NO: 115516 - RNA, 20 nt, Artificial Sequence
  MKO10115516_B_Sft2d3
  gRNA
cagcgccgucacaccgcccc

SEQ ID NO: 115517 - RNA, 20 nt, Artificial Sequence
  MKO10115517_B_Sft2d3
  gRNA
cgcuggccucgcgucacgcu

SEQ ID NO: 115518 - RNA, 20 nt, Artificial Sequence
  MKO10115518_B_Sfua2
  gRNA
gcuuucaggcucugcaagua

SEQ ID NO: 115519 - RNA, 20 nt, Artificial Sequence
  MKO10115519_B_Sfua2
  gRNA
ggucuuguccugaaaagucu

SEQ ID NO: 115520 - RNA, 20 nt, Artificial Sequence
  MKO10115520_B_Sfua2
  gRNA
cauuggucccugauggcaga

SEQ ID NO: 115521 - RNA, 20 nt, Artificial Sequence
  MKO10115521_B_Sftpa1
  gRNA
ccaggucuuccugggcgcga

SEQ ID NO: 115522 - RNA, 20 nt, Artificial Sequence
  MKO10115522_B_Sftpa1
  gRNA
caugguuugcccggcagaga

SEQ ID NO: 115523 - RNA, 20 nt, Artificial Sequence
  MKO10115523_B_Sftpa1
  gRNA
ccaggcagcccaucgcgccc

SEQ ID NO: 115524 - RNA, 20 nt, Artificial Sequence
  MKO10115524_B_Sftpb
  gRNA
ugcucucccaggaagcaauc

SEQ ID NO: 115525 - RNA, 20 nt, Artificial Sequence
  MKO10115525_B_Sftpb
  gRNA
ggccuugccaagagggcucc

SEQ ID NO: 115526 - RNA, 20 nt, Artificial Sequence
  MKO10115526_B_Sftpb
  gRNA
gagggccuugugcacacucc

SEQ ID NO: 115527 - RNA, 20 nt, Artificial Sequence
  MKO10115527_B_Sftpc
  gRNA
gucauacacaacgaugccag

SEQ ID NO: 115528 - RNA, 20 nt, Artificial Sequence
  MKO10115528_B_Sftpc
  gRNA
cuagcgaaagccucaagacu

SEQ ID NO: 115529 - RNA, 20 nt, Artificial Sequence
  MKO10115529_B_Sftpc
  gRNA
cugcucgcucacucggggcu

SEQ ID NO: 115530 - RNA, 20 nt, Artificial Sequence
  MKO10115530_B_Sftpd
  gRNA
caaggcaaaccagguccuaa

SEQ ID NO: 115531 - RNA, 20 nt, Artificial Sequence
  MKO10115531_B_Sftpd
  gRNA
ucaggagaaguaggugcucc

SEQ ID NO: 115532 - RNA, 20 nt, Artificial Sequence
  MKO10115532_B_Sftpd
  gRNA
ccucugucccccuugagucc

SEQ ID NO: 115533 - RNA, 20 nt, Artificial Sequence
  MKO10115533_B_Sfxn1
  gRNA
uucugcaaccacuggcgcug

SEQ ID NO: 115534 - RNA, 20 nt, Artificial Sequence
  MKO10115534_B_Sfxn1
  gRNA
aggcaaggaaucguuccugc

SEQ ID NO: 115535 - RNA, 20 nt, Artificial Sequence
  MKO10115535_B_Sfxn1
  gRNA
ugguuaaggcauugaguccu

SEQ ID NO: 115536 - RNA, 20 nt, Artificial Sequence
  MKO10115536_B_Sfxn2
  gRNA
cccgugaugagcaugccacc

SEQ ID NO: 115537 - RNA, 20 nt, Artificial Sequence
  MKO10115537_B_Sfxn2
  gRNA
aggcacccaucggcccacca

SEQ ID NO: 115538 - RNA, 20 nt, Artificial Sequence
  MKO10115538_B_Sfxn2
  gRNA
cagcuucccccacgucuguc

SEQ ID NO: 115539 - RNA, 20 nt, Artificial Sequence
  MKO10115539_B_Sfxn3
  gRNA
accaccuucucccccguguc

SEQ ID NO: 115540 - RNA, 20 nt, Artificial Sequence
  MKO10115540_B_Sfxn3
  gRNA
uguaauucugcacgauguuc

SEQ ID NO: 115541 - RNA, 20 nt, Artificial Sequence
  MKO10115541_B_Sfxn3
  gRNA
ggaacaucgugcagaauuac

SEQ ID NO: 115542 - RNA, 20 nt, Artificial Sequence
  MKO10115542_B_Sfxn4
  gRNA
cucuuuagauuaaagacgca

SEQ ID NO: 115543 - RNA, 20 nt, Artificial Sequence
  MKO10115543_B_Sfxn4
  gRNA
caccugcaggucgaaaaaga

SEQ ID NO: 115544 - RNA, 20 nt, Artificial Sequence
  MKO10115544_B_Sfxn4
  gRNA
gggaucaacuugcugcuguc

SEQ ID NO: 115545 - RNA, 20 nt, Artificial Sequence
  MKO10115545_B_Sfxn5
  gRNA
ucgaacacucuuugucacug

SEQ ID NO: 115546 - RNA, 20 nt, Artificial Sequence
  MKO10115546_B_Sfxn5
  gRNA
uccacagaaacgucucagag

SEQ ID NO: 115547 - RNA, 20 nt, Artificial Sequence
  MKO10115547_B_Sfxn5
  gRNA
accuguucauuuguaacucc

SEQ ID NO: 115548 - RNA, 20 nt, Artificial Sequence
  MKO10115548_B_Sgca
  gRNA
ccccucuuaccaacguguuc

SEQ ID NO: 115549 - RNA, 20 nt, Artificial Sequence
  MKO10115549_B_Sgca
  gRNA
augcuggcaccucgaugacu

SEQ ID NO: 115550 - RNA, 20 nt, Artificial Sequence
  MKO10115550_B_Sgca
  gRNA
gugguaggugagucggacag

SEQ ID NO: 115551 - RNA, 20 nt, Artificial Sequence
  MKO10115551_B_Sgcb
  gRNA
gaucguccuccuguuuaucc

SEQ ID NO: 115552 - RNA, 20 nt, Artificial Sequence
  MKO10115552_B_Sgcb
  gRNA
caggaggacgaucacgcaga

SEQ ID NO: 115553 - RNA, 20 nt, Artificial Sequence
  MKO10115553_B_Sgcb
  gRNA
gcaauugugcgaggcaacga

SEQ ID NO: 115554 - RNA, 20 nt, Artificial Sequence
  MKO10115554_B_Sgcd
  gRNA
uucugcggaugacagugaag

SEQ ID NO: 115555 - RNA, 20 nt, Artificial Sequence
  MKO10115555_B_Sgcd
  gRNA
ugucagagcagaccccuuca

SEQ ID NO: 115556 - RNA, 20 nt, Artificial Sequence
  MKO10115556_B_Sgcd
  gRNA
agcuuaccuuaguuccuuga

SEQ ID NO: 115557 - RNA, 20 nt, Artificial Sequence
  MKO10115557_B_Sgce
  gRNA
aagaugagccccgcgaccac

SEQ ID NO: 115558 - RNA, 20 nt, Artificial Sequence
  MKO10115558_B_Sgce
  gRNA
gacguaccuuugagacugca

SEQ ID NO: 115559 - RNA, 20 nt, Artificial Sequence
  MKO10115559_B_Sgce
  gRNA
guuaugccuugcagucucaa

SEQ ID NO: 115560 - RNA, 20 nt, Artificial Sequence
  MKO10115560_B_Sgcg
  gRNA
cugacccauuucaagaccuu

SEQ ID NO: 115561 - RNA, 20 nt, Artificial Sequence
  MKO10115561_B_Sgcg
  gRNA
caggacguugugguuggcac

SEQ ID NO: 115562 - RNA, 20 nt, Artificial Sequence
  MKO10115562_B_Sgcg
  gRNA
caaagaaauacgcuccagag

SEQ ID NO: 115563 - RNA, 20 nt, Artificial Sequence
  MKO10115563_B_Sgcz
  gRNA
gaaagaaauucauucccgaa

SEQ ID NO: 115564 - RNA, 20 nt, Artificial Sequence
  MKO10115564_B_Sgcz
  gRNA
gaugaagaugagaucacuau

SEQ ID NO: 115565 - RNA, 20 nt, Artificial Sequence
  MKO10115565_B_Sgcz
  gRNA
guccagugagcugccccaua

SEQ ID NO: 115566 - RNA, 20 nt, Artificial Sequence
  MKO10115566_B_Sgip1
  gRNA
gcgcacacucugcuuugcua

SEQ ID NO: 115567 - RNA, 20 nt, Artificial Sequence
  MKO10115567_B_Sgip1
  gRNA
uucuuucuuccguauuccaa

SEQ ID NO: 115568 - RNA, 20 nt, Artificial Sequence
  MKO10115568_B_Sgip1
  gRNA
aaauacuuaccauuccaucu

SEQ ID NO: 115569 - RNA, 20 nt, Artificial Sequence
  MKO10115569_B_Sgk1
  gRNA
ucccucucaacaaaucaacc

SEQ ID NO: 115570 - RNA, 20 nt, Artificial Sequence
  MKO10115570_B_Sgk1
  gRNA
acccagguugauuuguugag

SEQ ID NO: 115571 - RNA, 20 nt, Artificial Sequence
  MKO10115571_B_Sgk1
  gRNA
aacuuacuguuugcaugcau

SEQ ID NO: 115572 - RNA, 20 nt, Artificial Sequence
  MKO10115572_B_Sgk2
  gRNA
acgugcuguugaagaacgug

SEQ ID NO: 115573 - RNA, 20 nt, Artificial Sequence
  MKO10115573_B_Sgk2
  gRNA
acucacuuuggguuggcuga

SEQ ID NO: 115574 - RNA, 20 nt, Artificial Sequence
  MKO10115574_B_Sgk2
  gRNA
ccccagguugauguucccau

SEQ ID NO: 115575 - RNA, 20 nt, Artificial Sequence
  MKO10115575_B_Sgk3
  gRNA
auuccugccaagagaauauu

SEQ ID NO: 115576 - RNA, 20 nt, Artificial Sequence
  MKO10115576_B_Sgk3
  gRNA
gaaugaguucauucagaacu

SEQ ID NO: 115577 - RNA, 20 nt, Artificial Sequence
  MKO10115577_B_Sgk3
  gRNA
ggaaucuucagagccauagc

SEQ ID NO: 115578 - RNA, 20 nt, Artificial Sequence
  MKO10115578_B_Sgms1
  gRNA
agcgcaugaccacuacacug

SEQ ID NO: 115579 - RNA, 20 nt, Artificial Sequence
  MKO10115579_B_Sgms1
  gRNA
ggccgguaguccaccuuagu

SEQ ID NO: 115580 - RNA, 20 nt, Artificial Sequence
  MKO10115580_B_Sgms1
  gRNA
cauguugugcgagccuguga

SEQ ID NO: 115581 - RNA, 20 nt, Artificial Sequence
  MKO10115581_B_Sgms2
  gRNA
uggcgggggacugucuauca

SEQ ID NO: 115582 - RNA, 20 nt, Artificial Sequence
  MKO10115582_B_Sgms2
  gRNA
acauaguuauacagcgauac

SEQ ID NO: 115583 - RNA, 20 nt, Artificial Sequence
  MKO10115583_B_Sgms2
  gRNA
cauuauccuccccgaucuuc

SEQ ID NO: 115584 - RNA, 20 nt, Artificial Sequence
  MKO10115584_B_Sgol1
  gRNA
uaucuauccgucgccauuua

SEQ ID NO: 115585 - RNA, 20 nt, Artificial Sequence
  MKO10115585_B_Sgol1
  gRNA
ccagcauugacaauacgacc

SEQ ID NO: 115586 - RNA, 20 nt, Artificial Sequence
  MKO10115586_B_Sgol1
  gRNA
ggacuucccugacaaguccc

SEQ ID NO: 115587 - RNA, 20 nt, Artificial Sequence
  MKO10115587_B_Sgol2
  gRNA
acaacaacagagcauuagcg

SEQ ID NO: 115588 - RNA, 20 nt, Artificial Sequence
  MKO10115588_B_Sgol2
  gRNA
cugacaggagaaaagaaccu

SEQ ID NO: 115589 - RNA, 20 nt, Artificial Sequence
  MKO10115589_B_Sgol2
  gRNA
ugaaauaagcagucuuucug

SEQ ID NO: 115590 - RNA, 20 nt, Artificial Sequence
  MKO10115590_B_Sgpl1
  gRNA
acuccacgcaaugagcugcc

SEQ ID NO: 115591 - RNA, 20 nt, Artificial Sequence
  MKO10115591_B_Sgpl1
  gRNA
accgaagcucacggagcugc

SEQ ID NO: 115592 - RNA, 20 nt, Artificial Sequence
  MKO10115592_B_Sgpl1
  gRNA
cauaauccuuguccaccuuu

SEQ ID NO: 115593 - RNA, 20 nt, Artificial Sequence
  MKO10115593_B_Sgpp1
  gRNA
aaugucaugacacggaauac

SEQ ID NO: 115594 - RNA, 20 nt, Artificial Sequence
  MKO10115594_B_Sgpp1
  gRNA
agaaucagcccguagauaag

SEQ ID NO: 115595 - RNA, 20 nt, Artificial Sequence
  MKO10115595_B_Sgpp1
  gRNA
uucccauguagauucuacuu

SEQ ID NO: 115596 - RNA, 20 nt, Artificial Sequence
  MKO10115596_B_Sgpp2
  gRNA
aagcggcugaaaaccggaac

SEQ ID NO: 115597 - RNA, 20 nt, Artificial Sequence
  MKO10115597_B_Sgpp2
  gRNA
acgugauguagaacacuucc

SEQ ID NO: 115598 - RNA, 20 nt, Artificial Sequence
  MKO10115598_B_Sgpp2
  gRNA
aaugccauccacccacgcca

SEQ ID NO: 115599 - RNA, 20 nt, Artificial Sequence
  MKO10115599_B_Sgsh
  gRNA
caucacuagaauuaagcaac

SEQ ID NO: 115600 - RNA, 20 nt, Artificial Sequence
  MKO10115600_B_Sgsh
  gRNA
ucuuccucagcggaugacgg

SEQ ID NO: 115601 - RNA, 20 nt, Artificial Sequence
  MKO10115601_B_Sgsh
  gRNA
cguuacggaagauaaggcug

SEQ ID NO: 115602 - RNA, 20 nt, Artificial Sequence
  MKO10115602_B_Sgsm1
  gRNA
guccucguggacgaacuuuc

SEQ ID NO: 115603 - RNA, 20 nt, Artificial Sequence
  MKO10115603_B_Sgsm1
  gRNA
cagaggccgagacccgccag

SEQ ID NO: 115604 - RNA, 20 nt, Artificial Sequence
  MKO10115604_B_Sgsm1
  gRNA
acccgcagggaccgaagcca

SEQ ID NO: 115605 - RNA, 20 nt, Artificial Sequence
  MKO10115605_B_Sgsm2
  gRNA
cggcccuguucaccaaagug

SEQ ID NO: 115606 - RNA, 20 nt, Artificial Sequence
  MKO10115606_B_Sgsm2
  gRNA
ggacaggguuguacaguacc

SEQ ID NO: 115607 - RNA, 20 nt, Artificial Sequence
  MKO10115607_B_Sgsm2
  gRNA
aucuucaugcacgaauuucc

SEQ ID NO: 115608 - RNA, 20 nt, Artificial Sequence
  MKO10115608_B_Sgsm3
  gRNA
ugagaccaucgcugccaaac

SEQ ID NO: 115609 - RNA, 20 nt, Artificial Sequence
  MKO10115609_B_Sgsm3
  gRNA
aaccacacgccuucugccag

SEQ ID NO: 115610 - RNA, 20 nt, Artificial Sequence
  MKO10115610_B_Sgsm3
  gRNA
cugcccugacuccaagcaua

SEQ ID NO: 115611 - RNA, 20 nt, Artificial Sequence
  MKO10115611_B_Sgua
  gRNA
gaggcggcugugcaccucua

SEQ ID NO: 115612 - RNA, 20 nt, Artificial Sequence
  MKO10115612_B_Sgua
  gRNA
ugaggcagagcgccucaaaa

SEQ ID NO: 115613 - RNA, 20 nt, Artificial Sequence
  MKO10115613_B_Sgua
  gRNA
gguguccugucaggggcccg

SEQ ID NO: 115614 - RNA, 20 nt, Artificial Sequence
  MKO10115614_B_Sgub
  gRNA
gcuuucaaacucagugcccg

SEQ ID NO: 115615 - RNA, 20 nt, Artificial Sequence
  MKO10115615_B_Sgub
  gRNA
cuacacgcaggcaauagaac

SEQ ID NO: 115616 - RNA, 20 nt, Artificial Sequence
  MKO10115616_B_Sgub
  gRNA
uaaaaacggucuccaaacac

SEQ ID NO: 115617 - RNA, 20 nt, Artificial Sequence
  MKO10115617_B_Sh2b1
  gRNA
aggcuucuuacccggggcuu

SEQ ID NO: 115618 - RNA, 20 nt, Artificial Sequence
  MKO10115618_B_Sh2b1
  gRNA
acgccgauggccggucugag

SEQ ID NO: 115619 - RNA, 20 nt, Artificial Sequence
  MKO10115619_B_Sh2b1
  gRNA
acaaacguguucucccuguc

SEQ ID NO: 115620 - RNA, 20 nt, Artificial Sequence
  MKO10115620_B_Sh2b2
  gRNA
gcagugagucuaucguuucc

SEQ ID NO: 115621 - RNA, 20 nt, Artificial Sequence
  MKO10115621_B_Sh2b2
  gRNA
gaacggagcagaauacaucc

SEQ ID NO: 115622 - RNA, 20 nt, Artificial Sequence
  MKO10115622_B_Sh2b2
  gRNA
uugugcacggggaggcugcc

SEQ ID NO: 115623 - RNA, 20 nt, Artificial Sequence
  MKO10115623_B_Sh2b3
  gRNA
ugaugcccacggcguguucc

SEQ ID NO: 115624 - RNA, 20 nt, Artificial Sequence
  MKO10115624_B_Sh2b3
  gRNA
cgaguuaccucuuuccuuag

SEQ ID NO: 115625 - RNA, 20 nt, Artificial Sequence
  MKO10115625_B_Sh2b3
  gRNA
ggcucugccgcuaaggaaag

SEQ ID NO: 115626 - RNA, 20 nt, Artificial Sequence
  MKO10115626_B_Sh2d1a
  gRNA
cgagugucccagacagaaac

SEQ ID NO: 115627 - RNA, 20 nt, Artificial Sequence
  MKO10115627_B_Sh2d1a
  gRNA
uauccaguugaaaaguccuc

SEQ ID NO: 115628 - RNA, 20 nt, Artificial Sequence
  MKO10115628_B_Sh2d1a
  gRNA
uccaagaaccuguuucuguc

SEQ ID NO: 115629 - RNA, 20 nt, Artificial Sequence
  MKO10115629_B_Sh2d1b1
  gRNA
cgaaucuucagagagaaaca

SEQ ID NO: 115630 - RNA, 20 nt, Artificial Sequence
  MKO10115630_B_Sh2d1b1
  gRNA
cauguuucucucugaagauu

SEQ ID NO: 115631 - RNA, 20 nt, Artificial Sequence
  MKO10115631_B_Sh2d1b1
  gRNA
aggauacucacgagacacag

SEQ ID NO: 115632 - RNA, 20 nt, Artificial Sequence
  MKO10115632_B_Sh2d1b2
  gRNA
cgaaucuucagagagaaaaa

SEQ ID NO: 115633 - RNA, 20 nt, Artificial Sequence
  MKO10115633_B_Sh2d1b2
  gRNA
aggauacucacgagacacag

SEQ ID NO: 115634 - RNA, 20 nt, Artificial Sequence
  MKO10115634_B_Sh2d1b2
  gRNA
auggaucugccuuacuacca

SEQ ID NO: 115635 - RNA, 20 nt, Artificial Sequence
  MKO10115635_B_Sh2d2a
  gRNA
cgcaccagauagcauccuag

SEQ ID NO: 115636 - RNA, 20 nt, Artificial Sequence
  MKO10115636_B_Sh2d2a
  gRNA
ugcucaagacugccccucuu

SEQ ID NO: 115637 - RNA, 20 nt, Artificial Sequence
  MKO10115637_B_Sh2d2a
  gRNA
ugaccuucgugcuguccuac

SEQ ID NO: 115638 - RNA, 20 nt, Artificial Sequence
  MKO10115638_B_Sh2d3c
  gRNA
ugcuagcuuaccagugcuau

SEQ ID NO: 115639 - RNA, 20 nt, Artificial Sequence
  MKO10115639_B_Sh2d3c
  gRNA
ggccgcuggggacuauguga

SEQ ID NO: 115640 - RNA, 20 nt, Artificial Sequence
  MKO10115640_B_Sh2d3c
  gRNA
gucucgaggaugggguaaug

SEQ ID NO: 115641 - RNA, 20 nt, Artificial Sequence
  MKO10115641_B_Sh2d4a
  gRNA
ucagaugcucccucuccgca

SEQ ID NO: 115642 - RNA, 20 nt, Artificial Sequence
  MKO10115642_B_Sh2d4a
  gRNA
gacccagagcaauaccaacc

SEQ ID NO: 115643 - RNA, 20 nt, Artificial Sequence
  MKO10115643_B_Sh2d4a
  gRNA
gccccaguuccuacagccgc

SEQ ID NO: 115644 - RNA, 20 nt, Artificial Sequence
  MKO10115644_B_Sh2d4b
  gRNA
ccgcaaggcugcuaaaauuu

SEQ ID NO: 115645 - RNA, 20 nt, Artificial Sequence
  MKO10115645_B_Sh2d4b
  gRNA
cgagcaacaagcaucuccag

SEQ ID NO: 115646 - RNA, 20 nt, Artificial Sequence
  MKO10115646_B_Sh2d4b
  gRNA
uucacgcuccucauucucac

SEQ ID NO: 115647 - RNA, 20 nt, Artificial Sequence
  MKO10115647_B_Sh2d5
  gRNA
uagugcgagagcccuucagc

SEQ ID NO: 115648 - RNA, 20 nt, Artificial Sequence
  MKO10115648_B_Sh2d5
  gRNA
gcuucagcgcaugggccauu

SEQ ID NO: 115649 - RNA, 20 nt, Artificial Sequence
  MKO10115649_B_Sh2d5
  gRNA
ugaguguccaagucauccac

SEQ ID NO: 115650 - RNA, 20 nt, Artificial Sequence
  MKO10115650_B_Sh2d7
  gRNA
cucggaugaagugagugcag

SEQ ID NO: 115651 - RNA, 20 nt, Artificial Sequence
  MKO10115651_B_Sh2d7
  gRNA
ugucugugaagaagagccuc

SEQ ID NO: 115652 - RNA, 20 nt, Artificial Sequence
  MKO10115652_B_Sh2d7
  gRNA
gacaagaagcacaaauucug

SEQ ID NO: 115653 - RNA, 20 nt, Artificial Sequence
  MKO10115653_B_Sh3bgrl2
  gRNA
cgccacgaagccugagcaug

SEQ ID NO: 115654 - RNA, 20 nt, Artificial Sequence
  MKO10115654_B_Sh3bgrl2
  gRNA
gaagccacggccggcaucca

SEQ ID NO: 115655 - RNA, 20 nt, Artificial Sequence
  MKO10115655_B_Sh3bgrl2
  gRNA
uuccucgaacucuaucuugu

SEQ ID NO: 115656 - RNA, 20 nt, Artificial Sequence
  MKO10115656_B_Sh3bgrl3
  gRNA
ucaggacuaugaacucuucg

SEQ ID NO: 115657 - RNA, 20 nt, Artificial Sequence
  MKO10115657_B_Sh3bgrl3
  gRNA
ucgagaugagaugcgaaccu

SEQ ID NO: 115658 - RNA, 20 nt, Artificial Sequence
  MKO10115658_B_Sh3bgrl3
  gRNA
uccugacucaggccagcuuc

SEQ ID NO: 115659 - RNA, 20 nt, Artificial Sequence
  MKO10115659_B_Sh3bgrl
  gRNA
gacagcaccaccugguucaa

SEQ ID NO: 115660 - RNA, 20 nt, Artificial Sequence
  MKO10115660_B_Sh3bgrl
  gRNA
uggugcugucaagccuaaaa

SEQ ID NO: 115661 - RNA, 20 nt, Artificial Sequence
  MKO10115661_B_Sh3bgrl
  gRNA
guauauauugcaucuucuuc

SEQ ID NO: 115662 - RNA, 20 nt, Artificial Sequence
  MKO10115662_B_Sh3bgr
  gRNA
cuucccaauggagauguagc

SEQ ID NO: 115663 - RNA, 20 nt, Artificial Sequence
  MKO10115663_B_Sh3bgr
  gRNA
gcuguaggugacaaagucug

SEQ ID NO: 115664 - RNA, 20 nt, Artificial Sequence
  MKO10115664_B_Sh3bgr
  gRNA
ugcucuucauugaagaucug

SEQ ID NO: 115665 - RNA, 20 nt, Artificial Sequence
  MKO10115665_B_Sh3bp1
  gRNA
ggcugacauggacaagcggg

SEQ ID NO: 115666 - RNA, 20 nt, Artificial Sequence
  MKO10115666_B_Sh3bp1
  gRNA
acuggauccugauuccagca

SEQ ID NO: 115667 - RNA, 20 nt, Artificial Sequence
  MKO10115667_B_Sh3bp1
  gRNA
gcucaccccaugcuggaauc

SEQ ID NO: 115668 - RNA, 20 nt, Artificial Sequence
  MKO10115668_B_Sh3bp2
  gRNA
ccagccuucgccacaccacc

SEQ ID NO: 115669 - RNA, 20 nt, Artificial Sequence
  MKO10115669_B_Sh3bp2
  gRNA
ucagcaagaagcaccgaaca

SEQ ID NO: 115670 - RNA, 20 nt, Artificial Sequence
  MKO10115670_B_Sh3bp2
  gRNA
caccuugcgcucauccucag

SEQ ID NO: 115671 - RNA, 20 nt, Artificial Sequence
  MKO10115671_B_Sh3bp4
  gRNA
cucgguagcuguccccaauc

SEQ ID NO: 115672 - RNA, 20 nt, Artificial Sequence
  MKO10115672_B_Sh3bp4
  gRNA
guccccuccgacuugcaccg

SEQ ID NO: 115673 - RNA, 20 nt, Artificial Sequence
  MKO10115673_B_Sh3bp4
  gRNA
augagucuccucaccgagac

SEQ ID NO: 115674 - RNA, 20 nt, Artificial Sequence
  MKO10115674_B_Sh3bp5l
  gRNA
cuccugcaggauccuccgau

SEQ ID NO: 115675 - RNA, 20 nt, Artificial Sequence
  MKO10115675_B_Sh3bp5l
  gRNA
ggcucuugccaauggcccgc

SEQ ID NO: 115676 - RNA, 20 nt, Artificial Sequence
  MKO10115676_B_Sh3bp5l
  gRNA
aagagcggcuucgaggugaa

SEQ ID NO: 115677 - RNA, 20 nt, Artificial Sequence
  MKO10115677_B_Sh3bp5
  gRNA
aacggugaaacuagacgaac

SEQ ID NO: 115678 - RNA, 20 nt, Artificial Sequence
  MKO10115678_B_Sh3bp5
  gRNA
cgagguacuccgugcagcca

SEQ ID NO: 115679 - RNA, 20 nt, Artificial Sequence
  MKO10115679_B_Sh3bp5
  gRNA
agccagguacaacgcugcca

SEQ ID NO: 115680 - RNA, 20 nt, Artificial Sequence
  MKO10115680_B_Sh3d19
  gRNA
cuuccugccgaaaagccagu

SEQ ID NO: 115681 - RNA, 20 nt, Artificial Sequence
  MKO10115681_B_Sh3d19
  gRNA
uaccaagccucccgauucgc

SEQ ID NO: 115682 - RNA, 20 nt, Artificial Sequence
  MKO10115682_B_Sh3d19
  gRNA
acuggagcaagccagcgaau

SEQ ID NO: 115683 - RNA, 20 nt, Artificial Sequence
  MKO10115683_B_Sh3d21
  gRNA
ccucggguugguagucaaau

SEQ ID NO: 115684 - RNA, 20 nt, Artificial Sequence
  MKO10115684_B_Sh3d21
  gRNA
uuaggaggccucugugaauu

SEQ ID NO: 115685 - RNA, 20 nt, Artificial Sequence
  MKO10115685_B_Sh3d21
  gRNA
caauuaccccaaauucacag

SEQ ID NO: 115686 - RNA, 20 nt, Artificial Sequence
  MKO10115686_B_Sh3gl1
  gRNA
ccaacagcuggucagcgaga

SEQ ID NO: 115687 - RNA, 20 nt, Artificial Sequence
  MKO10115687_B_Sh3gl1
  gRNA
uggacucaccugcaucuagc

SEQ ID NO: 115688 - RNA, 20 nt, Artificial Sequence
  MKO10115688_B_Sh3gl1
  gRNA
uggggccgaagggaccaaac

SEQ ID NO: 115689 - RNA, 20 nt, Artificial Sequence
  MKO10115689_B_Sh3gl2
  gRNA
cucggaggucaaggacucau

SEQ ID NO: 115690 - RNA, 20 nt, Artificial Sequence
  MKO10115690_B_Sh3gl2
  gRNA
ucucccaccucaccgagagc

SEQ ID NO: 115691 - RNA, 20 nt, Artificial Sequence
  MKO10115691_B_Sh3gl2
  gRNA
agcacuuaccuggauugggu

SEQ ID NO: 115692 - RNA, 20 nt, Artificial Sequence
  MKO10115692_B_Sh3gl3
  gRNA
gaguaucuccaacccaaucc

SEQ ID NO: 115693 - RNA, 20 nt, Artificial Sequence
  MKO10115693_B_Sh3gl3
  gRNA
uuugccugcauaucuauccc

SEQ ID NO: 115694 - RNA, 20 nt, Artificial Sequence
  MKO10115694_B_Sh3gl3
  gRNA
uaagcauacagagcuaagcu

SEQ ID NO: 115695 - RNA, 20 nt, Artificial Sequence
  MKO10115695_B_Sh3glb1
  gRNA
aacuuaccauaagcuguccc

SEQ ID NO: 115696 - RNA, 20 nt, Artificial Sequence
  MKO10115696_B_Sh3glb1
  gRNA
ccuucuauaaaguuucuuaa

SEQ ID NO: 115697 - RNA, 20 nt, Artificial Sequence
  MKO10115697_B_Sh3glb1
  gRNA
cugauguuugaaucagcucu

SEQ ID NO: 115698 - RNA, 20 nt, Artificial Sequence
  MKO10115698_B_Sh3glb2
  gRNA
gggggacuggaaaacgauuu

SEQ ID NO: 115699 - RNA, 20 nt, Artificial Sequence
  MKO10115699_B_Sh3glb2
  gRNA
ucucccuacaggugcucgag

SEQ ID NO: 115700 - RNA, 20 nt, Artificial Sequence
  MKO10115700_B_Sh3glb2
  gRNA
ugcugucugcccgagcuagg

SEQ ID NO: 115701 - RNA, 20 nt, Artificial Sequence
  MKO10115701_B_Sh3kbp1
  gRNA
aacuccagacccaucgaaga

SEQ ID NO: 115702 - RNA, 20 nt, Artificial Sequence
  MKO10115702_B_Sh3kbp1
  gRNA
ccuuccuugucaaaguccga

SEQ ID NO: 115703 - RNA, 20 nt, Artificial Sequence
  MKO10115703_B_Sh3kbp1
  gRNA
ugauggagguggcgguuucu

SEQ ID NO: 115704 - RNA, 20 nt, Artificial Sequence
  MKO10115704_B_Sh3pxd2a
  gRNA
uacccugcaguauucaucga

SEQ ID NO: 115705 - RNA, 20 nt, Artificial Sequence
  MKO10115705_B_Sh3pxd2a
  gRNA
ccaccucccagacuaucuac

SEQ ID NO: 115706 - RNA, 20 nt, Artificial Sequence
  MKO10115706_B_Sh3pxd2a
  gRNA
aguacucacauaguguuuag

SEQ ID NO: 115707 - RNA, 20 nt, Artificial Sequence
  MKO10115707_B_Sh3pxd2b
  gRNA
ucuuccgccgcagccacauc

SEQ ID NO: 115708 - RNA, 20 nt, Artificial Sequence
  MKO10115708_B_Sh3pxd2b
  gRNA
ccuuacccaccuggcagaaa

SEQ ID NO: 115709 - RNA, 20 nt, Artificial Sequence
  MKO10115709_B_Sh3pxd2b
  gRNA
cuacaucucucagugugaug

SEQ ID NO: 115710 - RNA, 20 nt, Artificial Sequence
  MKO10115710_B_Sh3rf1
  gRNA
uaccugagacggggcgcugc

SEQ ID NO: 115711 - RNA, 20 nt, Artificial Sequence
  MKO10115711_B_Sh3rf1
  gRNA
uggggucacaauuaacccag

SEQ ID NO: 115712 - RNA, 20 nt, Artificial Sequence
  MKO10115712_B_Sh3rf1
  gRNA
acugaccgugauccgcagag

SEQ ID NO: 115713 - RNA, 20 nt, Artificial Sequence
  MKO10115713_B_Sh3rf2
  gRNA
cuuacaggugccucgagcca

SEQ ID NO: 115714 - RNA, 20 nt, Artificial Sequence
  MKO10115714_B_Sh3rf2
  gRNA
gggagauuaauggcgucagc

SEQ ID NO: 115715 - RNA, 20 nt, Artificial Sequence
  MKO10115715_B_Sh3rf2
  gRNA
cccugggcucuuucggagcg

SEQ ID NO: 115716 - RNA, 20 nt, Artificial Sequence
  MKO10115716_B_Sh3rf3
  gRNA
gcuguccacacgucguugaa

SEQ ID NO: 115717 - RNA, 20 nt, Artificial Sequence
  MKO10115717_B_Sh3rf3
  gRNA
guaagcuuaccuccacguac

SEQ ID NO: 115718 - RNA, 20 nt, Artificial Sequence
  MKO10115718_B_Sh3rf3
  gRNA
cucacacguugaggggcagc

SEQ ID NO: 115719 - RNA, 20 nt, Artificial Sequence
  MKO10115719_B_Sh3uc1
  gRNA
gccugcuggagaacgauagc

SEQ ID NO: 115720 - RNA, 20 nt, Artificial Sequence
  MKO10115720_B_Sh3uc1
  gRNA
gcugucuauccacagugacc

SEQ ID NO: 115721 - RNA, 20 nt, Artificial Sequence
  MKO10115721_B_Sh3uc1
  gRNA
ugucuuaccaagagcaugau

SEQ ID NO: 115722 - RNA, 20 nt, Artificial Sequence
  MKO10115722_B_Sh3uc2
  gRNA
cauaccuaaguucagguacg

SEQ ID NO: 115723 - RNA, 20 nt, Artificial Sequence
  MKO10115723_B_Sh3uc2
  gRNA
ucuucuuugaccacacguac

SEQ ID NO: 115724 - RNA, 20 nt, Artificial Sequence
  MKO10115724_B_Sh3uc2
  gRNA
auaccuugggucauauucug

SEQ ID NO: 115725 - RNA, 20 nt, Artificial Sequence
  MKO10115725_B_Sh3yl1
  gRNA
gauuguccuggcgcgucuuc

SEQ ID NO: 115726 - RNA, 20 nt, Artificial Sequence
  MKO10115726_B_Sh3yl1
  gRNA
cuaccaggaaugaucuuauc

SEQ ID NO: 115727 - RNA, 20 nt, Artificial Sequence
  MKO10115727_B_Sh3yl1
  gRNA
gcuucugauuucagauuaga

SEQ ID NO: 115728 - RNA, 20 nt, Artificial Sequence
  MKO10115728_B_Shank1
  gRNA
gcagcuugggacgucugaca

SEQ ID NO: 115729 - RNA, 20 nt, Artificial Sequence
  MKO10115729_B_Shank1
  gRNA
uaccuccugaaucugagucg

SEQ ID NO: 115730 - RNA, 20 nt, Artificial Sequence
  MKO10115730_B_Shank1
  gRNA
ugcccugagcgagagucuac

SEQ ID NO: 115731 - RNA, 20 nt, Artificial Sequence
  MKO10115731_B_Shank2
  gRNA
gguggugaacaugauccgcc

SEQ ID NO: 115732 - RNA, 20 nt, Artificial Sequence
  MKO10115732_B_Shank2
  gRNA
ucggagcccgcuuuggaggu

SEQ ID NO: 115733 - RNA, 20 nt, Artificial Sequence
  MKO10115733_B_Shank2
  gRNA
uuccuccaacuccgcuguca

SEQ ID NO: 115734 - RNA, 20 nt, Artificial Sequence
  MKO10115734_B_Shank3
  gRNA
acaggacuacccgccuaacc

SEQ ID NO: 115735 - RNA, 20 nt, Artificial Sequence
  MKO10115735_B_Shank3
  gRNA
cauaaacucuccgcuuguau

SEQ ID NO: 115736 - RNA, 20 nt, Artificial Sequence
  MKO10115736_B_Shank3
  gRNA
cauaguccaugaacuucuuc

SEQ ID NO: 115737 - RNA, 20 nt, Artificial Sequence
  MKO10115737_B_Sharpin
  gRNA
cacaguugaagacgccacau

SEQ ID NO: 115738 - RNA, 20 nt, Artificial Sequence
  MKO10115738_B_Sharpin
  gRNA
gagccacaugaugcugcgcc

SEQ ID NO: 115739 - RNA, 20 nt, Artificial Sequence
  MKO10115739_B_Sharpin
  gRNA
gacaugggcagacgaugaag

SEQ ID NO: 115740 - RNA, 20 nt, Artificial Sequence
  MKO10115740_B_Shbg
  gRNA
aguuaccggaaaccgaaguu

SEQ ID NO: 115741 - RNA, 20 nt, Artificial Sequence
  MKO10115741_B_Shbg
  gRNA
caucucccaucguccagccg

SEQ ID NO: 115742 - RNA, 20 nt, Artificial Sequence
  MKO10115742_B_Shbg
  gRNA
gugcaauccucaugcugcgc

SEQ ID NO: 115743 - RNA, 20 nt, Artificial Sequence
  MKO10115743_B_Shb
  gRNA
acggcgccagcuccgugccc

SEQ ID NO: 115744 - RNA, 20 nt, Artificial Sequence
  MKO10115744_B_Shb
  gRNA
acuccuuacagagucgcagc

SEQ ID NO: 115745 - RNA, 20 nt, Artificial Sequence
  MKO10115745_B_Shb
  gRNA
aguagucauguuugcugguc

SEQ ID NO: 115746 - RNA, 20 nt, Artificial Sequence
  MKO10115746_B_Shc1
  gRNA
cuccagggaggccaucaguu

SEQ ID NO: 115747 - RNA, 20 nt, Artificial Sequence
  MKO10115747_B_Shc1
  gRNA
ccuaccuaccuguuugcagu

SEQ ID NO: 115748 - RNA, 20 nt, Artificial Sequence
  MKO10115748_B_Shc1
  gRNA
ccuacaguacaugggcugug

SEQ ID NO: 115749 - RNA, 20 nt, Artificial Sequence
  MKO10115749_B_Shc2
  gRNA
gucuguucccgccacccgcc

SEQ ID NO: 115750 - RNA, 20 nt, Artificial Sequence
  MKO10115750_B_Shc2
  gRNA
gcagucuauuuccuucgccu

SEQ ID NO: 115751 - RNA, 20 nt, Artificial Sequence
  MKO10115751_B_Shc2
  gRNA
acacccgaacacaggugacg

SEQ ID NO: 115752 - RNA, 20 nt, Artificial Sequence
  MKO10115752_B_Shc3
  gRNA
aagagauagaccgcauauga

SEQ ID NO: 115753 - RNA, 20 nt, Artificial Sequence
  MKO10115753_B_Shc3
  gRNA
cuggcacagcuucgcagaca

SEQ ID NO: 115754 - RNA, 20 nt, Artificial Sequence
  MKO10115754_B_Shc3
  gRNA
cgugucugcgaagcugugcc

SEQ ID NO: 115755 - RNA, 20 nt, Artificial Sequence
  MKO10115755_B_Shc4
  gRNA
caaucgauuucauuugccuc

SEQ ID NO: 115756 - RNA, 20 nt, Artificial Sequence
  MKO10115756_B_Shc4
  gRNA
gaaucucuuaccuuguaacu

SEQ ID NO: 115757 - RNA, 20 nt, Artificial Sequence
  MKO10115757_B_Shc4
  gRNA
uggagccauuaaaaaacgaa

SEQ ID NO: 115758 - RNA, 20 nt, Artificial Sequence
  MKO10115758_B_Shcbp1l
  gRNA
accucguccaccaagucccg

SEQ ID NO: 115759 - RNA, 20 nt, Artificial Sequence
  MKO10115759_B_Shcbp1l
  gRNA
ucgaccaggaucccaacaaa

SEQ ID NO: 115760 - RNA, 20 nt, Artificial Sequence
  MKO10115760_B_Shcbp1l
  gRNA
agcuaugaguagauaccugu

SEQ ID NO: 115761 - RNA, 20 nt, Artificial Sequence
  MKO10115761_B_Shcbp1
  gRNA
ugauagccuugaucacugca

SEQ ID NO: 115762 - RNA, 20 nt, Artificial Sequence
  MKO10115762_B_Shcbp1
  gRNA
cagacugcccaccauccaga

SEQ ID NO: 115763 - RNA, 20 nt, Artificial Sequence
  MKO10115763_B_Shcbp1
  gRNA
uuaauuuguagcugacugua

SEQ ID NO: 115764 - RNA, 20 nt, Artificial Sequence
  MKO10115764_B_Shd
  gRNA
gcuguauccacacgcuccgc

SEQ ID NO: 115765 - RNA, 20 nt, Artificial Sequence
  MKO10115765_B_Shd
  gRNA
ccucuuccagugcaauuuga

SEQ ID NO: 115766 - RNA, 20 nt, Artificial Sequence
  MKO10115766_B_Shd
  gRNA
gaagguucucggccucugcu

SEQ ID NO: 115767 - RNA, 20 nt, Artificial Sequence
  MKO10115767_B_She
  gRNA
augcagggagaccgcaccac

SEQ ID NO: 115768 - RNA, 20 nt, Artificial Sequence
  MKO10115768_B_She
  gRNA
ccuuugaccuuucguccguu

SEQ ID NO: 115769 - RNA, 20 nt, Artificial Sequence
  MKO10115769_B_She
  gRNA
cugacccguaugaugccaaa

SEQ ID NO: 115770 - RNA, 20 nt, Artificial Sequence
  MKO10115770_B_Shfm1
  gRNA
aagaugaagaugcacauguc

SEQ ID NO: 115771 - RNA, 20 nt, Artificial Sequence
  MKO10115771_B_Shfm1
  gRNA
agugcugagcuggagaagca

SEQ ID NO: 115772 - RNA, 20 nt, Artificial Sequence
  MKO10115772_B_Shfm1
  gRNA
cgacuugggucucuuggaag

SEQ ID NO: 115773 - RNA, 20 nt, Artificial Sequence
  MKO10115773_B_Shf
  gRNA
aguucuccgauccuucaaac

SEQ ID NO: 115774 - RNA, 20 nt, Artificial Sequence
  MKO10115774_B_Shf
  gRNA
acuguugcgcaccagguagc

SEQ ID NO: 115775 - RNA, 20 nt, Artificial Sequence
  MKO10115775_B_Shf
  gRNA
gggguucccagcagauagcc

SEQ ID NO: 115776 - RNA, 20 nt, Artificial Sequence
  MKO10115776_B_Shh
  gRNA
gaccgggaccgcagcaagua

SEQ ID NO: 115777 - RNA, 20 nt, Artificial Sequence
  MKO10115777_B_Shh
  gRNA
aagaaacuccgaacgauuua

SEQ ID NO: 115778 - RNA, 20 nt, Artificial Sequence
  MKO10115778_B_Shh
  gRNA
acacuaugagggucgagcag

SEQ ID NO: 115779 - RNA, 20 nt, Artificial Sequence
  MKO10115779_B_Shisa2
  gRNA
gucgccgccgucgaagcgcu

SEQ ID NO: 115780 - RNA, 20 nt, Artificial Sequence
  MKO10115780_B_Shisa2
  gRNA
augcggcaacgagagacccg

SEQ ID NO: 115781 - RNA, 20 nt, Artificial Sequence
  MKO10115781_B_Shisa2
  gRNA
ccgaugucuacguccaaagc

SEQ ID NO: 115782 - RNA, 20 nt, Artificial Sequence
  MKO10115782_B_Shisa3
  gRNA
uauguccccuuccugaucgu

SEQ ID NO: 115783 - RNA, 20 nt, Artificial Sequence
  MKO10115783_B_Shisa3
  gRNA
cgcgcagggcaacuaucacg

SEQ ID NO: 115784 - RNA, 20 nt, Artificial Sequence
  MKO10115784_B_Shisa3
  gRNA
ugcucgugggcuugcuacgu

SEQ ID NO: 115785 - RNA, 20 nt, Artificial Sequence
  MKO10115785_B_Shisa4
  gRNA
gcccgcagcgcuggcgagug

SEQ ID NO: 115786 - RNA, 20 nt, Artificial Sequence
  MKO10115786_B_Shisa4
  gRNA
gcuaccagcgguacugcugc

SEQ ID NO: 115787 - RNA, 20 nt, Artificial Sequence
  MKO10115787_B_Shisa4
  gRNA
gccaguauaccaguaccccc

SEQ ID NO: 115788 - RNA, 20 nt, Artificial Sequence
  MKO10115788_B_Shisa5
  gRNA
cacaaagauggucacgccaa

SEQ ID NO: 115789 - RNA, 20 nt, Artificial Sequence
  MKO10115789_B_Shisa5
  gRNA
uagggugguggguacugcgu

SEQ ID NO: 115790 - RNA, 20 nt, Artificial Sequence
  MKO10115790_B_Shisa5
  gRNA
gaucgaauugucuucaccaa

SEQ ID NO: 115791 - RNA, 20 nt, Artificial Sequence
  MKO10115791_B_Shisa6
  gRNA
uggguagcgcugcuuaagau

SEQ ID NO: 115792 - RNA, 20 nt, Artificial Sequence
  MKO10115792_B_Shisa6
  gRNA
gaugaauaacauucugacgu

SEQ ID NO: 115793 - RNA, 20 nt, Artificial Sequence
  MKO10115793_B_Shisa6
  gRNA
cucuuugggagagguaucga

SEQ ID NO: 115794 - RNA, 20 nt, Artificial Sequence
  MKO10115794_B_Shisa7
  gRNA
cuugcacucaccgagguugg

SEQ ID NO: 115795 - RNA, 20 nt, Artificial Sequence
  MKO10115795_B_Shisa7
  gRNA
caagcaccacgccgccacac

SEQ ID NO: 115796 - RNA, 20 nt, Artificial Sequence
  MKO10115796_B_Shisa7
  gRNA
agcaggaccugcaacccgcc

SEQ ID NO: 115797 - RNA, 20 nt, Artificial Sequence
  MKO10115797_B_Shisa9
  gRNA
uguugccauaagccugccgc

SEQ ID NO: 115798 - RNA, 20 nt, Artificial Sequence
  MKO10115798_B_Shisa9
  gRNA
caacaaguacgccuccuuaa

SEQ ID NO: 115799 - RNA, 20 nt, Artificial Sequence
  MKO10115799_B_Shisa9
  gRNA
guacuuacggagauuauuua

SEQ ID NO: 115800 - RNA, 20 nt, Artificial Sequence
  MKO10115800_B_Shkbp1
  gRNA
ccaugcagaucuucaucgac

SEQ ID NO: 115801 - RNA, 20 nt, Artificial Sequence
  MKO10115801_B_Shkbp1
  gRNA
cugggauccagguaagcguc

SEQ ID NO: 115802 - RNA, 20 nt, Artificial Sequence
  MKO10115802_B_Shkbp1
  gRNA
cagcuccggucucaucuuuc

SEQ ID NO: 115803 - RNA, 20 nt, Artificial Sequence
  MKO10115803_B_Shmt1
  gRNA
aagcccaugauucgcccaug

SEQ ID NO: 115804 - RNA, 20 nt, Artificial Sequence
  MKO10115804_B_Shmt1
  gRNA
ucaccugcgaugaucagcuu

SEQ ID NO: 115805 - RNA, 20 nt, Artificial Sequence
  MKO10115805_B_Shmt1
  gRNA
ucggcuggcaaaauucuccg

SEQ ID NO: 115806 - RNA, 20 nt, Artificial Sequence
  MKO10115806_B_Shmt2
  gRNA
ccuggagcucaucgccucag

SEQ ID NO: 115807 - RNA, 20 nt, Artificial Sequence
  MKO10115807_B_Shmt2
  gRNA
cgaguacuuguuguugagac

SEQ ID NO: 115808 - RNA, 20 nt, Artificial Sequence
  MKO10115808_B_Shmt2
  gRNA
cagcaagguggcccagacgc

SEQ ID NO: 115809 - RNA, 20 nt, Artificial Sequence
  MKO10115809_B_Shoc2
  gRNA
uugcuuccaguuauauccag

SEQ ID NO: 115810 - RNA, 20 nt, Artificial Sequence
  MKO10115810_B_Shoc2
  gRNA
cgaaucaacaaaaucccauu

SEQ ID NO: 115811 - RNA, 20 nt, Artificial Sequence
  MKO10115811_B_Shoc2
  gRNA
uaaauucaauucuaccauac

SEQ ID NO: 115812 - RNA, 20 nt, Artificial Sequence
  MKO10115812_B_Shox2
  gRNA
aucgcaaagacgaugcgaaa

SEQ ID NO: 115813 - RNA, 20 nt, Artificial Sequence
  MKO10115813_B_Shox2
  gRNA
accgcccuucggacugccgc

SEQ ID NO: 115814 - RNA, 20 nt, Artificial Sequence
  MKO10115814_B_Shox2
  gRNA
uaaagcaccuacguugacau

SEQ ID NO: 115815 - RNA, 20 nt, Artificial Sequence
  MKO10115815_B_Shpk
  gRNA
ucggcugugcaaccaucuuc

SEQ ID NO: 115816 - RNA, 20 nt, Artificial Sequence
  MKO10115816_B_Shpk
  gRNA
cuguuucuaggggcgggagc

SEQ ID NO: 115817 - RNA, 20 nt, Artificial Sequence
  MKO10115817_B_Shpk
  gRNA
ccguuguaacaguaguuucc

SEQ ID NO: 115818 - RNA, 20 nt, Artificial Sequence
  MKO10115818_B_Shprh
  gRNA
cgagaaauuguuacaccuga

SEQ ID NO: 115819 - RNA, 20 nt, Artificial Sequence
  MKO10115819_B_Shprh
  gRNA
cucaggaccggaaucaacgc

SEQ ID NO: 115820 - RNA, 20 nt, Artificial Sequence
  MKO10115820_B_Shprh
  gRNA
cucuacuauaauccauauac

SEQ ID NO: 115821 - RNA, 20 nt, Artificial Sequence
  MKO10115821_B_Shq1
  gRNA
caggucugccaagccacuug

SEQ ID NO: 115822 - RNA, 20 nt, Artificial Sequence
  MKO10115822_B_Shq1
  gRNA
cauaccuuuaucugcaucau

SEQ ID NO: 115823 - RNA, 20 nt, Artificial Sequence
  MKO10115823_B_Shq1
  gRNA
auuuggccaacucagcagcc

SEQ ID NO: 115824 - RNA, 20 nt, Artificial Sequence
  MKO10115824_B_Shroom1
  gRNA
aagucugcagguccugcgug

SEQ ID NO: 115825 - RNA, 20 nt, Artificial Sequence
  MKO10115825_B_Shroom1
  gRNA
aucuugaggugacgguguuu

SEQ ID NO: 115826 - RNA, 20 nt, Artificial Sequence
  MKO10115826_B_Shroom1
  gRNA
uuguggacaccaccucacgc

SEQ ID NO: 115827 - RNA, 20 nt, Artificial Sequence
  MKO10115827_B_Shroom2
  gRNA
ucucuguacacuacaagcug

SEQ ID NO: 115828 - RNA, 20 nt, Artificial Sequence
  MKO10115828_B_Shroom2
  gRNA
ucuugugggagccuuucacc

SEQ ID NO: 115829 - RNA, 20 nt, Artificial Sequence
  MKO10115829_B_Shroom2
  gRNA
guaccuaccuagccuggugc

SEQ ID NO: 115830 - RNA, 20 nt, Artificial Sequence
  MKO10115830_B_Shroom3
  gRNA
acguugcuucagaugauccg

SEQ ID NO: 115831 - RNA, 20 nt, Artificial Sequence
  MKO10115831_B_Shroom3
  gRNA
cgaguacauaccuaggucca

SEQ ID NO: 115832 - RNA, 20 nt, Artificial Sequence
  MKO10115832_B_Shroom3
  gRNA
ggcaccagagcuaccauucc

SEQ ID NO: 115833 - RNA, 20 nt, Artificial Sequence
  MKO10115833_B_Shroom4
  gRNA
auuguauggcucccgccaag

SEQ ID NO: 115834 - RNA, 20 nt, Artificial Sequence
  MKO10115834_B_Shroom4
  gRNA
gacucaccuaguguugcaac

SEQ ID NO: 115835 - RNA, 20 nt, Artificial Sequence
  MKO10115835_B_Shroom4
  gRNA
ugcauggugguggccacguc

SEQ ID NO: 115836 - RNA, 20 nt, Artificial Sequence
  MKO10115836_B_Siae
  gRNA
ccuguggagucccuaauaca

SEQ ID NO: 115837 - RNA, 20 nt, Artificial Sequence
  MKO10115837_B_Siae
  gRNA
agugauggcgcaacagacuu

SEQ ID NO: 115838 - RNA, 20 nt, Artificial Sequence
  MKO10115838_B_Siae
  gRNA
uguugcgccaucacuucaaa

SEQ ID NO: 115839 - RNA, 20 nt, Artificial Sequence
  MKO10115839_B_Siah1a
  gRNA
ucccaaugggccccggcaag

SEQ ID NO: 115840 - RNA, 20 nt, Artificial Sequence
  MKO10115840_B_Siah1a
  gRNA
aacucugccacacaccgaaa

SEQ ID NO: 115841 - RNA, 20 nt, Artificial Sequence
  MKO10115841_B_Siah1a
  gRNA
cuguaaguggcaaggcuccu

SEQ ID NO: 115842 - RNA, 20 nt, Artificial Sequence
  MKO10115842_B_Siah1b
  gRNA
auccacagagaugagccguc

SEQ ID NO: 115843 - RNA, 20 nt, Artificial Sequence
  MKO10115843_B_Siah1b
  gRNA
ucccaaugggccccggcagg

SEQ ID NO: 115844 - RNA, 20 nt, Artificial Sequence
  MKO10115844_B_Siah1b
  gRNA
auaaugcuguagcagccuga

SEQ ID NO: 115845 - RNA, 20 nt, Artificial Sequence
  MKO10115845_B_Siah2
  gRNA
uuucaaguaccagcaugaag

SEQ ID NO: 115846 - RNA, 20 nt, Artificial Sequence
  MKO10115846_B_Siah2
  gRNA
uaagcugcugcccgacgugc

SEQ ID NO: 115847 - RNA, 20 nt, Artificial Sequence
  MKO10115847_B_Siah2
  gRNA
agcuuaacuucuggcggcau

SEQ ID NO: 115848 - RNA, 20 nt, Artificial Sequence
  MKO10115848_B_Siah3
  gRNA
uguuggaucucauucaccuc

SEQ ID NO: 115849 - RNA, 20 nt, Artificial Sequence
  MKO10115849_B_Siah3
  gRNA
cgacugcuucacuuaucgcc

SEQ ID NO: 115850 - RNA, 20 nt, Artificial Sequence
  MKO10115850_B_Siah3
  gRNA
caauccuguggauuugccgc

SEQ ID NO: 115851 - RNA, 20 nt, Artificial Sequence
  MKO10115851_B_Sidt1
  gRNA
cuuuguagauguagcgucca

SEQ ID NO: 115852 - RNA, 20 nt, Artificial Sequence
  MKO10115852_B_Sidt1
  gRNA
uggugcccacuacaaguugc

SEQ ID NO: 115853 - RNA, 20 nt, Artificial Sequence
  MKO10115853_B_Sidt1
  gRNA
uuuacuuaccugagguugag

SEQ ID NO: 115854 - RNA, 20 nt, Artificial Sequence
  MKO10115854_B_Sidt2
  gRNA
ccagcuccgagucaaccgug

SEQ ID NO: 115855 - RNA, 20 nt, Artificial Sequence
  MKO10115855_B_Sidt2
  gRNA
uguggacucgguaauuguca

SEQ ID NO: 115856 - RNA, 20 nt, Artificial Sequence
  MKO10115856_B_Sidt2
  gRNA
gaaguaccucuaccaaaaag

SEQ ID NO: 115857 - RNA, 20 nt, Artificial Sequence
  MKO10115857_B_Sigirr
  gRNA
accagcucgccaaagaguga

SEQ ID NO: 115858 - RNA, 20 nt, Artificial Sequence
  MKO10115858_B_Sigirr
  gRNA
cccugcucuauguuaagugu

SEQ ID NO: 115859 - RNA, 20 nt, Artificial Sequence
  MKO10115859_B_Sigirr
  gRNA
agagauuguguccagugucc

SEQ ID NO: 115860 - RNA, 20 nt, Artificial Sequence
  MKO10115860_B_Siglec15
  gRNA
accgagauguugacgauccg

SEQ ID NO: 115861 - RNA, 20 nt, Artificial Sequence
  MKO10115861_B_Siglec15
  gRNA
cguaccguggaggggugucc

SEQ ID NO: 115862 - RNA, 20 nt, Artificial Sequence
  MKO10115862_B_Siglec15
  gRNA
gaaaacuagaagagacgcuu

SEQ ID NO: 115863 - RNA, 20 nt, Artificial Sequence
  MKO10115863_B_Siglec1
  gRNA
cggcaggugguaauccacuc

SEQ ID NO: 115864 - RNA, 20 nt, Artificial Sequence
  MKO10115864_B_Siglec1
  gRNA
ucaccagacgacccuacaua

SEQ ID NO: 115865 - RNA, 20 nt, Artificial Sequence
  MKO10115865_B_Siglec1
  gRNA
gcacaugucccgugacuccg

SEQ ID NO: 115866 - RNA, 20 nt, Artificial Sequence
  MKO10115866_B_Siglec5
  gRNA
gcaacugccacgggcggagu

SEQ ID NO: 115867 - RNA, 20 nt, Artificial Sequence
  MKO10115867_B_Siglec5
  gRNA
cuccacagaagaugaccauc

SEQ ID NO: 115868 - RNA, 20 nt, Artificial Sequence
  MKO10115868_B_Siglec5
  gRNA
cauccaagucacaucuaccc

SEQ ID NO: 115869 - RNA, 20 nt, Artificial Sequence
  MKO10115869_B_Siglece
  gRNA
uggccagcuucaagcgucuc

SEQ ID NO: 115870 - RNA, 20 nt, Artificial Sequence
  MKO10115870_B_Siglece
  gRNA
cacugaggaacccguagugu

SEQ ID NO: 115871 - RNA, 20 nt, Artificial Sequence
  MKO10115871_B_Siglece
  gRNA
ugagucagcuccuugauaga

SEQ ID NO: 115872 - RNA, 20 nt, Artificial Sequence
  MKO10115872_B_Siglecg
  gRNA
ccgagggcgcuuccagcucu

SEQ ID NO: 115873 - RNA, 20 nt, Artificial Sequence
  MKO10115873_B_Siglecg
  gRNA
gccagauaucuucauuccug

SEQ ID NO: 115874 - RNA, 20 nt, Artificial Sequence
  MKO10115874_B_Siglecg
  gRNA
acucacaggccacucuuagu

SEQ ID NO: 115875 - RNA, 20 nt, Artificial Sequence
  MKO10115875_B_Siglech
  gRNA
uuugauagccgcuucuccca

SEQ ID NO: 115876 - RNA, 20 nt, Artificial Sequence
  MKO10115876_B_Siglech
  gRNA
cacugaggagaguguggucg

SEQ ID NO: 115877 - RNA, 20 nt, Artificial Sequence
  MKO10115877_B_Siglech
  gRNA
gcuaucaaauuccugcuucu

SEQ ID NO: 115878 - RNA, 20 nt, Artificial Sequence
  MKO10115878_B_Sigmar1
  gRNA
gcagcuugcucgacaguaug

SEQ ID NO: 115879 - RNA, 20 nt, Artificial Sequence
  MKO10115879_B_Sigmar1
  gRNA
cugucaaucaggacgauacu

SEQ ID NO: 115880 - RNA, 20 nt, Artificial Sequence
  MKO10115880_B_Sigmar1
  gRNA
cuccacgaucagccgagaga

SEQ ID NO: 115881 - RNA, 20 nt, Artificial Sequence
  MKO10115881_B_Sik1
  gRNA
aaauaucaucaagcuuuauc

SEQ ID NO: 115882 - RNA, 20 nt, Artificial Sequence
  MKO10115882_B_Sik1
  gRNA
gcaaucuggagaagaucuac

SEQ ID NO: 115883 - RNA, 20 nt, Artificial Sequence
  MKO10115883_B_Sik1
  gRNA
cuggcagauucugucagccg

SEQ ID NO: 115884 - RNA, 20 nt, Artificial Sequence
  MKO10115884_B_Sik2
  gRNA
ggucucugugcacuaccuuc

SEQ ID NO: 115885 - RNA, 20 nt, Artificial Sequence
  MKO10115885_B_Sik2
  gRNA
ucacaucauuaaacuguauc

SEQ ID NO: 115886 - RNA, 20 nt, Artificial Sequence
  MKO10115886_B_Sik2
  gRNA
uauucauguuguuauccagc

SEQ ID NO: 115887 - RNA, 20 nt, Artificial Sequence
  MKO10115887_B_Sik3
  gRNA
acagaccacuugguagccca

SEQ ID NO: 115888 - RNA, 20 nt, Artificial Sequence
  MKO10115888_B_Sik3
  gRNA
acucacccauauguccacuu

SEQ ID NO: 115889 - RNA, 20 nt, Artificial Sequence
  MKO10115889_B_Sik3
  gRNA
guucaaacagaucgucacag

SEQ ID NO: 115890 - RNA, 20 nt, Artificial Sequence
  MKO10115890_B_Sike1
  gRNA
ccagauuagagacuuacagc

SEQ ID NO: 115891 - RNA, 20 nt, Artificial Sequence
  MKO10115891_B_Sike1
  gRNA
aauggucgcuaagaaagccg

SEQ ID NO: 115892 - RNA, 20 nt, Artificial Sequence
  MKO10115892_B_Sike1
  gRNA
agugaugcggagagcuguuc

SEQ ID NO: 115893 - RNA, 20 nt, Artificial Sequence
  MKO10115893_B_Sil1
  gRNA
gugcgaaugaaccuacagac

SEQ ID NO: 115894 - RNA, 20 nt, Artificial Sequence
  MKO10115894_B_Sil1
  gRNA
gcagcucuuccgccccauug

SEQ ID NO: 115895 - RNA, 20 nt, Artificial Sequence
  MKO10115895_B_Sil1
  gRNA
auuuggccagcgcacucuug

SEQ ID NO: 115896 - RNA, 20 nt, Artificial Sequence
  MKO10115896_B_Sim1
  gRNA
cuaccacucucacuuuguac

SEQ ID NO: 115897 - RNA, 20 nt, Artificial Sequence
  MKO10115897_B_Sim1
  gRNA
ucgaacgcuccuucuuucua

SEQ ID NO: 115898 - RNA, 20 nt, Artificial Sequence
  MKO10115898_B_Sim1
  gRNA
gucaucucaucguggucagc

SEQ ID NO: 115899 - RNA, 20 nt, Artificial Sequence
  MKO10115899_B_Sim2
  gRNA
cuaccugggacaagccuaaa

SEQ ID NO: 115900 - RNA, 20 nt, Artificial Sequence
  MKO10115900_B_Sim2
  gRNA
gucaucucgucguggucaga

SEQ ID NO: 115901 - RNA, 20 nt, Artificial Sequence
  MKO10115901_B_Sim2
  gRNA
gagaccgcuucuguccauuu

SEQ ID NO: 115902 - RNA, 20 nt, Artificial Sequence
  MKO10115902_B_Simc1
  gRNA
cuauuguauaccccaacuug

SEQ ID NO: 115903 - RNA, 20 nt, Artificial Sequence
  MKO10115903_B_Simc1
  gRNA
acgcuacguagugcaaaccc

SEQ ID NO: 115904 - RNA, 20 nt, Artificial Sequence
  MKO10115904_B_Simc1
  gRNA
cccucaucgaagacuaagaa

SEQ ID NO: 115905 - RNA, 20 nt, Artificial Sequence
  MKO10115905_B_Sin3a
  gRNA
cgagugucccagcuauuuaa

SEQ ID NO: 115906 - RNA, 20 nt, Artificial Sequence
  MKO10115906_B_Sin3a
  gRNA
ugaggugcagacuaaugaca

SEQ ID NO: 115907 - RNA, 20 nt, Artificial Sequence
  MKO10115907_B_Sin3a
  gRNA
uaccgaacugcaguuucacc

SEQ ID NO: 115908 - RNA, 20 nt, Artificial Sequence
  MKO10115908_B_Sin3b
  gRNA
gacacacgccugaucacacc

SEQ ID NO: 115909 - RNA, 20 nt, Artificial Sequence
  MKO10115909_B_Sin3b
  gRNA
aagcauuaaaccccacgaug

SEQ ID NO: 115910 - RNA, 20 nt, Artificial Sequence
  MKO10115910_B_Sin3b
  gRNA
cgcucucaccuaccucgacc

SEQ ID NO: 115911 - RNA, 20 nt, Artificial Sequence
  MKO10115911_B_Sipa1l1
  gRNA
ugaugagaaccucgguccag

SEQ ID NO: 115912 - RNA, 20 nt, Artificial Sequence
  MKO10115912_B_Sipa1l1
  gRNA
acaacuaccgaauaauauuc

SEQ ID NO: 115913 - RNA, 20 nt, Artificial Sequence
  MKO10115913_B_Sipa1l1
  gRNA
ucuuguagcucaugacgcug

SEQ ID NO: 115914 - RNA, 20 nt, Artificial Sequence
  MKO10115914_B_Sipa1l2
  gRNA
cgcccggggccuaccccuca

SEQ ID NO: 115915 - RNA, 20 nt, Artificial Sequence
  MKO10115915_B_Sipa1l2
  gRNA
auggaagcagcgucgacaca

SEQ ID NO: 115916 - RNA, 20 nt, Artificial Sequence
  MKO10115916_B_Sipa1l2
  gRNA
ggugccgugccgagcugugg

SEQ ID NO: 115917 - RNA, 20 nt, Artificial Sequence
  MKO10115917_B_Sipa1l3
  gRNA
caacauccauugcuugcguc

SEQ ID NO: 115918 - RNA, 20 nt, Artificial Sequence
  MKO10115918_B_Sipa1l3
  gRNA
gagcagcucaucacgcuucg

SEQ ID NO: 115919 - RNA, 20 nt, Artificial Sequence
  MKO10115919_B_Sipa1l3
  gRNA
cgggccauaccucacgaguc

SEQ ID NO: 115920 - RNA, 20 nt, Artificial Sequence
  MKO10115920_B_Sipa1
  gRNA
agauaggccccucggggggc

SEQ ID NO: 115921 - RNA, 20 nt, Artificial Sequence
  MKO10115921_B_Sipa1
  gRNA
ggccgugagccugcgacggg

SEQ ID NO: 115922 - RNA, 20 nt, Artificial Sequence
  MKO10115922_B_Sipa1
  gRNA
cacgccuaauaaccagcaac

SEQ ID NO: 115923 - RNA, 20 nt, Artificial Sequence
  MKO10115923_B_Sirpa
  gRNA
uuugcucguaguccugcuga

SEQ ID NO: 115924 - RNA, 20 nt, Artificial Sequence
  MKO10115924_B_Sirpa
  gRNA
uguggaagauguugaccccu

SEQ ID NO: 115925 - RNA, 20 nt, Artificial Sequence
  MKO10115925_B_Sirpa
  gRNA
uccgcguccuguuucuguac

SEQ ID NO: 115926 - RNA, 20 nt, Artificial Sequence
  MKO10115926_B_Sirpb1a
  gRNA
guucagugaccagcacagua

SEQ ID NO: 115927 - RNA, 20 nt, Artificial Sequence
  MKO10115927_B_Sirpb1a
  gRNA
uggagaugagaucucucacu

SEQ ID NO: 115928 - RNA, 20 nt, Artificial Sequence
  MKO10115928_B_Sirpb1a
  gRNA
agcuaaaccaucuucaccua

SEQ ID NO: 115929 - RNA, 20 nt, Artificial Sequence
  MKO10115929_B_Sirpb1b
  gRNA
ugucugcuuagggacagcuc

SEQ ID NO: 115930 - RNA, 20 nt, Artificial Sequence
  MKO10115930_B_Sirpb1b
  gRNA
guucagugaccaccacagua

SEQ ID NO: 115931 - RNA, 20 nt, Artificial Sequence
  MKO10115931_B_Sirpb1b
  gRNA
acugaacaucagagagugaa

SEQ ID NO: 115932 - RNA, 20 nt, Artificial Sequence
  MKO10115932_B_Sirt1
  gRNA
agcgucauaucauccagcuc

SEQ ID NO: 115933 - RNA, 20 nt, Artificial Sequence
  MKO10115933_B_Sirt1
  gRNA
aacaauuccuccaccugagc

SEQ ID NO: 115934 - RNA, 20 nt, Artificial Sequence
  MKO10115934_B_Sirt1
  gRNA
auucauagcuuugucagaua

SEQ ID NO: 115935 - RNA, 20 nt, Artificial Sequence
  MKO10115935_B_Sirt2
  gRNA
gcggaagucagggauacccg

SEQ ID NO: 115936 - RNA, 20 nt, Artificial Sequence
  MKO10115936_B_Sirt2
  gRNA
aggccgcaaggucaucuguu

SEQ ID NO: 115937 - RNA, 20 nt, Artificial Sequence
  MKO10115937_B_Sirt2
  gRNA
gacuuccgcuccccguccac

SEQ ID NO: 115938 - RNA, 20 nt, Artificial Sequence
  MKO10115938_B_Sirt3
  gRNA
agucucgauugaugagcagu

SEQ ID NO: 115939 - RNA, 20 nt, Artificial Sequence
  MKO10115939_B_Sirt3
  gRNA
ccaaagcgaagucagccaua

SEQ ID NO: 115940 - RNA, 20 nt, Artificial Sequence
  MKO10115940_B_Sirt3
  gRNA
cgugcauguagcuguuacaa

SEQ ID NO: 115941 - RNA, 20 nt, Artificial Sequence
  MKO10115941_B_Sirt4
  gRNA
ugcggacgaaaucaaugugc

SEQ ID NO: 115942 - RNA, 20 nt, Artificial Sequence
  MKO10115942_B_Sirt4
  gRNA
ggcaagccaaaucgucagac

SEQ ID NO: 115943 - RNA, 20 nt, Artificial Sequence
  MKO10115943_B_Sirt4
  gRNA
ccccacccggucugacgauu

SEQ ID NO: 115944 - RNA, 20 nt, Artificial Sequence
  MKO10115944_B_Sirt5
  gRNA
ccgaucugcccagcuuuagc

SEQ ID NO: 115945 - RNA, 20 nt, Artificial Sequence
  MKO10115945_B_Sirt5
  gRNA
gaugcaacucgucaauguuc

SEQ ID NO: 115946 - RNA, 20 nt, Artificial Sequence
  MKO10115946_B_Sirt5
  gRNA
gcuggcguuagugcggagag

SEQ ID NO: 115947 - RNA, 20 nt, Artificial Sequence
  MKO10115947_B_Sirt6
  gRNA
gcccguguggaaaaccacgc

SEQ ID NO: 115948 - RNA, 20 nt, Artificial Sequence
  MKO10115948_B_Sirt6
  gRNA
caacacucacgucuuacacu

SEQ ID NO: 115949 - RNA, 20 nt, Artificial Sequence
  MKO10115949_B_Sirt6
  gRNA
ccuacaggcccgaagucccc

SEQ ID NO: 115950 - RNA, 20 nt, Artificial Sequence
  MKO10115950_B_Sirt7
  gRNA
cgcgacucgccuccuccugg

SEQ ID NO: 115951 - RNA, 20 nt, Artificial Sequence
  MKO10115951_B_Sirt7
  gRNA
uugguugucuacacgggcgc

SEQ ID NO: 115952 - RNA, 20 nt, Artificial Sequence
  MKO10115952_B_Sirt7
  gRNA
cagcuucuaucccagauuau

SEQ ID NO: 115953 - RNA, 20 nt, Artificial Sequence
  MKO10115953_B_Sis
  gRNA
ucagucacgaaugacaacag

SEQ ID NO: 115954 - RNA, 20 nt, Artificial Sequence
  MKO10115954_B_Sis
  gRNA
cugacgcagcaguauagcca

SEQ ID NO: 115955 - RNA, 20 nt, Artificial Sequence
  MKO10115955_B_Sis
  gRNA
ugcucaggcggacaccuucc

SEQ ID NO: 115956 - RNA, 20 nt, Artificial Sequence
  MKO10115956_B_Sit1
  gRNA
cacacggaggcauaaaguuc

SEQ ID NO: 115957 - RNA, 20 nt, Artificial Sequence
  MKO10115957_B_Sit1
  gRNA
auacaggggaacuucuuccg

SEQ ID NO: 115958 - RNA, 20 nt, Artificial Sequence
  MKO10115958_B_Sit1
  gRNA
gguccuccucagcugggugc

SEQ ID NO: 115959 - RNA, 20 nt, Artificial Sequence
  MKO10115959_B_Siva1
  gRNA
cggccacucaccaccuucug

SEQ ID NO: 115960 - RNA, 20 nt, Artificial Sequence
  MKO10115960_B_Siva1
  gRNA
cggucugcagccagugcgag

SEQ ID NO: 115961 - RNA, 20 nt, Artificial Sequence
  MKO10115961_B_Siva1
  gRNA
cagacuucagugacuccugc

SEQ ID NO: 115962 - RNA, 20 nt, Artificial Sequence
  MKO10115962_B_Six1
  gRNA
agcggcuugcccccuuccag

SEQ ID NO: 115963 - RNA, 20 nt, Artificial Sequence
  MKO10115963_B_Six1
  gRNA
guggaggccgagaaacuucg

SEQ ID NO: 115964 - RNA, 20 nt, Artificial Sequence
  MKO10115964_B_Six1
  gRNA
gcgcacccgauauuugccca

SEQ ID NO: 115965 - RNA, 20 nt, Artificial Sequence
  MKO10115965_B_Six2
  gRNA
uccacaagguuggccgacau

SEQ ID NO: 115966 - RNA, 20 nt, Artificial Sequence
  MKO10115966_B_Six2
  gRNA
caaggcgcacuacaucgagg

SEQ ID NO: 115967 - RNA, 20 nt, Artificial Sequence
  MKO10115967_B_Six2
  gRNA
agcagggcggcaacaucgag

SEQ ID NO: 115968 - RNA, 20 nt, Artificial Sequence
  MKO10115968_B_Six3
  gRNA
caccggcacuucgauccucu

SEQ ID NO: 115969 - RNA, 20 nt, Artificial Sequence
  MKO10115969_B_Six3
  gRNA
cgccgcuacucgccagaagu

SEQ ID NO: 115970 - RNA, 20 nt, Artificial Sequence
  MKO10115970_B_Six3
  gRNA
cgacgacagcgcgcgcgcgc

SEQ ID NO: 115971 - RNA, 20 nt, Artificial Sequence
  MKO10115971_B_Six4
  gRNA
aagauaucacuaagcucguc

SEQ ID NO: 115972 - RNA, 20 nt, Artificial Sequence
  MKO10115972_B_Six4
  gRNA
cucgaaauccaaguacgucc

SEQ ID NO: 115973 - RNA, 20 nt, Artificial Sequence
  MKO10115973_B_Six4
  gRNA
ccccugaacagcgaaucgga

SEQ ID NO: 115974 - RNA, 20 nt, Artificial Sequence
  MKO10115974_B_Six5
  gRNA
cccagucauuaucaauagcu

SEQ ID NO: 115975 - RNA, 20 nt, Artificial Sequence
  MKO10115975_B_Six5
  gRNA
ccacggguaccgacugcagc

SEQ ID NO: 115976 - RNA, 20 nt, Artificial Sequence
  MKO10115976_B_Six5
  gRNA
ucugguagccccauugucac

SEQ ID NO: 115977 - RNA, 20 nt, Artificial Sequence
  MKO10115977_B_Six6
  gRNA
cuccgagcguagcacccgcc

SEQ ID NO: 115978 - RNA, 20 nt, Artificial Sequence
  MKO10115978_B_Six6
  gRNA
gcucgcgguaguugccaccg

SEQ ID NO: 115979 - RNA, 20 nt, Artificial Sequence
  MKO10115979_B_Six6
  gRNA
gcugcgagcgagagccaucg

SEQ ID NO: 115980 - RNA, 20 nt, Artificial Sequence
  MKO10115980_B_Ska1
  gRNA
ucagcuuugucugacucuuu

SEQ ID NO: 115981 - RNA, 20 nt, Artificial Sequence
  MKO10115981_B_Ska1
  gRNA
aagaccaccuuaaguaaaau

SEQ ID NO: 115982 - RNA, 20 nt, Artificial Sequence
  MKO10115982_B_Ska1
  gRNA
acagagcucauagaugcuuu

SEQ ID NO: 115983 - RNA, 20 nt, Artificial Sequence
  MKO10115983_B_Ska2
  gRNA
acuauucaauauggaggcgg

SEQ ID NO: 115984 - RNA, 20 nt, Artificial Sequence
  MKO10115984_B_Ska2
  gRNA
aguagcacaaaugcagcucu

SEQ ID NO: 115985 - RNA, 20 nt, Artificial Sequence
  MKO10115985_B_Ska2
  gRNA
agcuuuaugugcacgcuuua

SEQ ID NO: 115986 - RNA, 20 nt, Artificial Sequence
  MKO10115986_B_Ska3
  gRNA
uccauccuuagagcacaccg

SEQ ID NO: 115987 - RNA, 20 nt, Artificial Sequence
  MKO10115987_B_Ska3
  gRNA
aauggcaaaagaauuaucac

SEQ ID NO: 115988 - RNA, 20 nt, Artificial Sequence
  MKO10115988_B_Ska3
  gRNA
gaagacuuugaagauucucc

SEQ ID NO: 115989 - RNA, 20 nt, Artificial Sequence
  MKO10115989_B_Skap1
  gRNA
ucacgucagaagcauccuuu

SEQ ID NO: 115990 - RNA, 20 nt, Artificial Sequence
  MKO10115990_B_Skap1
  gRNA
guuuccagcaaaucaaaucc

SEQ ID NO: 115991 - RNA, 20 nt, Artificial Sequence
  MKO10115991_B_Skap1
  gRNA
aggagccaacagaucuccuc

SEQ ID NO: 115992 - RNA, 20 nt, Artificial Sequence
  MKO10115992_B_Skap2
  gRNA
agguccugggcugcaauggg

SEQ ID NO: 115993 - RNA, 20 nt, Artificial Sequence
  MKO10115993_B_Skap2
  gRNA
cuucaggaauuucaagacaa

SEQ ID NO: 115994 - RNA, 20 nt, Artificial Sequence
  MKO10115994_B_Skap2
  gRNA
aaauuuauccaagaaagcca

SEQ ID NO: 115995 - RNA, 20 nt, Artificial Sequence
  MKO10115995_B_Skida1
  gRNA
gcuagaagcccucguccuac

SEQ ID NO: 115996 - RNA, 20 nt, Artificial Sequence
  MKO10115996_B_Skida1
  gRNA
aaccaaacccgcugcuuucg

SEQ ID NO: 115997 - RNA, 20 nt, Artificial Sequence
  MKO10115997_B_Skida1
  gRNA
agucugguaguaggcggcgg

SEQ ID NO: 115998 - RNA, 20 nt, Artificial Sequence
  MKO10115998_B_Skil
  gRNA
ugcugcgucccagucuaaag

SEQ ID NO: 115999 - RNA, 20 nt, Artificial Sequence
  MKO10115999_B_Skil
  gRNA
augguauccuguuauaaaac

SEQ ID NO: 116000 - RNA, 20 nt, Artificial Sequence
  MKO10116000_B_Skil
  gRNA
gcagaugugagcgacacauu

SEQ ID NO: 116001 - RNA, 20 nt, Artificial Sequence
  MKO10116001_B_Skint10
  gRNA
uucagauauccuauucaaau

SEQ ID NO: 116002 - RNA, 20 nt, Artificial Sequence
  MKO10116002_B_Skint10
  gRNA
ucuaccuugggugaguacug

SEQ ID NO: 116003 - RNA, 20 nt, Artificial Sequence
  MKO10116003_B_Skint10
  gRNA
aggaaggucauaaagaaucc

SEQ ID NO: 116004 - RNA, 20 nt, Artificial Sequence
  MKO10116004_B_Skint11
  gRNA
cucucaaguuuagaugcccu

SEQ ID NO: 116005 - RNA, 20 nt, Artificial Sequence
  MKO10116005_B_Skint11
  gRNA
ucuccuccuaguaaugagcu

SEQ ID NO: 116006 - RNA, 20 nt, Artificial Sequence
  MKO10116006_B_Skint11
  gRNA
gagcuugcuguccacuuauc

SEQ ID NO: 116007 - RNA, 20 nt, Artificial Sequence
  MKO10116007_B_Skint1
  gRNA
caggcucuguauagagguuc

SEQ ID NO: 116008 - RNA, 20 nt, Artificial Sequence
  MKO10116008_B_Skint1
  gRNA
cugcuacaucaugagcauaa

SEQ ID NO: 116009 - RNA, 20 nt, Artificial Sequence
  MKO10116009_B_Skint1
  gRNA
cuccaguuuguaaguggaag

SEQ ID NO: 116010 - RNA, 20 nt, Artificial Sequence
  MKO10116010_B_Skint2
  gRNA
ugucuuacacuuccuccaga

SEQ ID NO: 116011 - RNA, 20 nt, Artificial Sequence
  MKO10116011_B_Skint2
  gRNA
gccacaacaagcacagcaua

SEQ ID NO: 116012 - RNA, 20 nt, Artificial Sequence
  MKO10116012_B_Skint2
  gRNA
cugucaguuuaaagauccug

SEQ ID NO: 116013 - RNA, 20 nt, Artificial Sequence
  MKO10116013_B_Skint3
  gRNA
ccaccuaauggggcaaggac

SEQ ID NO: 116014 - RNA, 20 nt, Artificial Sequence
  MKO10116014_B_Skint3
  gRNA
cugaacucaguacuaacauc

SEQ ID NO: 116015 - RNA, 20 nt, Artificial Sequence
  MKO10116015_B_Skint3
  gRNA
aaguaaguaaauugagcuug

SEQ ID NO: 116016 - RNA, 20 nt, Artificial Sequence
  MKO10116016_B_Skint4
  gRNA
guucagcaacagcucauaca

SEQ ID NO: 116017 - RNA, 20 nt, Artificial Sequence
  MKO10116017_B_Skint4
  gRNA
ugucuuaugccuccuccaga

SEQ ID NO: 116018 - RNA, 20 nt, Artificial Sequence
  MKO10116018_B_Skint4
  gRNA
caaauuguucaacaugucaa

SEQ ID NO: 116019 - RNA, 20 nt, Artificial Sequence
  MKO10116019_B_Skint5
  gRNA
augcaucccccaaauaucaa

SEQ ID NO: 116020 - RNA, 20 nt, Artificial Sequence
  MKO10116020_B_Skint5
  gRNA
uuauuaaauccaacucucac

SEQ ID NO: 116021 - RNA, 20 nt, Artificial Sequence
  MKO10116021_B_Skint5
  gRNA
aaacaaaacaacgcagugug

SEQ ID NO: 116022 - RNA, 20 nt, Artificial Sequence
  MKO10116022_B_Skint6
  gRNA
uguagacaauugcuucauuc

SEQ ID NO: 116023 - RNA, 20 nt, Artificial Sequence
  MKO10116023_B_Skint6
  gRNA
aagauuucaaaguuccagug

SEQ ID NO: 116024 - RNA, 20 nt, Artificial Sequence
  MKO10116024_B_Skint6
  gRNA
gaccauaccuagauccacac

SEQ ID NO: 116025 - RNA, 20 nt, Artificial Sequence
  MKO10116025_B_Skint7
  gRNA
cuaaacuuuccauccaaaua

SEQ ID NO: 116026 - RNA, 20 nt, Artificial Sequence
  MKO10116026_B_Skint7
  gRNA
acaacuuaccugucacauug

SEQ ID NO: 116027 - RNA, 20 nt, Artificial Sequence
  MKO10116027_B_Skint7
  gRNA
guucaggcuccugaugcuga

SEQ ID NO: 116028 - RNA, 20 nt, Artificial Sequence
  MKO10116028_B_Skint8
  gRNA
acaacuuaccugucacguug

SEQ ID NO: 116029 - RNA, 20 nt, Artificial Sequence
  MKO10116029_B_Skint8
  gRNA
gucaugguggaauguaauac

SEQ ID NO: 116030 - RNA, 20 nt, Artificial Sequence
  MKO10116030_B_Skint8
  gRNA
auuaccuugacuccugaaaa

SEQ ID NO: 116031 - RNA, 20 nt, Artificial Sequence
  MKO10116031_B_Skint9
  gRNA
uacgugaguuucagaaguag

SEQ ID NO: 116032 - RNA, 20 nt, Artificial Sequence
  MKO10116032_B_Skint9
  gRNA
cacagccaauuaguauacaa

SEQ ID NO: 116033 - RNA, 20 nt, Artificial Sequence
  MKO10116033_B_Skint9
  gRNA
cauauccauuguauacuaau

SEQ ID NO: 116034 - RNA, 20 nt, Artificial Sequence
  MKO10116034_B_Skiv2l2
  gRNA
cacugacuguaccuugacuc

SEQ ID NO: 116035 - RNA, 20 nt, Artificial Sequence
  MKO10116035_B_Skiv2l2
  gRNA
cagucaguggaaacaguuga

SEQ ID NO: 116036 - RNA, 20 nt, Artificial Sequence
  MKO10116036_B_Skiv2l2
  gRNA
cacuacuuacucggcacaca

SEQ ID NO: 116037 - RNA, 20 nt, Artificial Sequence
  MKO10116037_B_Skiv2l
  gRNA
cacagaucuggggcgcaugg

SEQ ID NO: 116038 - RNA, 20 nt, Artificial Sequence
  MKO10116038_B_Skiv2l
  gRNA
ggccagccucccagucgcua

SEQ ID NO: 116039 - RNA, 20 nt, Artificial Sequence
  MKO10116039_B_Skiv2l
  gRNA
gagugcucuacaccguguag

SEQ ID NO: 116040 - RNA, 20 nt, Artificial Sequence
  MKO10116040_B_Ski
  gRNA
ucccagcuuugauucgagac

SEQ ID NO: 116041 - RNA, 20 nt, Artificial Sequence
  MKO10116041_B_Ski
  gRNA
caguccacccugcaccaccg

SEQ ID NO: 116042 - RNA, 20 nt, Artificial Sequence
  MKO10116042_B_Ski
  gRNA
acgggcggagcaugcaugcc

SEQ ID NO: 116043 - RNA, 20 nt, Artificial Sequence
  MKO10116043_B_Skor1
  gRNA
cgaacacgugaagaguacgg

SEQ ID NO: 116044 - RNA, 20 nt, Artificial Sequence
  MKO10116044_B_Skor1
  gRNA
cgcagguguaugcgccugaa

SEQ ID NO: 116045 - RNA, 20 nt, Artificial Sequence
  MKO10116045_B_Skor1
  gRNA
ucaccucgaucuguauuugc

SEQ ID NO: 116046 - RNA, 20 nt, Artificial Sequence
  MKO10116046_B_Skor2
  gRNA
uguuugagcaaauagauuug

SEQ ID NO: 116047 - RNA, 20 nt, Artificial Sequence
  MKO10116047_B_Skor2
  gRNA
uuugguccuagauaagaaca

SEQ ID NO: 116048 - RNA, 20 nt, Artificial Sequence
  MKO10116048_B_Skor2
  gRNA
ccuuuguagauauaauaacu

SEQ ID NO: 116049 - RNA, 20 nt, Artificial Sequence
  MKO10116049_B_Skp1a
  gRNA
uaaugcagcaauucuaaaga

SEQ ID NO: 116050 - RNA, 20 nt, Artificial Sequence
  MKO10116050_B_Skp1a
  gRNA
agaugacccuccuccuccug

SEQ ID NO: 116051 - RNA, 20 nt, Artificial Sequence
  MKO10116051_B_Skp1a
  gRNA
gaggagggucaucuuugugg

SEQ ID NO: 116052 - RNA, 20 nt, Artificial Sequence
  MKO10116052_B_Skp2
  gRNA
uugcccuugacucguuuccu

SEQ ID NO: 116053 - RNA, 20 nt, Artificial Sequence
  MKO10116053_B_Skp2
  gRNA
uuaggcucgaugagucucuc

SEQ ID NO: 116054 - RNA, 20 nt, Artificial Sequence
  MKO10116054_B_Skp2
  gRNA
cucuuuccggguacagcaca

SEQ ID NO: 116055 - RNA, 20 nt, Artificial Sequence
  MKO10116055_B_Sla2
  gRNA
aggauacagcgucuugacaa

SEQ ID NO: 116056 - RNA, 20 nt, Artificial Sequence
  MKO10116056_B_Sla2
  gRNA
acaguccagucggaagucuc

SEQ ID NO: 116057 - RNA, 20 nt, Artificial Sequence
  MKO10116057_B_Sla2
  gRNA
gacucagccgcccugcaucu

SEQ ID NO: 116058 - RNA, 20 nt, Artificial Sequence
  MKO10116058_B_Slain1
  gRNA
ggaggaugacucuauaucca

SEQ ID NO: 116059 - RNA, 20 nt, Artificial Sequence
  MKO10116059_B_Slain1
  gRNA
agagucauccuccaacuccg

SEQ ID NO: 116060 - RNA, 20 nt, Artificial Sequence
  MKO10116060_B_Slain1
  gRNA
caccccagccccgucuuccg

SEQ ID NO: 116061 - RNA, 20 nt, Artificial Sequence
  MKO10116061_B_Slain2
  gRNA
acuuaacucacuaucuauag

SEQ ID NO: 116062 - RNA, 20 nt, Artificial Sequence
  MKO10116062_B_Slain2
  gRNA
cugaugugcagauucuagcg

SEQ ID NO: 116063 - RNA, 20 nt, Artificial Sequence
  MKO10116063_B_Slain2
  gRNA
cacuccuuaccugaauuucc

SEQ ID NO: 116064 - RNA, 20 nt, Artificial Sequence
  MKO10116064_B_Slamf1
  gRNA
aagauuauaacgacccccag

SEQ ID NO: 116065 - RNA, 20 nt, Artificial Sequence
  MKO10116065_B_Slamf1
  gRNA
gcuugcaugcuugcgaugau

SEQ ID NO: 116066 - RNA, 20 nt, Artificial Sequence
  MKO10116066_B_Slamf1
  gRNA
gcaauauacucuuguaccac

SEQ ID NO: 116067 - RNA, 20 nt, Artificial Sequence
  MKO10116067_B_Slamf6
  gRNA
gcaaaucagcaaccuuacca

SEQ ID NO: 116068 - RNA, 20 nt, Artificial Sequence
  MKO10116068_B_Slamf6
  gRNA
gucaaacugucucaguugag

SEQ ID NO: 116069 - RNA, 20 nt, Artificial Sequence
  MKO10116069_B_Slamf6
  gRNA
ccuggauguuggcuagucaa

SEQ ID NO: 116070 - RNA, 20 nt, Artificial Sequence
  MKO10116070_B_Slamf7
  gRNA
gauuuacaguacaucgaguc

SEQ ID NO: 116071 - RNA, 20 nt, Artificial Sequence
  MKO10116071_B_Slamf7
  gRNA
caaggacucacuuccgugua

SEQ ID NO: 116072 - RNA, 20 nt, Artificial Sequence
  MKO10116072_B_Slamf7
  gRNA
cgacuugugcccucacuuag

SEQ ID NO: 116073 - RNA, 20 nt, Artificial Sequence
  MKO10116073_B_Slamf8
  gRNA
ucggcauaccugccucguga

SEQ ID NO: 116074 - RNA, 20 nt, Artificial Sequence
  MKO10116074_B_Slamf8
  gRNA
ccaaccccucaauaccuguc

SEQ ID NO: 116075 - RNA, 20 nt, Artificial Sequence
  MKO10116075_B_Slamf8
  gRNA
gccagauagccucacgcacu

SEQ ID NO: 116076 - RNA, 20 nt, Artificial Sequence
  MKO10116076_B_Slamf9
  gRNA
ccaauaugggggcccuucug

SEQ ID NO: 116077 - RNA, 20 nt, Artificial Sequence
  MKO10116077_B_Slamf9
  gRNA
aagcuccuuccuauacuugc

SEQ ID NO: 116078 - RNA, 20 nt, Artificial Sequence
  MKO10116078_B_Slamf9
  gRNA
agagaaaccgcaucaaacug

SEQ ID NO: 116079 - RNA, 20 nt, Artificial Sequence
  MKO10116079_B_Sla
  gRNA
gaggccguuauccagcagug

SEQ ID NO: 116080 - RNA, 20 nt, Artificial Sequence
  MKO10116080_B_Sla
  gRNA
aagcuaccaaucuuuguauc

SEQ ID NO: 116081 - RNA, 20 nt, Artificial Sequence
  MKO10116081_B_Sla
  gRNA
gucagacuuacccucacugc

SEQ ID NO: 116082 - RNA, 20 nt, Artificial Sequence
  MKO10116082_B_Slbp
  gRNA
uguagcuuuacaacuccuga

SEQ ID NO: 116083 - RNA, 20 nt, Artificial Sequence
  MKO10116083_B_Slbp
  gRNA
cuaugaucgauauauuaaag

SEQ ID NO: 116084 - RNA, 20 nt, Artificial Sequence
  MKO10116084_B_Slbp
  gRNA
augaaagugucuugaugaga

SEQ ID NO: 116085 - RNA, 20 nt, Artificial Sequence
  MKO10116085_B_Slc10a1
  gRNA
cucucuuccgacuaaaucca

SEQ ID NO: 116086 - RNA, 20 nt, Artificial Sequence
  MKO10116086_B_Slc10a1
  gRNA
uagaacagaguuggacguuu

SEQ ID NO: 116087 - RNA, 20 nt, Artificial Sequence
  MKO10116087_B_Slc10a1
  gRNA
aacagugguccaaugacuuc

SEQ ID NO: 116088 - RNA, 20 nt, Artificial Sequence
  MKO10116088_B_Slc10a2
  gRNA
uuccagauuggauccaucac

SEQ ID NO: 116089 - RNA, 20 nt, Artificial Sequence
  MKO10116089_B_Slc10a2
  gRNA
gaacccaaacuguggauuau

SEQ ID NO: 116090 - RNA, 20 nt, Artificial Sequence
  MKO10116090_B_Slc10a2
  gRNA
gaacaccagguugagauccu

SEQ ID NO: 116091 - RNA, 20 nt, Artificial Sequence
  MKO10116091_B_Slc10a3
  gRNA
gaucaccacacccgcugcua

SEQ ID NO: 116092 - RNA, 20 nt, Artificial Sequence
  MKO10116092_B_Slc10a3
  gRNA
cuaggaugaagacccccaug

SEQ ID NO: 116093 - RNA, 20 nt, Artificial Sequence
  MKO10116093_B_Slc10a3
  gRNA
aguggucacuauuugaguau

SEQ ID NO: 116094 - RNA, 20 nt, Artificial Sequence
  MKO10116094_B_Slc10a4
  gRNA
uccucggucagagggcgguc

SEQ ID NO: 116095 - RNA, 20 nt, Artificial Sequence
  MKO10116095_B_Slc10a4
  gRNA
ugcagcacucucauuccuau

SEQ ID NO: 116096 - RNA, 20 nt, Artificial Sequence
  MKO10116096_B_Slc10a4
  gRNA
aggcacggcuguagauccag

SEQ ID NO: 116097 - RNA, 20 nt, Artificial Sequence
  MKO10116097_B_Slc10a5
  gRNA
ucuaaacagauugcuuucgc

SEQ ID NO: 116098 - RNA, 20 nt, Artificial Sequence
  MKO10116098_B_Slc10a5
  gRNA
gacuugcacaucaacguccc

SEQ ID NO: 116099 - RNA, 20 nt, Artificial Sequence
  MKO10116099_B_Slc10a5
  gRNA
gagcuugacuuuaauguucg

SEQ ID NO: 116100 - RNA, 20 nt, Artificial Sequence
  MKO10116100_B_Slc10a6
  gRNA
ccagcugcuaaacuuugcau

SEQ ID NO: 116101 - RNA, 20 nt, Artificial Sequence
  MKO10116101_B_Slc10a6
  gRNA
ugcuuaggucggagccauuc

SEQ ID NO: 116102 - RNA, 20 nt, Artificial Sequence
  MKO10116102_B_Slc10a6
  gRNA
gacuguaccuuugccaagau

SEQ ID NO: 116103 - RNA, 20 nt, Artificial Sequence
  MKO10116103_B_Slc10a7
  gRNA
cucauuuccaccaacugccu

SEQ ID NO: 116104 - RNA, 20 nt, Artificial Sequence
  MKO10116104_B_Slc10a7
  gRNA
gcgauauuuaauucagcauu

SEQ ID NO: 116105 - RNA, 20 nt, Artificial Sequence
  MKO10116105_B_Slc10a7
  gRNA
auguaggacacaguuaucuc

SEQ ID NO: 116106 - RNA, 20 nt, Artificial Sequence
  MKO10116106_B_Slc11a1
  gRNA
gcccggcugggcguggugac

SEQ ID NO: 116107 - RNA, 20 nt, Artificial Sequence
  MKO10116107_B_Slc11a1
  gRNA
uccuucaaucugcucuccgc

SEQ ID NO: 116108 - RNA, 20 nt, Artificial Sequence
  MKO10116108_B_Slc11a1
  gRNA
auugaguccgaccuucaagc

SEQ ID NO: 116109 - RNA, 20 nt, Artificial Sequence
  MKO10116109_B_Slc11a2
  gRNA
aggguugauggcgccaaggc

SEQ ID NO: 116110 - RNA, 20 nt, Artificial Sequence
  MKO10116110_B_Slc11a2
  gRNA
aaaucagauucgauguuucc

SEQ ID NO: 116111 - RNA, 20 nt, Artificial Sequence
  MKO10116111_B_Slc11a2
  gRNA
ccacuccaagucucgcugca

SEQ ID NO: 116112 - RNA, 20 nt, Artificial Sequence
  MKO10116112_B_Slc12a1
  gRNA
ccuauugacccaccgaacuc

SEQ ID NO: 116113 - RNA, 20 nt, Artificial Sequence
  MKO10116113_B_Slc12a1
  gRNA
auuguaggagaagcgggaau

SEQ ID NO: 116114 - RNA, 20 nt, Artificial Sequence
  MKO10116114_B_Slc12a1
  gRNA
ugcgaugcaugcugaacauc

SEQ ID NO: 116115 - RNA, 20 nt, Artificial Sequence
  MKO10116115_B_Slc12a2
  gRNA
ccggaauuugguggugcaau

SEQ ID NO: 116116 - RNA, 20 nt, Artificial Sequence
  MKO10116116_B_Slc12a2
  gRNA
ccaauugcaccaccaaauuc

SEQ ID NO: 116117 - RNA, 20 nt, Artificial Sequence
  MKO10116117_B_Slc12a2
  gRNA
acuguugugacaacuaucac

SEQ ID NO: 116118 - RNA, 20 nt, Artificial Sequence
  MKO10116118_B_Slc12a3
  gRNA
gcccgccugcgccguaaucc

SEQ ID NO: 116119 - RNA, 20 nt, Artificial Sequence
  MKO10116119_B_Slc12a3
  gRNA
acccgacuugaccuugccau

SEQ ID NO: 116120 - RNA, 20 nt, Artificial Sequence
  MKO10116120_B_Slc12a3
  gRNA
ugggcuuugcagaaaccgua

SEQ ID NO: 116121 - RNA, 20 nt, Artificial Sequence
  MKO10116121_B_Slc12a4
  gRNA
ggagcuggacauccgcccaa

SEQ ID NO: 116122 - RNA, 20 nt, Artificial Sequence
  MKO10116122_B_Slc12a4
  gRNA
ucccaugagugugcccaugc

SEQ ID NO: 116123 - RNA, 20 nt, Artificial Sequence
  MKO10116123_B_Slc12a4
  gRNA
uccucuuccugcggcugacc

SEQ ID NO: 116124 - RNA, 20 nt, Artificial Sequence
  MKO10116124_B_Slc12a5
  gRNA
uggaaaaaagaagccggugc

SEQ ID NO: 116125 - RNA, 20 nt, Artificial Sequence
  MKO10116125_B_Slc12a5
  gRNA
caacuacaccaaccuacccc

SEQ ID NO: 116126 - RNA, 20 nt, Artificial Sequence
  MKO10116126_B_Slc12a5
  gRNA
cauaccaggcacaacaccau

SEQ ID NO: 116127 - RNA, 20 nt, Artificial Sequence
  MKO10116127_B_Slc12a6
  gRNA
uugugucagauuuguauagu

SEQ ID NO: 116128 - RNA, 20 nt, Artificial Sequence
  MKO10116128_B_Slc12a6
  gRNA
gggaacagcuggaauccuuc

SEQ ID NO: 116129 - RNA, 20 nt, Artificial Sequence
  MKO10116129_B_Slc12a6
  gRNA
uucgucuccuucuucauagu

SEQ ID NO: 116130 - RNA, 20 nt, Artificial Sequence
  MKO10116130_B_Slc12a7
  gRNA
accuccacauuauugaugaa

SEQ ID NO: 116131 - RNA, 20 nt, Artificial Sequence
  MKO10116131_B_Slc12a7
  gRNA
cagcccuuucaucaauaaug

SEQ ID NO: 116132 - RNA, 20 nt, Artificial Sequence
  MKO10116132_B_Slc12a7
  gRNA
accagcugcccccacaaucc

SEQ ID NO: 116133 - RNA, 20 nt, Artificial Sequence
  MKO10116133_B_Slc12a8
  gRNA
ggggcuuaccuggguccagg

SEQ ID NO: 116134 - RNA, 20 nt, Artificial Sequence
  MKO10116134_B_Slc12a8
  gRNA
auguugcucuguagcaguuc

SEQ ID NO: 116135 - RNA, 20 nt, Artificial Sequence
  MKO10116135_B_Slc12a8
  gRNA
auucugccagaguacagccc

SEQ ID NO: 116136 - RNA, 20 nt, Artificial Sequence
  MKO10116136_B_Slc12a9
  gRNA
caucccguuagcuccucgac

SEQ ID NO: 116137 - RNA, 20 nt, Artificial Sequence
  MKO10116137_B_Slc12a9
  gRNA
ugcccgugcagccguugaag

SEQ ID NO: 116138 - RNA, 20 nt, Artificial Sequence
  MKO10116138_B_Slc12a9
  gRNA
cacagccacagacguuagcc

SEQ ID NO: 116139 - RNA, 20 nt, Artificial Sequence
  MKO10116139_B_Slc13a1
  gRNA
ugcacaagaggaucgcucug

SEQ ID NO: 116140 - RNA, 20 nt, Artificial Sequence
  MKO10116140_B_Slc13a1
  gRNA
agaacgcaugaucccaaaca

SEQ ID NO: 116141 - RNA, 20 nt, Artificial Sequence
  MKO10116141_B_Slc13a1
  gRNA
gacuuucaccuucugcuaau

SEQ ID NO: 116142 - RNA, 20 nt, Artificial Sequence
  MKO10116142_B_Slc13a2
  gRNA
gacggguaccacacccaacc

SEQ ID NO: 116143 - RNA, 20 nt, Artificial Sequence
  MKO10116143_B_Slc13a2
  gRNA
gcugaagcggugaugcucuu

SEQ ID NO: 116144 - RNA, 20 nt, Artificial Sequence
  MKO10116144_B_Slc13a2
  gRNA
uacaccacagcagcgccaug

SEQ ID NO: 116145 - RNA, 20 nt, Artificial Sequence
  MKO10116145_B_Slc13a3
  gRNA
accaguacaccgccaugagc

SEQ ID NO: 116146 - RNA, 20 nt, Artificial Sequence
  MKO10116146_B_Slc13a3
  gRNA
cugugcucucgucgccuucc

SEQ ID NO: 116147 - RNA, 20 nt, Artificial Sequence
  MKO10116147_B_Slc13a3
  gRNA
uccuccuccuuggagucauc

SEQ ID NO: 116148 - RNA, 20 nt, Artificial Sequence
  MKO10116148_B_Slc13a4
  gRNA
gccuuccucuacccguucuu

SEQ ID NO: 116149 - RNA, 20 nt, Artificial Sequence
  MKO10116149_B_Slc13a4
  gRNA
cugcagcaccgccuccacga

SEQ ID NO: 116150 - RNA, 20 nt, Artificial Sequence
  MKO10116150_B_Slc13a4
  gRNA
caucguggaggcggugcugc

SEQ ID NO: 116151 - RNA, 20 nt, Artificial Sequence
  MKO10116151_B_Slc13a5
  gRNA
uacagccaccuugaccggga

SEQ ID NO: 116152 - RNA, 20 nt, Artificial Sequence
  MKO10116152_B_Slc13a5
  gRNA
guguguuuaccgugagggcu

SEQ ID NO: 116153 - RNA, 20 nt, Artificial Sequence
  MKO10116153_B_Slc13a5
  gRNA
aacgcuggaaacuucauaag

SEQ ID NO: 116154 - RNA, 20 nt, Artificial Sequence
  MKO10116154_B_Slc14a1
  gRNA
cuacgucacgggugacauga

SEQ ID NO: 116155 - RNA, 20 nt, Artificial Sequence
  MKO10116155_B_Slc14a1
  gRNA
accugucuuggcuaagcaag

SEQ ID NO: 116156 - RNA, 20 nt, Artificial Sequence
  MKO10116156_B_Slc14a1
  gRNA
uucauggacuggauacuucg

SEQ ID NO: 116157 - RNA, 20 nt, Artificial Sequence
  MKO10116157_B_Slc14a2
  gRNA
uggacgauugcugggacacu

SEQ ID NO: 116158 - RNA, 20 nt, Artificial Sequence
  MKO10116158_B_Slc14a2
  gRNA
ucaaucguggggcugcuagc

SEQ ID NO: 116159 - RNA, 20 nt, Artificial Sequence
  MKO10116159_B_Slc14a2
  gRNA
cagccccacgauugacccua

SEQ ID NO: 116160 - RNA, 20 nt, Artificial Sequence
  MKO10116160_B_Slc15a1
  gRNA
cuuaccucgcaugccauagu

SEQ ID NO: 116161 - RNA, 20 nt, Artificial Sequence
  MKO10116161_B_Slc15a1
  gRNA
cuauccaucgucuacacgau

SEQ ID NO: 116162 - RNA, 20 nt, Artificial Sequence
  MKO10116162_B_Slc15a1
  gRNA
guugagcaucuucuucaucg

SEQ ID NO: 116163 - RNA, 20 nt, Artificial Sequence
  MKO10116163_B_Slc15a2
  gRNA
cugcuauuucacccccaucu

SEQ ID NO: 116164 - RNA, 20 nt, Artificial Sequence
  MKO10116164_B_Slc15a2
  gRNA
cccuccaaagaagucaacuc

SEQ ID NO: 116165 - RNA, 20 nt, Artificial Sequence
  MKO10116165_B_Slc15a2
  gRNA
agcaaucgcugcucccaaga

SEQ ID NO: 116166 - RNA, 20 nt, Artificial Sequence
  MKO10116166_B_Slc15a3
  gRNA
gaucagauagcaguaacuac

SEQ ID NO: 116167 - RNA, 20 nt, Artificial Sequence
  MKO10116167_B_Slc15a3
  gRNA
ucaaucaagugauccuugac

SEQ ID NO: 116168 - RNA, 20 nt, Artificial Sequence
  MKO10116168_B_Slc15a3
  gRNA
cccaccuguugccugaccag

SEQ ID NO: 116169 - RNA, 20 nt, Artificial Sequence
  MKO10116169_B_Slc15a4
  gRNA
uuacuuuagguuaaagaucg

SEQ ID NO: 116170 - RNA, 20 nt, Artificial Sequence
  MKO10116170_B_Slc15a4
  gRNA
gaugagcaccgcaucaaaca

SEQ ID NO: 116171 - RNA, 20 nt, Artificial Sequence
  MKO10116171_B_Slc15a4
  gRNA
gucucuuaccgugugauggg

SEQ ID NO: 116172 - RNA, 20 nt, Artificial Sequence
  MKO10116172_B_Slc15a5
  gRNA
gguucucuggccgauagauc

SEQ ID NO: 116173 - RNA, 20 nt, Artificial Sequence
  MKO10116173_B_Slc15a5
  gRNA
gcaggaggcacguucuguac

SEQ ID NO: 116174 - RNA, 20 nt, Artificial Sequence
  MKO10116174_B_Slc15a5
  gRNA
uguguuuaacaacacgucug

SEQ ID NO: 116175 - RNA, 20 nt, Artificial Sequence
  MKO10116175_B_Slc16a10
  gRNA
guccgugaagacacucacga

SEQ ID NO: 116176 - RNA, 20 nt, Artificial Sequence
  MKO10116176_B_Slc16a10
  gRNA
augucgauacccaugacugu

SEQ ID NO: 116177 - RNA, 20 nt, Artificial Sequence
  MKO10116177_B_Slc16a10
  gRNA
ccccaucgugagugucuuca

SEQ ID NO: 116178 - RNA, 20 nt, Artificial Sequence
  MKO10116178_B_Slc16a11
  gRNA
cucgguacuucucccgccgu

SEQ ID NO: 116179 - RNA, 20 nt, Artificial Sequence
  MKO10116179_B_Slc16a11
  gRNA
cgagaagaccaagccaagcg

SEQ ID NO: 116180 - RNA, 20 nt, Artificial Sequence
  MKO10116180_B_Slc16a11
  gRNA
gugccccccagcgagugcuc

SEQ ID NO: 116181 - RNA, 20 nt, Artificial Sequence
  MKO10116181_B_Slc16a12
  gRNA
cagcaugauccccgcuugac

SEQ ID NO: 116182 - RNA, 20 nt, Artificial Sequence
  MKO10116182_B_Slc16a12
  gRNA
acuaucucugcagucacgac

SEQ ID NO: 116183 - RNA, 20 nt, Artificial Sequence
  MKO10116183_B_Slc16a12
  gRNA
uaaccaguuauccugucaag

SEQ ID NO: 116184 - RNA, 20 nt, Artificial Sequence
  MKO10116184_B_Slc16a13
  gRNA
cugcugcaccgcgaucccua

SEQ ID NO: 116185 - RNA, 20 nt, Artificial Sequence
  MKO10116185_B_Slc16a13
  gRNA
gccggggccuuccuacucgc

SEQ ID NO: 116186 - RNA, 20 nt, Artificial Sequence
  MKO10116186_B_Slc16a13
  gRNA
gaacuccacuuccugcgagu

SEQ ID NO: 116187 - RNA, 20 nt, Artificial Sequence
  MKO10116187_B_Slc16a14
  gRNA
cauguacgcacccacgauca

SEQ ID NO: 116188 - RNA, 20 nt, Artificial Sequence
  MKO10116188_B_Slc16a14
  gRNA
gccuggugaacucccucggc

SEQ ID NO: 116189 - RNA, 20 nt, Artificial Sequence
  MKO10116189_B_Slc16a14
  gRNA
ugccgccagacagcaaucau

SEQ ID NO: 116190 - RNA, 20 nt, Artificial Sequence
  MKO10116190_B_Slc16a1
  gRNA
ugugucuacgccggagucuu

SEQ ID NO: 116191 - RNA, 20 nt, Artificial Sequence
  MKO10116191_B_Slc16a1
  gRNA
uggcgugauccucaucaucg

SEQ ID NO: 116192 - RNA, 20 nt, Artificial Sequence
  MKO10116192_B_Slc16a1
  gRNA
caaccaccagcgaucauuac

SEQ ID NO: 116193 - RNA, 20 nt, Artificial Sequence
  MKO10116193_B_Slc16a2
  gRNA
gaguauauucacugaccguu

SEQ ID NO: 116194 - RNA, 20 nt, Artificial Sequence
  MKO10116194_B_Slc16a2
  gRNA
ggcccgagacgagacguccg

SEQ ID NO: 116195 - RNA, 20 nt, Artificial Sequence
  MKO10116195_B_Slc16a2
  gRNA
aggccucggacgucucgucu

SEQ ID NO: 116196 - RNA, 20 nt, Artificial Sequence
  MKO10116196_B_Slc16a3
  gRNA
gaaaaagacgcugaccgccu

SEQ ID NO: 116197 - RNA, 20 nt, Artificial Sequence
  MKO10116197_B_Slc16a3
  gRNA
cucaccagugaugacccccg

SEQ ID NO: 116198 - RNA, 20 nt, Artificial Sequence
  MKO10116198_B_Slc16a3
  gRNA
ugagcaccucggcccccgcc

SEQ ID NO: 116199 - RNA, 20 nt, Artificial Sequence
  MKO10116199_B_Slc16a4
  gRNA
aggccguuacuuaugagcaa

SEQ ID NO: 116200 - RNA, 20 nt, Artificial Sequence
  MKO10116200_B_Slc16a4
  gRNA
cgucacagaugauagcagcc

SEQ ID NO: 116201 - RNA, 20 nt, Artificial Sequence
  MKO10116201_B_Slc16a4
  gRNA
ucaucacuccguuucucugc

SEQ ID NO: 116202 - RNA, 20 nt, Artificial Sequence
  MKO10116202_B_Slc16a5
  gRNA
gggugagggccugcgucacc

SEQ ID NO: 116203 - RNA, 20 nt, Artificial Sequence
  MKO10116203_B_Slc16a5
  gRNA
cgaucucaccucagaagaca

SEQ ID NO: 116204 - RNA, 20 nt, Artificial Sequence
  MKO10116204_B_Slc16a5
  gRNA
guuugaccaagaugcugcac

SEQ ID NO: 116205 - RNA, 20 nt, Artificial Sequence
  MKO10116205_B_Slc16a6
  gRNA
ugugccuagcgaagcgaaga

SEQ ID NO: 116206 - RNA, 20 nt, Artificial Sequence
  MKO10116206_B_Slc16a6
  gRNA
cucucccguagaagcgaccg

SEQ ID NO: 116207 - RNA, 20 nt, Artificial Sequence
  MKO10116207_B_Slc16a6
  gRNA
cucacccgagauuaccccua

SEQ ID NO: 116208 - RNA, 20 nt, Artificial Sequence
  MKO10116208_B_Slc16a7
  gRNA
ggaggacuauuaugcugcau

SEQ ID NO: 116209 - RNA, 20 nt, Artificial Sequence
  MKO10116209_B_Slc16a7
  gRNA
uaacuauggcagccggccug

SEQ ID NO: 116210 - RNA, 20 nt, Artificial Sequence
  MKO10116210_B_Slc16a7
  gRNA
uugugcuguugauaccuuac

SEQ ID NO: 116211 - RNA, 20 nt, Artificial Sequence
  MKO10116211_B_Slc16a8
  gRNA
uuccuuugccucgcgccucg

SEQ ID NO: 116212 - RNA, 20 nt, Artificial Sequence
  MKO10116212_B_Slc16a8
  gRNA
caaagucgcgcuugagcucu

SEQ ID NO: 116213 - RNA, 20 nt, Artificial Sequence
  MKO10116213_B_Slc16a8
  gRNA
cgagagcucaagcgcgacuu

SEQ ID NO: 116214 - RNA, 20 nt, Artificial Sequence
  MKO10116214_B_Slc16a9
  gRNA
gcaggaugaaucccccgagc

SEQ ID NO: 116215 - RNA, 20 nt, Artificial Sequence
  MKO10116215_B_Slc16a9
  gRNA
cucugcggcugucaaaauac

SEQ ID NO: 116216 - RNA, 20 nt, Artificial Sequence
  MKO10116216_B_Slc16a9
  gRNA
gcauuagaccgccagccacc

SEQ ID NO: 116217 - RNA, 20 nt, Artificial Sequence
  MKO10116217_B_Slc17a1
  gRNA
agucugccucguucuaaggg

SEQ ID NO: 116218 - RNA, 20 nt, Artificial Sequence
  MKO10116218_B_Slc17a1
  gRNA
cauugugugucgaguacucc

SEQ ID NO: 116219 - RNA, 20 nt, Artificial Sequence
  MKO10116219_B_Slc17a1
  gRNA
auuugacccauauuucaugc

SEQ ID NO: 116220 - RNA, 20 nt, Artificial Sequence
  MKO10116220_B_Slc17a2
  gRNA
auccccgcuaaauauccacu

SEQ ID NO: 116221 - RNA, 20 nt, Artificial Sequence
  MKO10116221_B_Slc17a2
  gRNA
cucaccugaacccgcaaugc

SEQ ID NO: 116222 - RNA, 20 nt, Artificial Sequence
  MKO10116222_B_Slc17a2
  gRNA
aauugugaacugaccagucc

SEQ ID NO: 116223 - RNA, 20 nt, Artificial Sequence
  MKO10116223_B_Slc17a3
  gRNA
augauacugaugcaaggucc

SEQ ID NO: 116224 - RNA, 20 nt, Artificial Sequence
  MKO10116224_B_Slc17a3
  gRNA
cagagucggcugcgcucauu

SEQ ID NO: 116225 - RNA, 20 nt, Artificial Sequence
  MKO10116225_B_Slc17a3
  gRNA
auugcagaaaugugugacga

SEQ ID NO: 116226 - RNA, 20 nt, Artificial Sequence
  MKO10116226_B_Slc17a4
  gRNA
ccaguuaccugaugcagcga

SEQ ID NO: 116227 - RNA, 20 nt, Artificial Sequence
  MKO10116227_B_Slc17a4
  gRNA
cuaugaacgauccauagcug

SEQ ID NO: 116228 - RNA, 20 nt, Artificial Sequence
  MKO10116228_B_Slc17a4
  gRNA
ggucuuauuugucaggcccu

SEQ ID NO: 116229 - RNA, 20 nt, Artificial Sequence
  MKO10116229_B_Slc17a5
  gRNA
uuccagcuaugcacgccaug

SEQ ID NO: 116230 - RNA, 20 nt, Artificial Sequence
  MKO10116230_B_Slc17a5
  gRNA
cuucacccuguucacaccgc

SEQ ID NO: 116231 - RNA, 20 nt, Artificial Sequence
  MKO10116231_B_Slc17a5
  gRNA
uaucuuacccgcauaggaaa

SEQ ID NO: 116232 - RNA, 20 nt, Artificial Sequence
  MKO10116232_B_Slc17a6
  gRNA
agccccagaagaacgauccg

SEQ ID NO: 116233 - RNA, 20 nt, Artificial Sequence
  MKO10116233_B_Slc17a6
  gRNA
gacacauccauaaugcacuc

SEQ ID NO: 116234 - RNA, 20 nt, Artificial Sequence
  MKO10116234_B_Slc17a6
  gRNA
cagaugggaucagcauauug

SEQ ID NO: 116235 - RNA, 20 nt, Artificial Sequence
  MKO10116235_B_Slc17a7
  gRNA
ugccagccgacuccguucua

SEQ ID NO: 116236 - RNA, 20 nt, Artificial Sequence
  MKO10116236_B_Slc17a7
  gRNA
ucagcagcccgcguucacua

SEQ ID NO: 116237 - RNA, 20 nt, Artificial Sequence
  MKO10116237_B_Slc17a7
  gRNA
aaugggccccucccuuagaa

SEQ ID NO: 116238 - RNA, 20 nt, Artificial Sequence
  MKO10116238_B_Slc17a8
  gRNA
uccagacagcgcaguuuaac

SEQ ID NO: 116239 - RNA, 20 nt, Artificial Sequence
  MKO10116239_B_Slc17a8
  gRNA
gagacggugggccugaucca

SEQ ID NO: 116240 - RNA, 20 nt, Artificial Sequence
  MKO10116240_B_Slc17a8
  gRNA
gaguaagugggcgccucccc

SEQ ID NO: 116241 - RNA, 20 nt, Artificial Sequence
  MKO10116241_B_Slc17a9
  gRNA
acaccacugcuugcgcaccu

SEQ ID NO: 116242 - RNA, 20 nt, Artificial Sequence
  MKO10116242_B_Slc17a9
  gRNA
aggccagguggccgcugccg

SEQ ID NO: 116243 - RNA, 20 nt, Artificial Sequence
  MKO10116243_B_Slc17a9
  gRNA
ucugggcguacuauguguac

SEQ ID NO: 116244 - RNA, 20 nt, Artificial Sequence
  MKO10116244_B_Slc18a1
  gRNA
guaguuauccguauagacac

SEQ ID NO: 116245 - RNA, 20 nt, Artificial Sequence
  MKO10116245_B_Slc18a1
  gRNA
gaguucgggccacaaacagc

SEQ ID NO: 116246 - RNA, 20 nt, Artificial Sequence
  MKO10116246_B_Slc18a1
  gRNA
uaucacauccccauguuugu

SEQ ID NO: 116247 - RNA, 20 nt, Artificial Sequence
  MKO10116247_B_Slc18a2
  gRNA
augccuuccugcugaucgcc

SEQ ID NO: 116248 - RNA, 20 nt, Artificial Sequence
  MKO10116248_B_Slc18a2
  gRNA
uaacgccauggggauugcuc

SEQ ID NO: 116249 - RNA, 20 nt, Artificial Sequence
  MKO10116249_B_Slc18a2
  gRNA
gccgauucccugcagggacc

SEQ ID NO: 116250 - RNA, 20 nt, Artificial Sequence
  MKO10116250_B_Slc18a3
  gRNA
gagugcgucgaagagcgaca

SEQ ID NO: 116251 - RNA, 20 nt, Artificial Sequence
  MKO10116251_B_Slc18a3
  gRNA
gacuauaucgcucacaugcg

SEQ ID NO: 116252 - RNA, 20 nt, Artificial Sequence
  MKO10116252_B_Slc18a3
  gRNA
gcuugcccgcgaacucguag

SEQ ID NO: 116253 - RNA, 20 nt, Artificial Sequence
  MKO10116253_B_Slc18b1
  gRNA
uuauugcagcuuguacacau

SEQ ID NO: 116254 - RNA, 20 nt, Artificial Sequence
  MKO10116254_B_Slc18b1
  gRNA
aucgucauccauccuugcua

SEQ ID NO: 116255 - RNA, 20 nt, Artificial Sequence
  MKO10116255_B_Slc18b1
  gRNA
ggaggaguuacaauucucuu

SEQ ID NO: 116256 - RNA, 20 nt, Artificial Sequence
  MKO10116256_B_Slc19a1
  gRNA
gggucuccaaguccgugauc

SEQ ID NO: 116257 - RNA, 20 nt, Artificial Sequence
  MKO10116257_B_Slc19a1
  gRNA
gccggcggagaaggacguga

SEQ ID NO: 116258 - RNA, 20 nt, Artificial Sequence
  MKO10116258_B_Slc19a1
  gRNA
ggcuuaccugaucacggacu

SEQ ID NO: 116259 - RNA, 20 nt, Artificial Sequence
  MKO10116259_B_Slc19a2
  gRNA
gcagauccucgucuccgugg

SEQ ID NO: 116260 - RNA, 20 nt, Artificial Sequence
  MKO10116260_B_Slc19a2
  gRNA
agguguucacgccgaacaca

SEQ ID NO: 116261 - RNA, 20 nt, Artificial Sequence
  MKO10116261_B_Slc19a2
  gRNA
ugcugagguucgcagcaauc

SEQ ID NO: 116262 - RNA, 20 nt, Artificial Sequence
  MKO10116262_B_Slc19a3
  gRNA
gagcuuagaacguuaugccc

SEQ ID NO: 116263 - RNA, 20 nt, Artificial Sequence
  MKO10116263_B_Slc19a3
  gRNA
cugcucagcuaagugccgaa

SEQ ID NO: 116264 - RNA, 20 nt, Artificial Sequence
  MKO10116264_B_Slc19a3
  gRNA
gugcuaugcuggguaucuac

SEQ ID NO: 116265 - RNA, 20 nt, Artificial Sequence
  MKO10116265_B_Slc1a1
  gRNA
aucguauccagcaugaucac

SEQ ID NO: 116266 - RNA, 20 nt, Artificial Sequence
  MKO10116266_B_Slc1a1
  gRNA
ccagguaccugugaucaugc

SEQ ID NO: 116267 - RNA, 20 nt, Artificial Sequence
  MKO10116267_B_Slc1a1
  gRNA
augccauguuggaccugauc

SEQ ID NO: 116268 - RNA, 20 nt, Artificial Sequence
  MKO10116268_B_Slc1a2
  gRNA
ugagccaaagcaccgaaacc

SEQ ID NO: 116269 - RNA, 20 nt, Artificial Sequence
  MKO10116269_B_Slc1a2
  gRNA
aaggacgggaugaacgucuu

SEQ ID NO: 116270 - RNA, 20 nt, Artificial Sequence
  MKO10116270_B_Slc1a2
  gRNA
gaugaccgccuuggugguau

SEQ ID NO: 116271 - RNA, 20 nt, Artificial Sequence
  MKO10116271_B_Slc1a3
  gRNA
uaacgaagccaucaugcgau

SEQ ID NO: 116272 - RNA, 20 nt, Artificial Sequence
  MKO10116272_B_Slc1a3
  gRNA
gaccguauaaaaugagcuac

SEQ ID NO: 116273 - RNA, 20 nt, Artificial Sequence
  MKO10116273_B_Slc1a3
  gRNA
agcgcgcauccccaucuucc

SEQ ID NO: 116274 - RNA, 20 nt, Artificial Sequence
  MKO10116274_B_Slc1a4
  gRNA
gucugcaaccgauuacacag

SEQ ID NO: 116275 - RNA, 20 nt, Artificial Sequence
  MKO10116275_B_Slc1a4
  gRNA
aaaccuuaccguagugaaug

SEQ ID NO: 116276 - RNA, 20 nt, Artificial Sequence
  MKO10116276_B_Slc1a4
  gRNA
gauccccguuguaacagaug

SEQ ID NO: 116277 - RNA, 20 nt, Artificial Sequence
  MKO10116277_B_Slc1a5
  gRNA
agacgauagcgaagaccacc

SEQ ID NO: 116278 - RNA, 20 nt, Artificial Sequence
  MKO10116278_B_Slc1a5
  gRNA
agacaacucauguaaaauac

SEQ ID NO: 116279 - RNA, 20 nt, Artificial Sequence
  MKO10116279_B_Slc1a5
  gRNA
gaaggcagcagacaccagau

SEQ ID NO: 116280 - RNA, 20 nt, Artificial Sequence
  MKO10116280_B_Slc1a6
  gRNA
caacaaggcgacagggcgga

SEQ ID NO: 116281 - RNA, 20 nt, Artificial Sequence
  MKO10116281_B_Slc1a6
  gRNA
auugguggcaugaagcacaa

SEQ ID NO: 116282 - RNA, 20 nt, Artificial Sequence
  MKO10116282_B_Slc1a6
  gRNA
cuuccuaaccuguuugaagc

SEQ ID NO: 116283 - RNA, 20 nt, Artificial Sequence
  MKO10116283_B_Slc1a7
  gRNA
ucugcucaccuguuugaacg

SEQ ID NO: 116284 - RNA, 20 nt, Artificial Sequence
  MKO10116284_B_Slc1a7
  gRNA
ucaccguggcauacuaccug

SEQ ID NO: 116285 - RNA, 20 nt, Artificial Sequence
  MKO10116285_B_Slc1a7
  gRNA
auccgcaucaagaguucucc

SEQ ID NO: 116286 - RNA, 20 nt, Artificial Sequence
  MKO10116286_B_Slc20a1
  gRNA
gguaccauccucaucucggu

SEQ ID NO: 116287 - RNA, 20 nt, Artificial Sequence
  MKO10116287_B_Slc20a1
  gRNA
cggugcuccaguauacauaa

SEQ ID NO: 116288 - RNA, 20 nt, Artificial Sequence
  MKO10116288_B_Slc20a1
  gRNA
cugcacaucccaccgagaug

SEQ ID NO: 116289 - RNA, 20 nt, Artificial Sequence
  MKO10116289_B_Slc20a2
  gRNA
gaacagcagagcaacgccga

SEQ ID NO: 116290 - RNA, 20 nt, Artificial Sequence
  MKO10116290_B_Slc20a2
  gRNA
cucguggcgauuggcccgaa

SEQ ID NO: 116291 - RNA, 20 nt, Artificial Sequence
  MKO10116291_B_Slc20a2
  gRNA
uuuauaucgccacuucuuuc

SEQ ID NO: 116292 - RNA, 20 nt, Artificial Sequence
  MKO10116292_B_Slc22a12
  gRNA
gggccugggaguuacauacc

SEQ ID NO: 116293 - RNA, 20 nt, Artificial Sequence
  MKO10116293_B_Slc22a12
  gRNA
ggaccugguauguaacuccc

SEQ ID NO: 116294 - RNA, 20 nt, Artificial Sequence
  MKO10116294_B_Slc22a12
  gRNA
cguucaaggucaucaccaaa

SEQ ID NO: 116295 - RNA, 20 nt, Artificial Sequence
  MKO10116295_B_Slc22a13
  gRNA
caguagccaagacaaagcgu

SEQ ID NO: 116296 - RNA, 20 nt, Artificial Sequence
  MKO10116296_B_Slc22a13
  gRNA
aucuuggagaacacaagccg

SEQ ID NO: 116297 - RNA, 20 nt, Artificial Sequence
  MKO10116297_B_Slc22a13
  gRNA
ccugaagaagaccucccagu

SEQ ID NO: 116298 - RNA, 20 nt, Artificial Sequence
  MKO10116298_B_Slc22a14
  gRNA
acccugucaagacgccugac

SEQ ID NO: 116299 - RNA, 20 nt, Artificial Sequence
  MKO10116299_B_Slc22a14
  gRNA
cuuuguaagccagccccguc

SEQ ID NO: 116300 - RNA, 20 nt, Artificial Sequence
  MKO10116300_B_Slc22a14
  gRNA
aaucauccugcugucgcugc

SEQ ID NO: 116301 - RNA, 20 nt, Artificial Sequence
  MKO10116301_B_Slc22a15
  gRNA
ggucagcuuucagaucgauu

SEQ ID NO: 116302 - RNA, 20 nt, Artificial Sequence
  MKO10116302_B_Slc22a15
  gRNA
aaggccaggccuucggggac

SEQ ID NO: 116303 - RNA, 20 nt, Artificial Sequence
  MKO10116303_B_Slc22a15
  gRNA
aucuuauuugcugucgcaaa

SEQ ID NO: 116304 - RNA, 20 nt, Artificial Sequence
  MKO10116304_B_Slc22a16
  gRNA
cgccgaugcucgugcaccac

SEQ ID NO: 116305 - RNA, 20 nt, Artificial Sequence
  MKO10116305_B_Slc22a16
  gRNA
accuccaagcagauacguug

SEQ ID NO: 116306 - RNA, 20 nt, Artificial Sequence
  MKO10116306_B_Slc22a16
  gRNA
uuccagauuuggaaggcgaa

SEQ ID NO: 116307 - RNA, 20 nt, Artificial Sequence
  MKO10116307_B_Slc22a17
  gRNA
gcugagcgaaaccggcccca

SEQ ID NO: 116308 - RNA, 20 nt, Artificial Sequence
  MKO10116308_B_Slc22a17
  gRNA
gccacccgaagccucugggu

SEQ ID NO: 116309 - RNA, 20 nt, Artificial Sequence
  MKO10116309_B_Slc22a17
  gRNA
cacgguggcugauagugaag

SEQ ID NO: 116310 - RNA, 20 nt, Artificial Sequence
  MKO10116310_B_Slc22a18
  gRNA
gugccgcucuugccccgcac

SEQ ID NO: 116311 - RNA, 20 nt, Artificial Sequence
  MKO10116311_B_Slc22a18
  gRNA
auacuauaccugccgaacac

SEQ ID NO: 116312 - RNA, 20 nt, Artificial Sequence
  MKO10116312_B_Slc22a18
  gRNA
gauccaguguccugccaucc

SEQ ID NO: 116313 - RNA, 20 nt, Artificial Sequence
  MKO10116313_B_Slc22a19
  gRNA
gcaaagcacuguuuguccuc

SEQ ID NO: 116314 - RNA, 20 nt, Artificial Sequence
  MKO10116314_B_Slc22a19
  gRNA
aguuucgaaaagcaaaagcc

SEQ ID NO: 116315 - RNA, 20 nt, Artificial Sequence
  MKO10116315_B_Slc22a19
  gRNA
cacgugcucuuuacugaaaa

SEQ ID NO: 116316 - RNA, 20 nt, Artificial Sequence
  MKO10116316_B_Slc22a1
  gRNA
cuucaguuuaaccuggugug

SEQ ID NO: 116317 - RNA, 20 nt, Artificial Sequence
  MKO10116317_B_Slc22a1
  gRNA
agcaacauggauguauaguc

SEQ ID NO: 116318 - RNA, 20 nt, Artificial Sequence
  MKO10116318_B_Slc22a1
  gRNA
cugcaauguaacccacaacc

SEQ ID NO: 116319 - RNA, 20 nt, Artificial Sequence
  MKO10116319_B_Slc22a20
  gRNA
gagccaggucacgaagggug

SEQ ID NO: 116320 - RNA, 20 nt, Artificial Sequence
  MKO10116320_B_Slc22a20
  gRNA
caacaccccggacauguaga

SEQ ID NO: 116321 - RNA, 20 nt, Artificial Sequence
  MKO10116321_B_Slc22a20
  gRNA
uggguucagguugggucgca

SEQ ID NO: 116322 - RNA, 20 nt, Artificial Sequence
  MKO10116322_B_Slc22a21
  gRNA
cacuaucuucgauccaagcg

SEQ ID NO: 116323 - RNA, 20 nt, Artificial Sequence
  MKO10116323_B_Slc22a21
  gRNA
gagcacacccacguaaaaga

SEQ ID NO: 116324 - RNA, 20 nt, Artificial Sequence
  MKO10116324_B_Slc22a21
  gRNA
ugagagcugucccgaaauga

SEQ ID NO: 116325 - RNA, 20 nt, Artificial Sequence
  MKO10116325_B_Slc22a22
  gRNA
auugggggcaaaggcacagu

SEQ ID NO: 116326 - RNA, 20 nt, Artificial Sequence
  MKO10116326_B_Slc22a22
  gRNA
ugcacaaaaucuaacuacug

SEQ ID NO: 116327 - RNA, 20 nt, Artificial Sequence
  MKO10116327_B_Slc22a22
  gRNA
uggaagaagcaucaguccag

SEQ ID NO: 116328 - RNA, 20 nt, Artificial Sequence
  MKO10116328_B_Slc22a23
  gRNA
aucuugugugugauaauacc

SEQ ID NO: 116329 - RNA, 20 nt, Artificial Sequence
  MKO10116329_B_Slc22a23
  gRNA
gcgcagccagccccggcaug

SEQ ID NO: 116330 - RNA, 20 nt, Artificial Sequence
  MKO10116330_B_Slc22a23
  gRNA
ggccacgaagcucgccacca

SEQ ID NO: 116331 - RNA, 20 nt, Artificial Sequence
  MKO10116331_B_Slc22a26
  gRNA
aggccuuauccuggcagguc

SEQ ID NO: 116332 - RNA, 20 nt, Artificial Sequence
  MKO10116332_B_Slc22a26
  gRNA
ugcuuacuucgcuuccugac

SEQ ID NO: 116333 - RNA, 20 nt, Artificial Sequence
  MKO10116333_B_Slc22a26
  gRNA
gcuccugagauccacacacc

SEQ ID NO: 116334 - RNA, 20 nt, Artificial Sequence
  MKO10116334_B_Slc22a27
  gRNA
ggacuugguaugugaauccc

SEQ ID NO: 116335 - RNA, 20 nt, Artificial Sequence
  MKO10116335_B_Slc22a27
  gRNA
caagugacuauuuacuaaua

SEQ ID NO: 116336 - RNA, 20 nt, Artificial Sequence
  MKO10116336_B_Slc22a27
  gRNA
guuccacagacaauccugcc

SEQ ID NO: 116337 - RNA, 20 nt, Artificial Sequence
  MKO10116337_B_Slc22a28
  gRNA
ucuucuucuuuauacucaca

SEQ ID NO: 116338 - RNA, 20 nt, Artificial Sequence
  MKO10116338_B_Slc22a28
  gRNA
ggaccuggugugugaaucuc

SEQ ID NO: 116339 - RNA, 20 nt, Artificial Sequence
  MKO10116339_B_Slc22a28
  gRNA
acacucaccugucugacaaa

SEQ ID NO: 116340 - RNA, 20 nt, Artificial Sequence
  MKO10116340_B_Slc22a29
  gRNA
uuugaucaacaaaccccaga

SEQ ID NO: 116341 - RNA, 20 nt, Artificial Sequence
  MKO10116341_B_Slc22a29
  gRNA
ggacuugguaugugaaucuc

SEQ ID NO: 116342 - RNA, 20 nt, Artificial Sequence
  MKO10116342_B_Slc22a29
  gRNA
acacucaccugucugacaga

SEQ ID NO: 116343 - RNA, 20 nt, Artificial Sequence
  MKO10116343_B_Slc22a2
  gRNA
cgauuucacccaacuaugcc

SEQ ID NO: 116344 - RNA, 20 nt, Artificial Sequence
  MKO10116344_B_Slc22a2
  gRNA
guuucagucauuagugaacg

SEQ ID NO: 116345 - RNA, 20 nt, Artificial Sequence
  MKO10116345_B_Slc22a2
  gRNA
uucugggagaucaaccaucu

SEQ ID NO: 116346 - RNA, 20 nt, Artificial Sequence
  MKO10116346_B_Slc22a30
  gRNA
cuacugcuuacuucgauucc

SEQ ID NO: 116347 - RNA, 20 nt, Artificial Sequence
  MKO10116347_B_Slc22a30
  gRNA
caagugacuauuuacugaua

SEQ ID NO: 116348 - RNA, 20 nt, Artificial Sequence
  MKO10116348_B_Slc22a30
  gRNA
gcucauaccuugugaguaua

SEQ ID NO: 116349 - RNA, 20 nt, Artificial Sequence
  MKO10116349_B_Slc22a3
  gRNA
uggucccugagucuccccgc

SEQ ID NO: 116350 - RNA, 20 nt, Artificial Sequence
  MKO10116350_B_Slc22a3
  gRNA
uugccuacuucacgcccagc

SEQ ID NO: 116351 - RNA, 20 nt, Artificial Sequence
  MKO10116351_B_Slc22a3
  gRNA
ccuguccgcugcauagccca

SEQ ID NO: 116352 - RNA, 20 nt, Artificial Sequence
  MKO10116352_B_Slc22a4
  gRNA
ugacagcugcccagacacga

SEQ ID NO: 116353 - RNA, 20 nt, Artificial Sequence
  MKO10116353_B_Slc22a4
  gRNA
gaaaguccucuuugcaacca

SEQ ID NO: 116354 - RNA, 20 nt, Artificial Sequence
  MKO10116354_B_Slc22a4
  gRNA
gucauuccuaccuaguauga

SEQ ID NO: 116355 - RNA, 20 nt, Artificial Sequence
  MKO10116355_B_Slc22a5
  gRNA
cagcacacccacgaaaaaca

SEQ ID NO: 116356 - RNA, 20 nt, Artificial Sequence
  MKO10116356_B_Slc22a5
  gRNA
cugcuggcgcucacugugcc

SEQ ID NO: 116357 - RNA, 20 nt, Artificial Sequence
  MKO10116357_B_Slc22a5
  gRNA
cucacuuggaucgaagauag

SEQ ID NO: 116358 - RNA, 20 nt, Artificial Sequence
  MKO10116358_B_Slc22a6
  gRNA
ucgccuaugcugugccccac

SEQ ID NO: 116359 - RNA, 20 nt, Artificial Sequence
  MKO10116359_B_Slc22a6
  gRNA
guaacacucccaccaugaac

SEQ ID NO: 116360 - RNA, 20 nt, Artificial Sequence
  MKO10116360_B_Slc22a6
  gRNA
uagccaaagacaugcccgag

SEQ ID NO: 116361 - RNA, 20 nt, Artificial Sequence
  MKO10116361_B_Slc22a7
  gRNA
uaccaucauuguacuuccgu

SEQ ID NO: 116362 - RNA, 20 nt, Artificial Sequence
  MKO10116362_B_Slc22a7
  gRNA
uaugggccgcccauugagcu

SEQ ID NO: 116363 - RNA, 20 nt, Artificial Sequence
  MKO10116363_B_Slc22a7
  gRNA
cacgccgaugaagaagcacg

SEQ ID NO: 116364 - RNA, 20 nt, Artificial Sequence
  MKO10116364_B_Slc22a8
  gRNA
aacuguagccagcgccacug

SEQ ID NO: 116365 - RNA, 20 nt, Artificial Sequence
  MKO10116365_B_Slc22a8
  gRNA
uggccuaugccguuccucag

SEQ ID NO: 116366 - RNA, 20 nt, Artificial Sequence
  MKO10116366_B_Slc22a8
  gRNA
ugccagcaagagauagcucc

SEQ ID NO: 116367 - RNA, 20 nt, Artificial Sequence
  MKO10116367_B_Slc23a1
  gRNA
uuccaggcugccguuguucc

SEQ ID NO: 116368 - RNA, 20 nt, Artificial Sequence
  MKO10116368_B_Slc23a1
  gRNA
ugacauguuguacaagauug

SEQ ID NO: 116369 - RNA, 20 nt, Artificial Sequence
  MKO10116369_B_Slc23a1
  gRNA
cuuguacaacaugucaaacu

SEQ ID NO: 116370 - RNA, 20 nt, Artificial Sequence
  MKO10116370_B_Slc23a2
  gRNA
ggccacauccagcggagagc

SEQ ID NO: 116371 - RNA, 20 nt, Artificial Sequence
  MKO10116371_B_Slc23a2
  gRNA
aucaucucaccugcaauccc

SEQ ID NO: 116372 - RNA, 20 nt, Artificial Sequence
  MKO10116372_B_Slc23a2
  gRNA
ugugcgugggggaugaccag

SEQ ID NO: 116373 - RNA, 20 nt, Artificial Sequence
  MKO10116373_B_Slc23a3
  gRNA
ggccguguguuccccuacug

SEQ ID NO: 116374 - RNA, 20 nt, Artificial Sequence
  MKO10116374_B_Slc23a3
  gRNA
agcuucuugucaaacuacac

SEQ ID NO: 116375 - RNA, 20 nt, Artificial Sequence
  MKO10116375_B_Slc23a3
  gRNA
gacucacguacagcaaggcc

SEQ ID NO: 116376 - RNA, 20 nt, Artificial Sequence
  MKO10116376_B_Slc24a1
  gRNA
gcccagugaggaugcugucg

SEQ ID NO: 116377 - RNA, 20 nt, Artificial Sequence
  MKO10116377_B_Slc24a1
  gRNA
aucguccuccugaucucccu

SEQ ID NO: 116378 - RNA, 20 nt, Artificial Sequence
  MKO10116378_B_Slc24a1
  gRNA
uuccucgacagcauccucac

SEQ ID NO: 116379 - RNA, 20 nt, Artificial Sequence
  MKO10116379_B_Slc24a2
  gRNA
caaggaugggccaacuuuac

SEQ ID NO: 116380 - RNA, 20 nt, Artificial Sequence
  MKO10116380_B_Slc24a2
  gRNA
cugaagcuaauucgagucau

SEQ ID NO: 116381 - RNA, 20 nt, Artificial Sequence
  MKO10116381_B_Slc24a2
  gRNA
cugcucccuaccgguaaagu

SEQ ID NO: 116382 - RNA, 20 nt, Artificial Sequence
  MKO10116382_B_Slc24a3
  gRNA
ggccccagagcuguucacgu

SEQ ID NO: 116383 - RNA, 20 nt, Artificial Sequence
  MKO10116383_B_Slc24a3
  gRNA
ugugggaguuggcaccaucg

SEQ ID NO: 116384 - RNA, 20 nt, Artificial Sequence
  MKO10116384_B_Slc24a3
  gRNA
cauguacauguucuaugcgc

SEQ ID NO: 116385 - RNA, 20 nt, Artificial Sequence
  MKO10116385_B_Slc24a4
  gRNA
aaagaagucaucgcacacga

SEQ ID NO: 116386 - RNA, 20 nt, Artificial Sequence
  MKO10116386_B_Slc24a4
  gRNA
ucugugcaguucuuagccag

SEQ ID NO: 116387 - RNA, 20 nt, Artificial Sequence
  MKO10116387_B_Slc24a4
  gRNA
aucccuagagaagaucugug

SEQ ID NO: 116388 - RNA, 20 nt, Artificial Sequence
  MKO10116388_B_Slc24a5
  gRNA
gaaguacuugucgcagacga

SEQ ID NO: 116389 - RNA, 20 nt, Artificial Sequence
  MKO10116389_B_Slc24a5
  gRNA
auaaauugcagauccuagua

SEQ ID NO: 116390 - RNA, 20 nt, Artificial Sequence
  MKO10116390_B_Slc24a5
  gRNA
auugguaucagcaccauacu

SEQ ID NO: 116391 - RNA, 20 nt, Artificial Sequence
  MKO10116391_B_Slc25a10
  gRNA
ucgcaaucuacgagaccaug

SEQ ID NO: 116392 - RNA, 20 nt, Artificial Sequence
  MKO10116392_B_Slc25a10
  gRNA
ugcgaaccgagucagagagu

SEQ ID NO: 116393 - RNA, 20 nt, Artificial Sequence
  MKO10116393_B_Slc25a10
  gRNA
cguggggaccccagcagauu

SEQ ID NO: 116394 - RNA, 20 nt, Artificial Sequence
  MKO10116394_B_Slc25a11
  gRNA
gacaacgacagcucgagcca

SEQ ID NO: 116395 - RNA, 20 nt, Artificial Sequence
  MKO10116395_B_Slc25a11
  gRNA
ucaaucuaagcaguucuugc

SEQ ID NO: 116396 - RNA, 20 nt, Artificial Sequence
  MKO10116396_B_Slc25a11
  gRNA
acccaguguaaaugcccuuc

SEQ ID NO: 116397 - RNA, 20 nt, Artificial Sequence
  MKO10116397_B_Slc25a12
  gRNA
gaguucauccggcugcacuu

SEQ ID NO: 116398 - RNA, 20 nt, Artificial Sequence
  MKO10116398_B_Slc25a12
  gRNA
gcugagaaacauauuccucc

SEQ ID NO: 116399 - RNA, 20 nt, Artificial Sequence
  MKO10116399_B_Slc25a12
  gRNA
aaaugccaaaaacucuugau

SEQ ID NO: 116400 - RNA, 20 nt, Artificial Sequence
  MKO10116400_B_Slc25a13
  gRNA
aauauugcuuuaagcucagc

SEQ ID NO: 116401 - RNA, 20 nt, Artificial Sequence
  MKO10116401_B_Slc25a13
  gRNA
uuccagcuguuugacaaagc

SEQ ID NO: 116402 - RNA, 20 nt, Artificial Sequence
  MKO10116402_B_Slc25a13
  gRNA
uaccgagugacaaagucaug

SEQ ID NO: 116403 - RNA, 20 nt, Artificial Sequence
  MKO10116403_B_Slc25a14
  gRNA
accgaacucggcaacaauag

SEQ ID NO: 116404 - RNA, 20 nt, Artificial Sequence
  MKO10116404_B_Slc25a14
  gRNA
gccucuauuguugccgaguu

SEQ ID NO: 116405 - RNA, 20 nt, Artificial Sequence
  MKO10116405_B_Slc25a14
  gRNA
aaaacacggcugcaagucca

SEQ ID NO: 116406 - RNA, 20 nt, Artificial Sequence
  MKO10116406_B_Slc25a15
  gRNA
cuucauucuuuacgauacuc

SEQ ID NO: 116407 - RNA, 20 nt, Artificial Sequence
  MKO10116407_B_Slc25a15
  gRNA
cuagauuugauacaauccac

SEQ ID NO: 116408 - RNA, 20 nt, Artificial Sequence
  MKO10116408_B_Slc25a15
  gRNA
ccggcauuucacaagcuccg

SEQ ID NO: 116409 - RNA, 20 nt, Artificial Sequence
  MKO10116409_B_Slc25a16
  gRNA
cugcacuuacccucucgaug

SEQ ID NO: 116410 - RNA, 20 nt, Artificial Sequence
  MKO10116410_B_Slc25a16
  gRNA
caaaaccacaguugcccccc

SEQ ID NO: 116411 - RNA, 20 nt, Artificial Sequence
  MKO10116411_B_Slc25a16
  gRNA
caggggggcaacugugguuu

SEQ ID NO: 116412 - RNA, 20 nt, Artificial Sequence
  MKO10116412_B_Slc25a17
  gRNA
ugcugcugacgacuccgcuc

SEQ ID NO: 116413 - RNA, 20 nt, Artificial Sequence
  MKO10116413_B_Slc25a17
  gRNA
uacugcuagacuucggcuuc

SEQ ID NO: 116414 - RNA, 20 nt, Artificial Sequence
  MKO10116414_B_Slc25a17
  gRNA
ccgaagucuagcaguaucca

SEQ ID NO: 116415 - RNA, 20 nt, Artificial Sequence
  MKO10116415_B_Slc25a18
  gRNA
aucuccgcaaaacucaucaa

SEQ ID NO: 116416 - RNA, 20 nt, Artificial Sequence
  MKO10116416_B_Slc25a18
  gRNA
gacgcagcggaaccugaaga

SEQ ID NO: 116417 - RNA, 20 nt, Artificial Sequence
  MKO10116417_B_Slc25a18
  gRNA
cggcagcugcucaugcaaga

SEQ ID NO: 116418 - RNA, 20 nt, Artificial Sequence
  MKO10116418_B_Slc25a19
  gRNA
guucgaacccgcccaccugc

SEQ ID NO: 116419 - RNA, 20 nt, Artificial Sequence
  MKO10116419_B_Slc25a19
  gRNA
gcguacccgccuugccgcuc

SEQ ID NO: 116420 - RNA, 20 nt, Artificial Sequence
  MKO10116420_B_Slc25a19
  gRNA
cggaucuugaugacguccaa

SEQ ID NO: 116421 - RNA, 20 nt, Artificial Sequence
  MKO10116421_B_Slc25a1
  gRNA
uuaccgaugccccgguaccg

SEQ ID NO: 116422 - RNA, 20 nt, Artificial Sequence
  MKO10116422_B_Slc25a1
  gRNA
ccauccccaaggcggcuguc

SEQ ID NO: 116423 - RNA, 20 nt, Artificial Sequence
  MKO10116423_B_Slc25a1
  gRNA
uccuccaaccccaaguaccg

SEQ ID NO: 116424 - RNA, 20 nt, Artificial Sequence
  MKO10116424_B_Slc25a20
  gRNA
ccggaagacucuuaugagag

SEQ ID NO: 116425 - RNA, 20 nt, Artificial Sequence
  MKO10116425_B_Slc25a20
  gRNA
gggauccgcggcuucuacaa

SEQ ID NO: 116426 - RNA, 20 nt, Artificial Sequence
  MKO10116426_B_Slc25a20
  gRNA
aagcauuugauccguucucc

SEQ ID NO: 116427 - RNA, 20 nt, Artificial Sequence
  MKO10116427_B_Slc25a21
  gRNA
gauauaugucacuaucacca

SEQ ID NO: 116428 - RNA, 20 nt, Artificial Sequence
  MKO10116428_B_Slc25a21
  gRNA
ugagcuguacaagaaauuuc

SEQ ID NO: 116429 - RNA, 20 nt, Artificial Sequence
  MKO10116429_B_Slc25a21
  gRNA
aacaccaaaaagagcaguca

SEQ ID NO: 116430 - RNA, 20 nt, Artificial Sequence
  MKO10116430_B_Slc25a22
  gRNA
uggcaucgcugggcuaaucg

SEQ ID NO: 116431 - RNA, 20 nt, Artificial Sequence
  MKO10116431_B_Slc25a22
  gRNA
ugcggccugcaucuugcaac

SEQ ID NO: 116432 - RNA, 20 nt, Artificial Sequence
  MKO10116432_B_Slc25a22
  gRNA
cccggagaaggccaucaagu

SEQ ID NO: 116433 - RNA, 20 nt, Artificial Sequence
  MKO10116433_B_Slc25a23
  gRNA
ggaguuuacucgcuaccugc

SEQ ID NO: 116434 - RNA, 20 nt, Artificial Sequence
  MKO10116434_B_Slc25a23
  gRNA
caacagagcuuccgagcacu

SEQ ID NO: 116435 - RNA, 20 nt, Artificial Sequence
  MKO10116435_B_Slc25a23
  gRNA
agaacucaucaggcaccguc

SEQ ID NO: 116436 - RNA, 20 nt, Artificial Sequence
  MKO10116436_B_Slc25a24
  gRNA
acuuucagcaucgacucuga

SEQ ID NO: 116437 - RNA, 20 nt, Artificial Sequence
  MKO10116437_B_Slc25a24
  gRNA
aaauauguaaaccgagcauc

SEQ ID NO: 116438 - RNA, 20 nt, Artificial Sequence
  MKO10116438_B_Slc25a24
  gRNA
ugaccguggacuggaaugaa

SEQ ID NO: 116439 - RNA, 20 nt, Artificial Sequence
  MKO10116439_B_Slc25a25
  gRNA
guuccgagaucuugacaccc

SEQ ID NO: 116440 - RNA, 20 nt, Artificial Sequence
  MKO10116440_B_Slc25a25
  gRNA
cccccauagaucuucgaugu

SEQ ID NO: 116441 - RNA, 20 nt, Artificial Sequence
  MKO10116441_B_Slc25a25
  gRNA
caaggaccuugaugggcaac

SEQ ID NO: 116442 - RNA, 20 nt, Artificial Sequence
  MKO10116442_B_Slc25a26
  gRNA
ggcauucaaggacuguaccg

SEQ ID NO: 116443 - RNA, 20 nt, Artificial Sequence
  MKO10116443_B_Slc25a26
  gRNA
caaacccgugaagcacaugc

SEQ ID NO: 116444 - RNA, 20 nt, Artificial Sequence
  MKO10116444_B_Slc25a26
  gRNA
aacaaggcugguggauuucg

SEQ ID NO: 116445 - RNA, 20 nt, Artificial Sequence
  MKO10116445_B_Slc25a27
  gRNA
gacuucccguagauguucau

SEQ ID NO: 116446 - RNA, 20 nt, Artificial Sequence
  MKO10116446_B_Slc25a27
  gRNA
ggaauccgcgggcuuugggc

SEQ ID NO: 116447 - RNA, 20 nt, Artificial Sequence
  MKO10116447_B_Slc25a27
  gRNA
aagcgcugcucucugaauau

SEQ ID NO: 116448 - RNA, 20 nt, Artificial Sequence
  MKO10116448_B_Slc25a28
  gRNA
ccuccaacacguuccgauag

SEQ ID NO: 116449 - RNA, 20 nt, Artificial Sequence
  MKO10116449_B_Slc25a28
  gRNA
uacuugauagaccguccuga

SEQ ID NO: 116450 - RNA, 20 nt, Artificial Sequence
  MKO10116450_B_Slc25a28
  gRNA
ggggguuaaagugcucuugc

SEQ ID NO: 116451 - RNA, 20 nt, Artificial Sequence
  MKO10116451_B_Slc25a29
  gRNA
ggccauggcgcucgacuucc

SEQ ID NO: 116452 - RNA, 20 nt, Artificial Sequence
  MKO10116452_B_Slc25a29
  gRNA
cucaccuugacuaugucaaa

SEQ ID NO: 116453 - RNA, 20 nt, Artificial Sequence
  MKO10116453_B_Slc25a29
  gRNA
cacacucuccugcuugauga

SEQ ID NO: 116454 - RNA, 20 nt, Artificial Sequence
  MKO10116454_B_Slc25a2
  gRNA
gaaugcagagcugaacgacu

SEQ ID NO: 116455 - RNA, 20 nt, Artificial Sequence
  MKO10116455_B_Slc25a2
  gRNA
acugcuagccuaugucaccc

SEQ ID NO: 116456 - RNA, 20 nt, Artificial Sequence
  MKO10116456_B_Slc25a2
  gRNA
aagccuccacuuaacaucaa

SEQ ID NO: 116457 - RNA, 20 nt, Artificial Sequence
  MKO10116457_B_Slc25a30
  gRNA
gcaugcugcacgcgcugaug

SEQ ID NO: 116458 - RNA, 20 nt, Artificial Sequence
  MKO10116458_B_Slc25a30
  gRNA
cuucaugagcauuuaccagc

SEQ ID NO: 116459 - RNA, 20 nt, Artificial Sequence
  MKO10116459_B_Slc25a30
  gRNA
gcacagaacagcgcuguuca

SEQ ID NO: 116460 - RNA, 20 nt, Artificial Sequence
  MKO10116460_B_Slc25a31
  gRNA
uagaagacguaugaugaugc

SEQ ID NO: 116461 - RNA, 20 nt, Artificial Sequence
  MKO10116461_B_Slc25a31
  gRNA
acgucuucuaacugugucaa

SEQ ID NO: 116462 - RNA, 20 nt, Artificial Sequence
  MKO10116462_B_Slc25a31
  gRNA
uuccaauaucaacaccuaau

SEQ ID NO: 116463 - RNA, 20 nt, Artificial Sequence
  MKO10116463_B_Slc25a32
  gRNA
caccaccauauuguaacaua

SEQ ID NO: 116464 - RNA, 20 nt, Artificial Sequence
  MKO10116464_B_Slc25a32
  gRNA
acucauaugccauaaacuga

SEQ ID NO: 116465 - RNA, 20 nt, Artificial Sequence
  MKO10116465_B_Slc25a32
  gRNA
cucgucucagcugcugaagc

SEQ ID NO: 116466 - RNA, 20 nt, Artificial Sequence
  MKO10116466_B_Slc25a33
  gRNA
ggaccaaagucacucuuuag

SEQ ID NO: 116467 - RNA, 20 nt, Artificial Sequence
  MKO10116467_B_Slc25a33
  gRNA
auaccuuaaugaauccuauu

SEQ ID NO: 116468 - RNA, 20 nt, Artificial Sequence
  MKO10116468_B_Slc25a33
  gRNA
gaugccauugaauugcucuu

SEQ ID NO: 116469 - RNA, 20 nt, Artificial Sequence
  MKO10116469_B_Slc25a34
  gRNA
guggggacccaagcgcagau

SEQ ID NO: 116470 - RNA, 20 nt, Artificial Sequence
  MKO10116470_B_Slc25a34
  gRNA
gacaguggcuacuauggccg

SEQ ID NO: 116471 - RNA, 20 nt, Artificial Sequence
  MKO10116471_B_Slc25a34
  gRNA
gcugugccccgagucacagu

SEQ ID NO: 116472 - RNA, 20 nt, Artificial Sequence
  MKO10116472_B_Slc25a35
  gRNA
cccucaccugaugcuuauac

SEQ ID NO: 116473 - RNA, 20 nt, Artificial Sequence
  MKO10116473_B_Slc25a35
  gRNA
agaggagccgaugacaacuc

SEQ ID NO: 116474 - RNA, 20 nt, Artificial Sequence
  MKO10116474_B_Slc25a35
  gRNA
ccaggugaagacacaccuac

SEQ ID NO: 116475 - RNA, 20 nt, Artificial Sequence
  MKO10116475_B_Slc25a36
  gRNA
cagggcuauccuggaaaaag

SEQ ID NO: 116476 - RNA, 20 nt, Artificial Sequence
  MKO10116476_B_Slc25a36
  gRNA
ugcugcuuauucaaacugca

SEQ ID NO: 116477 - RNA, 20 nt, Artificial Sequence
  MKO10116477_B_Slc25a36
  gRNA
cagcugaagccaugugcacu

SEQ ID NO: 116478 - RNA, 20 nt, Artificial Sequence
  MKO10116478_B_Slc25a37
  gRNA
cacccaucaucaucacguuc

SEQ ID NO: 116479 - RNA, 20 nt, Artificial Sequence
  MKO10116479_B_Slc25a37
  gRNA
cuggauucauuacugcaucg

SEQ ID NO: 116480 - RNA, 20 nt, Artificial Sequence
  MKO10116480_B_Slc25a37
  gRNA
gcaguaaugaauccagcaga

SEQ ID NO: 116481 - RNA, 20 nt, Artificial Sequence
  MKO10116481_B_Slc25a38
  gRNA
agccaacaucccaacacguc

SEQ ID NO: 116482 - RNA, 20 nt, Artificial Sequence
  MKO10116482_B_Slc25a38
  gRNA
uuccucaggcccagacgugu

SEQ ID NO: 116483 - RNA, 20 nt, Artificial Sequence
  MKO10116483_B_Slc25a38
  gRNA
uacugcagcgagggccaccg

SEQ ID NO: 116484 - RNA, 20 nt, Artificial Sequence
  MKO10116484_B_Slc25a39
  gRNA
ggcggaccuucaccacaucc

SEQ ID NO: 116485 - RNA, 20 nt, Artificial Sequence
  MKO10116485_B_Slc25a39
  gRNA
augccgcacaaucuucacaa

SEQ ID NO: 116486 - RNA, 20 nt, Artificial Sequence
  MKO10116486_B_Slc25a39
  gRNA
ugacaacucccuccagauuc

SEQ ID NO: 116487 - RNA, 20 nt, Artificial Sequence
  MKO10116487_B_Slc25a3
  gRNA
ugcggcacuuuacuaagucc

SEQ ID NO: 116488 - RNA, 20 nt, Artificial Sequence
  MKO10116488_B_Slc25a3
  gRNA
uucaacaguacguucaaagc

SEQ ID NO: 116489 - RNA, 20 nt, Artificial Sequence
  MKO10116489_B_Slc25a3
  gRNA
gccuuauauagcaacauacu

SEQ ID NO: 116490 - RNA, 20 nt, Artificial Sequence
  MKO10116490_B_Slc25a40
  gRNA
augucuuuaccaauguccca

SEQ ID NO: 116491 - RNA, 20 nt, Artificial Sequence
  MKO10116491_B_Slc25a40
  gRNA
acccgaauaccaauaguugc

SEQ ID NO: 116492 - RNA, 20 nt, Artificial Sequence
  MKO10116492_B_Slc25a40
  gRNA
ucacaugugugucugugaag

SEQ ID NO: 116493 - RNA, 20 nt, Artificial Sequence
  MKO10116493_B_Slc25a41
  gRNA
gcggcguccgcucccucugg

SEQ ID NO: 116494 - RNA, 20 nt, Artificial Sequence
  MKO10116494_B_Slc25a41
  gRNA
cgcuucacuggccaguauaa

SEQ ID NO: 116495 - RNA, 20 nt, Artificial Sequence
  MKO10116495_B_Slc25a41
  gRNA
acugcggagccugguccagg

SEQ ID NO: 116496 - RNA, 20 nt, Artificial Sequence
  MKO10116496_B_Slc25a42
  gRNA
guacgugagggaagccgcag

SEQ ID NO: 116497 - RNA, 20 nt, Artificial Sequence
  MKO10116497_B_Slc25a42
  gRNA
cggaccaagaucaucuucca

SEQ ID NO: 116498 - RNA, 20 nt, Artificial Sequence
  MKO10116498_B_Slc25a42
  gRNA
caggggggcuacugcugucu

SEQ ID NO: 116499 - RNA, 20 nt, Artificial Sequence
  MKO10116499_B_Slc25a43
  gRNA
ucuuuagcucccguaauucc

SEQ ID NO: 116500 - RNA, 20 nt, Artificial Sequence
  MKO10116500_B_Slc25a43
  gRNA
ccuucuaguuuacaugaacc

SEQ ID NO: 116501 - RNA, 20 nt, Artificial Sequence
  MKO10116501_B_Slc25a43
  gRNA
cggcagaucgugaaaaccca

SEQ ID NO: 116502 - RNA, 20 nt, Artificial Sequence
  MKO10116502_B_Slc25a44
  gRNA
uaugcccggggacucugaau

SEQ ID NO: 116503 - RNA, 20 nt, Artificial Sequence
  MKO10116503_B_Slc25a44
  gRNA
ugucaucagaacccgugugc

SEQ ID NO: 116504 - RNA, 20 nt, Artificial Sequence
  MKO10116504_B_Slc25a44
  gRNA
ccgugcaagagccugacaga

SEQ ID NO: 116505 - RNA, 20 nt, Artificial Sequence
  MKO10116505_B_Slc25a45
  gRNA
ugucgccaguacacaccaga

SEQ ID NO: 116506 - RNA, 20 nt, Artificial Sequence
  MKO10116506_B_Slc25a45
  gRNA
gcacccauucgacacuguaa

SEQ ID NO: 116507 - RNA, 20 nt, Artificial Sequence
  MKO10116507_B_Slc25a45
  gRNA
cucaccuuuacagugucgaa

SEQ ID NO: 116508 - RNA, 20 nt, Artificial Sequence
  MKO10116508_B_Slc25a46
  gRNA
uauaggucaauuaccaugcu

SEQ ID NO: 116509 - RNA, 20 nt, Artificial Sequence
  MKO10116509_B_Slc25a46
  gRNA
uuauauuuaccugacacugg

SEQ ID NO: 116510 - RNA, 20 nt, Artificial Sequence
  MKO10116510_B_Slc25a46
  gRNA
gaacaguugaauagauuugc

SEQ ID NO: 116511 - RNA, 20 nt, Artificial Sequence
  MKO10116511_B_Slc25a47
  gRNA
caaaggagugacccucacga

SEQ ID NO: 116512 - RNA, 20 nt, Artificial Sequence
  MKO10116512_B_Slc25a47
  gRNA
cacaucugccgcuuccggua

SEQ ID NO: 116513 - RNA, 20 nt, Artificial Sequence
  MKO10116513_B_Slc25a47
  gRNA
ccaccucagugggugacguc

SEQ ID NO: 116514 - RNA, 20 nt, Artificial Sequence
  MKO10116514_B_Slc25a48
  gRNA
cugguaugcugccaccgccc

SEQ ID NO: 116515 - RNA, 20 nt, Artificial Sequence
  MKO10116515_B_Slc25a48
  gRNA
cuagccauggauugaagucc

SEQ ID NO: 116516 - RNA, 20 nt, Artificial Sequence
  MKO10116516_B_Slc25a48
  gRNA
cauagccgacaccagcuugc

SEQ ID NO: 116517 - RNA, 20 nt, Artificial Sequence
  MKO10116517_B_Slc25a4
  gRNA
augugcacauuaucgugagc

SEQ ID NO: 116518 - RNA, 20 nt, Artificial Sequence
  MKO10116518_B_Slc25a4
  gRNA
cggcggcgaugccaccugcc

SEQ ID NO: 116519 - RNA, 20 nt, Artificial Sequence
  MKO10116519_B_Slc25a4
  gRNA
agcaccuuugaagaaagcgu

SEQ ID NO: 116520 - RNA, 20 nt, Artificial Sequence
  MKO10116520_B_Slc25a51
  gRNA
auggcaucugagcgcccuga

SEQ ID NO: 116521 - RNA, 20 nt, Artificial Sequence
  MKO10116521_B_Slc25a51
  gRNA
ucucccacgcccgcaaugug

SEQ ID NO: 116522 - RNA, 20 nt, Artificial Sequence
  MKO10116522_B_Slc25a51
  gRNA
cgaguuugccacccguagcg

SEQ ID NO: 116523 - RNA, 20 nt, Artificial Sequence
  MKO10116523_B_Slc25a53
  gRNA
guacugcuugcuguaccugc

SEQ ID NO: 116524 - RNA, 20 nt, Artificial Sequence
  MKO10116524_B_Slc25a53
  gRNA
cuccuucaaagauccuaucc

SEQ ID NO: 116525 - RNA, 20 nt, Artificial Sequence
  MKO10116525_B_Slc25a53
  gRNA
gccaauaugcagucucauau

SEQ ID NO: 116526 - RNA, 20 nt, Artificial Sequence
  MKO10116526_B_Slc25a54
  gRNA
guggauucccaaugaucuca

SEQ ID NO: 116527 - RNA, 20 nt, Artificial Sequence
  MKO10116527_B_Slc25a54
  gRNA
gcagauuccaaugcugauuc

SEQ ID NO: 116528 - RNA, 20 nt, Artificial Sequence
  MKO10116528_B_Slc25a54
  gRNA
ucacugacauuguucguuuc

SEQ ID NO: 116529 - RNA, 20 nt, Artificial Sequence
  MKO10116529_B_Slc25a5
  gRNA
aucauacaagacaagcacaa

SEQ ID NO: 116530 - RNA, 20 nt, Artificial Sequence
  MKO10116530_B_Slc25a5
  gRNA
agugucauagauaccaaagu

SEQ ID NO: 116531 - RNA, 20 nt, Artificial Sequence
  MKO10116531_B_Slc25a5
  gRNA
gcaugccagcaagcaaauca

SEQ ID NO: 116532 - RNA, 20 nt, Artificial Sequence
  MKO10116532_B_Slc26a10
  gRNA
gcucccuuucgauuccacug

SEQ ID NO: 116533 - RNA, 20 nt, Artificial Sequence
  MKO10116533_B_Slc26a10
  gRNA
gguggugcccgaaccccucg

SEQ ID NO: 116534 - RNA, 20 nt, Artificial Sequence
  MKO10116534_B_Slc26a10
  gRNA
ggacaccagcacgugcagcg

SEQ ID NO: 116535 - RNA, 20 nt, Artificial Sequence
  MKO10116535_B_Slc26a11
  gRNA
aggguaggcgacgcuguccu

SEQ ID NO: 116536 - RNA, 20 nt, Artificial Sequence
  MKO10116536_B_Slc26a11
  gRNA
caccucccgggaugugacuc

SEQ ID NO: 116537 - RNA, 20 nt, Artificial Sequence
  MKO10116537_B_Slc26a11
  gRNA
auacacgaagcaucccauga

SEQ ID NO: 116538 - RNA, 20 nt, Artificial Sequence
  MKO10116538_B_Slc26a1
  gRNA
gacgggacugcuaugccauu

SEQ ID NO: 116539 - RNA, 20 nt, Artificial Sequence
  MKO10116539_B_Slc26a1
  gRNA
gcugcccuucuugcccgaau

SEQ ID NO: 116540 - RNA, 20 nt, Artificial Sequence
  MKO10116540_B_Slc26a1
  gRNA
aaacggaacacucgcaccuc

SEQ ID NO: 116541 - RNA, 20 nt, Artificial Sequence
  MKO10116541_B_Slc26a2
  gRNA
gaugacguagcaucaguguc

SEQ ID NO: 116542 - RNA, 20 nt, Artificial Sequence
  MKO10116542_B_Slc26a2
  gRNA
cuauagcugacagcugcguc

SEQ ID NO: 116543 - RNA, 20 nt, Artificial Sequence
  MKO10116543_B_Slc26a2
  gRNA
acacacugaaagaaguucgc

SEQ ID NO: 116544 - RNA, 20 nt, Artificial Sequence
  MKO10116544_B_Slc26a3
  gRNA
agccgaccugcagaaccccc

SEQ ID NO: 116545 - RNA, 20 nt, Artificial Sequence
  MKO10116545_B_Slc26a3
  gRNA
aagccauuccuuuaucuugu

SEQ ID NO: 116546 - RNA, 20 nt, Artificial Sequence
  MKO10116546_B_Slc26a3
  gRNA
cuucucagugacaucgucuc

SEQ ID NO: 116547 - RNA, 20 nt, Artificial Sequence
  MKO10116547_B_Slc26a4
  gRNA
uacuuggcagaccccuuggu

SEQ ID NO: 116548 - RNA, 20 nt, Artificial Sequence
  MKO10116548_B_Slc26a4
  gRNA
gguugugaauccgccaacca

SEQ ID NO: 116549 - RNA, 20 nt, Artificial Sequence
  MKO10116549_B_Slc26a4
  gRNA
caccagcccagugcuaacuc

SEQ ID NO: 116550 - RNA, 20 nt, Artificial Sequence
  MKO10116550_B_Slc26a5
  gRNA
gugguaaagccucgcaccaa

SEQ ID NO: 116551 - RNA, 20 nt, Artificial Sequence
  MKO10116551_B_Slc26a5
  gRNA
cacggcugccagcauggcga

SEQ ID NO: 116552 - RNA, 20 nt, Artificial Sequence
  MKO10116552_B_Slc26a5
  gRNA
gcuguuauuagcuugaugau

SEQ ID NO: 116553 - RNA, 20 nt, Artificial Sequence
  MKO10116553_B_Slc26a6
  gRNA
guccuagaugcucccgugcu

SEQ ID NO: 116554 - RNA, 20 nt, Artificial Sequence
  MKO10116554_B_Slc26a6
  gRNA
guaccuggaagaggccgacc

SEQ ID NO: 116555 - RNA, 20 nt, Artificial Sequence
  MKO10116555_B_Slc26a6
  gRNA
caaucccgccagaagggcau

SEQ ID NO: 116556 - RNA, 20 nt, Artificial Sequence
  MKO10116556_B_Slc26a7
  gRNA
cuuaccaaaacuaagucgac

SEQ ID NO: 116557 - RNA, 20 nt, Artificial Sequence
  MKO10116557_B_Slc26a7
  gRNA
cacagcguuggcugauauca

SEQ ID NO: 116558 - RNA, 20 nt, Artificial Sequence
  MKO10116558_B_Slc26a7
  gRNA
guggucauggcgcugaucac

SEQ ID NO: 116559 - RNA, 20 nt, Artificial Sequence
  MKO10116559_B_Slc26a9
  gRNA
acucaguggaggguguaucc

SEQ ID NO: 116560 - RNA, 20 nt, Artificial Sequence
  MKO10116560_B_Slc26a9
  gRNA
gaguagagaccguugacagc

SEQ ID NO: 116561 - RNA, 20 nt, Artificial Sequence
  MKO10116561_B_Slc26a9
  gRNA
cuacaucaucccugacuugc

SEQ ID NO: 116562 - RNA, 20 nt, Artificial Sequence
  MKO10116562_B_Slc27a1
  gRNA
ugaggcgcccaccacacccc

SEQ ID NO: 116563 - RNA, 20 nt, Artificial Sequence
  MKO10116563_B_Slc27a1
  gRNA
ugucaccacagcgguggcgg

SEQ ID NO: 116564 - RNA, 20 nt, Artificial Sequence
  MKO10116564_B_Slc27a1
  gRNA
cggcacgcaugcuguaggaa

SEQ ID NO: 116565 - RNA, 20 nt, Artificial Sequence
  MKO10116565_B_Slc27a2
  gRNA
augcguagaacucauacacg

SEQ ID NO: 116566 - RNA, 20 nt, Artificial Sequence
  MKO10116566_B_Slc27a2
  gRNA
agugucggcggaacccaccc

SEQ ID NO: 116567 - RNA, 20 nt, Artificial Sequence
  MKO10116567_B_Slc27a2
  gRNA
acuucagaccuccacgacuc

SEQ ID NO: 116568 - RNA, 20 nt, Artificial Sequence
  MKO10116568_B_Slc27a3
  gRNA
cgagguagaucacguccucc

SEQ ID NO: 116569 - RNA, 20 nt, Artificial Sequence
  MKO10116569_B_Slc27a3
  gRNA
ccacugccaagcgcaccuua

SEQ ID NO: 116570 - RNA, 20 nt, Artificial Sequence
  MKO10116570_B_Slc27a3
  gRNA
augacugauucgagcagccu

SEQ ID NO: 116571 - RNA, 20 nt, Artificial Sequence
  MKO10116571_B_Slc27a4
  gRNA
cccuugaagguauuaucgua

SEQ ID NO: 116572 - RNA, 20 nt, Artificial Sequence
  MKO10116572_B_Slc27a4
  gRNA
ccaccuguaaaacccuuguc

SEQ ID NO: 116573 - RNA, 20 nt, Artificial Sequence
  MKO10116573_B_Slc27a4
  gRNA
gugacugggcaggugcuucg

SEQ ID NO: 116574 - RNA, 20 nt, Artificial Sequence
  MKO10116574_B_Slc27a5
  gRNA
caaggacaagcccuaucgua

SEQ ID NO: 116575 - RNA, 20 nt, Artificial Sequence
  MKO10116575_B_Slc27a5
  gRNA
guacuuguguaacgucccug

SEQ ID NO: 116576 - RNA, 20 nt, Artificial Sequence
  MKO10116576_B_Slc27a5
  gRNA
cuaccucuguaccauacgau

SEQ ID NO: 116577 - RNA, 20 nt, Artificial Sequence
  MKO10116577_B_Slc27a6
  gRNA
gaacgcaccuguuguuccag

SEQ ID NO: 116578 - RNA, 20 nt, Artificial Sequence
  MKO10116578_B_Slc27a6
  gRNA
ccccaaacucugacguguuu

SEQ ID NO: 116579 - RNA, 20 nt, Artificial Sequence
  MKO10116579_B_Slc27a6
  gRNA
uagccaguugcaaguguuga

SEQ ID NO: 116580 - RNA, 20 nt, Artificial Sequence
  MKO10116580_B_Slc28a1
  gRNA
cgcccagcggccggaacagc

SEQ ID NO: 116581 - RNA, 20 nt, Artificial Sequence
  MKO10116581_B_Slc28a1
  gRNA
caucaccuaccaucgggaga

SEQ ID NO: 116582 - RNA, 20 nt, Artificial Sequence
  MKO10116582_B_Slc28a1
  gRNA
ugcaagcgagaagccucugc

SEQ ID NO: 116583 - RNA, 20 nt, Artificial Sequence
  MKO10116583_B_Slc28a2
  gRNA
cuguuguuggccucauccuc

SEQ ID NO: 116584 - RNA, 20 nt, Artificial Sequence
  MKO10116584_B_Slc28a2
  gRNA
ucuugagcaaagauacacac

SEQ ID NO: 116585 - RNA, 20 nt, Artificial Sequence
  MKO10116585_B_Slc28a2
  gRNA
gcuuggggcauuccucucuc

SEQ ID NO: 116586 - RNA, 20 nt, Artificial Sequence
  MKO10116586_B_Slc28a3
  gRNA
ucaucuucgcuaucauccuc

SEQ ID NO: 116587 - RNA, 20 nt, Artificial Sequence
  MKO10116587_B_Slc28a3
  gRNA
uuguucuccgaagcaccauc

SEQ ID NO: 116588 - RNA, 20 nt, Artificial Sequence
  MKO10116588_B_Slc28a3
  gRNA
gaaggcuucucgacaggcau

SEQ ID NO: 116589 - RNA, 20 nt, Artificial Sequence
  MKO10116589_B_Slc29a1
  gRNA
ugcggucauaaaaaaauucc

SEQ ID NO: 116590 - RNA, 20 nt, Artificial Sequence
  MKO10116590_B_Slc29a1
  gRNA
cuaggaucucucaaucuguu

SEQ ID NO: 116591 - RNA, 20 nt, Artificial Sequence
  MKO10116591_B_Slc29a1
  gRNA
uacgcagguauaaggcagua

SEQ ID NO: 116592 - RNA, 20 nt, Artificial Sequence
  MKO10116592_B_Slc29a2
  gRNA
cuucuucauuaccgccaucc

SEQ ID NO: 116593 - RNA, 20 nt, Artificial Sequence
  MKO10116593_B_Slc29a2
  gRNA
gccuugaagcacggcacaga

SEQ ID NO: 116594 - RNA, 20 nt, Artificial Sequence
  MKO10116594_B_Slc29a2
  gRNA
ugaagaagcugaucccaacc

SEQ ID NO: 116595 - RNA, 20 nt, Artificial Sequence
  MKO10116595_B_Slc29a3
  gRNA
gcaccauugaagcgauccuc

SEQ ID NO: 116596 - RNA, 20 nt, Artificial Sequence
  MKO10116596_B_Slc29a3
  gRNA
cgugcugucccgcacaucac

SEQ ID NO: 116597 - RNA, 20 nt, Artificial Sequence
  MKO10116597_B_Slc29a3
  gRNA
cuaucuauugcugucccaac

SEQ ID NO: 116598 - RNA, 20 nt, Artificial Sequence
  MKO10116598_B_Slc29a4
  gRNA
uacacgcagggugugaugac

SEQ ID NO: 116599 - RNA, 20 nt, Artificial Sequence
  MKO10116599_B_Slc29a4
  gRNA
gaggcucaugucaaauacga

SEQ ID NO: 116600 - RNA, 20 nt, Artificial Sequence
  MKO10116600_B_Slc29a4
  gRNA
acacgggauuacugcccaag

SEQ ID NO: 116601 - RNA, 20 nt, Artificial Sequence
  MKO10116601_B_Slc2a10
  gRNA
agugcucaccgaucaggucg

SEQ ID NO: 116602 - RNA, 20 nt, Artificial Sequence
  MKO10116602_B_Slc2a10
  gRNA
cucgccuccaguaaccuggu

SEQ ID NO: 116603 - RNA, 20 nt, Artificial Sequence
  MKO10116603_B_Slc2a10
  gRNA
gucccaaggugccaucggcu

SEQ ID NO: 116604 - RNA, 20 nt, Artificial Sequence
  MKO10116604_B_Slc2a12
  gRNA
ggcgcggccucuaauuccac

SEQ ID NO: 116605 - RNA, 20 nt, Artificial Sequence
  MKO10116605_B_Slc2a12
  gRNA
uagaucuuauugguuuguca

SEQ ID NO: 116606 - RNA, 20 nt, Artificial Sequence
  MKO10116606_B_Slc2a12
  gRNA
cccugacaucuagcaugaac

SEQ ID NO: 116607 - RNA, 20 nt, Artificial Sequence
  MKO10116607_B_Slc2a13
  gRNA
uguugaugcccgagaguugc

SEQ ID NO: 116608 - RNA, 20 nt, Artificial Sequence
  MKO10116608_B_Slc2a13
  gRNA
acuguccgccugugaugaag

SEQ ID NO: 116609 - RNA, 20 nt, Artificial Sequence
  MKO10116609_B_Slc2a13
  gRNA
gcaaccauccuccagauguc

SEQ ID NO: 116610 - RNA, 20 nt, Artificial Sequence
  MKO10116610_B_Slc2a1
  gRNA
ggugacgggccgccucaugu

SEQ ID NO: 116611 - RNA, 20 nt, Artificial Sequence
  MKO10116611_B_Slc2a1
  gRNA
ugccaacgacgauucccagc

SEQ ID NO: 116612 - RNA, 20 nt, Artificial Sequence
  MKO10116612_B_Slc2a1
  gRNA
agggcuccacguagagcugu

SEQ ID NO: 116613 - RNA, 20 nt, Artificial Sequence
  MKO10116613_B_Slc2a2
  gRNA
cacccaaaacaugucgauaa

SEQ ID NO: 116614 - RNA, 20 nt, Artificial Sequence
  MKO10116614_B_Slc2a2
  gRNA
gcacacgcccucaucauugc

SEQ ID NO: 116615 - RNA, 20 nt, Artificial Sequence
  MKO10116615_B_Slc2a2
  gRNA
ccuggguacucuucaccaac

SEQ ID NO: 116616 - RNA, 20 nt, Artificial Sequence
  MKO10116616_B_Slc2a3
  gRNA
gccgugacuguugccacgau

SEQ ID NO: 116617 - RNA, 20 nt, Artificial Sequence
  MKO10116617_B_Slc2a3
  gRNA
ggacuuucuuaacuacacuu

SEQ ID NO: 116618 - RNA, 20 nt, Artificial Sequence
  MKO10116618_B_Slc2a3
  gRNA
gccgaucguggcaacaguca

SEQ ID NO: 116619 - RNA, 20 nt, Artificial Sequence
  MKO10116619_B_Slc2a4
  gRNA
caugggccuagccaaugccg

SEQ ID NO: 116620 - RNA, 20 nt, Artificial Sequence
  MKO10116620_B_Slc2a4
  gRNA
aacagagcuacaaugcaacg

SEQ ID NO: 116621 - RNA, 20 nt, Artificial Sequence
  MKO10116621_B_Slc2a4
  gRNA
uucugcccagggcuaacauc

SEQ ID NO: 116622 - RNA, 20 nt, Artificial Sequence
  MKO10116622_B_Slc2a5
  gRNA
cgaugagcguugccagagca

SEQ ID NO: 116623 - RNA, 20 nt, Artificial Sequence
  MKO10116623_B_Slc2a5
  gRNA
cuccucauuucugucguagu

SEQ ID NO: 116624 - RNA, 20 nt, Artificial Sequence
  MKO10116624_B_Slc2a5
  gRNA
gcaacgcucaucgcugccuu

SEQ ID NO: 116625 - RNA, 20 nt, Artificial Sequence
  MKO10116625_B_Slc2a6
  gRNA
augcugacgggcuuugccgg

SEQ ID NO: 116626 - RNA, 20 nt, Artificial Sequence
  MKO10116626_B_Slc2a6
  gRNA
auugcacccccugauguucg

SEQ ID NO: 116627 - RNA, 20 nt, Artificial Sequence
  MKO10116627_B_Slc2a6
  gRNA
ggcuaccuucgccgcugugc

SEQ ID NO: 116628 - RNA, 20 nt, Artificial Sequence
  MKO10116628_B_Slc2a7
  gRNA
uucccaccagcacucgagac

SEQ ID NO: 116629 - RNA, 20 nt, Artificial Sequence
  MKO10116629_B_Slc2a7
  gRNA
gguuaccuguggcauuaccc

SEQ ID NO: 116630 - RNA, 20 nt, Artificial Sequence
  MKO10116630_B_Slc2a7
  gRNA
uauaaccucugccguccuga

SEQ ID NO: 116631 - RNA, 20 nt, Artificial Sequence
  MKO10116631_B_Slc2a8
  gRNA
aucgccuacccagcuguccg

SEQ ID NO: 116632 - RNA, 20 nt, Artificial Sequence
  MKO10116632_B_Slc2a8
  gRNA
cucagcuucggcuucgcgcu

SEQ ID NO: 116633 - RNA, 20 nt, Artificial Sequence
  MKO10116633_B_Slc2a8
  gRNA
ccaccaauagguuuacaucu

SEQ ID NO: 116634 - RNA, 20 nt, Artificial Sequence
  MKO10116634_B_Slc2a9
  gRNA
ucucaacgagaucucaccca

SEQ ID NO: 116635 - RNA, 20 nt, Artificial Sequence
  MKO10116635_B_Slc2a9
  gRNA
gcaugccaucagcaacgcug

SEQ ID NO: 116636 - RNA, 20 nt, Artificial Sequence
  MKO10116636_B_Slc2a9
  gRNA
gcauggacagcccauugacc

SEQ ID NO: 116637 - RNA, 20 nt, Artificial Sequence
  MKO10116637_B_Slc30a10
  gRNA
ccugguauuccgugcccuuc

SEQ ID NO: 116638 - RNA, 20 nt, Artificial Sequence
  MKO10116638_B_Slc30a10
  gRNA
gcuucgguaagacucucgag

SEQ ID NO: 116639 - RNA, 20 nt, Artificial Sequence
  MKO10116639_B_Slc30a10
  gRNA
ugccuugggguccgugguug

SEQ ID NO: 116640 - RNA, 20 nt, Artificial Sequence
  MKO10116640_B_Slc30a1
  gRNA
cagccugaauucgcuagcgu

SEQ ID NO: 116641 - RNA, 20 nt, Artificial Sequence
  MKO10116641_B_Slc30a1
  gRNA
ccuugcgcgcgcccuuggcg

SEQ ID NO: 116642 - RNA, 20 nt, Artificial Sequence
  MKO10116642_B_Slc30a1
  gRNA
uggccgagcgcuucgcccgg

SEQ ID NO: 116643 - RNA, 20 nt, Artificial Sequence
  MKO10116643_B_Slc30a2
  gRNA
gacuggggugcucguguacc

SEQ ID NO: 116644 - RNA, 20 nt, Artificial Sequence
  MKO10116644_B_Slc30a2
  gRNA
ggacaccauguugaucacuu

SEQ ID NO: 116645 - RNA, 20 nt, Artificial Sequence
  MKO10116645_B_Slc30a2
  gRNA
aggccacauagaguuugcgu

SEQ ID NO: 116646 - RNA, 20 nt, Artificial Sequence
  MKO10116646_B_Slc30a3
  gRNA
ugcagaguaugcaccucuag

SEQ ID NO: 116647 - RNA, 20 nt, Artificial Sequence
  MKO10116647_B_Slc30a3
  gRNA
gucucccucuggauagucac

SEQ ID NO: 116648 - RNA, 20 nt, Artificial Sequence
  MKO10116648_B_Slc30a3
  gRNA
gcccacuugcuagcagacau

SEQ ID NO: 116649 - RNA, 20 nt, Artificial Sequence
  MKO10116649_B_Slc30a4
  gRNA
caccagcauuacacugauca

SEQ ID NO: 116650 - RNA, 20 nt, Artificial Sequence
  MKO10116650_B_Slc30a4
  gRNA
ucugcacagccucauauaag

SEQ ID NO: 116651 - RNA, 20 nt, Artificial Sequence
  MKO10116651_B_Slc30a4
  gRNA
acaguagugauaauccugga

SEQ ID NO: 116652 - RNA, 20 nt, Artificial Sequence
  MKO10116652_B_Slc30a5
  gRNA
guguuuaaccaaauguuuga

SEQ ID NO: 116653 - RNA, 20 nt, Artificial Sequence
  MKO10116653_B_Slc30a5
  gRNA
gaaaccuauuacaaagcauc

SEQ ID NO: 116654 - RNA, 20 nt, Artificial Sequence
  MKO10116654_B_Slc30a5
  gRNA
ucccacagccuucaaacauu

SEQ ID NO: 116655 - RNA, 20 nt, Artificial Sequence
  MKO10116655_B_Slc30a6
  gRNA
ucaccaucuuugaucucuuu

SEQ ID NO: 116656 - RNA, 20 nt, Artificial Sequence
  MKO10116656_B_Slc30a6
  gRNA
uuaccuaaagagaucaaaga

SEQ ID NO: 116657 - RNA, 20 nt, Artificial Sequence
  MKO10116657_B_Slc30a6
  gRNA
uuuccaaaaaaagaucucug

SEQ ID NO: 116658 - RNA, 20 nt, Artificial Sequence
  MKO10116658_B_Slc30a7
  gRNA
cgugcccagguccauccugu

SEQ ID NO: 116659 - RNA, 20 nt, Artificial Sequence
  MKO10116659_B_Slc30a7
  gRNA
aaacaagcagcagucucucg

SEQ ID NO: 116660 - RNA, 20 nt, Artificial Sequence
  MKO10116660_B_Slc30a7
  gRNA
aggagucggagaucaagccu

SEQ ID NO: 116661 - RNA, 20 nt, Artificial Sequence
  MKO10116661_B_Slc30a8
  gRNA
ccugauuaccagauccaagc

SEQ ID NO: 116662 - RNA, 20 nt, Artificial Sequence
  MKO10116662_B_Slc30a8
  gRNA
cacaaaggcugcucggacac

SEQ ID NO: 116663 - RNA, 20 nt, Artificial Sequence
  MKO10116663_B_Slc30a8
  gRNA
ucacugccacaacagcgcca

SEQ ID NO: 116664 - RNA, 20 nt, Artificial Sequence
  MKO10116664_B_Slc30a9
  gRNA
uagaacaacuucgaaaaauc

SEQ ID NO: 116665 - RNA, 20 nt, Artificial Sequence
  MKO10116665_B_Slc30a9
  gRNA
gucccaucacuuacacaaac

SEQ ID NO: 116666 - RNA, 20 nt, Artificial Sequence
  MKO10116666_B_Slc30a9
  gRNA
acgaguucugccuuaagucc

SEQ ID NO: 116667 - RNA, 20 nt, Artificial Sequence
  MKO10116667_B_Slc31a1
  gRNA
uaguaaaaacacugccacga

SEQ ID NO: 116668 - RNA, 20 nt, Artificial Sequence
  MKO10116668_B_Slc31a1
  gRNA
uugguaaucaauacaccugg

SEQ ID NO: 116669 - RNA, 20 nt, Artificial Sequence
  MKO10116669_B_Slc31a1
  gRNA
cugcugcuacugcaaugcau

SEQ ID NO: 116670 - RNA, 20 nt, Artificial Sequence
  MKO10116670_B_Slc31a2
  gRNA
caauuaccaccugaaugaca

SEQ ID NO: 116671 - RNA, 20 nt, Artificial Sequence
  MKO10116671_B_Slc31a2
  gRNA
ccgugcuucucuuugauuuc

SEQ ID NO: 116672 - RNA, 20 nt, Artificial Sequence
  MKO10116672_B_Slc31a2
  gRNA
gcauuucaucuucucagaug

SEQ ID NO: 116673 - RNA, 20 nt, Artificial Sequence
  MKO10116673_B_Slc32a1
  gRNA
ucucgacuuugagcaucgcc

SEQ ID NO: 116674 - RNA, 20 nt, Artificial Sequence
  MKO10116674_B_Slc32a1
  gRNA
cgucuucguucuccucguac

SEQ ID NO: 116675 - RNA, 20 nt, Artificial Sequence
  MKO10116675_B_Slc32a1
  gRNA
gagguugaccacggcgcgga

SEQ ID NO: 116676 - RNA, 20 nt, Artificial Sequence
  MKO10116676_B_Slc33a1
  gRNA
cagcauguaugugucgauaa

SEQ ID NO: 116677 - RNA, 20 nt, Artificial Sequence
  MKO10116677_B_Slc33a1
  gRNA
uuuacaaagccaugcccuac

SEQ ID NO: 116678 - RNA, 20 nt, Artificial Sequence
  MKO10116678_B_Slc33a1
  gRNA
ccuucugauucuaacgucaa

SEQ ID NO: 116679 - RNA, 20 nt, Artificial Sequence
  MKO10116679_B_Slc34a1
  gRNA
ugacccacuaccuaccaagc

SEQ ID NO: 116680 - RNA, 20 nt, Artificial Sequence
  MKO10116680_B_Slc34a1
  gRNA
gcucagcuccgccuuccagu

SEQ ID NO: 116681 - RNA, 20 nt, Artificial Sequence
  MKO10116681_B_Slc34a1
  gRNA
uacauccaucauugucagca

SEQ ID NO: 116682 - RNA, 20 nt, Artificial Sequence
  MKO10116682_B_Slc34a2
  gRNA
gcuacccuccuauuccgccc

SEQ ID NO: 116683 - RNA, 20 nt, Artificial Sequence
  MKO10116683_B_Slc34a2
  gRNA
cuacuuguucgugugcuccc

SEQ ID NO: 116684 - RNA, 20 nt, Artificial Sequence
  MKO10116684_B_Slc34a2
  gRNA
agcaaccaugcugacgauga

SEQ ID NO: 116685 - RNA, 20 nt, Artificial Sequence
  MKO10116685_B_Slc34a3
  gRNA
aguuggucagcguucuucag

SEQ ID NO: 116686 - RNA, 20 nt, Artificial Sequence
  MKO10116686_B_Slc34a3
  gRNA
ggaaucuccgguuccauucc

SEQ ID NO: 116687 - RNA, 20 nt, Artificial Sequence
  MKO10116687_B_Slc34a3
  gRNA
cugacugcgccauugagacc

SEQ ID NO: 116688 - RNA, 20 nt, Artificial Sequence
  MKO10116688_B_Slc35a1
  gRNA
ugcacagcauacacuaguga

SEQ ID NO: 116689 - RNA, 20 nt, Artificial Sequence
  MKO10116689_B_Slc35a1
  gRNA
agcccaagcuacaaaagucg

SEQ ID NO: 116690 - RNA, 20 nt, Artificial Sequence
  MKO10116690_B_Slc35a1
  gRNA
auagcaccaaagccuaacaa

SEQ ID NO: 116691 - RNA, 20 nt, Artificial Sequence
  MKO10116691_B_Slc35a2
  gRNA
caaugacgagcccagcgccc

SEQ ID NO: 116692 - RNA, 20 nt, Artificial Sequence
  MKO10116692_B_Slc35a2
  gRNA
ggccaccucacccgcuguag

SEQ ID NO: 116693 - RNA, 20 nt, Artificial Sequence
  MKO10116693_B_Slc35a2
  gRNA
gugggcugagggcaccgccg

SEQ ID NO: 116694 - RNA, 20 nt, Artificial Sequence
  MKO10116694_B_Slc35a3
  gRNA
ucagaacaacuuacucuaug

SEQ ID NO: 116695 - RNA, 20 nt, Artificial Sequence
  MKO10116695_B_Slc35a3
  gRNA
guggauaguuguugcucugc

SEQ ID NO: 116696 - RNA, 20 nt, Artificial Sequence
  MKO10116696_B_Slc35a3
  gRNA
cuccugccaucagaauuacu

SEQ ID NO: 116697 - RNA, 20 nt, Artificial Sequence
  MKO10116697_B_Slc35a4
  gRNA
gauuuaucugcagcgcuaca

SEQ ID NO: 116698 - RNA, 20 nt, Artificial Sequence
  MKO10116698_B_Slc35a4
  gRNA
acagugcuaagaacggugca

SEQ ID NO: 116699 - RNA, 20 nt, Artificial Sequence
  MKO10116699_B_Slc35a4
  gRNA
auguuugccagccuaccagg

SEQ ID NO: 116700 - RNA, 20 nt, Artificial Sequence
  MKO10116700_B_Slc35a5
  gRNA
gaaacuugagaauuccuucc

SEQ ID NO: 116701 - RNA, 20 nt, Artificial Sequence
  MKO10116701_B_Slc35a5
  gRNA
uaacaacagcucuucuauuc

SEQ ID NO: 116702 - RNA, 20 nt, Artificial Sequence
  MKO10116702_B_Slc35a5
  gRNA
gcuacuuacaggcugaagau

SEQ ID NO: 116703 - RNA, 20 nt, Artificial Sequence
  MKO10116703_B_Slc35b1
  gRNA
cccuggcagugucaaaaaac

SEQ ID NO: 116704 - RNA, 20 nt, Artificial Sequence
  MKO10116704_B_Slc35b1
  gRNA
acauagcauugaucacacac

SEQ ID NO: 116705 - RNA, 20 nt, Artificial Sequence
  MKO10116705_B_Slc35b1
  gRNA
aaauccugcaagccaauccc

SEQ ID NO: 116706 - RNA, 20 nt, Artificial Sequence
  MKO10116706_B_Slc35b2
  gRNA
uccgucuuaaguacugcacc

SEQ ID NO: 116707 - RNA, 20 nt, Artificial Sequence
  MKO10116707_B_Slc35b2
  gRNA
gauuccgcugucucuguccg

SEQ ID NO: 116708 - RNA, 20 nt, Artificial Sequence
  MKO10116708_B_Slc35b2
  gRNA
cuuaagacggaagaacuacc

SEQ ID NO: 116709 - RNA, 20 nt, Artificial Sequence
  MKO10116709_B_Slc35b3
  gRNA
gccgcacaucaagucaguug

SEQ ID NO: 116710 - RNA, 20 nt, Artificial Sequence
  MKO10116710_B_Slc35b3
  gRNA
cucagugcccuccaaaacgc

SEQ ID NO: 116711 - RNA, 20 nt, Artificial Sequence
  MKO10116711_B_Slc35b3
  gRNA
gcaccaaacuuuaaucugac

SEQ ID NO: 116712 - RNA, 20 nt, Artificial Sequence
  MKO10116712_B_Slc35b4
  gRNA
uugcagguacuaugccauca

SEQ ID NO: 116713 - RNA, 20 nt, Artificial Sequence
  MKO10116713_B_Slc35b4
  gRNA
caaguauaccuccauugccc

SEQ ID NO: 116714 - RNA, 20 nt, Artificial Sequence
  MKO10116714_B_Slc35b4
  gRNA
cugauugccaacaugauucu

SEQ ID NO: 116715 - RNA, 20 nt, Artificial Sequence
  MKO10116715_B_Slc35c1
  gRNA
gcucgcccagcacuaucauc

SEQ ID NO: 116716 - RNA, 20 nt, Artificial Sequence
  MKO10116716_B_Slc35c1
  gRNA
auccugcgcauggcgcugac

SEQ ID NO: 116717 - RNA, 20 nt, Artificial Sequence
  MKO10116717_B_Slc35c1
  gRNA
ccccugacccauaacguguc

SEQ ID NO: 116718 - RNA, 20 nt, Artificial Sequence
  MKO10116718_B_Slc35c2
  gRNA
ccguccagcucagcaccacc

SEQ ID NO: 116719 - RNA, 20 nt, Artificial Sequence
  MKO10116719_B_Slc35c2
  gRNA
ccggguggugcugagcugga

SEQ ID NO: 116720 - RNA, 20 nt, Artificial Sequence
  MKO10116720_B_Slc35c2
  gRNA
acagggacacagugauguag

SEQ ID NO: 116721 - RNA, 20 nt, Artificial Sequence
  MKO10116721_B_Slc35d1
  gRNA
uuuccauccucgcuaugugu

SEQ ID NO: 116722 - RNA, 20 nt, Artificial Sequence
  MKO10116722_B_Slc35d1
  gRNA
gguacauuucugucgaaguc

SEQ ID NO: 116723 - RNA, 20 nt, Artificial Sequence
  MKO10116723_B_Slc35d1
  gRNA
ccaaaauauaguagagguag

SEQ ID NO: 116724 - RNA, 20 nt, Artificial Sequence
  MKO10116724_B_Slc35d2
  gRNA
ugcuugauaagccacuuaug

SEQ ID NO: 116725 - RNA, 20 nt, Artificial Sequence
  MKO10116725_B_Slc35d2
  gRNA
ccucugccccuucucuacgu

SEQ ID NO: 116726 - RNA, 20 nt, Artificial Sequence
  MKO10116726_B_Slc35d2
  gRNA
uguccaauuccaaguacaau

SEQ ID NO: 116727 - RNA, 20 nt, Artificial Sequence
  MKO10116727_B_Slc35d3
  gRNA
aagaacggcgcgcccucgcc

SEQ ID NO: 116728 - RNA, 20 nt, Artificial Sequence
  MKO10116728_B_Slc35d3
  gRNA
ccguguccgcgcucgccuuc

SEQ ID NO: 116729 - RNA, 20 nt, Artificial Sequence
  MKO10116729_B_Slc35d3
  gRNA
caugguggcguucagcgacg

SEQ ID NO: 116730 - RNA, 20 nt, Artificial Sequence
  MKO10116730_B_Slc35e1
  gRNA
cuggguugcgcagcauaaug

SEQ ID NO: 116731 - RNA, 20 nt, Artificial Sequence
  MKO10116731_B_Slc35e1
  gRNA
gagguccaccagaacccacg

SEQ ID NO: 116732 - RNA, 20 nt, Artificial Sequence
  MKO10116732_B_Slc35e1
  gRNA
caaugcucaccuuguuguac

SEQ ID NO: 116733 - RNA, 20 nt, Artificial Sequence
  MKO10116733_B_Slc35e2
  gRNA
augauucugggggaguacac

SEQ ID NO: 116734 - RNA, 20 nt, Artificial Sequence
  MKO10116734_B_Slc35e2
  gRNA
agacaugaucaccgugaaaa

SEQ ID NO: 116735 - RNA, 20 nt, Artificial Sequence
  MKO10116735_B_Slc35e2
  gRNA
caucaugacuaugcucuuug

SEQ ID NO: 116736 - RNA, 20 nt, Artificial Sequence
  MKO10116736_B_Slc35e3
  gRNA
ucuauuuaaggacccccugu

SEQ ID NO: 116737 - RNA, 20 nt, Artificial Sequence
  MKO10116737_B_Slc35e3
  gRNA
ucccuggucaguuucugcuu

SEQ ID NO: 116738 - RNA, 20 nt, Artificial Sequence
  MKO10116738_B_Slc35e3
  gRNA
uaccaaagcagaaacugacc

SEQ ID NO: 116739 - RNA, 20 nt, Artificial Sequence
  MKO10116739_B_Slc35e4
  gRNA
ccagguagcugagcgcgcug

SEQ ID NO: 116740 - RNA, 20 nt, Artificial Sequence
  MKO10116740_B_Slc35e4
  gRNA
guuuguccggaggccacuug

SEQ ID NO: 116741 - RNA, 20 nt, Artificial Sequence
  MKO10116741_B_Slc35e4
  gRNA
gcggaugugccgcugcccac

SEQ ID NO: 116742 - RNA, 20 nt, Artificial Sequence
  MKO10116742_B_Slc35f1
  gRNA
uguacgggaucucaaauguc

SEQ ID NO: 116743 - RNA, 20 nt, Artificial Sequence
  MKO10116743_B_Slc35f1
  gRNA
aucuucgucguaaaauugcc

SEQ ID NO: 116744 - RNA, 20 nt, Artificial Sequence
  MKO10116744_B_Slc35f1
  gRNA
agccaauuccacaaacgaga

SEQ ID NO: 116745 - RNA, 20 nt, Artificial Sequence
  MKO10116745_B_Slc35f2
  gRNA
ucucuuggggcuugccgaug

SEQ ID NO: 116746 - RNA, 20 nt, Artificial Sequence
  MKO10116746_B_Slc35f2
  gRNA
uaauaugucugcaccaacca

SEQ ID NO: 116747 - RNA, 20 nt, Artificial Sequence
  MKO10116747_B_Slc35f2
  gRNA
cacuggucagagucguguac

SEQ ID NO: 116748 - RNA, 20 nt, Artificial Sequence
  MKO10116748_B_Slc35f3
  gRNA
cagcgccaaguucggagaag

SEQ ID NO: 116749 - RNA, 20 nt, Artificial Sequence
  MKO10116749_B_Slc35f3
  gRNA
uaaggccgcuucuccgaacu

SEQ ID NO: 116750 - RNA, 20 nt, Artificial Sequence
  MKO10116750_B_Slc35f3
  gRNA
gucaugaugaccuaugccga

SEQ ID NO: 116751 - RNA, 20 nt, Artificial Sequence
  MKO10116751_B_Slc35f4
  gRNA
gaaucuuccgugaccgacag

SEQ ID NO: 116752 - RNA, 20 nt, Artificial Sequence
  MKO10116752_B_Slc35f4
  gRNA
uuccacgcugauuccaucau

SEQ ID NO: 116753 - RNA, 20 nt, Artificial Sequence
  MKO10116753_B_Slc35f4
  gRNA
ccuguccuucagcacaaucc

SEQ ID NO: 116754 - RNA, 20 nt, Artificial Sequence
  MKO10116754_B_Slc35f5
  gRNA
caguguacaagaggauuuag

SEQ ID NO: 116755 - RNA, 20 nt, Artificial Sequence
  MKO10116755_B_Slc35f5
  gRNA
ugagaauuuaccuuguugca

SEQ ID NO: 116756 - RNA, 20 nt, Artificial Sequence
  MKO10116756_B_Slc35f5
  gRNA
cugggcucugcccgcuuugc

SEQ ID NO: 116757 - RNA, 20 nt, Artificial Sequence
  MKO10116757_B_Slc35f6
  gRNA
cuucaagcaucccuucgucc

SEQ ID NO: 116758 - RNA, 20 nt, Artificial Sequence
  MKO10116758_B_Slc35f6
  gRNA
ccagcccugugugacaugac

SEQ ID NO: 116759 - RNA, 20 nt, Artificial Sequence
  MKO10116759_B_Slc35f6
  gRNA
gggcauccugaucacuauug

SEQ ID NO: 116760 - RNA, 20 nt, Artificial Sequence
  MKO10116760_B_Slc35g1
  gRNA
cccacgcgagccgcacgccc

SEQ ID NO: 116761 - RNA, 20 nt, Artificial Sequence
  MKO10116761_B_Slc35g1
  gRNA
cgcggcggagcuugcagccg

SEQ ID NO: 116762 - RNA, 20 nt, Artificial Sequence
  MKO10116762_B_Slc35g1
  gRNA
cguguaaaacaagccaaguc

SEQ ID NO: 116763 - RNA, 20 nt, Artificial Sequence
  MKO10116763_B_Slc35g2
  gRNA
cacagucauuguauacccga

SEQ ID NO: 116764 - RNA, 20 nt, Artificial Sequence
  MKO10116764_B_Slc35g2
  gRNA
gauuguuccaguccaaccga

SEQ ID NO: 116765 - RNA, 20 nt, Artificial Sequence
  MKO10116765_B_Slc35g2
  gRNA
cggguauacaaugacuguga

SEQ ID NO: 116766 - RNA, 20 nt, Artificial Sequence
  MKO10116766_B_Slc35g3
  gRNA
cacaauggcugaagcucugc

SEQ ID NO: 116767 - RNA, 20 nt, Artificial Sequence
  MKO10116767_B_Slc35g3
  gRNA
gaccucccaguugcccucgu

SEQ ID NO: 116768 - RNA, 20 nt, Artificial Sequence
  MKO10116768_B_Slc35g3
  gRNA
aaggcccgaacccgaacauc

SEQ ID NO: 116769 - RNA, 20 nt, Artificial Sequence
  MKO10116769_B_Slc36a1
  gRNA
cguguccccauaguccaaaa

SEQ ID NO: 116770 - RNA, 20 nt, Artificial Sequence
  MKO10116770_B_Slc36a1
  gRNA
ugccaauguugccuuucagc

SEQ ID NO: 116771 - RNA, 20 nt, Artificial Sequence
  MKO10116771_B_Slc36a1
  gRNA
ccucuggcagugaagaacgc

SEQ ID NO: 116772 - RNA, 20 nt, Artificial Sequence
  MKO10116772_B_Slc36a2
  gRNA
gaugggcccacucagcuugc

SEQ ID NO: 116773 - RNA, 20 nt, Artificial Sequence
  MKO10116773_B_Slc36a2
  gRNA
guguccccauaguccaugaa

SEQ ID NO: 116774 - RNA, 20 nt, Artificial Sequence
  MKO10116774_B_Slc36a2
  gRNA
cugcaaaaccacgcccacug

SEQ ID NO: 116775 - RNA, 20 nt, Artificial Sequence
  MKO10116775_B_Slc36a3
  gRNA
cguguccaaguccuuggcug

SEQ ID NO: 116776 - RNA, 20 nt, Artificial Sequence
  MKO10116776_B_Slc36a3
  gRNA
ccugcugaucgucacucagc

SEQ ID NO: 116777 - RNA, 20 nt, Artificial Sequence
  MKO10116777_B_Slc36a3
  gRNA
ggcgcucacagugcacugua

SEQ ID NO: 116778 - RNA, 20 nt, Artificial Sequence
  MKO10116778_B_Slc36a4
  gRNA
uuauagauauggacgugaug

SEQ ID NO: 116779 - RNA, 20 nt, Artificial Sequence
  MKO10116779_B_Slc36a4
  gRNA
gcccgcguucuuuauagcca

SEQ ID NO: 116780 - RNA, 20 nt, Artificial Sequence
  MKO10116780_B_Slc36a4
  gRNA
guggaguugccuucagcgac

SEQ ID NO: 116781 - RNA, 20 nt, Artificial Sequence
  MKO10116781_B_Slc37a1
  gRNA
agaaauagcccaagccgaac

SEQ ID NO: 116782 - RNA, 20 nt, Artificial Sequence
  MKO10116782_B_Slc37a1
  gRNA
uuccugugcgccuaugccau

SEQ ID NO: 116783 - RNA, 20 nt, Artificial Sequence
  MKO10116783_B_Slc37a1
  gRNA
cuucacaagcaguguacugc

SEQ ID NO: 116784 - RNA, 20 nt, Artificial Sequence
  MKO10116784_B_Slc37a2
  gRNA
ccucaccuugacgaugcuga

SEQ ID NO: 116785 - RNA, 20 nt, Artificial Sequence
  MKO10116785_B_Slc37a2
  gRNA
gguuccuucgcgccuucucu

SEQ ID NO: 116786 - RNA, 20 nt, Artificial Sequence
  MKO10116786_B_Slc37a2
  gRNA
uguggacaaugccuuccuag

SEQ ID NO: 116787 - RNA, 20 nt, Artificial Sequence
  MKO10116787_B_Slc37a3
  gRNA
cucucgaagguguuugucuu

SEQ ID NO: 116788 - RNA, 20 nt, Artificial Sequence
  MKO10116788_B_Slc37a3
  gRNA
uucugcauaccucugcaggc

SEQ ID NO: 116789 - RNA, 20 nt, Artificial Sequence
  MKO10116789_B_Slc37a3
  gRNA
aucacuugaccugccugcag

SEQ ID NO: 116790 - RNA, 20 nt, Artificial Sequence
  MKO10116790_B_Slc37a4
  gRNA
guugucaaccagcaugaacc

SEQ ID NO: 116791 - RNA, 20 nt, Artificial Sequence
  MKO10116791_B_Slc37a4
  gRNA
gcuguccacuggcuaccucg

SEQ ID NO: 116792 - RNA, 20 nt, Artificial Sequence
  MKO10116792_B_Slc37a4
  gRNA
uggucaacguagucuucuca

SEQ ID NO: 116793 - RNA, 20 nt, Artificial Sequence
  MKO10116793_B_Slc38a10
  gRNA
guucgugaucagcccccacu

SEQ ID NO: 116794 - RNA, 20 nt, Artificial Sequence
  MKO10116794_B_Slc38a10
  gRNA
cggccgccuccaccuccaag

SEQ ID NO: 116795 - RNA, 20 nt, Artificial Sequence
  MKO10116795_B_Slc38a10
  gRNA
agucggccagccugagcaag

SEQ ID NO: 116796 - RNA, 20 nt, Artificial Sequence
  MKO10116796_B_Slc38a11
  gRNA
ccuuauucaaugaagcaagc

SEQ ID NO: 116797 - RNA, 20 nt, Artificial Sequence
  MKO10116797_B_Slc38a11
  gRNA
aggucuuguuaaccaaagac

SEQ ID NO: 116798 - RNA, 20 nt, Artificial Sequence
  MKO10116798_B_Slc38a11
  gRNA
ccagcuugcuucauugaaua

SEQ ID NO: 116799 - RNA, 20 nt, Artificial Sequence
  MKO10116799_B_Slc38a1
  gRNA
gaagaucaccagcuuccccg

SEQ ID NO: 116800 - RNA, 20 nt, Artificial Sequence
  MKO10116800_B_Slc38a1
  gRNA
gagucucacaaacagccauc

SEQ ID NO: 116801 - RNA, 20 nt, Artificial Sequence
  MKO10116801_B_Slc38a1
  gRNA
ucucagcuuaccgguuuccu

SEQ ID NO: 116802 - RNA, 20 nt, Artificial Sequence
  MKO10116802_B_Slc38a2
  gRNA
uaaucugagcaaugcgauug

SEQ ID NO: 116803 - RNA, 20 nt, Artificial Sequence
  MKO10116803_B_Slc38a2
  gRNA
agcuacuguaccuccuucgu

SEQ ID NO: 116804 - RNA, 20 nt, Artificial Sequence
  MKO10116804_B_Slc38a2
  gRNA
aucuuuauuguacgaacagu

SEQ ID NO: 116805 - RNA, 20 nt, Artificial Sequence
  MKO10116805_B_Slc38a3
  gRNA
ccacaauccccgaagacuug

SEQ ID NO: 116806 - RNA, 20 nt, Artificial Sequence
  MKO10116806_B_Slc38a3
  gRNA
gaaaaggaugaugcccguau

SEQ ID NO: 116807 - RNA, 20 nt, Artificial Sequence
  MKO10116807_B_Slc38a3
  gRNA
cagcucacaucggugaagug

SEQ ID NO: 116808 - RNA, 20 nt, Artificial Sequence
  MKO10116808_B_Slc38a4
  gRNA
cuuaggcuuguccuaugcca

SEQ ID NO: 116809 - RNA, 20 nt, Artificial Sequence
  MKO10116809_B_Slc38a4
  gRNA
uuacauaaaaaggaugaucc

SEQ ID NO: 116810 - RNA, 20 nt, Artificial Sequence
  MKO10116810_B_Slc38a4
  gRNA
cugcauuguaauagagauga

SEQ ID NO: 116811 - RNA, 20 nt, Artificial Sequence
  MKO10116811_B_Slc38a5
  gRNA
caaccucagcaacgcuauca

SEQ ID NO: 116812 - RNA, 20 nt, Artificial Sequence
  MKO10116812_B_Slc38a5
  gRNA
accacccguaacccugcuac

SEQ ID NO: 116813 - RNA, 20 nt, Artificial Sequence
  MKO10116813_B_Slc38a5
  gRNA
ugccaacaggauggaaaugc

SEQ ID NO: 116814 - RNA, 20 nt, Artificial Sequence
  MKO10116814_B_Slc38a6
  gRNA
ccaucacauacgccaaacca

SEQ ID NO: 116815 - RNA, 20 nt, Artificial Sequence
  MKO10116815_B_Slc38a6
  gRNA
cucaccgguguggaugcaca

SEQ ID NO: 116816 - RNA, 20 nt, Artificial Sequence
  MKO10116816_B_Slc38a6
  gRNA
gauggacugaguaagaagcc

SEQ ID NO: 116817 - RNA, 20 nt, Artificial Sequence
  MKO10116817_B_Slc38a7
  gRNA
gccauugcggucuauaccuu

SEQ ID NO: 116818 - RNA, 20 nt, Artificial Sequence
  MKO10116818_B_Slc38a7
  gRNA
aguuauagcugugaugucga

SEQ ID NO: 116819 - RNA, 20 nt, Artificial Sequence
  MKO10116819_B_Slc38a7
  gRNA
cuccgaaccuggcauauuuc

SEQ ID NO: 116820 - RNA, 20 nt, Artificial Sequence
  MKO10116820_B_Slc38a8
  gRNA
ugccugacgccccacagccu

SEQ ID NO: 116821 - RNA, 20 nt, Artificial Sequence
  MKO10116821_B_Slc38a8
  gRNA
gcaauacuaccuguggcccc

SEQ ID NO: 116822 - RNA, 20 nt, Artificial Sequence
  MKO10116822_B_Slc38a8
  gRNA
cuguucacagcccgucuccc

SEQ ID NO: 116823 - RNA, 20 nt, Artificial Sequence
  MKO10116823_B_Slc38a9
  gRNA
acuuuacugcugcuauagag

SEQ ID NO: 116824 - RNA, 20 nt, Artificial Sequence
  MKO10116824_B_Slc38a9
  gRNA
uaguauagauguucccauca

SEQ ID NO: 116825 - RNA, 20 nt, Artificial Sequence
  MKO10116825_B_Slc38a9
  gRNA
gcucaccacuccugcagaca

SEQ ID NO: 116826 - RNA, 20 nt, Artificial Sequence
  MKO10116826_B_Slc39a10
  gRNA
uuccuuguugcacuagcagu

SEQ ID NO: 116827 - RNA, 20 nt, Artificial Sequence
  MKO10116827_B_Slc39a10
  gRNA
cgugcguaugcugaugacug

SEQ ID NO: 116828 - RNA, 20 nt, Artificial Sequence
  MKO10116828_B_Slc39a10
  gRNA
caaagguacgugaauagauc

SEQ ID NO: 116829 - RNA, 20 nt, Artificial Sequence
  MKO10116829_B_Slc39a11
  gRNA
ucaccccugcggcaaagccc

SEQ ID NO: 116830 - RNA, 20 nt, Artificial Sequence
  MKO10116830_B_Slc39a11
  gRNA
aaaggcuccgaagccccccg

SEQ ID NO: 116831 - RNA, 20 nt, Artificial Sequence
  MKO10116831_B_Slc39a11
  gRNA
uugcagaggcggaucuuaga

SEQ ID NO: 116832 - RNA, 20 nt, Artificial Sequence
  MKO10116832_B_Slc39a12
  gRNA
ugaacaugcucacgaccaga

SEQ ID NO: 116833 - RNA, 20 nt, Artificial Sequence
  MKO10116833_B_Slc39a12
  gRNA
ggaagugccaaaguacuucc

SEQ ID NO: 116834 - RNA, 20 nt, Artificial Sequence
  MKO10116834_B_Slc39a12
  gRNA
gacuuuaagcagcuaagucc

SEQ ID NO: 116835 - RNA, 20 nt, Artificial Sequence
  MKO10116835_B_Slc39a13
  gRNA
acaguggccuccauugagcg

SEQ ID NO: 116836 - RNA, 20 nt, Artificial Sequence
  MKO10116836_B_Slc39a13
  gRNA
ugggguccuccuugcuguug

SEQ ID NO: 116837 - RNA, 20 nt, Artificial Sequence
  MKO10116837_B_Slc39a13
  gRNA
accauagacaacuucacuca

SEQ ID NO: 116838 - RNA, 20 nt, Artificial Sequence
  MKO10116838_B_Slc39a14
  gRNA
ccacaugcagguggucgagc

SEQ ID NO: 116839 - RNA, 20 nt, Artificial Sequence
  MKO10116839_B_Slc39a14
  gRNA
ggcgccuggcacggacgaga

SEQ ID NO: 116840 - RNA, 20 nt, Artificial Sequence
  MKO10116840_B_Slc39a14
  gRNA
cagcagacgaggcaugaguc

SEQ ID NO: 116841 - RNA, 20 nt, Artificial Sequence
  MKO10116841_B_Slc39a1
  gRNA
cuuggaggcccugcauguga

SEQ ID NO: 116842 - RNA, 20 nt, Artificial Sequence
  MKO10116842_B_Slc39a1
  gRNA
agcagucgcaucggagcccu

SEQ ID NO: 116843 - RNA, 20 nt, Artificial Sequence
  MKO10116843_B_Slc39a1
  gRNA
gguccaucgugccagugcug

SEQ ID NO: 116844 - RNA, 20 nt, Artificial Sequence
  MKO10116844_B_Slc39a2
  gRNA
ccaaagauggagguacuacu

SEQ ID NO: 116845 - RNA, 20 nt, Artificial Sequence
  MKO10116845_B_Slc39a2
  gRNA
gcauaugacugcugaagcuc

SEQ ID NO: 116846 - RNA, 20 nt, Artificial Sequence
  MKO10116846_B_Slc39a2
  gRNA
cuagaauaguacaggaagua

SEQ ID NO: 116847 - RNA, 20 nt, Artificial Sequence
  MKO10116847_B_Slc39a3
  gRNA
cacccccgaagguguugcag

SEQ ID NO: 116848 - RNA, 20 nt, Artificial Sequence
  MKO10116848_B_Slc39a3
  gRNA
cguggccauccacgagacgc

SEQ ID NO: 116849 - RNA, 20 nt, Artificial Sequence
  MKO10116849_B_Slc39a3
  gRNA
uguggcaucggcgcugcuac

SEQ ID NO: 116850 - RNA, 20 nt, Artificial Sequence
  MKO10116850_B_Slc39a4
  gRNA
uggccagguaaucguccaca

SEQ ID NO: 116851 - RNA, 20 nt, Artificial Sequence
  MKO10116851_B_Slc39a4
  gRNA
gagaauuugaugcaucaccu

SEQ ID NO: 116852 - RNA, 20 nt, Artificial Sequence
  MKO10116852_B_Slc39a4
  gRNA
cugaauacggauaguggggu

SEQ ID NO: 116853 - RNA, 20 nt, Artificial Sequence
  MKO10116853_B_Slc39a5
  gRNA
ucgagggcccugacccgugc

SEQ ID NO: 116854 - RNA, 20 nt, Artificial Sequence
  MKO10116854_B_Slc39a5
  gRNA
ggaccuggguccgggacugu

SEQ ID NO: 116855 - RNA, 20 nt, Artificial Sequence
  MKO10116855_B_Slc39a5
  gRNA
ugaccagacaguacaucccc

SEQ ID NO: 116856 - RNA, 20 nt, Artificial Sequence
  MKO10116856_B_Slc39a6
  gRNA
aaaggucugacggcucuagg

SEQ ID NO: 116857 - RNA, 20 nt, Artificial Sequence
  MKO10116857_B_Slc39a6
  gRNA
ccguugcauucaacagagcc

SEQ ID NO: 116858 - RNA, 20 nt, Artificial Sequence
  MKO10116858_B_Slc39a6
  gRNA
agcaucaauuugauugauga

SEQ ID NO: 116859 - RNA, 20 nt, Artificial Sequence
  MKO10116859_B_Slc39a7
  gRNA
cuggagcagagagcggugcc

SEQ ID NO: 116860 - RNA, 20 nt, Artificial Sequence
  MKO10116860_B_Slc39a7
  gRNA
gguggaggaacgcaucaccc

SEQ ID NO: 116861 - RNA, 20 nt, Artificial Sequence
  MKO10116861_B_Slc39a7
  gRNA
ucuggagcguggugagaaug

SEQ ID NO: 116862 - RNA, 20 nt, Artificial Sequence
  MKO10116862_B_Slc39a8
  gRNA
caagucacaccguugacugc

SEQ ID NO: 116863 - RNA, 20 nt, Artificial Sequence
  MKO10116863_B_Slc39a8
  gRNA
gcugaacuuccaucccugcg

SEQ ID NO: 116864 - RNA, 20 nt, Artificial Sequence
  MKO10116864_B_Slc39a8
  gRNA
cucaacguaauugucaauuu

SEQ ID NO: 116865 - RNA, 20 nt, Artificial Sequence
  MKO10116865_B_Slc39a9
  gRNA
uuucuaggagcggcugaagc

SEQ ID NO: 116866 - RNA, 20 nt, Artificial Sequence
  MKO10116866_B_Slc39a9
  gRNA
cagcauggacgacuagcccc

SEQ ID NO: 116867 - RNA, 20 nt, Artificial Sequence
  MKO10116867_B_Slc39a9
  gRNA
ugaaaacgaagcccaauaca

SEQ ID NO: 116868 - RNA, 20 nt, Artificial Sequence
  MKO10116868_B_Slc3a1
  gRNA
ccgaaauccugcuguucaag

SEQ ID NO: 116869 - RNA, 20 nt, Artificial Sequence
  MKO10116869_B_Slc3a1
  gRNA
uacuucaucaaagugccagc

SEQ ID NO: 116870 - RNA, 20 nt, Artificial Sequence
  MKO10116870_B_Slc3a1
  gRNA
uucaggaaauaauaacguuc

SEQ ID NO: 116871 - RNA, 20 nt, Artificial Sequence
  MKO10116871_B_Slc3a2
  gRNA
acuaccagggccagaaugcg

SEQ ID NO: 116872 - RNA, 20 nt, Artificial Sequence
  MKO10116872_B_Slc3a2
  gRNA
ggaaccacgcauucuggccc

SEQ ID NO: 116873 - RNA, 20 nt, Artificial Sequence
  MKO10116873_B_Slc3a2
  gRNA
guguggaugguuuccaauuc

SEQ ID NO: 116874 - RNA, 20 nt, Artificial Sequence
  MKO10116874_B_Slc40a1
  gRNA
ugugaucgcaguggcaguac

SEQ ID NO: 116875 - RNA, 20 nt, Artificial Sequence
  MKO10116875_B_Slc40a1
  gRNA
uacaguggcccagacgucac

SEQ ID NO: 116876 - RNA, 20 nt, Artificial Sequence
  MKO10116876_B_Slc40a1
  gRNA
cuucucuugacagcugucua

SEQ ID NO: 116877 - RNA, 20 nt, Artificial Sequence
  MKO10116877_B_Slc41a1
  gRNA
augggcguggcuacguuguc

SEQ ID NO: 116878 - RNA, 20 nt, Artificial Sequence
  MKO10116878_B_Slc41a1
  gRNA
agggauccagccaaagacga

SEQ ID NO: 116879 - RNA, 20 nt, Artificial Sequence
  MKO10116879_B_Slc41a1
  gRNA
ggggaauauggcccuuaucc

SEQ ID NO: 116880 - RNA, 20 nt, Artificial Sequence
  MKO10116880_B_Slc41a2
  gRNA
cuucaucgcaucucuacugc

SEQ ID NO: 116881 - RNA, 20 nt, Artificial Sequence
  MKO10116881_B_Slc41a2
  gRNA
aucguuggcuccaagaagac

SEQ ID NO: 116882 - RNA, 20 nt, Artificial Sequence
  MKO10116882_B_Slc41a2
  gRNA
uggcaacuuggcuuuaaagc

SEQ ID NO: 116883 - RNA, 20 nt, Artificial Sequence
  MKO10116883_B_Slc41a3
  gRNA
uuucccuucagaccgacgag

SEQ ID NO: 116884 - RNA, 20 nt, Artificial Sequence
  MKO10116884_B_Slc41a3
  gRNA
uggaccaaucgaacuccucg

SEQ ID NO: 116885 - RNA, 20 nt, Artificial Sequence
  MKO10116885_B_Slc41a3
  gRNA
gucaucgauuugcccagugu

SEQ ID NO: 116886 - RNA, 20 nt, Artificial Sequence
  MKO10116886_B_Slc43a1
  gRNA
ggccaaggccauuagagugc

SEQ ID NO: 116887 - RNA, 20 nt, Artificial Sequence
  MKO10116887_B_Slc43a1
  gRNA
aagccauccaccagcgccug

SEQ ID NO: 116888 - RNA, 20 nt, Artificial Sequence
  MKO10116888_B_Slc43a1
  gRNA
ugccgcauccugcacucuaa

SEQ ID NO: 116889 - RNA, 20 nt, Artificial Sequence
  MKO10116889_B_Slc43a2
  gRNA
ccucagcugcccaauauguu

SEQ ID NO: 116890 - RNA, 20 nt, Artificial Sequence
  MKO10116890_B_Slc43a2
  gRNA
ugugcucaucuuuaucgccu

SEQ ID NO: 116891 - RNA, 20 nt, Artificial Sequence
  MKO10116891_B_Slc43a2
  gRNA
cccaaagccguucagagcca

SEQ ID NO: 116892 - RNA, 20 nt, Artificial Sequence
  MKO10116892_B_Slc43a3
  gRNA
gauuccucccacugcgagca

SEQ ID NO: 116893 - RNA, 20 nt, Artificial Sequence
  MKO10116893_B_Slc43a3
  gRNA
ugaccgcuucaagacuacug

SEQ ID NO: 116894 - RNA, 20 nt, Artificial Sequence
  MKO10116894_B_Slc43a3
  gRNA
guuccuuaucaccaaccuac

SEQ ID NO: 116895 - RNA, 20 nt, Artificial Sequence
  MKO10116895_B_Slc44a1
  gRNA
gccccucaccugcgcggcgg

SEQ ID NO: 116896 - RNA, 20 nt, Artificial Sequence
  MKO10116896_B_Slc44a1
  gRNA
gugcagcuacggucuuccaa

SEQ ID NO: 116897 - RNA, 20 nt, Artificial Sequence
  MKO10116897_B_Slc44a1
  gRNA
auuagagcuccaaacgagaa

SEQ ID NO: 116898 - RNA, 20 nt, Artificial Sequence
  MKO10116898_B_Slc44a2
  gRNA
cgugaagugugccaaccccc

SEQ ID NO: 116899 - RNA, 20 nt, Artificial Sequence
  MKO10116899_B_Slc44a2
  gRNA
aaacgcauuaccugaggggu

SEQ ID NO: 116900 - RNA, 20 nt, Artificial Sequence
  MKO10116900_B_Slc44a2
  gRNA
aagguggggucguauuucug

SEQ ID NO: 116901 - RNA, 20 nt, Artificial Sequence
  MKO10116901_B_Slc44a3
  gRNA
gcaaucuugaagucaaagac

SEQ ID NO: 116902 - RNA, 20 nt, Artificial Sequence
  MKO10116902_B_Slc44a3
  gRNA
agaggggggcuccuuccacu

SEQ ID NO: 116903 - RNA, 20 nt, Artificial Sequence
  MKO10116903_B_Slc44a3
  gRNA
agcucuuaccuuggaggaac

SEQ ID NO: 116904 - RNA, 20 nt, Artificial Sequence
  MKO10116904_B_Slc44a4
  gRNA
uuacaucauaguggggcuug

SEQ ID NO: 116905 - RNA, 20 nt, Artificial Sequence
  MKO10116905_B_Slc44a4
  gRNA
cuguaggccauucucagcga

SEQ ID NO: 116906 - RNA, 20 nt, Artificial Sequence
  MKO10116906_B_Slc44a4
  gRNA
aaauaugaccccuccuuucg

SEQ ID NO: 116907 - RNA, 20 nt, Artificial Sequence
  MKO10116907_B_Slc44a5
  gRNA
cguagcccaaaauaaacagu

SEQ ID NO: 116908 - RNA, 20 nt, Artificial Sequence
  MKO10116908_B_Slc44a5
  gRNA
uaaaugcaggugacccaagg

SEQ ID NO: 116909 - RNA, 20 nt, Artificial Sequence
  MKO10116909_B_Slc44a5
  gRNA
gugugguagagcacuguagc

SEQ ID NO: 116910 - RNA, 20 nt, Artificial Sequence
  MKO10116910_B_Slc45a1
  gRNA
ucucauauuucacaccguuc

SEQ ID NO: 116911 - RNA, 20 nt, Artificial Sequence
  MKO10116911_B_Slc45a1
  gRNA
gccgcacacauccaucaugu

SEQ ID NO: 116912 - RNA, 20 nt, Artificial Sequence
  MKO10116912_B_Slc45a1
  gRNA
ggagugaccgauguaccuca

SEQ ID NO: 116913 - RNA, 20 nt, Artificial Sequence
  MKO10116913_B_Slc45a2
  gRNA
accguauucaugcaucccac

SEQ ID NO: 116914 - RNA, 20 nt, Artificial Sequence
  MKO10116914_B_Slc45a2
  gRNA
aucuagaugcacccagucua

SEQ ID NO: 116915 - RNA, 20 nt, Artificial Sequence
  MKO10116915_B_Slc45a2
  gRNA
gugcaccguagggaucccca

SEQ ID NO: 116916 - RNA, 20 nt, Artificial Sequence
  MKO10116916_B_Slc45a3
  gRNA
uacgggacggggcauuugcc

SEQ ID NO: 116917 - RNA, 20 nt, Artificial Sequence
  MKO10116917_B_Slc45a3
  gRNA
ugugggccagccgucugcua

SEQ ID NO: 116918 - RNA, 20 nt, Artificial Sequence
  MKO10116918_B_Slc45a3
  gRNA
cauagguaaugccggcagcc

SEQ ID NO: 116919 - RNA, 20 nt, Artificial Sequence
  MKO10116919_B_Slc45a4
  gRNA
aacauacacgccuucucugc

SEQ ID NO: 116920 - RNA, 20 nt, Artificial Sequence
  MKO10116920_B_Slc45a4
  gRNA
uguagaugauccugaugcuc

SEQ ID NO: 116921 - RNA, 20 nt, Artificial Sequence
  MKO10116921_B_Slc45a4
  gRNA
cuggucaucuacgcugcuac

SEQ ID NO: 116922 - RNA, 20 nt, Artificial Sequence
  MKO10116922_B_Slc46a1
  gRNA
cauggccaagcuauucacac

SEQ ID NO: 116923 - RNA, 20 nt, Artificial Sequence
  MKO10116923_B_Slc46a1
  gRNA
cuccgacucgcucaccagcu

SEQ ID NO: 116924 - RNA, 20 nt, Artificial Sequence
  MKO10116924_B_Slc46a1
  gRNA
aacugcuggaacuccgggug

SEQ ID NO: 116925 - RNA, 20 nt, Artificial Sequence
  MKO10116925_B_Slc46a2
  gRNA
uuauuccgaucacaaccauc

SEQ ID NO: 116926 - RNA, 20 nt, Artificial Sequence
  MKO10116926_B_Slc46a2
  gRNA
uggccuacaaacaagucccg

SEQ ID NO: 116927 - RNA, 20 nt, Artificial Sequence
  MKO10116927_B_Slc46a2
  gRNA
gcugaccugaugguugugau

SEQ ID NO: 116928 - RNA, 20 nt, Artificial Sequence
  MKO10116928_B_Slc46a3
  gRNA
guaaaucccacuguacgcag

SEQ ID NO: 116929 - RNA, 20 nt, Artificial Sequence
  MKO10116929_B_Slc46a3
  gRNA
ugcagcugcgucaagagcau

SEQ ID NO: 116930 - RNA, 20 nt, Artificial Sequence
  MKO10116930_B_Slc46a3
  gRNA
acucaccuugcucagucgag

SEQ ID NO: 116931 - RNA, 20 nt, Artificial Sequence
  MKO10116931_B_Slc47a1
  gRNA
agccagaacuuaaagcacgu

SEQ ID NO: 116932 - RNA, 20 nt, Artificial Sequence
  MKO10116932_B_Slc47a1
  gRNA
cugagcuuaugaaacugauu

SEQ ID NO: 116933 - RNA, 20 nt, Artificial Sequence
  MKO10116933_B_Slc47a1
  gRNA
uugugacacgcucaucuccc

SEQ ID NO: 116934 - RNA, 20 nt, Artificial Sequence
  MKO10116934_B_Slc47a2
  gRNA
ggugcucaccuggcgacauc

SEQ ID NO: 116935 - RNA, 20 nt, Artificial Sequence
  MKO10116935_B_Slc47a2
  gRNA
caucagugugucacaagccg

SEQ ID NO: 116936 - RNA, 20 nt, Artificial Sequence
  MKO10116936_B_Slc47a2
  gRNA
uugugacacacugaugucuc

SEQ ID NO: 116937 - RNA, 20 nt, Artificial Sequence
  MKO10116937_B_Slc48a1
  gRNA
acgguccucacucugaugcu

SEQ ID NO: 116938 - RNA, 20 nt, Artificial Sequence
  MKO10116938_B_Slc48a1
  gRNA
ugauguccgcaaagucagcc

SEQ ID NO: 116939 - RNA, 20 nt, Artificial Sequence
  MKO10116939_B_Slc48a1
  gRNA
ggugggcguagaggcuaagu

SEQ ID NO: 116940 - RNA, 20 nt, Artificial Sequence
  MKO10116940_B_Slc4a10
  gRNA
ucucuuaccguaggcagcag

SEQ ID NO: 116941 - RNA, 20 nt, Artificial Sequence
  MKO10116941_B_Slc4a10
  gRNA
uguuccaccucuauccacaa

SEQ ID NO: 116942 - RNA, 20 nt, Artificial Sequence
  MKO10116942_B_Slc4a10
  gRNA
gcaguuuauucuuggaacug

SEQ ID NO: 116943 - RNA, 20 nt, Artificial Sequence
  MKO10116943_B_Slc4a11
  gRNA
gagucacugccacuguccga

SEQ ID NO: 116944 - RNA, 20 nt, Artificial Sequence
  MKO10116944_B_Slc4a11
  gRNA
cauccccauaccagauuugg

SEQ ID NO: 116945 - RNA, 20 nt, Artificial Sequence
  MKO10116945_B_Slc4a11
  gRNA
ccuggugacagccggcacuc

SEQ ID NO: 116946 - RNA, 20 nt, Artificial Sequence
  MKO10116946_B_Slc4a1ap
  gRNA
ccuuuauauaaaacgcuucc

SEQ ID NO: 116947 - RNA, 20 nt, Artificial Sequence
  MKO10116947_B_Slc4a1ap
  gRNA
aaguggucaagaugaugagc

SEQ ID NO: 116948 - RNA, 20 nt, Artificial Sequence
  MKO10116948_B_Slc4a1ap
  gRNA
uaaacagcagcagauauuau

SEQ ID NO: 116949 - RNA, 20 nt, Artificial Sequence
  MKO10116949_B_Slc4a1
  gRNA
agcaguucuucucgguccug

SEQ ID NO: 116950 - RNA, 20 nt, Artificial Sequence
  MKO10116950_B_Slc4a1
  gRNA
aauggguggaggcagcgcac

SEQ ID NO: 116951 - RNA, 20 nt, Artificial Sequence
  MKO10116951_B_Slc4a1
  gRNA
ucuucuucgcugucucgauc

SEQ ID NO: 116952 - RNA, 20 nt, Artificial Sequence
  MKO10116952_B_Slc4a2
  gRNA
agacgaauuggcaguaugac

SEQ ID NO: 116953 - RNA, 20 nt, Artificial Sequence
  MKO10116953_B_Slc4a2
  gRNA
caauucgucuucgcuccuga

SEQ ID NO: 116954 - RNA, 20 nt, Artificial Sequence
  MKO10116954_B_Slc4a2
  gRNA
ugaacuucguaccuuaggug

SEQ ID NO: 116955 - RNA, 20 nt, Artificial Sequence
  MKO10116955_B_Slc4a3
  gRNA
cuagccgcagcuacagcgag

SEQ ID NO: 116956 - RNA, 20 nt, Artificial Sequence
  MKO10116956_B_Slc4a3
  gRNA
cgaggcggaggcucaaaugu

SEQ ID NO: 116957 - RNA, 20 nt, Artificial Sequence
  MKO10116957_B_Slc4a3
  gRNA
auagggggugucccuucuga

SEQ ID NO: 116958 - RNA, 20 nt, Artificial Sequence
  MKO10116958_B_Slc4a4
  gRNA
agaacgcauccgauucaucu

SEQ ID NO: 116959 - RNA, 20 nt, Artificial Sequence
  MKO10116959_B_Slc4a4
  gRNA
aaggauccaucaugcuugac

SEQ ID NO: 116960 - RNA, 20 nt, Artificial Sequence
  MKO10116960_B_Slc4a4
  gRNA
ucgaguuccgugaagagcug

SEQ ID NO: 116961 - RNA, 20 nt, Artificial Sequence
  MKO10116961_B_Slc4a5
  gRNA
ucgaauccucagguccucag

SEQ ID NO: 116962 - RNA, 20 nt, Artificial Sequence
  MKO10116962_B_Slc4a5
  gRNA
ugcucccuaccacagaucau

SEQ ID NO: 116963 - RNA, 20 nt, Artificial Sequence
  MKO10116963_B_Slc4a5
  gRNA
ucauaccccaaacacagacc

SEQ ID NO: 116964 - RNA, 20 nt, Artificial Sequence
  MKO10116964_B_Slc4a7
  gRNA
cgacgacucucuuuacuaaa

SEQ ID NO: 116965 - RNA, 20 nt, Artificial Sequence
  MKO10116965_B_Slc4a7
  gRNA
agcacucuugaugaaauugc

SEQ ID NO: 116966 - RNA, 20 nt, Artificial Sequence
  MKO10116966_B_Slc4a7
  gRNA
uugaagaugguggugaccga

SEQ ID NO: 116967 - RNA, 20 nt, Artificial Sequence
  MKO10116967_B_Slc4a8
  gRNA
augaacugaacacgcugaga

SEQ ID NO: 116968 - RNA, 20 nt, Artificial Sequence
  MKO10116968_B_Slc4a8
  gRNA
gugaauguugagaauugugc

SEQ ID NO: 116969 - RNA, 20 nt, Artificial Sequence
  MKO10116969_B_Slc4a8
  gRNA
uggaggacgggggagagcgc

SEQ ID NO: 116970 - RNA, 20 nt, Artificial Sequence
  MKO10116970_B_Slc4a9
  gRNA
ccagaagcuucgaagucugu

SEQ ID NO: 116971 - RNA, 20 nt, Artificial Sequence
  MKO10116971_B_Slc4a9
  gRNA
ugaugaggacgccccacuga

SEQ ID NO: 116972 - RNA, 20 nt, Artificial Sequence
  MKO10116972_B_Slc4a9
  gRNA
ucuccagagcagguagucag

SEQ ID NO: 116973 - RNA, 20 nt, Artificial Sequence
  MKO10116973_B_Slc50a1
  gRNA
aaacccguaaauagaccaag

SEQ ID NO: 116974 - RNA, 20 nt, Artificial Sequence
  MKO10116974_B_Slc50a1
  gRNA
acacucucacuugacauccg

SEQ ID NO: 116975 - RNA, 20 nt, Artificial Sequence
  MKO10116975_B_Slc50a1
  gRNA
ucccuuccagcucggaccuc

SEQ ID NO: 116976 - RNA, 20 nt, Artificial Sequence
  MKO10116976_B_Slc51a
  gRNA
aucuugaccuuucuuaccac

SEQ ID NO: 116977 - RNA, 20 nt, Artificial Sequence
  MKO10116977_B_Slc51a
  gRNA
cgcccucacacuuguagaaa

SEQ ID NO: 116978 - RNA, 20 nt, Artificial Sequence
  MKO10116978_B_Slc51a
  gRNA
uggccauuucuacaagugug

SEQ ID NO: 116979 - RNA, 20 nt, Artificial Sequence
  MKO10116979_B_Slc51b
  gRNA
gcauuucuuccagcaguucc

SEQ ID NO: 116980 - RNA, 20 nt, Artificial Sequence
  MKO10116980_B_Slc51b
  gRNA
ugucuuucugccagacccac

SEQ ID NO: 116981 - RNA, 20 nt, Artificial Sequence
  MKO10116981_B_Slc51b
  gRNA
gaaagcugcagccaaugccg

SEQ ID NO: 116982 - RNA, 20 nt, Artificial Sequence
  MKO10116982_B_Slc52a2
  gRNA
gaucccguugacagcagccc

SEQ ID NO: 116983 - RNA, 20 nt, Artificial Sequence
  MKO10116983_B_Slc52a2
  gRNA
ccuaauggcagcaccuccgc

SEQ ID NO: 116984 - RNA, 20 nt, Artificial Sequence
  MKO10116984_B_Slc52a2
  gRNA
gggcuccuaccugaugacac

SEQ ID NO: 116985 - RNA, 20 nt, Artificial Sequence
  MKO10116985_B_Slc52a3
  gRNA
uggggccuacaauauggcca

SEQ ID NO: 116986 - RNA, 20 nt, Artificial Sequence
  MKO10116986_B_Slc52a3
  gRNA
ugggcggagcgaagccacac

SEQ ID NO: 116987 - RNA, 20 nt, Artificial Sequence
  MKO10116987_B_Slc52a3
  gRNA
caccuugacauagcugagac

SEQ ID NO: 116988 - RNA, 20 nt, Artificial Sequence
  MKO10116988_B_Slc5a10
  gRNA
acaggacagauaaguacgug

SEQ ID NO: 116989 - RNA, 20 nt, Artificial Sequence
  MKO10116989_B_Slc5a10
  gRNA
ccggccaccaagccaugucc

SEQ ID NO: 116990 - RNA, 20 nt, Artificial Sequence
  MKO10116990_B_Slc5a10
  gRNA
cucgcugcuugcaaagagug

SEQ ID NO: 116991 - RNA, 20 nt, Artificial Sequence
  MKO10116991_B_Slc5a11
  gRNA
ccacgaugccagaauaucua

SEQ ID NO: 116992 - RNA, 20 nt, Artificial Sequence
  MKO10116992_B_Slc5a11
  gRNA
gccuuucacugugucucguu

SEQ ID NO: 116993 - RNA, 20 nt, Artificial Sequence
  MKO10116993_B_Slc5a11
  gRNA
ggacacuucauuggccucgc

SEQ ID NO: 116994 - RNA, 20 nt, Artificial Sequence
  MKO10116994_B_Slc5a12
  gRNA
cauuaucuacaucguacaga

SEQ ID NO: 116995 - RNA, 20 nt, Artificial Sequence
  MKO10116995_B_Slc5a12
  gRNA
ccugcugaagucuaccgcuu

SEQ ID NO: 116996 - RNA, 20 nt, Artificial Sequence
  MKO10116996_B_Slc5a12
  gRNA
augccagaccuguagaacac

SEQ ID NO: 116997 - RNA, 20 nt, Artificial Sequence
  MKO10116997_B_Slc5a1
  gRNA
ccggccaccacaccauacuu

SEQ ID NO: 116998 - RNA, 20 nt, Artificial Sequence
  MKO10116998_B_Slc5a1
  gRNA
auuugucccgauuuacauca

SEQ ID NO: 116999 - RNA, 20 nt, Artificial Sequence
  MKO10116999_B_Slc5a1
  gRNA
gugaccacuuccaauguuac

SEQ ID NO: 117000 - RNA, 20 nt, Artificial Sequence
  MKO10117000_B_Slc5a2
  gRNA
cgcuucggucaucgcucucu

SEQ ID NO: 117001 - RNA, 20 nt, Artificial Sequence
  MKO10117001_B_Slc5a2
  gRNA
gacuggcgcagcaaguggcu

SEQ ID NO: 117002 - RNA, 20 nt, Artificial Sequence
  MKO10117002_B_Slc5a2
  gRNA
ucuauguucagaaccaauag

SEQ ID NO: 117003 - RNA, 20 nt, Artificial Sequence
  MKO10117003_B_Slc5a3
  gRNA
uaccccugaccggauguaaa

SEQ ID NO: 117004 - RNA, 20 nt, Artificial Sequence
  MKO10117004_B_Slc5a3
  gRNA
cgcuauucucgcugcacugc

SEQ ID NO: 117005 - RNA, 20 nt, Artificial Sequence
  MKO10117005_B_Slc5a3
  gRNA
accagcagauuaacgucuuc

SEQ ID NO: 117006 - RNA, 20 nt, Artificial Sequence
  MKO10117006_B_Slc5a4a
  gRNA
guggccacugccgauguugc

SEQ ID NO: 117007 - RNA, 20 nt, Artificial Sequence
  MKO10117007_B_Slc5a4a
  gRNA
ucaauaucacgcagaugaaa

SEQ ID NO: 117008 - RNA, 20 nt, Artificial Sequence
  MKO10117008_B_Slc5a4a
  gRNA
caccccagccuugauguaaa

SEQ ID NO: 117009 - RNA, 20 nt, Artificial Sequence
  MKO10117009_B_Slc5a4b
  gRNA
aggaaucgcuauugcagcug

SEQ ID NO: 117010 - RNA, 20 nt, Artificial Sequence
  MKO10117010_B_Slc5a4b
  gRNA
cugaacucacggaaguuuga

SEQ ID NO: 117011 - RNA, 20 nt, Artificial Sequence
  MKO10117011_B_Slc5a4b
  gRNA
caagaaccagcaccauaagc

SEQ ID NO: 117012 - RNA, 20 nt, Artificial Sequence
  MKO10117012_B_Slc5a5
  gRNA
cugcgggacgcugcaguacu

SEQ ID NO: 117013 - RNA, 20 nt, Artificial Sequence
  MKO10117013_B_Slc5a5
  gRNA
cugcaccuuguacacgaccg

SEQ ID NO: 117014 - RNA, 20 nt, Artificial Sequence
  MKO10117014_B_Slc5a5
  gRNA
ccuugguucaggaugagcgc

SEQ ID NO: 117015 - RNA, 20 nt, Artificial Sequence
  MKO10117015_B_Slc5a6
  gRNA
uccgcuucaauaaagcaguu

SEQ ID NO: 117016 - RNA, 20 nt, Artificial Sequence
  MKO10117016_B_Slc5a6
  gRNA
acuuaccaucugaaagauga

SEQ ID NO: 117017 - RNA, 20 nt, Artificial Sequence
  MKO10117017_B_Slc5a6
  gRNA
uucccugcagggugggcuga

SEQ ID NO: 117018 - RNA, 20 nt, Artificial Sequence
  MKO10117018_B_Slc5a7
  gRNA
caucagcgugaucauugaug

SEQ ID NO: 117019 - RNA, 20 nt, Artificial Sequence
  MKO10117019_B_Slc5a7
  gRNA
gcccaagcuagaccacaacc

SEQ ID NO: 117020 - RNA, 20 nt, Artificial Sequence
  MKO10117020_B_Slc5a7
  gRNA
uaacauagucacauaucccu

SEQ ID NO: 117021 - RNA, 20 nt, Artificial Sequence
  MKO10117021_B_Slc5a8
  gRNA
gaaugugcagaccaccccug

SEQ ID NO: 117022 - RNA, 20 nt, Artificial Sequence
  MKO10117022_B_Slc5a8
  gRNA
ccuugauucaaagccagagc

SEQ ID NO: 117023 - RNA, 20 nt, Artificial Sequence
  MKO10117023_B_Slc5a8
  gRNA
uauugaugccuguauaauua

SEQ ID NO: 117024 - RNA, 20 nt, Artificial Sequence
  MKO10117024_B_Slc5a9
  gRNA
gaccguugguggcuauuucc

SEQ ID NO: 117025 - RNA, 20 nt, Artificial Sequence
  MKO10117025_B_Slc5a9
  gRNA
gucccccaaaucguuucuuc

SEQ ID NO: 117026 - RNA, 20 nt, Artificial Sequence
  MKO10117026_B_Slc5a9
  gRNA
aucucuaauguccagcaaug

SEQ ID NO: 117027 - RNA, 20 nt, Artificial Sequence
  MKO10117027_B_Slc6a11
  gRNA
uccgauggcauugagcacau

SEQ ID NO: 117028 - RNA, 20 nt, Artificial Sequence
  MKO10117028_B_Slc6a11
  gRNA
ugugggcacgaguggaacac

SEQ ID NO: 117029 - RNA, 20 nt, Artificial Sequence
  MKO10117029_B_Slc6a11
  gRNA
aggcauuggcuaugcaacac

SEQ ID NO: 117030 - RNA, 20 nt, Artificial Sequence
  MKO10117030_B_Slc6a12
  gRNA
cagggccucccuauccagua

SEQ ID NO: 117031 - RNA, 20 nt, Artificial Sequence
  MKO10117031_B_Slc6a12
  gRNA
cugaaucacucaucggccag

SEQ ID NO: 117032 - RNA, 20 nt, Artificial Sequence
  MKO10117032_B_Slc6a12
  gRNA
gaacuuuaccucgccuguca

SEQ ID NO: 117033 - RNA, 20 nt, Artificial Sequence
  MKO10117033_B_Slc6a13
  gRNA
ggaugccauccgagagcuuc

SEQ ID NO: 117034 - RNA, 20 nt, Artificial Sequence
  MKO10117034_B_Slc6a13
  gRNA
ugcagccaugaguggaauac

SEQ ID NO: 117035 - RNA, 20 nt, Artificial Sequence
  MKO10117035_B_Slc6a13
  gRNA
uuugcggguagaaaacugug

SEQ ID NO: 117036 - RNA, 20 nt, Artificial Sequence
  MKO10117036_B_Slc6a14
  gRNA
caaugcuagcaugauugcau

SEQ ID NO: 117037 - RNA, 20 nt, Artificial Sequence
  MKO10117037_B_Slc6a14
  gRNA
aacaaucucaccugcuugaa

SEQ ID NO: 117038 - RNA, 20 nt, Artificial Sequence
  MKO10117038_B_Slc6a14
  gRNA
uccaggugugggaaucacga

SEQ ID NO: 117039 - RNA, 20 nt, Artificial Sequence
  MKO10117039_B_Slc6a15
  gRNA
guucugccaccaccuauuac

SEQ ID NO: 117040 - RNA, 20 nt, Artificial Sequence
  MKO10117040_B_Slc6a15
  gRNA
ccgacacauguucacuccua

SEQ ID NO: 117041 - RNA, 20 nt, Artificial Sequence
  MKO10117041_B_Slc6a15
  gRNA
ggacugaaugccuuugauca

SEQ ID NO: 117042 - RNA, 20 nt, Artificial Sequence
  MKO10117042_B_Slc6a17
  gRNA
cccacucucugaaaucgagu

SEQ ID NO: 117043 - RNA, 20 nt, Artificial Sequence
  MKO10117043_B_Slc6a17
  gRNA
cgugggcauggcugucguca

SEQ ID NO: 117044 - RNA, 20 nt, Artificial Sequence
  MKO10117044_B_Slc6a17
  gRNA
acagucccauuccugaugac

SEQ ID NO: 117045 - RNA, 20 nt, Artificial Sequence
  MKO10117045_B_Slc6a18
  gRNA
aggcagcuuaccuccuccgu

SEQ ID NO: 117046 - RNA, 20 nt, Artificial Sequence
  MKO10117046_B_Slc6a18
  gRNA
acuacaacacgguucuccug

SEQ ID NO: 117047 - RNA, 20 nt, Artificial Sequence
  MKO10117047_B_Slc6a18
  gRNA
guggcaccgugagcuacuuc

SEQ ID NO: 117048 - RNA, 20 nt, Artificial Sequence
  MKO10117048_B_Slc6a19os
  gRNA
uaauaucgugggcuuaacug

SEQ ID NO: 117049 - RNA, 20 nt, Artificial Sequence
  MKO10117049_B_Slc6a19os
  gRNA
gggugccgcuggggagacau

SEQ ID NO: 117050 - RNA, 20 nt, Artificial Sequence
  MKO10117050_B_Slc6a19os
  gRNA
guguugcagaaucccuuuag

SEQ ID NO: 117051 - RNA, 20 nt, Artificial Sequence
  MKO10117051_B_Slc6a19
  gRNA
ucccaguggucucgaugcca

SEQ ID NO: 117052 - RNA, 20 nt, Artificial Sequence
  MKO10117052_B_Slc6a19
  gRNA
ucgguaccagaaguagucca

SEQ ID NO: 117053 - RNA, 20 nt, Artificial Sequence
  MKO10117053_B_Slc6a19
  gRNA
caccaugaaggacacgaaca

SEQ ID NO: 117054 - RNA, 20 nt, Artificial Sequence
  MKO10117054_B_Slc6a1
  gRNA
gcagaaauacacgagcaccc

SEQ ID NO: 117055 - RNA, 20 nt, Artificial Sequence
  MKO10117055_B_Slc6a1
  gRNA
acaagccaggacagauccgc

SEQ ID NO: 117056 - RNA, 20 nt, Artificial Sequence
  MKO10117056_B_Slc6a1
  gRNA
ccguggugaaggaguuguac

SEQ ID NO: 117057 - RNA, 20 nt, Artificial Sequence
  MKO10117057_B_Slc6a20a
  gRNA
auugaugacauuguaguaca

SEQ ID NO: 117058 - RNA, 20 nt, Artificial Sequence
  MKO10117058_B_Slc6a20a
  gRNA
ccuguccacagggaguuucc

SEQ ID NO: 117059 - RNA, 20 nt, Artificial Sequence
  MKO10117059_B_Slc6a20a
  gRNA
uaggugugaacauguacauc

SEQ ID NO: 117060 - RNA, 20 nt, Artificial Sequence
  MKO10117060_B_Slc6a20b
  gRNA
acuucaaugucaucaacacc

SEQ ID NO: 117061 - RNA, 20 nt, Artificial Sequence
  MKO10117061_B_Slc6a20b
  gRNA
cuuugugcucaucaucuacc

SEQ ID NO: 117062 - RNA, 20 nt, Artificial Sequence
  MKO10117062_B_Slc6a20b
  gRNA
ccuguucacaggaaauuucc

SEQ ID NO: 117063 - RNA, 20 nt, Artificial Sequence
  MKO10117063_B_Slc6a2
  gRNA
cauugacuucuaccgccuca

SEQ ID NO: 117064 - RNA, 20 nt, Artificial Sequence
  MKO10117064_B_Slc6a2
  gRNA
augaugaggaacagcgugua

SEQ ID NO: 117065 - RNA, 20 nt, Artificial Sequence
  MKO10117065_B_Slc6a2
  gRNA
acacugcccggugccuccaa

SEQ ID NO: 117066 - RNA, 20 nt, Artificial Sequence
  MKO10117066_B_Slc6a3
  gRNA
ggauccacugcaacaacacc

SEQ ID NO: 117067 - RNA, 20 nt, Artificial Sequence
  MKO10117067_B_Slc6a3
  gRNA
cggcaauaaccaugaagagc

SEQ ID NO: 117068 - RNA, 20 nt, Artificial Sequence
  MKO10117068_B_Slc6a3
  gRNA
uugaugaccugggcccucca

SEQ ID NO: 117069 - RNA, 20 nt, Artificial Sequence
  MKO10117069_B_Slc6a4
  gRNA
ugacguggaauggagugucc

SEQ ID NO: 117070 - RNA, 20 nt, Artificial Sequence
  MKO10117070_B_Slc6a4
  gRNA
ggggaucccacucuucuaca

SEQ ID NO: 117071 - RNA, 20 nt, Artificial Sequence
  MKO10117071_B_Slc6a4
  gRNA
ccauuaucuacuucagcauc

SEQ ID NO: 117072 - RNA, 20 nt, Artificial Sequence
  MKO10117072_B_Slc6a5
  gRNA
gaugaugacguuguaguaua

SEQ ID NO: 117073 - RNA, 20 nt, Artificial Sequence
  MKO10117073_B_Slc6a5
  gRNA
cgcccucaggaggacgagca

SEQ ID NO: 117074 - RNA, 20 nt, Artificial Sequence
  MKO10117074_B_Slc6a5
  gRNA
aaacuuaccuaguaaaaguu

SEQ ID NO: 117075 - RNA, 20 nt, Artificial Sequence
  MKO10117075_B_Slc6a6
  gRNA
cgcucugccuccucuuaguc

SEQ ID NO: 117076 - RNA, 20 nt, Artificial Sequence
  MKO10117076_B_Slc6a6
  gRNA
uuucccguuugccaugcuuc

SEQ ID NO: 117077 - RNA, 20 nt, Artificial Sequence
  MKO10117077_B_Slc6a6
  gRNA
aacagacgagccagacuaag

SEQ ID NO: 117078 - RNA, 20 nt, Artificial Sequence
  MKO10117078_B_Slc6a7
  gRNA
caggcccauaccgccuccau

SEQ ID NO: 117079 - RNA, 20 nt, Artificial Sequence
  MKO10117079_B_Slc6a7
  gRNA
cccucaccagcaauuugccc

SEQ ID NO: 117080 - RNA, 20 nt, Artificial Sequence
  MKO10117080_B_Slc6a7
  gRNA
caugcugcucauuguaggcc

SEQ ID NO: 117081 - RNA, 20 nt, Artificial Sequence
  MKO10117081_B_Slc6a8
  gRNA
gugaccagcuugcugaccgc

SEQ ID NO: 117082 - RNA, 20 nt, Artificial Sequence
  MKO10117082_B_Slc6a8
  gRNA
uggcggcucaccuuugaaua

SEQ ID NO: 117083 - RNA, 20 nt, Artificial Sequence
  MKO10117083_B_Slc6a8
  gRNA
acuggcccaaugagauuucc

SEQ ID NO: 117084 - RNA, 20 nt, Artificial Sequence
  MKO10117084_B_Slc6a9
  gRNA
gacgcuuccaaccucaccaa

SEQ ID NO: 117085 - RNA, 20 nt, Artificial Sequence
  MKO10117085_B_Slc6a9
  gRNA
cggaucagccccauguucaa

SEQ ID NO: 117086 - RNA, 20 nt, Artificial Sequence
  MKO10117086_B_Slc6a9
  gRNA
cugaagcugucagacgacau

SEQ ID NO: 117087 - RNA, 20 nt, Artificial Sequence
  MKO10117087_B_Slc7a10
  gRNA
gacaccgucugugggucacc

SEQ ID NO: 117088 - RNA, 20 nt, Artificial Sequence
  MKO10117088_B_Slc7a10
  gRNA
cguaguccccaccagacuug

SEQ ID NO: 117089 - RNA, 20 nt, Artificial Sequence
  MKO10117089_B_Slc7a10
  gRNA
gagcugucacgcccccaccc

SEQ ID NO: 117090 - RNA, 20 nt, Artificial Sequence
  MKO10117090_B_Slc7a11
  gRNA
ggauguagcguccaaaugcc

SEQ ID NO: 117091 - RNA, 20 nt, Artificial Sequence
  MKO10117091_B_Slc7a11
  gRNA
acgagcuugauugcaaguuc

SEQ ID NO: 117092 - RNA, 20 nt, Artificial Sequence
  MKO10117092_B_Slc7a11
  gRNA
aagucuaaugggguugcccu

SEQ ID NO: 117093 - RNA, 20 nt, Artificial Sequence
  MKO10117093_B_Slc7a12
  gRNA
auucuacucugcaagucaag

SEQ ID NO: 117094 - RNA, 20 nt, Artificial Sequence
  MKO10117094_B_Slc7a12
  gRNA
ugacuuaccuuauaaggucu

SEQ ID NO: 117095 - RNA, 20 nt, Artificial Sequence
  MKO10117095_B_Slc7a12
  gRNA
ugauagacaugcucuauacu

SEQ ID NO: 117096 - RNA, 20 nt, Artificial Sequence
  MKO10117096_B_Slc7a13
  gRNA
ccacaauccacagcaucgcc

SEQ ID NO: 117097 - RNA, 20 nt, Artificial Sequence
  MKO10117097_B_Slc7a13
  gRNA
acuuuaaagugaaguucguu

SEQ ID NO: 117098 - RNA, 20 nt, Artificial Sequence
  MKO10117098_B_Slc7a13
  gRNA
gauaguuuaucagaucaauu

SEQ ID NO: 117099 - RNA, 20 nt, Artificial Sequence
  MKO10117099_B_Slc7a14
  gRNA
aaaugccacgaacuccccaa

SEQ ID NO: 117100 - RNA, 20 nt, Artificial Sequence
  MKO10117100_B_Slc7a14
  gRNA
cuaugcugcgaaguuuguag

SEQ ID NO: 117101 - RNA, 20 nt, Artificial Sequence
  MKO10117101_B_Slc7a14
  gRNA
cguccucaaugugcugaacc

SEQ ID NO: 117102 - RNA, 20 nt, Artificial Sequence
  MKO10117102_B_Slc7a15
  gRNA
gcagguaacugauauugacc

SEQ ID NO: 117103 - RNA, 20 nt, Artificial Sequence
  MKO10117103_B_Slc7a15
  gRNA
gguaguuccauaggugagcc

SEQ ID NO: 117104 - RNA, 20 nt, Artificial Sequence
  MKO10117104_B_Slc7a15
  gRNA
gcaccuuugugaaccucuua

SEQ ID NO: 117105 - RNA, 20 nt, Artificial Sequence
  MKO10117105_B_Slc7a1
  gRNA
uugugcuucaucgugguguc

SEQ ID NO: 117106 - RNA, 20 nt, Artificial Sequence
  MKO10117106_B_Slc7a1
  gRNA
caucaugagcgugagagcgg

SEQ ID NO: 117107 - RNA, 20 nt, Artificial Sequence
  MKO10117107_B_Slc7a1
  gRNA
uuugacugcaucgccaccac

SEQ ID NO: 117108 - RNA, 20 nt, Artificial Sequence
  MKO10117108_B_Slc7a2
  gRNA
acuccaugcucuugcgacac

SEQ ID NO: 117109 - RNA, 20 nt, Artificial Sequence
  MKO10117109_B_Slc7a2
  gRNA
acaagcaucuacggggcugg

SEQ ID NO: 117110 - RNA, 20 nt, Artificial Sequence
  MKO10117110_B_Slc7a2
  gRNA
caacgucccuguaaagccau

SEQ ID NO: 117111 - RNA, 20 nt, Artificial Sequence
  MKO10117111_B_Slc7a3
  gRNA
agaaacagguagcagcgcca

SEQ ID NO: 117112 - RNA, 20 nt, Artificial Sequence
  MKO10117112_B_Slc7a3
  gRNA
aauacagucaaaaccaacga

SEQ ID NO: 117113 - RNA, 20 nt, Artificial Sequence
  MKO10117113_B_Slc7a3
  gRNA
uugaccaugagugaauccaa

SEQ ID NO: 117114 - RNA, 20 nt, Artificial Sequence
  MKO10117114_B_Slc7a4
  gRNA
gcaggacuugucguguauuu

SEQ ID NO: 117115 - RNA, 20 nt, Artificial Sequence
  MKO10117115_B_Slc7a4
  gRNA
ccuguguccggggguguaca

SEQ ID NO: 117116 - RNA, 20 nt, Artificial Sequence
  MKO10117116_B_Slc7a4
  gRNA
gcugacuacagcacacuacg

SEQ ID NO: 117117 - RNA, 20 nt, Artificial Sequence
  MKO10117117_B_Slc7a5
  gRNA
ugugaacugcuacagcguaa

SEQ ID NO: 117118 - RNA, 20 nt, Artificial Sequence
  MKO10117118_B_Slc7a5
  gRNA
aggagaugaucaaccccuac

SEQ ID NO: 117119 - RNA, 20 nt, Artificial Sequence
  MKO10117119_B_Slc7a5
  gRNA
uccuuucaggaaccugcccc

SEQ ID NO: 117120 - RNA, 20 nt, Artificial Sequence
  MKO10117120_B_Slc7a6os
  gRNA
augauguucucaauccaccc

SEQ ID NO: 117121 - RNA, 20 nt, Artificial Sequence
  MKO10117121_B_Slc7a6os
  gRNA
ugaauacaacagccucagcg

SEQ ID NO: 117122 - RNA, 20 nt, Artificial Sequence
  MKO10117122_B_Slc7a6os
  gRNA
gaagcugcgagcgacugaug

SEQ ID NO: 117123 - RNA, 20 nt, Artificial Sequence
  MKO10117123_B_Slc7a6
  gRNA
cagccacagcgucacucuua

SEQ ID NO: 117124 - RNA, 20 nt, Artificial Sequence
  MKO10117124_B_Slc7a6
  gRNA
uguccauaagagugacgcug

SEQ ID NO: 117125 - RNA, 20 nt, Artificial Sequence
  MKO10117125_B_Slc7a6
  gRNA
ucgugugccccacuugacgu

SEQ ID NO: 117126 - RNA, 20 nt, Artificial Sequence
  MKO10117126_B_Slc7a7
  gRNA
acuaugucaccgaagagauc

SEQ ID NO: 117127 - RNA, 20 nt, Artificial Sequence
  MKO10117127_B_Slc7a7
  gRNA
ggaguucucaaaguuagcug

SEQ ID NO: 117128 - RNA, 20 nt, Artificial Sequence
  MKO10117128_B_Slc7a7
  gRNA
ggccagugacgcuguugccg

SEQ ID NO: 117129 - RNA, 20 nt, Artificial Sequence
  MKO10117129_B_Slc7a8
  gRNA
guuccucagucacauaauua

SEQ ID NO: 117130 - RNA, 20 nt, Artificial Sequence
  MKO10117130_B_Slc7a8
  gRNA
gcuggaaaacgcgggcucug

SEQ ID NO: 117131 - RNA, 20 nt, Artificial Sequence
  MKO10117131_B_Slc7a8
  gRNA
uggagcaguugacccaugug

SEQ ID NO: 117132 - RNA, 20 nt, Artificial Sequence
  MKO10117132_B_Slc7a9
  gRNA
caugacgaucaggcuggucc

SEQ ID NO: 117133 - RNA, 20 nt, Artificial Sequence
  MKO10117133_B_Slc7a9
  gRNA
ggcggcccauaugaugagac

SEQ ID NO: 117134 - RNA, 20 nt, Artificial Sequence
  MKO10117134_B_Slc7a9
  gRNA
aauggacucugggccuacga

SEQ ID NO: 117135 - RNA, 20 nt, Artificial Sequence
  MKO10117135_B_Slc8a1
  gRNA
ugcuaggccaaccuaucuuc

SEQ ID NO: 117136 - RNA, 20 nt, Artificial Sequence
  MKO10117136_B_Slc8a1
  gRNA
gaaucggaugaucucuagca

SEQ ID NO: 117137 - RNA, 20 nt, Artificial Sequence
  MKO10117137_B_Slc8a1
  gRNA
cucuccaaucucaaugaaga

SEQ ID NO: 117138 - RNA, 20 nt, Artificial Sequence
  MKO10117138_B_Slc8a2
  gRNA
ugugcgcgugguucgcagcu

SEQ ID NO: 117139 - RNA, 20 nt, Artificial Sequence
  MKO10117139_B_Slc8a2
  gRNA
agaugccucgcuuaagccac

SEQ ID NO: 117140 - RNA, 20 nt, Artificial Sequence
  MKO10117140_B_Slc8a2
  gRNA
ccaccccaggaaaacucuuc

SEQ ID NO: 117141 - RNA, 20 nt, Artificial Sequence
  MKO10117141_B_Slc8a3
  gRNA
ggagcaucuucgccuacauu

SEQ ID NO: 117142 - RNA, 20 nt, Artificial Sequence
  MKO10117142_B_Slc8a3
  gRNA
ggguccccacaaccaaugcc

SEQ ID NO: 117143 - RNA, 20 nt, Artificial Sequence
  MKO10117143_B_Slc8a3
  gRNA
gggugaacaccccaaacuag

SEQ ID NO: 117144 - RNA, 20 nt, Artificial Sequence
  MKO10117144_B_Slc8b1
  gRNA
ccagguagcccgccucgcug

SEQ ID NO: 117145 - RNA, 20 nt, Artificial Sequence
  MKO10117145_B_Slc8b1
  gRNA
ucacauccgccauggcaguc

SEQ ID NO: 117146 - RNA, 20 nt, Artificial Sequence
  MKO10117146_B_Slc8b1
  gRNA
cucaccaaacagagccccga

SEQ ID NO: 117147 - RNA, 20 nt, Artificial Sequence
  MKO10117147_B_Slc9a1
  gRNA
aggggccaucgccuucucgc

SEQ ID NO: 117148 - RNA, 20 nt, Artificial Sequence
  MKO10117148_B_Slc9a1
  gRNA
aguagugaugcgccccuaug

SEQ ID NO: 117149 - RNA, 20 nt, Artificial Sequence
  MKO10117149_B_Slc9a1
  gRNA
cgcccacaaacaccccaccg

SEQ ID NO: 117150 - RNA, 20 nt, Artificial Sequence
  MKO10117150_B_Slc9a2
  gRNA
gaugccagcaaacacgucua

SEQ ID NO: 117151 - RNA, 20 nt, Artificial Sequence
  MKO10117151_B_Slc9a2
  gRNA
gaagcccgaccauuaugaga

SEQ ID NO: 117152 - RNA, 20 nt, Artificial Sequence
  MKO10117152_B_Slc9a2
  gRNA
gaccaucccgcuaaccuuca

SEQ ID NO: 117153 - RNA, 20 nt, Artificial Sequence
  MKO10117153_B_Slc9a3r1
  gRNA
gugcaaagugaucccauccc

SEQ ID NO: 117154 - RNA, 20 nt, Artificial Sequence
  MKO10117154_B_Slc9a3r1
  gRNA
gggcaagcagcacggggacg

SEQ ID NO: 117155 - RNA, 20 nt, Artificial Sequence
  MKO10117155_B_Slc9a3r1
  gRNA
uaccuccucacugguaucgc

SEQ ID NO: 117156 - RNA, 20 nt, Artificial Sequence
  MKO10117156_B_Slc9a3r2
  gRNA
cugccaucaccagucacgaa

SEQ ID NO: 117157 - RNA, 20 nt, Artificial Sequence
  MKO10117157_B_Slc9a3r2
  gRNA
agacugaugaacacuucaag

SEQ ID NO: 117158 - RNA, 20 nt, Artificial Sequence
  MKO10117158_B_Slc9a3r2
  gRNA
uucgugacuggugauggcag

SEQ ID NO: 117159 - RNA, 20 nt, Artificial Sequence
  MKO10117159_B_Slc9a3
  gRNA
augcccaaucgacucuucuu

SEQ ID NO: 117160 - RNA, 20 nt, Artificial Sequence
  MKO10117160_B_Slc9a3
  gRNA
uggugacgcagugacuggcg

SEQ ID NO: 117161 - RNA, 20 nt, Artificial Sequence
  MKO10117161_B_Slc9a3
  gRNA
cauugcagcuguggacccag

SEQ ID NO: 117162 - RNA, 20 nt, Artificial Sequence
  MKO10117162_B_Slc9a4
  gRNA
gugugccagauucgucaucg

SEQ ID NO: 117163 - RNA, 20 nt, Artificial Sequence
  MKO10117163_B_Slc9a4
  gRNA
cgcuguagaauauuaugaac

SEQ ID NO: 117164 - RNA, 20 nt, Artificial Sequence
  MKO10117164_B_Slc9a4
  gRNA
agugaccaugaaaaaguacg

SEQ ID NO: 117165 - RNA, 20 nt, Artificial Sequence
  MKO10117165_B_Slc9a5
  gRNA
ccgcaucaucgagccguugc

SEQ ID NO: 117166 - RNA, 20 nt, Artificial Sequence
  MKO10117166_B_Slc9a5
  gRNA
ccucccaucgugcuagacuc

SEQ ID NO: 117167 - RNA, 20 nt, Artificial Sequence
  MKO10117167_B_Slc9a5
  gRNA
cguguuggccgucuuugagg

SEQ ID NO: 117168 - RNA, 20 nt, Artificial Sequence
  MKO10117168_B_Slc9a6
  gRNA
gucacauuauucacaucgcu

SEQ ID NO: 117169 - RNA, 20 nt, Artificial Sequence
  MKO10117169_B_Slc9a6
  gRNA
gcaauuucuuguuucguuau

SEQ ID NO: 117170 - RNA, 20 nt, Artificial Sequence
  MKO10117170_B_Slc9a6
  gRNA
cauaugcuaagauagaccca

SEQ ID NO: 117171 - RNA, 20 nt, Artificial Sequence
  MKO10117171_B_Slc9a7
  gRNA
ucuuuaagcuguauccagca

SEQ ID NO: 117172 - RNA, 20 nt, Artificial Sequence
  MKO10117172_B_Slc9a7
  gRNA
gcuguuucuugcuucauuau

SEQ ID NO: 117173 - RNA, 20 nt, Artificial Sequence
  MKO10117173_B_Slc9a7
  gRNA
ucuuacagaaaucuuaugua

SEQ ID NO: 117174 - RNA, 20 nt, Artificial Sequence
  MKO10117174_B_Slc9a8
  gRNA
uauccugacucaaagauaau

SEQ ID NO: 117175 - RNA, 20 nt, Artificial Sequence
  MKO10117175_B_Slc9a8
  gRNA
uuuccuuccagguauucuca

SEQ ID NO: 117176 - RNA, 20 nt, Artificial Sequence
  MKO10117176_B_Slc9a8
  gRNA
aguuauagaguuuaaaaagc

SEQ ID NO: 117177 - RNA, 20 nt, Artificial Sequence
  MKO10117177_B_Slc9a9
  gRNA
ccucccaucauauuucaugc

SEQ ID NO: 117178 - RNA, 20 nt, Artificial Sequence
  MKO10117178_B_Slc9a9
  gRNA
guauccugcaugaaauauga

SEQ ID NO: 117179 - RNA, 20 nt, Artificial Sequence
  MKO10117179_B_Slc9a9
  gRNA
cugaugucugcuacagaucc

SEQ ID NO: 117180 - RNA, 20 nt, Artificial Sequence
  MKO10117180_B_Slc9b1
  gRNA
acucuacucugggcccuuau

SEQ ID NO: 117181 - RNA, 20 nt, Artificial Sequence
  MKO10117181_B_Slc9b1
  gRNA
accaaaggaaccagaaccga

SEQ ID NO: 117182 - RNA, 20 nt, Artificial Sequence
  MKO10117182_B_Slc9b1
  gRNA
aauaguuacuguccuccaca

SEQ ID NO: 117183 - RNA, 20 nt, Artificial Sequence
  MKO10117183_B_Slc9b2
  gRNA
agcacacgccuccacgaugc

SEQ ID NO: 117184 - RNA, 20 nt, Artificial Sequence
  MKO10117184_B_Slc9b2
  gRNA
auggcaauggggguucaucc

SEQ ID NO: 117185 - RNA, 20 nt, Artificial Sequence
  MKO10117185_B_Slc9b2
  gRNA
gccgguaacugaccaaacca

SEQ ID NO: 117186 - RNA, 20 nt, Artificial Sequence
  MKO10117186_B_Slc9c1
  gRNA
ucagccuccauaagagaccu

SEQ ID NO: 117187 - RNA, 20 nt, Artificial Sequence
  MKO10117187_B_Slc9c1
  gRNA
aacaccacuauauauaacua

SEQ ID NO: 117188 - RNA, 20 nt, Artificial Sequence
  MKO10117188_B_Slc9c1
  gRNA
cuccauuaauuaaauuugug

SEQ ID NO: 117189 - RNA, 20 nt, Artificial Sequence
  MKO10117189_B_Slco1a1
  gRNA
caaccuguuggaucuugcgu

SEQ ID NO: 117190 - RNA, 20 nt, Artificial Sequence
  MKO10117190_B_Slco1a1
  gRNA
aagccaacgcaagauccaac

SEQ ID NO: 117191 - RNA, 20 nt, Artificial Sequence
  MKO10117191_B_Slco1a1
  gRNA
uggaugugugguuaugggcc

SEQ ID NO: 117192 - RNA, 20 nt, Artificial Sequence
  MKO10117192_B_Slco1a4
  gRNA
cguacacacaaagcuauuug

SEQ ID NO: 117193 - RNA, 20 nt, Artificial Sequence
  MKO10117193_B_Slco1a4
  gRNA
ucuguaguugggcuuaucaa

SEQ ID NO: 117194 - RNA, 20 nt, Artificial Sequence
  MKO10117194_B_Slco1a4
  gRNA
aagccaacgcaagacccaac

SEQ ID NO: 117195 - RNA, 20 nt, Artificial Sequence
  MKO10117195_B_Slco1a5
  gRNA
cugguaggaaacaucauacg

SEQ ID NO: 117196 - RNA, 20 nt, Artificial Sequence
  MKO10117196_B_Slco1a5
  gRNA
caaccugcagggucuugcgu

SEQ ID NO: 117197 - RNA, 20 nt, Artificial Sequence
  MKO10117197_B_Slco1a5
  gRNA
uauguauccaaaucacucuc

SEQ ID NO: 117198 - RNA, 20 nt, Artificial Sequence
  MKO10117198_B_Slco1a6
  gRNA
uauauauccaaaauacuauc

SEQ ID NO: 117199 - RNA, 20 nt, Artificial Sequence
  MKO10117199_B_Slco1a6
  gRNA
uuuggcaaagucuucuauau

SEQ ID NO: 117200 - RNA, 20 nt, Artificial Sequence
  MKO10117200_B_Slco1a6
  gRNA
caaccugcugggucuugugu

SEQ ID NO: 117201 - RNA, 20 nt, Artificial Sequence
  MKO10117201_B_Slco1b2
  gRNA
ugcguugccacauuucuuca

SEQ ID NO: 117202 - RNA, 20 nt, Artificial Sequence
  MKO10117202_B_Slco1b2
  gRNA
uguaguuugauugacuaaac

SEQ ID NO: 117203 - RNA, 20 nt, Artificial Sequence
  MKO10117203_B_Slco1b2
  gRNA
cucauucagcuacauaugca

SEQ ID NO: 117204 - RNA, 20 nt, Artificial Sequence
  MKO10117204_B_Slco1c1
  gRNA
uaggcgucuccccuaacccu

SEQ ID NO: 117205 - RNA, 20 nt, Artificial Sequence
  MKO10117205_B_Slco1c1
  gRNA
uccaucaccaagcucaaucc

SEQ ID NO: 117206 - RNA, 20 nt, Artificial Sequence
  MKO10117206_B_Slco1c1
  gRNA
ugagcuuggugauggacugc

SEQ ID NO: 117207 - RNA, 20 nt, Artificial Sequence
  MKO10117207_B_Slco2a1
  gRNA
aaugggcaccgucccaacgc

SEQ ID NO: 117208 - RNA, 20 nt, Artificial Sequence
  MKO10117208_B_Slco2a1
  gRNA
cccaaagcgcuucucgauag

SEQ ID NO: 117209 - RNA, 20 nt, Artificial Sequence
  MKO10117209_B_Slco2a1
  gRNA
uuauuugcuaucgccguguu

SEQ ID NO: 117210 - RNA, 20 nt, Artificial Sequence
  MKO10117210_B_Slco2b1
  gRNA
cuggagccauagucgugggc

SEQ ID NO: 117211 - RNA, 20 nt, Artificial Sequence
  MKO10117211_B_Slco2b1
  gRNA
gcugcaguagacugugacau

SEQ ID NO: 117212 - RNA, 20 nt, Artificial Sequence
  MKO10117212_B_Slco2b1
  gRNA
cgggauguuccacaacauca

SEQ ID NO: 117213 - RNA, 20 nt, Artificial Sequence
  MKO10117213_B_Slco3a1
  gRNA
gucugagugcgccuugaugc

SEQ ID NO: 117214 - RNA, 20 nt, Artificial Sequence
  MKO10117214_B_Slco3a1
  gRNA
aggaauccuguucacgaugu

SEQ ID NO: 117215 - RNA, 20 nt, Artificial Sequence
  MKO10117215_B_Slco3a1
  gRNA
ucacuccagaugacccgcgu

SEQ ID NO: 117216 - RNA, 20 nt, Artificial Sequence
  MKO10117216_B_Slco4a1
  gRNA
gcgcuacguuguuaugagag

SEQ ID NO: 117217 - RNA, 20 nt, Artificial Sequence
  MKO10117217_B_Slco4a1
  gRNA
uucuguguaaacguuuagca

SEQ ID NO: 117218 - RNA, 20 nt, Artificial Sequence
  MKO10117218_B_Slco4a1
  gRNA
augcagcaaucccgguuccu

SEQ ID NO: 117219 - RNA, 20 nt, Artificial Sequence
  MKO10117219_B_Slco4c1
  gRNA
uuauaguucggaucugacug

SEQ ID NO: 117220 - RNA, 20 nt, Artificial Sequence
  MKO10117220_B_Slco4c1
  gRNA
auccccgguggcugggggcu

SEQ ID NO: 117221 - RNA, 20 nt, Artificial Sequence
  MKO10117221_B_Slco4c1
  gRNA
acaaagauacgugcuuaaca

SEQ ID NO: 117222 - RNA, 20 nt, Artificial Sequence
  MKO10117222_B_Slco5a1
  gRNA
cagagugacccucguuucau

SEQ ID NO: 117223 - RNA, 20 nt, Artificial Sequence
  MKO10117223_B_Slco5a1
  gRNA
caccaguuuccgaugaaacg

SEQ ID NO: 117224 - RNA, 20 nt, Artificial Sequence
  MKO10117224_B_Slco5a1
  gRNA
acaauaccaacaccggcacu

SEQ ID NO: 117225 - RNA, 20 nt, Artificial Sequence
  MKO10117225_B_Slco6b1
  gRNA
cauaaauauagguuacacca

SEQ ID NO: 117226 - RNA, 20 nt, Artificial Sequence
  MKO10117226_B_Slco6b1
  gRNA
cugaagagacugcccgauga

SEQ ID NO: 117227 - RNA, 20 nt, Artificial Sequence
  MKO10117227_B_Slco6b1
  gRNA
uccgaacugugauuaaauga

SEQ ID NO: 117228 - RNA, 20 nt, Artificial Sequence
  MKO10117228_B_Slco6c1
  gRNA
auagaagccgcaugaacuug

SEQ ID NO: 117229 - RNA, 20 nt, Artificial Sequence
  MKO10117229_B_Slco6c1
  gRNA
uguaccaacuguugcagagu

SEQ ID NO: 117230 - RNA, 20 nt, Artificial Sequence
  MKO10117230_B_Slco6c1
  gRNA
gcaauaauuauagcacacuu

SEQ ID NO: 117231 - RNA, 20 nt, Artificial Sequence
  MKO10117231_B_Slco6d1
  gRNA
uuauuuaaaagaguugugcg

SEQ ID NO: 117232 - RNA, 20 nt, Artificial Sequence
  MKO10117232_B_Slco6d1
  gRNA
ucgaaaauacaaagaucccu

SEQ ID NO: 117233 - RNA, 20 nt, Artificial Sequence
  MKO10117233_B_Slco6d1
  gRNA
cacguucccacaaacucauc

SEQ ID NO: 117234 - RNA, 20 nt, Artificial Sequence
  MKO10117234_B_Slfn14
  gRNA
acaccgcccuucaguuaaag

SEQ ID NO: 117235 - RNA, 20 nt, Artificial Sequence
  MKO10117235_B_Slfn14
  gRNA
gagccuccuggaacguugcc

SEQ ID NO: 117236 - RNA, 20 nt, Artificial Sequence
  MKO10117236_B_Slfn14
  gRNA
agcguaucucacaaaagucc

SEQ ID NO: 117237 - RNA, 20 nt, Artificial Sequence
  MKO10117237_B_Slfn1
  gRNA
uucaucgaaguccacgauuc

SEQ ID NO: 117238 - RNA, 20 nt, Artificial Sequence
  MKO10117238_B_Slfn1
  gRNA
aaaaugaacaucaccgauga

SEQ ID NO: 117239 - RNA, 20 nt, Artificial Sequence
  MKO10117239_B_Slfn1
  gRNA
accugacuagcuaagacaug

SEQ ID NO: 117240 - RNA, 20 nt, Artificial Sequence
  MKO10117240_B_Slfn2
  gRNA
uuacuuaccucugaguucug

SEQ ID NO: 117241 - RNA, 20 nt, Artificial Sequence
  MKO10117241_B_Slfn2
  gRNA
cuucgcucuccgugaagucc

SEQ ID NO: 117242 - RNA, 20 nt, Artificial Sequence
  MKO10117242_B_Slfn2
  gRNA
cuccagaugaaugccccauc

SEQ ID NO: 117243 - RNA, 20 nt, Artificial Sequence
  MKO10117243_B_Slfn3
  gRNA
uaaccaguguuccuuuaagc

SEQ ID NO: 117244 - RNA, 20 nt, Artificial Sequence
  MKO10117244_B_Slfn3
  gRNA
cagugcagcuccucaaaucc

SEQ ID NO: 117245 - RNA, 20 nt, Artificial Sequence
  MKO10117245_B_Slfn3
  gRNA
ccauugaagccgaaucagaa

SEQ ID NO: 117246 - RNA, 20 nt, Artificial Sequence
  MKO10117246_B_Slfn4
  gRNA
ugugguuacacugcgaaaau

SEQ ID NO: 117247 - RNA, 20 nt, Artificial Sequence
  MKO10117247_B_Slfn4
  gRNA
gauuugguaaaucccuugcc

SEQ ID NO: 117248 - RNA, 20 nt, Artificial Sequence
  MKO10117248_B_Slfn4
  gRNA
cgccauccaucuuccucgcu

SEQ ID NO: 117249 - RNA, 20 nt, Artificial Sequence
  MKO10117249_B_Slfn5
  gRNA
cuacuaucgaugccuguauc

SEQ ID NO: 117250 - RNA, 20 nt, Artificial Sequence
  MKO10117250_B_Slfn5
  gRNA
uacaggauuggaacguuguu

SEQ ID NO: 117251 - RNA, 20 nt, Artificial Sequence
  MKO10117251_B_Slfn5
  gRNA
guccucuguaaucugcgaag

SEQ ID NO: 117252 - RNA, 20 nt, Artificial Sequence
  MKO10117252_B_Slfn8
  gRNA
cagaacaauauugagaccaa

SEQ ID NO: 117253 - RNA, 20 nt, Artificial Sequence
  MKO10117253_B_Slfn8
  gRNA
cagggcaaaaagaaucugcc

SEQ ID NO: 117254 - RNA, 20 nt, Artificial Sequence
  MKO10117254_B_Slfn8
  gRNA
agaccaguguauucuaaaaa

SEQ ID NO: 117255 - RNA, 20 nt, Artificial Sequence
  MKO10117255_B_Slfn9
  gRNA
uuugcaagguuauaggagcu

SEQ ID NO: 117256 - RNA, 20 nt, Artificial Sequence
  MKO10117256_B_Slfn9
  gRNA
agaauauuuagggacucuug

SEQ ID NO: 117257 - RNA, 20 nt, Artificial Sequence
  MKO10117257_B_Slfn9
  gRNA
cgaggaaugaaaaacugucc

SEQ ID NO: 117258 - RNA, 20 nt, Artificial Sequence
  MKO10117258_B_Slfnl1
  gRNA
ugcuaagguacuccgccuga

SEQ ID NO: 117259 - RNA, 20 nt, Artificial Sequence
  MKO10117259_B_Slfnl1
  gRNA
guccucgcagaagugggcga

SEQ ID NO: 117260 - RNA, 20 nt, Artificial Sequence
  MKO10117260_B_Slfnl1
  gRNA
uugagguagugaggcggcca

SEQ ID NO: 117261 - RNA, 20 nt, Artificial Sequence
  MKO10117261_B_Slirp
  gRNA
cguucaagcucaaagagcaa

SEQ ID NO: 117262 - RNA, 20 nt, Artificial Sequence
  MKO10117262_B_Slirp
  gRNA
guacagugcaccuucuuaca

SEQ ID NO: 117263 - RNA, 20 nt, Artificial Sequence
  MKO10117263_B_Slirp
  gRNA
cuuucacagaggcauggguu

SEQ ID NO: 117264 - RNA, 20 nt, Artificial Sequence
  MKO10117264_B_Slit1
  gRNA
ggcuccccgaaaagccuucc

SEQ ID NO: 117265 - RNA, 20 nt, Artificial Sequence
  MKO10117265_B_Slit1
  gRNA
cucacagucuggauagagcc

SEQ ID NO: 117266 - RNA, 20 nt, Artificial Sequence
  MKO10117266_B_Slit1
  gRNA
uuguucuggaacaguaguuc

SEQ ID NO: 117267 - RNA, 20 nt, Artificial Sequence
  MKO10117267_B_Slit2
  gRNA
auuccaggaucuuaaggagc

SEQ ID NO: 117268 - RNA, 20 nt, Artificial Sequence
  MKO10117268_B_Slit2
  gRNA
aucaaauucaagcaauucca

SEQ ID NO: 117269 - RNA, 20 nt, Artificial Sequence
  MKO10117269_B_Slit2
  gRNA
aacacacuuacagaacucug

SEQ ID NO: 117270 - RNA, 20 nt, Artificial Sequence
  MKO10117270_B_Slit3
  gRNA
uggacagaaauaacaucacc

SEQ ID NO: 117271 - RNA, 20 nt, Artificial Sequence
  MKO10117271_B_Slit3
  gRNA
acaagacucgaagauucuuc

SEQ ID NO: 117272 - RNA, 20 nt, Artificial Sequence
  MKO10117272_B_Slit3
  gRNA
acucacagucuggugagcuu

SEQ ID NO: 117273 - RNA, 20 nt, Artificial Sequence
  MKO10117273_B_Slitrk1
  gRNA
uggucugcgaagcccccacc

SEQ ID NO: 117274 - RNA, 20 nt, Artificial Sequence
  MKO10117274_B_Slitrk1
  gRNA
gcgagauccucgcauacagc

SEQ ID NO: 117275 - RNA, 20 nt, Artificial Sequence
  MKO10117275_B_Slitrk1
  gRNA
uuuacugugcgaaguuaacg

SEQ ID NO: 117276 - RNA, 20 nt, Artificial Sequence
  MKO10117276_B_Slitrk2
  gRNA
gcugaaugccccugccucga

SEQ ID NO: 117277 - RNA, 20 nt, Artificial Sequence
  MKO10117277_B_Slitrk2
  gRNA
acagcugauagaugcgauac

SEQ ID NO: 117278 - RNA, 20 nt, Artificial Sequence
  MKO10117278_B_Slitrk2
  gRNA
ugcgguuuagcuugcaguaa

SEQ ID NO: 117279 - RNA, 20 nt, Artificial Sequence
  MKO10117279_B_Slitrk3
  gRNA
ccccaucuauaagccucgag

SEQ ID NO: 117280 - RNA, 20 nt, Artificial Sequence
  MKO10117280_B_Slitrk3
  gRNA
uaccccaauuccccugauag

SEQ ID NO: 117281 - RNA, 20 nt, Artificial Sequence
  MKO10117281_B_Slitrk3
  gRNA
ucuuuaacuucgcaguagca

SEQ ID NO: 117282 - RNA, 20 nt, Artificial Sequence
  MKO10117282_B_Slitrk4
  gRNA
ugaucaaguacuccgcugac

SEQ ID NO: 117283 - RNA, 20 nt, Artificial Sequence
  MKO10117283_B_Slitrk4
  gRNA
cccccaggaggacuucgaau

SEQ ID NO: 117284 - RNA, 20 nt, Artificial Sequence
  MKO10117284_B_Slitrk4
  gRNA
uuaaucaaguauauugaacg

SEQ ID NO: 117285 - RNA, 20 nt, Artificial Sequence
  MKO10117285_B_Slitrk5
  gRNA
aauacugaugggggcgucgc

SEQ ID NO: 117286 - RNA, 20 nt, Artificial Sequence
  MKO10117286_B_Slitrk5
  gRNA
cggaauugccuucucgagac

SEQ ID NO: 117287 - RNA, 20 nt, Artificial Sequence
  MKO10117287_B_Slitrk5
  gRNA
cccgcgggagucuucaccuu

SEQ ID NO: 117288 - RNA, 20 nt, Artificial Sequence
  MKO10117288_B_Slitrk6
  gRNA
uccaauuggaggacaauaag

SEQ ID NO: 117289 - RNA, 20 nt, Artificial Sequence
  MKO10117289_B_Slitrk6
  gRNA
accaguauacgaagagcaug

SEQ ID NO: 117290 - RNA, 20 nt, Artificial Sequence
  MKO10117290_B_Slitrk6
  gRNA
agaacacauuggccggauau

SEQ ID NO: 117291 - RNA, 20 nt, Artificial Sequence
  MKO10117291_B_Slk
  gRNA
ucuagaagcuugacgauguu

SEQ ID NO: 117292 - RNA, 20 nt, Artificial Sequence
  MKO10117292_B_Slk
  gRNA
ccccugcacagaauucaaug

SEQ ID NO: 117293 - RNA, 20 nt, Artificial Sequence
  MKO10117293_B_Slk
  gRNA
auccaccgagaucuaaaagc

SEQ ID NO: 117294 - RNA, 20 nt, Artificial Sequence
  MKO10117294_B_Slmap
  gRNA
aguuccugagaguacauacu

SEQ ID NO: 117295 - RNA, 20 nt, Artificial Sequence
  MKO10117295_B_Slmap
  gRNA
ucacaacuuacuuugucuac

SEQ ID NO: 117296 - RNA, 20 nt, Artificial Sequence
  MKO10117296_B_Slmap
  gRNA
cacuccaaguauguacucuc

SEQ ID NO: 117297 - RNA, 20 nt, Artificial Sequence
  MKO10117297_B_Slmo1
  gRNA
aaagaucacgcucacgaauc

SEQ ID NO: 117298 - RNA, 20 nt, Artificial Sequence
  MKO10117298_B_Slmo1
  gRNA
gcgcucuuugauguacguca

SEQ ID NO: 117299 - RNA, 20 nt, Artificial Sequence
  MKO10117299_B_Slmo1
  gRNA
ggcguucaccuucuuagcau

SEQ ID NO: 117300 - RNA, 20 nt, Artificial Sequence
  MKO10117300_B_Slmo2
  gRNA
cuguaguugacccgguaacg

SEQ ID NO: 117301 - RNA, 20 nt, Artificial Sequence
  MKO10117301_B_Slmo2
  gRNA
ugcuugccaugaguccuucc

SEQ ID NO: 117302 - RNA, 20 nt, Artificial Sequence
  MKO10117302_B_Slmo2
  gRNA
ugaccccuuucacugugaug

SEQ ID NO: 117303 - RNA, 20 nt, Artificial Sequence
  MKO10117303_B_Sln
  gRNA
accucacgaggagccacaua

SEQ ID NO: 117304 - RNA, 20 nt, Artificial Sequence
  MKO10117304_B_Sln
  gRNA
cauggccccucaguauuggu

SEQ ID NO: 117305 - RNA, 20 nt, Artificial Sequence
  MKO10117305_B_Slpi
  gRNA
gucugccugcccccgaugug

SEQ ID NO: 117306 - RNA, 20 nt, Artificial Sequence
  MKO10117306_B_Slpi
  gRNA
cgugaaagguaaaaggccgc

SEQ ID NO: 117307 - RNA, 20 nt, Artificial Sequence
  MKO10117307_B_Slpi
  gRNA
uuucacggugcuccuugcuc

SEQ ID NO: 117308 - RNA, 20 nt, Artificial Sequence
  MKO10117308_B_Sltm
  gRNA
ccauuaaaaggacugugaau

SEQ ID NO: 117309 - RNA, 20 nt, Artificial Sequence
  MKO10117309_B_Sltm
  gRNA
cuucuguagaaagcaacucc

SEQ ID NO: 117310 - RNA, 20 nt, Artificial Sequence
  MKO10117310_B_Sltm
  gRNA
caagaagcagaugaguugag

SEQ ID NO: 117311 - RNA, 20 nt, Artificial Sequence
  MKO10117311_B_Slu7
  gRNA
cugcaagaagaguuagccuc

SEQ ID NO: 117312 - RNA, 20 nt, Artificial Sequence
  MKO10117312_B_Slu7
  gRNA
agagcacaugaagauugucg

SEQ ID NO: 117313 - RNA, 20 nt, Artificial Sequence
  MKO10117313_B_Slu7
  gRNA
uuugauggaucaauguacca

SEQ ID NO: 117314 - RNA, 20 nt, Artificial Sequence
  MKO10117314_B_Slurp1
  gRNA
acugaagaaugacccuucgc

SEQ ID NO: 117315 - RNA, 20 nt, Artificial Sequence
  MKO10117315_B_Slurp1
  gRNA
cacagccuguaagacuguac

SEQ ID NO: 117316 - RNA, 20 nt, Artificial Sequence
  MKO10117316_B_Slurp1
  gRNA
cucaccauagcccaugcucc

SEQ ID NO: 117317 - RNA, 20 nt, Artificial Sequence
  MKO10117317_B_Slx1b
  gRNA
cgucugcuguggccgcccuu

SEQ ID NO: 117318 - RNA, 20 nt, Artificial Sequence
  MKO10117318_B_Slx1b
  gRNA
accuaggacaaugucccucu

SEQ ID NO: 117319 - RNA, 20 nt, Artificial Sequence
  MKO10117319_B_Slx1b
  gRNA
cccuuaggggacaaccaggg

SEQ ID NO: 117320 - RNA, 20 nt, Artificial Sequence
  MKO10117320_B_Slx4ip
  gRNA
auccagaacucccagaauac

SEQ ID NO: 117321 - RNA, 20 nt, Artificial Sequence
  MKO10117321_B_Slx4ip
  gRNA
gugugggaacuucgcagucc

SEQ ID NO: 117322 - RNA, 20 nt, Artificial Sequence
  MKO10117322_B_Slx4ip
  gRNA
cuucuguucagaaaaccaac

SEQ ID NO: 117323 - RNA, 20 nt, Artificial Sequence
  MKO10117323_B_Slx4
  gRNA
aucccugauugcccaauaug

SEQ ID NO: 117324 - RNA, 20 nt, Artificial Sequence
  MKO10117324_B_Slx4
  gRNA
uguucacauguugcucccuc

SEQ ID NO: 117325 - RNA, 20 nt, Artificial Sequence
  MKO10117325_B_Slx4
  gRNA
agaucuucagacggagccuc

SEQ ID NO: 117326 - RNA, 20 nt, Artificial Sequence
  MKO10117326_B_Slxl1
  gRNA
gaaauuccugaagaaaucgu

SEQ ID NO: 117327 - RNA, 20 nt, Artificial Sequence
  MKO10117327_B_Slxl1
  gRNA
cuugcuguucauugaaauuc

SEQ ID NO: 117328 - RNA, 20 nt, Artificial Sequence
  MKO10117328_B_Slxl1
  gRNA
uacauuucagaaguuugaua

SEQ ID NO: 117329 - RNA, 20 nt, Artificial Sequence
  MKO10117329_B_Slx
  gRNA
ucuucaucugcuucuacgug

SEQ ID NO: 117330 - RNA, 20 nt, Artificial Sequence
  MKO10117330_B_Slx
  gRNA
agaugaacaagacaguaugu

SEQ ID NO: 117331 - RNA, 20 nt, Artificial Sequence
  MKO10117331_B_Slx
  gRNA
agaaaacguaaguuucucag

SEQ ID NO: 117332 - RNA, 20 nt, Artificial Sequence
  MKO10117332_B_Sly
  gRNA
agcagaagcagaugaagaua

SEQ ID NO: 117333 - RNA, 20 nt, Artificial Sequence
  MKO10117333_B_Sly
  gRNA
agaugaaguagacaguaugu

SEQ ID NO: 117334 - RNA, 20 nt, Artificial Sequence
  MKO10117334_B_Sly
  gRNA
acaguaaauaauccagcaau

SEQ ID NO: 117335 - RNA, 20 nt, Artificial Sequence
  MKO10117335_B_Smad1
  gRNA
cguggaacgcuucacccaca

SEQ ID NO: 117336 - RNA, 20 nt, Artificial Sequence
  MKO10117336_B_Smad1
  gRNA
cgccaucauguucgugucca

SEQ ID NO: 117337 - RNA, 20 nt, Artificial Sequence
  MKO10117337_B_Smad1
  gRNA
cugugccucggaaccagcac

SEQ ID NO: 117338 - RNA, 20 nt, Artificial Sequence
  MKO10117338_B_Smad2
  gRNA
ugccacauguuauauauugc

SEQ ID NO: 117339 - RNA, 20 nt, Artificial Sequence
  MKO10117339_B_Smad2
  gRNA
acuuaccuguguccauacuu

SEQ ID NO: 117340 - RNA, 20 nt, Artificial Sequence
  MKO10117340_B_Smad2
  gRNA
cagcaaauacgguagaucag

SEQ ID NO: 117341 - RNA, 20 nt, Artificial Sequence
  MKO10117341_B_Smad3
  gRNA
gccacgccacaccgagaucc

SEQ ID NO: 117342 - RNA, 20 nt, Artificial Sequence
  MKO10117342_B_Smad3
  gRNA
aucggauucggggagagguu

SEQ ID NO: 117343 - RNA, 20 nt, Artificial Sequence
  MKO10117343_B_Smad3
  gRNA
guccccagcacacaauaacu

SEQ ID NO: 117344 - RNA, 20 nt, Artificial Sequence
  MKO10117344_B_Smad4
  gRNA
agacgggcauagaucacaug

SEQ ID NO: 117345 - RNA, 20 nt, Artificial Sequence
  MKO10117345_B_Smad4
  gRNA
cugcccgccagaauacuggc

SEQ ID NO: 117346 - RNA, 20 nt, Artificial Sequence
  MKO10117346_B_Smad4
  gRNA
aggucagccggccaguauuc

SEQ ID NO: 117347 - RNA, 20 nt, Artificial Sequence
  MKO10117347_B_Smad5
  gRNA
uaugaauuaaacaaucgugu

SEQ ID NO: 117348 - RNA, 20 nt, Artificial Sequence
  MKO10117348_B_Smad5
  gRNA
guggcaugugcgguucauug

SEQ ID NO: 117349 - RNA, 20 nt, Artificial Sequence
  MKO10117349_B_Smad5
  gRNA
uguucagccugucgccuaug

SEQ ID NO: 117350 - RNA, 20 nt, Artificial Sequence
  MKO10117350_B_Smad6
  gRNA
guggcaccuugcgcacgacc

SEQ ID NO: 117351 - RNA, 20 nt, Artificial Sequence
  MKO10117351_B_Smad6
  gRNA
uccugaccaguacaagccac

SEQ ID NO: 117352 - RNA, 20 nt, Artificial Sequence
  MKO10117352_B_Smad6
  gRNA
acuuacccaguggcuuguac

SEQ ID NO: 117353 - RNA, 20 nt, Artificial Sequence
  MKO10117353_B_Smad7
  gRNA
ggccagauaauucguucccc

SEQ ID NO: 117354 - RNA, 20 nt, Artificial Sequence
  MKO10117354_B_Smad7
  gRNA
cuucaucaaguccgccacac

SEQ ID NO: 117355 - RNA, 20 nt, Artificial Sequence
  MKO10117355_B_Smad7
  gRNA
aaccgggggaacgaauuauc

SEQ ID NO: 117356 - RNA, 20 nt, Artificial Sequence
  MKO10117356_B_Smad9
  gRNA
cucgcccaguccgugcacca

SEQ ID NO: 117357 - RNA, 20 nt, Artificial Sequence
  MKO10117357_B_Smad9
  gRNA
gggagcagaguaucaucgcc

SEQ ID NO: 117358 - RNA, 20 nt, Artificial Sequence
  MKO10117358_B_Smad9
  gRNA
agguggcguugugcggcaug

SEQ ID NO: 117359 - RNA, 20 nt, Artificial Sequence
  MKO10117359_B_Smagp
  gRNA
guuccucacccugcucucgg

SEQ ID NO: 117360 - RNA, 20 nt, Artificial Sequence
  MKO10117360_B_Smagp
  gRNA
agcaacgaugaacaaccuac

SEQ ID NO: 117361 - RNA, 20 nt, Artificial Sequence
  MKO10117361_B_Smagp
  gRNA
caucaccuaccuucaggaga

SEQ ID NO: 117362 - RNA, 20 nt, Artificial Sequence
  MKO10117362_B_Smap1
  gRNA
aaaggauacugaucugucug

SEQ ID NO: 117363 - RNA, 20 nt, Artificial Sequence
  MKO10117363_B_Smap1
  gRNA
gccugcaaaaccacuaacaa

SEQ ID NO: 117364 - RNA, 20 nt, Artificial Sequence
  MKO10117364_B_Smap1
  gRNA
gaaagaaaaggaaaaaaaaa

SEQ ID NO: 117365 - RNA, 20 nt, Artificial Sequence
  MKO10117365_B_Smap2
  gRNA
ccgaaaggucucgggaaggu

SEQ ID NO: 117366 - RNA, 20 nt, Artificial Sequence
  MKO10117366_B_Smap2
  gRNA
aaaagauacgggucuaucug

SEQ ID NO: 117367 - RNA, 20 nt, Artificial Sequence
  MKO10117367_B_Smap2
  gRNA
gucuggacaucaauguccuu

SEQ ID NO: 117368 - RNA, 20 nt, Artificial Sequence
  MKO10117368_B_Smarca1
  gRNA
gaaugugugugucagauucg

SEQ ID NO: 117369 - RNA, 20 nt, Artificial Sequence
  MKO10117369_B_Smarca1
  gRNA
aaaucaaccaguuuaguccu

SEQ ID NO: 117370 - RNA, 20 nt, Artificial Sequence
  MKO10117370_B_Smarca1
  gRNA
gcagcaaguuugaguugaaa

SEQ ID NO: 117371 - RNA, 20 nt, Artificial Sequence
  MKO10117371_B_Smarca2
  gRNA
cacucuuaaacacugacugu

SEQ ID NO: 117372 - RNA, 20 nt, Artificial Sequence
  MKO10117372_B_Smarca2
  gRNA
uucaucugcuucguuaguuu

SEQ ID NO: 117373 - RNA, 20 nt, Artificial Sequence
  MKO10117373_B_Smarca2
  gRNA
cuaauuaauucauaguauuc

SEQ ID NO: 117374 - RNA, 20 nt, Artificial Sequence
  MKO10117374_B_Smarca4
  gRNA
ggugugccccccgggaugcc

SEQ ID NO: 117375 - RNA, 20 nt, Artificial Sequence
  MKO10117375_B_Smarca4
  gRNA
caucccggggggcacaccug

SEQ ID NO: 117376 - RNA, 20 nt, Artificial Sequence
  MKO10117376_B_Smarca4
  gRNA
augcggucaggggcccacac

SEQ ID NO: 117377 - RNA, 20 nt, Artificial Sequence
  MKO10117377_B_Smarca5
  gRNA
ccuccucuugcuccguucua

SEQ ID NO: 117378 - RNA, 20 nt, Artificial Sequence
  MKO10117378_B_Smarca5
  gRNA
uccuacauaugaagaaaaaa

SEQ ID NO: 117379 - RNA, 20 nt, Artificial Sequence
  MKO10117379_B_Smarca5
  gRNA
ucacccuugaagaugaaacc

SEQ ID NO: 117380 - RNA, 20 nt, Artificial Sequence
  MKO10117380_B_Smarcad1
  gRNA
aagugacagugaucuucuaa

SEQ ID NO: 117381 - RNA, 20 nt, Artificial Sequence
  MKO10117381_B_Smarcad1
  gRNA
gauugaaucaacaagcacua

SEQ ID NO: 117382 - RNA, 20 nt, Artificial Sequence
  MKO10117382_B_Smarcad1
  gRNA
ccaaaaucaaagagcaauac

SEQ ID NO: 117383 - RNA, 20 nt, Artificial Sequence
  MKO10117383_B_Smarcal1
  gRNA
ucauugcagauaucaagacc

SEQ ID NO: 117384 - RNA, 20 nt, Artificial Sequence
  MKO10117384_B_Smarcal1
  gRNA
cuagccucaugcccuuucag

SEQ ID NO: 117385 - RNA, 20 nt, Artificial Sequence
  MKO10117385_B_Smarcal1
  gRNA
gucgcucaugcugaaguccc

SEQ ID NO: 117386 - RNA, 20 nt, Artificial Sequence
  MKO10117386_B_Smarcb1
  gRNA
cagagcccccgaccuaccuc

SEQ ID NO: 117387 - RNA, 20 nt, Artificial Sequence
  MKO10117387_B_Smarcb1
  gRNA
agaucauggauauaccaccc

SEQ ID NO: 117388 - RNA, 20 nt, Artificial Sequence
  MKO10117388_B_Smarcb1
  gRNA
ucuucuugucccgacccaug

SEQ ID NO: 117389 - RNA, 20 nt, Artificial Sequence
  MKO10117389_B_Smarcc1
  gRNA
gccaacuucaaaucaauguc

SEQ ID NO: 117390 - RNA, 20 nt, Artificial Sequence
  MKO10117390_B_Smarcc1
  gRNA
acagguaguuuggugaaagc

SEQ ID NO: 117391 - RNA, 20 nt, Artificial Sequence
  MKO10117391_B_Smarcc1
  gRNA
ggcaccuugugucacauucu

SEQ ID NO: 117392 - RNA, 20 nt, Artificial Sequence
  MKO10117392_B_Smarcc2
  gRNA
cucaccggcaguuuaguaag

SEQ ID NO: 117393 - RNA, 20 nt, Artificial Sequence
  MKO10117393_B_Smarcc2
  gRNA
uuuccagaauccaucacgca

SEQ ID NO: 117394 - RNA, 20 nt, Artificial Sequence
  MKO10117394_B_Smarcc2
  gRNA
cuggucacucuugaauuugu

SEQ ID NO: 117395 - RNA, 20 nt, Artificial Sequence
  MKO10117395_B_Smarcd1
  gRNA
uaccuugaugggacguuuca

SEQ ID NO: 117396 - RNA, 20 nt, Artificial Sequence
  MKO10117396_B_Smarcd1
  gRNA
cggcuaccuggcagcauacc

SEQ ID NO: 117397 - RNA, 20 nt, Artificial Sequence
  MKO10117397_B_Smarcd1
  gRNA
gggaacccuucaguccgacc

SEQ ID NO: 117398 - RNA, 20 nt, Artificial Sequence
  MKO10117398_B_Smarcd2
  gRNA
ccuccugccgguuccccauu

SEQ ID NO: 117399 - RNA, 20 nt, Artificial Sequence
  MKO10117399_B_Smarcd2
  gRNA
auuaucuccauccgccuugc

SEQ ID NO: 117400 - RNA, 20 nt, Artificial Sequence
  MKO10117400_B_Smarcd2
  gRNA
cuccugggagcuucgaguag

SEQ ID NO: 117401 - RNA, 20 nt, Artificial Sequence
  MKO10117401_B_Smarcd3
  gRNA
aucaaaccaucaugcggaag

SEQ ID NO: 117402 - RNA, 20 nt, Artificial Sequence
  MKO10117402_B_Smarcd3
  gRNA
cuucgcaggguuaaaaguau

SEQ ID NO: 117403 - RNA, 20 nt, Artificial Sequence
  MKO10117403_B_Smarcd3
  gRNA
ccaucagagucuuccgcauc

SEQ ID NO: 117404 - RNA, 20 nt, Artificial Sequence
  MKO10117404_B_Smarce1
  gRNA
aaacgaauacgaagcagaaa

SEQ ID NO: 117405 - RNA, 20 nt, Artificial Sequence
  MKO10117405_B_Smarce1
  gRNA
uaaggucugggaccaaguaa

SEQ ID NO: 117406 - RNA, 20 nt, Artificial Sequence
  MKO10117406_B_Smarce1
  gRNA
gugggagguggggcauaaga

SEQ ID NO: 117407 - RNA, 20 nt, Artificial Sequence
  MKO10117407_B_Smc1a
  gRNA
acccugcgggaccugauaca

SEQ ID NO: 117408 - RNA, 20 nt, Artificial Sequence
  MKO10117408_B_Smc1a
  gRNA
caaccgagccuuugucagca

SEQ ID NO: 117409 - RNA, 20 nt, Artificial Sequence
  MKO10117409_B_Smc1a
  gRNA
uaaacucuaccacaacgaag

SEQ ID NO: 117410 - RNA, 20 nt, Artificial Sequence
  MKO10117410_B_Smc1b
  gRNA
ugugacaauuauauacauag

SEQ ID NO: 117411 - RNA, 20 nt, Artificial Sequence
  MKO10117411_B_Smc1b
  gRNA
uuugaagaaaucaguacuuc

SEQ ID NO: 117412 - RNA, 20 nt, Artificial Sequence
  MKO10117412_B_Smc1b
  gRNA
uuuccucauuauaauauagu

SEQ ID NO: 117413 - RNA, 20 nt, Artificial Sequence
  MKO10117413_B_Smc2
  gRNA
uccaugauugaagaagcugc

SEQ ID NO: 117414 - RNA, 20 nt, Artificial Sequence
  MKO10117414_B_Smc2
  gRNA
uccagcagcuucuucaauca

SEQ ID NO: 117415 - RNA, 20 nt, Artificial Sequence
  MKO10117415_B_Smc2
  gRNA
accugcaugaugagaaagug

SEQ ID NO: 117416 - RNA, 20 nt, Artificial Sequence
  MKO10117416_B_Smc3
  gRNA
cucgguaacuucggaagccc

SEQ ID NO: 117417 - RNA, 20 nt, Artificial Sequence
  MKO10117417_B_Smc3
  gRNA
acaaaagcagaaauaacacg

SEQ ID NO: 117418 - RNA, 20 nt, Artificial Sequence
  MKO10117418_B_Smc3
  gRNA
ucuuuaauaggugaucaucc

SEQ ID NO: 117419 - RNA, 20 nt, Artificial Sequence
  MKO10117419_B_Smc4
  gRNA
gcaagauuaaaaaucgauua

SEQ ID NO: 117420 - RNA, 20 nt, Artificial Sequence
  MKO10117420_B_Smc4
  gRNA
aaccuauuaaagucuugugu

SEQ ID NO: 117421 - RNA, 20 nt, Artificial Sequence
  MKO10117421_B_Smc4
  gRNA
acuucugucuaccacauaag

SEQ ID NO: 117422 - RNA, 20 nt, Artificial Sequence
  MKO10117422_B_Smc5
  gRNA
gccuguaacccagaagauag

SEQ ID NO: 117423 - RNA, 20 nt, Artificial Sequence
  MKO10117423_B_Smc5
  gRNA
ugaugcuguaggacaaaguu

SEQ ID NO: 117424 - RNA, 20 nt, Artificial Sequence
  MKO10117424_B_Smc5
  gRNA
uucaauuucaaccaaaccuu

SEQ ID NO: 117425 - RNA, 20 nt, Artificial Sequence
  MKO10117425_B_Smc6
  gRNA
gugcucaccgcacucauagu

SEQ ID NO: 117426 - RNA, 20 nt, Artificial Sequence
  MKO10117426_B_Smc6
  gRNA
ucuaacgucaacuuuguugu

SEQ ID NO: 117427 - RNA, 20 nt, Artificial Sequence
  MKO10117427_B_Smc6
  gRNA
caauuaccuggauguuaaaa

SEQ ID NO: 117428 - RNA, 20 nt, Artificial Sequence
  MKO10117428_B_Smchd1
  gRNA
uuaacuagagugucguagug

SEQ ID NO: 117429 - RNA, 20 nt, Artificial Sequence
  MKO10117429_B_Smchd1
  gRNA
ucagcuacuucucgaaauaa

SEQ ID NO: 117430 - RNA, 20 nt, Artificial Sequence
  MKO10117430_B_Smchd1
  gRNA
uuacuuaccaaaauuauuac

SEQ ID NO: 117431 - RNA, 20 nt, Artificial Sequence
  MKO10117431_B_Smco1
  gRNA
ggcuugccaaagucuugcua

SEQ ID NO: 117432 - RNA, 20 nt, Artificial Sequence
  MKO10117432_B_Smco1
  gRNA
cacaacccugauauccuuga

SEQ ID NO: 117433 - RNA, 20 nt, Artificial Sequence
  MKO10117433_B_Smco1
  gRNA
auaucaggguuguggucuca

SEQ ID NO: 117434 - RNA, 20 nt, Artificial Sequence
  MKO10117434_B_Smco2
  gRNA
agaagugacucuaguuugcg

SEQ ID NO: 117435 - RNA, 20 nt, Artificial Sequence
  MKO10117435_B_Smco2
  gRNA
ggggugcucucauccguaga

SEQ ID NO: 117436 - RNA, 20 nt, Artificial Sequence
  MKO10117436_B_Smco2
  gRNA
gauaagggaaguuucggaaa

SEQ ID NO: 117437 - RNA, 20 nt, Artificial Sequence
  MKO10117437_B_Smco3
  gRNA
gaaugaucauaucuaucccg

SEQ ID NO: 117438 - RNA, 20 nt, Artificial Sequence
  MKO10117438_B_Smco3
  gRNA
aacuagagccaacccuuuau

SEQ ID NO: 117439 - RNA, 20 nt, Artificial Sequence
  MKO10117439_B_Smco3
  gRNA
caguuuaacagccacugcac

SEQ ID NO: 117440 - RNA, 20 nt, Artificial Sequence
  MKO10117440_B_Smco4
  gRNA
cauacacaaacacgacaaug

SEQ ID NO: 117441 - RNA, 20 nt, Artificial Sequence
  MKO10117441_B_Smco4
  gRNA
cauugucguguuuguguaug

SEQ ID NO: 117442 - RNA, 20 nt, Artificial Sequence
  MKO10117442_B_Smco4
  gRNA
cugcugccgcgccuccugca

SEQ ID NO: 117443 - RNA, 20 nt, Artificial Sequence
  MKO10117443_B_Smcp
  gRNA
aagaacuguguugccagauc

SEQ ID NO: 117444 - RNA, 20 nt, Artificial Sequence
  MKO10117444_B_Smcp
  gRNA
ugcaauaguagccuacaguu

SEQ ID NO: 117445 - RNA, 20 nt, Artificial Sequence
  MKO10117445_B_Smcp
  gRNA
uucuguggacagcacgguuu

SEQ ID NO: 117446 - RNA, 20 nt, Artificial Sequence
  MKO10117446_B_Smcr8
  gRNA
cccgcuugaucugagugcga

SEQ ID NO: 117447 - RNA, 20 nt, Artificial Sequence
  MKO10117447_B_Smcr8
  gRNA
ggcccccucauuauccgcau

SEQ ID NO: 117448 - RNA, 20 nt, Artificial Sequence
  MKO10117448_B_Smcr8
  gRNA
gauuaccaggcuucauucgu

SEQ ID NO: 117449 - RNA, 20 nt, Artificial Sequence
  MKO10117449_B_Smdt1
  gRNA
gaacuucgcugcucugcuug

SEQ ID NO: 117450 - RNA, 20 nt, Artificial Sequence
  MKO10117450_B_Smdt1
  gRNA
gccuggguugcaguucgacc

SEQ ID NO: 117451 - RNA, 20 nt, Artificial Sequence
  MKO10117451_B_Smdt1
  gRNA
gugacgaugacugaccucga

SEQ ID NO: 117452 - RNA, 20 nt, Artificial Sequence
  MKO10117452_B_Smek1
  gRNA
agucgacuuaacucacauga

SEQ ID NO: 117453 - RNA, 20 nt, Artificial Sequence
  MKO10117453_B_Smek1
  gRNA
caaaggauacucugauugug

SEQ ID NO: 117454 - RNA, 20 nt, Artificial Sequence
  MKO10117454_B_Smek1
  gRNA
ugcaguguuaggauuuauuu

SEQ ID NO: 117455 - RNA, 20 nt, Artificial Sequence
  MKO10117455_B_Smek2
  gRNA
aacaggauacauuaauuguu

SEQ ID NO: 117456 - RNA, 20 nt, Artificial Sequence
  MKO10117456_B_Smek2
  gRNA
aagcuacagaugaugauaaa

SEQ ID NO: 117457 - RNA, 20 nt, Artificial Sequence
  MKO10117457_B_Smek2
  gRNA
uguuucugauaugcaguguu

SEQ ID NO: 117458 - RNA, 20 nt, Artificial Sequence
  MKO10117458_B_Smg1
  gRNA
cgucauucuguaugucagca

SEQ ID NO: 117459 - RNA, 20 nt, Artificial Sequence
  MKO10117459_B_Smg1
  gRNA
agaugacagagaccgaagac

SEQ ID NO: 117460 - RNA, 20 nt, Artificial Sequence
  MKO10117460_B_Smg1
  gRNA
agucguuggggcaagagcug

SEQ ID NO: 117461 - RNA, 20 nt, Artificial Sequence
  MKO10117461_B_Smg5
  gRNA
uucuugcauccaguagacua

SEQ ID NO: 117462 - RNA, 20 nt, Artificial Sequence
  MKO10117462_B_Smg5
  gRNA
ccaccgaugccugguguacc

SEQ ID NO: 117463 - RNA, 20 nt, Artificial Sequence
  MKO10117463_B_Smg5
  gRNA
gccuuccucccauagucuac

SEQ ID NO: 117464 - RNA, 20 nt, Artificial Sequence
  MKO10117464_B_Smg6
  gRNA
caacgaaguaugauuugcca

SEQ ID NO: 117465 - RNA, 20 nt, Artificial Sequence
  MKO10117465_B_Smg6
  gRNA
gauagaaagcguucuuccac

SEQ ID NO: 117466 - RNA, 20 nt, Artificial Sequence
  MKO10117466_B_Smg6
  gRNA
agucuguuccgaaucugcuc

SEQ ID NO: 117467 - RNA, 20 nt, Artificial Sequence
  MKO10117467_B_Smg7
  gRNA
ccgugugaagucuucccagu

SEQ ID NO: 117468 - RNA, 20 nt, Artificial Sequence
  MKO10117468_B_Smg7
  gRNA
cggcugaggucuggacaucc

SEQ ID NO: 117469 - RNA, 20 nt, Artificial Sequence
  MKO10117469_B_Smg7
  gRNA
gcuagacuguggcuucacua

SEQ ID NO: 117470 - RNA, 20 nt, Artificial Sequence
  MKO10117470_B_Smg8
  gRNA
aauagccgagcccgauccac

SEQ ID NO: 117471 - RNA, 20 nt, Artificial Sequence
  MKO10117471_B_Smg8
  gRNA
guacauccuguccucgucgc

SEQ ID NO: 117472 - RNA, 20 nt, Artificial Sequence
  MKO10117472_B_Smg8
  gRNA
uaccuaccccgcugauccac

SEQ ID NO: 117473 - RNA, 20 nt, Artificial Sequence
  MKO10117473_B_Smg9
  gRNA
acacguccgucugauccagc

SEQ ID NO: 117474 - RNA, 20 nt, Artificial Sequence
  MKO10117474_B_Smg9
  gRNA
cuguguaccagauucaaaac

SEQ ID NO: 117475 - RNA, 20 nt, Artificial Sequence
  MKO10117475_B_Smg9
  gRNA
ugugcucaugaagccacgug

SEQ ID NO: 117476 - RNA, 20 nt, Artificial Sequence
  MKO10117476_B_Smgc
  gRNA
aagaaucuuaguccugcuac

SEQ ID NO: 117477 - RNA, 20 nt, Artificial Sequence
  MKO10117477_B_Smgc
  gRNA
cucuuaaaccgauauuacca

SEQ ID NO: 117478 - RNA, 20 nt, Artificial Sequence
  MKO10117478_B_Smgc
  gRNA
aggaaaugaugccaccgucc

SEQ ID NO: 117479 - RNA, 20 nt, Artificial Sequence
  MKO10117479_B_Smim11
  gRNA
cuggcccgccaugaacugga

SEQ ID NO: 117480 - RNA, 20 nt, Artificial Sequence
  MKO10117480_B_Smim11
  gRNA
aaaaacccugauccugugcc

SEQ ID NO: 117481 - RNA, 20 nt, Artificial Sequence
  MKO10117481_B_Smim11
  gRNA
gaaaacugcaagcagagaag

SEQ ID NO: 117482 - RNA, 20 nt, Artificial Sequence
  MKO10117482_B_Smim12
  gRNA
uuccccugaugaaccauucc

SEQ ID NO: 117483 - RNA, 20 nt, Artificial Sequence
  MKO10117483_B_Smim12
  gRNA
cgcaccacgguccaaagcac

SEQ ID NO: 117484 - RNA, 20 nt, Artificial Sequence
  MKO10117484_B_Smim12
  gRNA
cacucagguggugagccuua

SEQ ID NO: 117485 - RNA, 20 nt, Artificial Sequence
  MKO10117485_B_Smim13
  gRNA
cgagcagaucugaucuucug

SEQ ID NO: 117486 - RNA, 20 nt, Artificial Sequence
  MKO10117486_B_Smim13
  gRNA
gcugacccugcugguguucg

SEQ ID NO: 117487 - RNA, 20 nt, Artificial Sequence
  MKO10117487_B_Smim13
  gRNA
caccgcacaccaucagcaac

SEQ ID NO: 117488 - RNA, 20 nt, Artificial Sequence
  MKO10117488_B_Smim14
  gRNA
cgaucaccauccaggccauc

SEQ ID NO: 117489 - RNA, 20 nt, Artificial Sequence
  MKO10117489_B_Smim14
  gRNA
cucccgaaggcacucugugu

SEQ ID NO: 117490 - RNA, 20 nt, Artificial Sequence
  MKO10117490_B_Smim14
  gRNA
agcucuuacacugugaggac

SEQ ID NO: 117491 - RNA, 20 nt, Artificial Sequence
  MKO10117491_B_Smim15
  gRNA
aaucaucuuggccaacuucc

SEQ ID NO: 117492 - RNA, 20 nt, Artificial Sequence
  MKO10117492_B_Smim15
  gRNA
acagcacuagcuaggaacag

SEQ ID NO: 117493 - RNA, 20 nt, Artificial Sequence
  MKO10117493_B_Smim15
  gRNA
gggcugaguauguuguggag

SEQ ID NO: 117494 - RNA, 20 nt, Artificial Sequence
  MKO10117494_B_Smim18
  gRNA
ugcaaagaacaaaaccguga

SEQ ID NO: 117495 - RNA, 20 nt, Artificial Sequence
  MKO10117495_B_Smim18
  gRNA
uucacccuuuccaugacaac

SEQ ID NO: 117496 - RNA, 20 nt, Artificial Sequence
  MKO10117496_B_Smim18
  gRNA
gaauccucucagaaguauga

SEQ ID NO: 117497 - RNA, 20 nt, Artificial Sequence
  MKO10117497_B_Smim19
  gRNA
uuuagcgugccucccacaga

SEQ ID NO: 117498 - RNA, 20 nt, Artificial Sequence
  MKO10117498_B_Smim19
  gRNA
guaucaacagccacaaagcc

SEQ ID NO: 117499 - RNA, 20 nt, Artificial Sequence
  MKO10117499_B_Smim19
  gRNA
cgacagugugcagcucucau

SEQ ID NO: 117500 - RNA, 20 nt, Artificial Sequence
  MKO10117500_B_Smim1
  gRNA
aguagccagugauguaaccc

SEQ ID NO: 117501 - RNA, 20 nt, Artificial Sequence
  MKO10117501_B_Smim1
  gRNA
acuguaccuccuauagcaug

SEQ ID NO: 117502 - RNA, 20 nt, Artificial Sequence
  MKO10117502_B_Smim1
  gRNA
caugaccgccauguccagcu

SEQ ID NO: 117503 - RNA, 20 nt, Artificial Sequence
  MKO10117503_B_Smim20
  gRNA
uuuccauaggguugaaagug

SEQ ID NO: 117504 - RNA, 20 nt, Artificial Sequence
  MKO10117504_B_Smim20
  gRNA
aaaucgagcugguauugucc

SEQ ID NO: 117505 - RNA, 20 nt, Artificial Sequence
  MKO10117505_B_Smim20
  gRNA
cagccucauuuccugccaaa

SEQ ID NO: 117506 - RNA, 20 nt, Artificial Sequence
  MKO10117506_B_Smim22
  gRNA
caaguuagcauuaagguucc

SEQ ID NO: 117507 - RNA, 20 nt, Artificial Sequence
  MKO10117507_B_Smim22
  gRNA
cucuugcaggaaaagcgcaa

SEQ ID NO: 117508 - RNA, 20 nt, Artificial Sequence
  MKO10117508_B_Smim22
  gRNA
ccuucccggggcucaccuuc

SEQ ID NO: 117509 - RNA, 20 nt, Artificial Sequence
  MKO10117509_B_Smim3
  gRNA
cgcuaucacccaauccccug

SEQ ID NO: 117510 - RNA, 20 nt, Artificial Sequence
  MKO10117510_B_Smim3
  gRNA
ggccauaguccucaucaucc

SEQ ID NO: 117511 - RNA, 20 nt, Artificial Sequence
  MKO10117511_B_Smim3
  gRNA
cgugcuucccaagcacaucc

SEQ ID NO: 117512 - RNA, 20 nt, Artificial Sequence
  MKO10117512_B_Smim5
  gRNA
cggcaggagcccuaccacca

SEQ ID NO: 117513 - RNA, 20 nt, Artificial Sequence
  MKO10117513_B_Smim5
  gRNA
gucagcuuagcagaugcccc

SEQ ID NO: 117514 - RNA, 20 nt, Artificial Sequence
  MKO10117514_B_Smim5
  gRNA
cuucucacucgggcaccucc

SEQ ID NO: 117515 - RNA, 20 nt, Artificial Sequence
  MKO10117515_B_Smim6
  gRNA
ugcuccuuggugguaccauu

SEQ ID NO: 117516 - RNA, 20 nt, Artificial Sequence
  MKO10117516_B_Smim6
  gRNA
gcauccagaaugaagacuuc

SEQ ID NO: 117517 - RNA, 20 nt, Artificial Sequence
  MKO10117517_B_Smim6
  gRNA
ucuuccagaagucuucauuc

SEQ ID NO: 117518 - RNA, 20 nt, Artificial Sequence
  MKO10117518_B_Smim7
  gRNA
uuuaaaguugagcacagccc

SEQ ID NO: 117519 - RNA, 20 nt, Artificial Sequence
  MKO10117519_B_Smim7
  gRNA
gaaucgaaggaacccagcac

SEQ ID NO: 117520 - RNA, 20 nt, Artificial Sequence
  MKO10117520_B_Smim7
  gRNA
aggaaaaagaaggacacaca

SEQ ID NO: 117521 - RNA, 20 nt, Artificial Sequence
  MKO10117521_B_Smim8
  gRNA
ccgaugcccuucacugucaa

SEQ ID NO: 117522 - RNA, 20 nt, Artificial Sequence
  MKO10117522_B_Smim8
  gRNA
uacggguuuaaugaagagcu

SEQ ID NO: 117523 - RNA, 20 nt, Artificial Sequence
  MKO10117523_B_Smim8
  gRNA
accaauccaaaagccaucac

SEQ ID NO: 117524 - RNA, 20 nt, Artificial Sequence
  MKO10117524_B_Smim9
  gRNA
agcucuugaagaaaucugac

SEQ ID NO: 117525 - RNA, 20 nt, Artificial Sequence
  MKO10117525_B_Smim9
  gRNA
caaugggaguauuugcuauu

SEQ ID NO: 117526 - RNA, 20 nt, Artificial Sequence
  MKO10117526_B_Smim9
  gRNA
aaaagagcaaaaauagcugc

SEQ ID NO: 117527 - RNA, 20 nt, Artificial Sequence
  MKO10117527_B_Smlr1
  gRNA
aucuucuugcaggaacuccc

SEQ ID NO: 117528 - RNA, 20 nt, Artificial Sequence
  MKO10117528_B_Smlr1
  gRNA
caucaguuugauccugaagu

SEQ ID NO: 117529 - RNA, 20 nt, Artificial Sequence
  MKO10117529_B_Smlr1
  gRNA
ucugaucgccagaacaaguu

SEQ ID NO: 117530 - RNA, 20 nt, Artificial Sequence
  MKO10117530_B_Smn1
  gRNA
ugcuuuacuucugagcgauc

SEQ ID NO: 117531 - RNA, 20 nt, Artificial Sequence
  MKO10117531_B_Smn1
  gRNA
ugccacaacucccuugaaac

SEQ ID NO: 117532 - RNA, 20 nt, Artificial Sequence
  MKO10117532_B_Smn1
  gRNA
caaucuaucaccuguuucaa

SEQ ID NO: 117533 - RNA, 20 nt, Artificial Sequence
  MKO10117533_B_Smndc1
  gRNA
auacauccaaguacaauguc

SEQ ID NO: 117534 - RNA, 20 nt, Artificial Sequence
  MKO10117534_B_Smndc1
  gRNA
caaaugccugacauuguacu

SEQ ID NO: 117535 - RNA, 20 nt, Artificial Sequence
  MKO10117535_B_Smndc1
  gRNA
gcguacuccaagaacaagaa

SEQ ID NO: 117536 - RNA, 20 nt, Artificial Sequence
  MKO10117536_B_Smoc1
  gRNA
agcaguacccuguguacgua

SEQ ID NO: 117537 - RNA, 20 nt, Artificial Sequence
  MKO10117537_B_Smoc1
  gRNA
gugcagugccauacguacac

SEQ ID NO: 117538 - RNA, 20 nt, Artificial Sequence
  MKO10117538_B_Smoc1
  gRNA
gccggcggccaccgcaccac

SEQ ID NO: 117539 - RNA, 20 nt, Artificial Sequence
  MKO10117539_B_Smoc2
  gRNA
gcuggaacucacaucgggac

SEQ ID NO: 117540 - RNA, 20 nt, Artificial Sequence
  MKO10117540_B_Smoc2
  gRNA
guccagugucacagcuacac

SEQ ID NO: 117541 - RNA, 20 nt, Artificial Sequence
  MKO10117541_B_Smoc2
  gRNA
ugccgcagcgggaaggagca

SEQ ID NO: 117542 - RNA, 20 nt, Artificial Sequence
  MKO10117542_B_Smok2a
  gRNA
cugucauuaaaagaguaauc

SEQ ID NO: 117543 - RNA, 20 nt, Artificial Sequence
  MKO10117543_B_Smok2a
  gRNA
cuuggcauccaagugaagcc

SEQ ID NO: 117544 - RNA, 20 nt, Artificial Sequence
  MKO10117544_B_Smok2a
  gRNA
auuguggguguuauguuaau

SEQ ID NO: 117545 - RNA, 20 nt, Artificial Sequence
  MKO10117545_B_Smok2b
  gRNA
agaagccccucugccuaucc

SEQ ID NO: 117546 - RNA, 20 nt, Artificial Sequence
  MKO10117546_B_Smok2b
  gRNA
uagauacaaugaaauugcaa

SEQ ID NO: 117547 - RNA, 20 nt, Artificial Sequence
  MKO10117547_B_Smok2b
  gRNA
gucugauuaugacccuggau

SEQ ID NO: 117548 - RNA, 20 nt, Artificial Sequence
  MKO10117548_B_Smok3a
  gRNA
guagcaguaucaacaaggga

SEQ ID NO: 117549 - RNA, 20 nt, Artificial Sequence
  MKO10117549_B_Smok3a
  gRNA
aguucacagggaccugaaac

SEQ ID NO: 117550 - RNA, 20 nt, Artificial Sequence
  MKO10117550_B_Smok3a
  gRNA
uggggucaccgauggguuca

SEQ ID NO: 117551 - RNA, 20 nt, Artificial Sequence
  MKO10117551_B_Smok3b
  gRNA
guagcaguaucaacaaggga

SEQ ID NO: 117552 - RNA, 20 nt, Artificial Sequence
  MKO10117552_B_Smok3b
  gRNA
aguucacagggaccugaaac

SEQ ID NO: 117553 - RNA, 20 nt, Artificial Sequence
  MKO10117553_B_Smok3b
  gRNA
uggggucaccgauggguuca

SEQ ID NO: 117554 - RNA, 20 nt, Artificial Sequence
  MKO10117554_B_Smox
  gRNA
ggaguaguacuugcggugug

SEQ ID NO: 117555 - RNA, 20 nt, Artificial Sequence
  MKO10117555_B_Smox
  gRNA
cuccguaggccacgacugag

SEQ ID NO: 117556 - RNA, 20 nt, Artificial Sequence
  MKO10117556_B_Smox
  gRNA
cauggcgagcuucaggcgcu

SEQ ID NO: 117557 - RNA, 20 nt, Artificial Sequence
  MKO10117557_B_Smo
  gRNA
guuccgccagucagccacaa

SEQ ID NO: 117558 - RNA, 20 nt, Artificial Sequence
  MKO10117558_B_Smo
  gRNA
ugacuuucugcguugcacac

SEQ ID NO: 117559 - RNA, 20 nt, Artificial Sequence
  MKO10117559_B_Smo
  gRNA
acuccccuuuguccucacgg

SEQ ID NO: 117560 - RNA, 20 nt, Artificial Sequence
  MKO10117560_B_Smpd1
  gRNA
accacuagcuguagccuucc

SEQ ID NO: 117561 - RNA, 20 nt, Artificial Sequence
  MKO10117561_B_Smpd1
  gRNA
aucaacuccacagauccugc

SEQ ID NO: 117562 - RNA, 20 nt, Artificial Sequence
  MKO10117562_B_Smpd1
  gRNA
cuucaggcugcugagaaucg

SEQ ID NO: 117563 - RNA, 20 nt, Artificial Sequence
  MKO10117563_B_Smpd2
  gRNA
cuucugaaguagugugcauc

SEQ ID NO: 117564 - RNA, 20 nt, Artificial Sequence
  MKO10117564_B_Smpd2
  gRNA
ugagcaccaguccacuuaga

SEQ ID NO: 117565 - RNA, 20 nt, Artificial Sequence
  MKO10117565_B_Smpd2
  gRNA
cccacucacaugagucacgu

SEQ ID NO: 117566 - RNA, 20 nt, Artificial Sequence
  MKO10117566_B_Smpd3
  gRNA
gccuaccugguggggcaugc

SEQ ID NO: 117567 - RNA, 20 nt, Artificial Sequence
  MKO10117567_B_Smpd3
  gRNA
gugguguuugacgucaucug

SEQ ID NO: 117568 - RNA, 20 nt, Artificial Sequence
  MKO10117568_B_Smpd3
  gRNA
uacaaagaccccugccgccu

SEQ ID NO: 117569 - RNA, 20 nt, Artificial Sequence
  MKO10117569_B_Smpd4
  gRNA
cagugguccaaugaugaagu

SEQ ID NO: 117570 - RNA, 20 nt, Artificial Sequence
  MKO10117570_B_Smpd4
  gRNA
caaugacuuucaccaaaucu

SEQ ID NO: 117571 - RNA, 20 nt, Artificial Sequence
  MKO10117571_B_Smpd4
  gRNA
uuauaaaccaacuucaucau

SEQ ID NO: 117572 - RNA, 20 nt, Artificial Sequence
  MKO10117572_B_Smpd5
  gRNA
acucaccuccgaagcaucuc

SEQ ID NO: 117573 - RNA, 20 nt, Artificial Sequence
  MKO10117573_B_Smpd5
  gRNA
gcaggcgcagcuaggcaucg

SEQ ID NO: 117574 - RNA, 20 nt, Artificial Sequence
  MKO10117574_B_Smpd5
  gRNA
uguagccuucagcguccucc

SEQ ID NO: 117575 - RNA, 20 nt, Artificial Sequence
  MKO10117575_B_Smpdl3a
  gRNA
ggcgcaaaugccuccaaccc

SEQ ID NO: 117576 - RNA, 20 nt, Artificial Sequence
  MKO10117576_B_Smpdl3a
  gRNA
cagaaaguugcaaguaaucc

SEQ ID NO: 117577 - RNA, 20 nt, Artificial Sequence
  MKO10117577_B_Smpdl3a
  gRNA
ccaguaccugaacucuccac

SEQ ID NO: 117578 - RNA, 20 nt, Artificial Sequence
  MKO10117578_B_Smpdl3b
  gRNA
caucccgagaugcauugcuc

SEQ ID NO: 117579 - RNA, 20 nt, Artificial Sequence
  MKO10117579_B_Smpdl3b
  gRNA
acgcuugaccaaccucauca

SEQ ID NO: 117580 - RNA, 20 nt, Artificial Sequence
  MKO10117580_B_Smpdl3b
  gRNA
gagcaaccgcaucuauaacc

SEQ ID NO: 117581 - RNA, 20 nt, Artificial Sequence
  MKO10117581_B_Smpx
  gRNA
uuucgacuacuguucaccuu

SEQ ID NO: 117582 - RNA, 20 nt, Artificial Sequence
  MKO10117582_B_Smpx
  gRNA
aucucagacaaguugacaac

SEQ ID NO: 117583 - RNA, 20 nt, Artificial Sequence
  MKO10117583_B_Smpx
  gRNA
uuccaacgucagagccaucc

SEQ ID NO: 117584 - RNA, 20 nt, Artificial Sequence
  MKO10117584_B_Smr2
  gRNA
aacauccuauaagaacccag

SEQ ID NO: 117585 - RNA, 20 nt, Artificial Sequence
  MKO10117585_B_Smr2
  gRNA
ucuggacguauuaguauaua

SEQ ID NO: 117586 - RNA, 20 nt, Artificial Sequence
  MKO10117586_B_Smr2
  gRNA
ucaaaagcuaucaguagaau

SEQ ID NO: 117587 - RNA, 20 nt, Artificial Sequence
  MKO10117587_B_Smr3a
  gRNA
uuaggccucugcauucuugu

SEQ ID NO: 117588 - RNA, 20 nt, Artificial Sequence
  MKO10117588_B_Smr3a
  gRNA
gguccgguaggaggaaugcu

SEQ ID NO: 117589 - RNA, 20 nt, Artificial Sequence
  MKO10117589_B_Smr3a
  gRNA
acuccaagcauuccuccuac

SEQ ID NO: 117590 - RNA, 20 nt, Artificial Sequence
  MKO10117590_B_Sms
  gRNA
uguaaguugcuaaauaucca

SEQ ID NO: 117591 - RNA, 20 nt, Artificial Sequence
  MKO10117591_B_Sms
  gRNA
aauuugcgaauuuauccaca

SEQ ID NO: 117592 - RNA, 20 nt, Artificial Sequence
  MKO10117592_B_Sms
  gRNA
caucacugucguaacucuga

SEQ ID NO: 117593 - RNA, 20 nt, Artificial Sequence
  MKO10117593_B_Smtnl1
  gRNA
cccgccaaauuuguccauga

SEQ ID NO: 117594 - RNA, 20 nt, Artificial Sequence
  MKO10117594_B_Smtnl1
  gRNA
acuuuaccuggcugaaggac

SEQ ID NO: 117595 - RNA, 20 nt, Artificial Sequence
  MKO10117595_B_Smtnl1
  gRNA
gcccgaaagccccacagaug

SEQ ID NO: 117596 - RNA, 20 nt, Artificial Sequence
  MKO10117596_B_Smtnl2
  gRNA
cgaggggccugagucauagc

SEQ ID NO: 117597 - RNA, 20 nt, Artificial Sequence
  MKO10117597_B_Smtnl2
  gRNA
agugacggcuggcaaacgca

SEQ ID NO: 117598 - RNA, 20 nt, Artificial Sequence
  MKO10117598_B_Smtnl2
  gRNA
caagggcugauggccucacu

SEQ ID NO: 117599 - RNA, 20 nt, Artificial Sequence
  MKO10117599_B_Smtn
  gRNA
cacccacagcuucggagugc

SEQ ID NO: 117600 - RNA, 20 nt, Artificial Sequence
  MKO10117600_B_Smtn
  gRNA
ggaguccaugaaugaugucg

SEQ ID NO: 117601 - RNA, 20 nt, Artificial Sequence
  MKO10117601_B_Smtn
  gRNA
ggcggauccgcucagccauc

SEQ ID NO: 117602 - RNA, 20 nt, Artificial Sequence
  MKO10117602_B_Smu1
  gRNA
augaccaucgauuuguuucg

SEQ ID NO: 117603 - RNA, 20 nt, Artificial Sequence
  MKO10117603_B_Smu1
  gRNA
gaacaguuuacaucgggcac

SEQ ID NO: 117604 - RNA, 20 nt, Artificial Sequence
  MKO10117604_B_Smu1
  gRNA
ucaaguacugcaugauuagu

SEQ ID NO: 117605 - RNA, 20 nt, Artificial Sequence
  MKO10117605_B_Smug1
  gRNA
aguagcgagucacauaguua

SEQ ID NO: 117606 - RNA, 20 nt, Artificial Sequence
  MKO10117606_B_Smug1
  gRNA
gcaccccaagcgaccagugu

SEQ ID NO: 117607 - RNA, 20 nt, Artificial Sequence
  MKO10117607_B_Smug1
  gRNA
aagugaaugugguccgggac

SEQ ID NO: 117608 - RNA, 20 nt, Artificial Sequence
  MKO10117608_B_Smurf1
  gRNA
ccccuuugccaagauuguug

SEQ ID NO: 117609 - RNA, 20 nt, Artificial Sequence
  MKO10117609_B_Smurf1
  gRNA
acucgauaaccaucagugug

SEQ ID NO: 117610 - RNA, 20 nt, Artificial Sequence
  MKO10117610_B_Smurf1
  gRNA
agccagcccccugcuucuug

SEQ ID NO: 117611 - RNA, 20 nt, Artificial Sequence
  MKO10117611_B_Smurf2
  gRNA
aaugacaaugauacaguucg

SEQ ID NO: 117612 - RNA, 20 nt, Artificial Sequence
  MKO10117612_B_Smurf2
  gRNA
aguacucugugcaaaaaacu

SEQ ID NO: 117613 - RNA, 20 nt, Artificial Sequence
  MKO10117613_B_Smurf2
  gRNA
cgaacuguaucauugucauu

SEQ ID NO: 117614 - RNA, 20 nt, Artificial Sequence
  MKO10117614_B_Smyd1
  gRNA
acuugcacugcccgcagcga

SEQ ID NO: 117615 - RNA, 20 nt, Artificial Sequence
  MKO10117615_B_Smyd1
  gRNA
gccuggugaaccaugauugc

SEQ ID NO: 117616 - RNA, 20 nt, Artificial Sequence
  MKO10117616_B_Smyd1
  gRNA
cguggaggucuucacuuccg

SEQ ID NO: 117617 - RNA, 20 nt, Artificial Sequence
  MKO10117617_B_Smyd2
  gRNA
gcggcucacagcaagaauuc

SEQ ID NO: 117618 - RNA, 20 nt, Artificial Sequence
  MKO10117618_B_Smyd2
  gRNA
ggagagcggcgaugucacuc

SEQ ID NO: 117619 - RNA, 20 nt, Artificial Sequence
  MKO10117619_B_Smyd2
  gRNA
acagccaacaauuucucuga

SEQ ID NO: 117620 - RNA, 20 nt, Artificial Sequence
  MKO10117620_B_Smyd3
  gRNA
aagucauugcaaguugccuc

SEQ ID NO: 117621 - RNA, 20 nt, Artificial Sequence
  MKO10117621_B_Smyd3
  gRNA
auacugcagugccaaguguc

SEQ ID NO: 117622 - RNA, 20 nt, Artificial Sequence
  MKO10117622_B_Smyd3
  gRNA
auaaaguuucucugacucug

SEQ ID NO: 117623 - RNA, 20 nt, Artificial Sequence
  MKO10117623_B_Smyd4
  gRNA
cucugcagcgcucuuccauc

SEQ ID NO: 117624 - RNA, 20 nt, Artificial Sequence
  MKO10117624_B_Smyd4
  gRNA
aaggcguaucugccugcugu

SEQ ID NO: 117625 - RNA, 20 nt, Artificial Sequence
  MKO10117625_B_Smyd4
  gRNA
caggagauucugcacugcua

SEQ ID NO: 117626 - RNA, 20 nt, Artificial Sequence
  MKO10117626_B_Smyd5
  gRNA
ggaaugcacuuuaucaguac

SEQ ID NO: 117627 - RNA, 20 nt, Artificial Sequence
  MKO10117627_B_Smyd5
  gRNA
gcacccccucaauaagcugc

SEQ ID NO: 117628 - RNA, 20 nt, Artificial Sequence
  MKO10117628_B_Smyd5
  gRNA
uuacgcacacugcauagcuc

SEQ ID NO: 117629 - RNA, 20 nt, Artificial Sequence
  MKO10117629_B_Snai1
  gRNA
gguaucucuucacauccgag

SEQ ID NO: 117630 - RNA, 20 nt, Artificial Sequence
  MKO10117630_B_Snai1
  gRNA
ggucggacggcuuccugacc

SEQ ID NO: 117631 - RNA, 20 nt, Artificial Sequence
  MKO10117631_B_Snai1
  gRNA
cagcaaaagcacgguugcag

SEQ ID NO: 117632 - RNA, 20 nt, Artificial Sequence
  MKO10117632_B_Snai2
  gRNA
ggguucgaaugugcaucuuc

SEQ ID NO: 117633 - RNA, 20 nt, Artificial Sequence
  MKO10117633_B_Snai2
  gRNA
gcaaaagcccuauugcagug

SEQ ID NO: 117634 - RNA, 20 nt, Artificial Sequence
  MKO10117634_B_Snai2
  gRNA
uguguccaguucgcuguagu

SEQ ID NO: 117635 - RNA, 20 nt, Artificial Sequence
  MKO10117635_B_Snai3
  gRNA
caggugcgccgugugcccca

SEQ ID NO: 117636 - RNA, 20 nt, Artificial Sequence
  MKO10117636_B_Snai3
  gRNA
ugaaaacgcacuccagucac

SEQ ID NO: 117637 - RNA, 20 nt, Artificial Sequence
  MKO10117637_B_Snai3
  gRNA
ugucuccaguuucccguagu

SEQ ID NO: 117638 - RNA, 20 nt, Artificial Sequence
  MKO10117638_B_Snap23
  gRNA
gcccgcagcugaacuuccuc

SEQ ID NO: 117639 - RNA, 20 nt, Artificial Sequence
  MKO10117639_B_Snap23
  gRNA
caucaacuuaccuauuacaa

SEQ ID NO: 117640 - RNA, 20 nt, Artificial Sequence
  MKO10117640_B_Snap23
  gRNA
caacuaaaucgcauagaaga

SEQ ID NO: 117641 - RNA, 20 nt, Artificial Sequence
  MKO10117641_B_Snap25
  gRNA
agaacaacuggaacgcauug

SEQ ID NO: 117642 - RNA, 20 nt, Artificial Sequence
  MKO10117642_B_Snap25
  gRNA
gcggaugaagccaccacuga

SEQ ID NO: 117643 - RNA, 20 nt, Artificial Sequence
  MKO10117643_B_Snap25
  gRNA
agggauggaccaaaucaaua

SEQ ID NO: 117644 - RNA, 20 nt, Artificial Sequence
  MKO10117644_B_Snap29
  gRNA
cuagguugcugucaaucuuc

SEQ ID NO: 117645 - RNA, 20 nt, Artificial Sequence
  MKO10117645_B_Snap29
  gRNA
ucgucucccagcccaacagc

SEQ ID NO: 117646 - RNA, 20 nt, Artificial Sequence
  MKO10117646_B_Snap29
  gRNA
gcacucaccugcuguugggc

SEQ ID NO: 117647 - RNA, 20 nt, Artificial Sequence
  MKO10117647_B_Snap47
  gRNA
acaucagcuuucucauacgc

SEQ ID NO: 117648 - RNA, 20 nt, Artificial Sequence
  MKO10117648_B_Snap47
  gRNA
uguuccagcauccagaccga

SEQ ID NO: 117649 - RNA, 20 nt, Artificial Sequence
  MKO10117649_B_Snap47
  gRNA
cuggcuucccaaugaagcgc

SEQ ID NO: 117650 - RNA, 20 nt, Artificial Sequence
  MKO10117650_B_Snap91
  gRNA
gggcuacaggcaucgcggcc

SEQ ID NO: 117651 - RNA, 20 nt, Artificial Sequence
  MKO10117651_B_Snap91
  gRNA
uguuugucgcccgcucaaag

SEQ ID NO: 117652 - RNA, 20 nt, Artificial Sequence
  MKO10117652_B_Snap91
  gRNA
auugaauagcguauuccuag

SEQ ID NO: 117653 - RNA, 20 nt, Artificial Sequence
  MKO10117653_B_Snapc1
  gRNA
guagauccgaguugccuuga

SEQ ID NO: 117654 - RNA, 20 nt, Artificial Sequence
  MKO10117654_B_Snapc1
  gRNA
aguuucauuacacgaucauu

SEQ ID NO: 117655 - RNA, 20 nt, Artificial Sequence
  MKO10117655_B_Snapc1
  gRNA
uaucacuucugauguauuag

SEQ ID NO: 117656 - RNA, 20 nt, Artificial Sequence
  MKO10117656_B_Snapc2
  gRNA
ccacccggcccuugagcugc

SEQ ID NO: 117657 - RNA, 20 nt, Artificial Sequence
  MKO10117657_B_Snapc2
  gRNA
accccugggccucgugagcc

SEQ ID NO: 117658 - RNA, 20 nt, Artificial Sequence
  MKO10117658_B_Snapc2
  gRNA
ggcaagcccacaaaggcccg

SEQ ID NO: 117659 - RNA, 20 nt, Artificial Sequence
  MKO10117659_B_Snapc3
  gRNA
cugaccuuauuaaauauaac

SEQ ID NO: 117660 - RNA, 20 nt, Artificial Sequence
  MKO10117660_B_Snapc3
  gRNA
cuccaggaaucucaugcacu

SEQ ID NO: 117661 - RNA, 20 nt, Artificial Sequence
  MKO10117661_B_Snapc3
  gRNA
ugugucagugaccuccagau

SEQ ID NO: 117662 - RNA, 20 nt, Artificial Sequence
  MKO10117662_B_Snapc4
  gRNA
gagauccuguuugaucuguc

SEQ ID NO: 117663 - RNA, 20 nt, Artificial Sequence
  MKO10117663_B_Snapc4
  gRNA
gaccugucugcagcuaaaua

SEQ ID NO: 117664 - RNA, 20 nt, Artificial Sequence
  MKO10117664_B_Snapc4
  gRNA
gcaguuuccaaguccucauc

SEQ ID NO: 117665 - RNA, 20 nt, Artificial Sequence
  MKO10117665_B_Snapc5
  gRNA
caauccaugauaaauucucg

SEQ ID NO: 117666 - RNA, 20 nt, Artificial Sequence
  MKO10117666_B_Snapc5
  gRNA
ucacuucguugucuacaugu

SEQ ID NO: 117667 - RNA, 20 nt, Artificial Sequence
  MKO10117667_B_Snapc5
  gRNA
cuacacugaagcugagcaca

SEQ ID NO: 117668 - RNA, 20 nt, Artificial Sequence
  MKO10117668_B_Snapin
  gRNA
agaacugugccggaucaaug

SEQ ID NO: 117669 - RNA, 20 nt, Artificial Sequence
  MKO10117669_B_Snapin
  gRNA
guuaaaccacagcguggcca

SEQ ID NO: 117670 - RNA, 20 nt, Artificial Sequence
  MKO10117670_B_Snapin
  gRNA
cugucuuacaggaacgacua

SEQ ID NO: 117671 - RNA, 20 nt, Artificial Sequence
  MKO10117671_B_Sncaip
  gRNA
agccccugaauaccuugauu

SEQ ID NO: 117672 - RNA, 20 nt, Artificial Sequence
  MKO10117672_B_Sncaip
  gRNA
agucgauuucauccaaauca

SEQ ID NO: 117673 - RNA, 20 nt, Artificial Sequence
  MKO10117673_B_Sncaip
  gRNA
guuacacauugcugcaucaa

SEQ ID NO: 117674 - RNA, 20 nt, Artificial Sequence
  MKO10117674_B_Snca
  gRNA
ggcuuaugaaaugccuucag

SEQ ID NO: 117675 - RNA, 20 nt, Artificial Sequence
  MKO10117675_B_Snca
  gRNA
uucuuuagguuccaaaacua

SEQ ID NO: 117676 - RNA, 20 nt, Artificial Sequence
  MKO10117676_B_Snca
  gRNA
aauccuggaagacaugccug

SEQ ID NO: 117677 - RNA, 20 nt, Artificial Sequence
  MKO10117677_B_Sncb
  gRNA
gcuucuugggccaccuccuc

SEQ ID NO: 117678 - RNA, 20 nt, Artificial Sequence
  MKO10117678_B_Sncb
  gRNA
uacaccuuguaccacuccac

SEQ ID NO: 117679 - RNA, 20 nt, Artificial Sequence
  MKO10117679_B_Sncb
  gRNA
uccucauaacuuuccccuuc

SEQ ID NO: 117680 - RNA, 20 nt, Artificial Sequence
  MKO10117680_B_Sncg
  gRNA
acuuuguaccacguucuccu

SEQ ID NO: 117681 - RNA, 20 nt, Artificial Sequence
  MKO10117681_B_Sncg
  gRNA
gugguacaaagugucaccuc

SEQ ID NO: 117682 - RNA, 20 nt, Artificial Sequence
  MKO10117682_B_Sncg
  gRNA
cuucuagucuucuccacucu

SEQ ID NO: 117683 - RNA, 20 nt, Artificial Sequence
  MKO10117683_B_Snd1
  gRNA
uuguguggcagcugcccgac

SEQ ID NO: 117684 - RNA, 20 nt, Artificial Sequence
  MKO10117684_B_Snd1
  gRNA
ucccaaucagcuucuugcga

SEQ ID NO: 117685 - RNA, 20 nt, Artificial Sequence
  MKO10117685_B_Snd1
  gRNA
ucaucccauacucucguccc

SEQ ID NO: 117686 - RNA, 20 nt, Artificial Sequence
  MKO10117686_B_Sned1
  gRNA
caucgccaaagaccgcugug

SEQ ID NO: 117687 - RNA, 20 nt, Artificial Sequence
  MKO10117687_B_Sned1
  gRNA
caaacuguacucaucaccga

SEQ ID NO: 117688 - RNA, 20 nt, Artificial Sequence
  MKO10117688_B_Sned1
  gRNA
ugugccgguaguccacaaga

SEQ ID NO: 117689 - RNA, 20 nt, Artificial Sequence
  MKO10117689_B_Snf8
  gRNA
ugucugacaggccaaguaua

SEQ ID NO: 117690 - RNA, 20 nt, Artificial Sequence
  MKO10117690_B_Snf8
  gRNA
auaacagaugucaaaacagc

SEQ ID NO: 117691 - RNA, 20 nt, Artificial Sequence
  MKO10117691_B_Snf8
  gRNA
gcaagcacaagcaagagauc

SEQ ID NO: 117692 - RNA, 20 nt, Artificial Sequence
  MKO10117692_B_Snhg11
  gRNA
ggaugacgacgcaaaaccug

SEQ ID NO: 117693 - RNA, 20 nt, Artificial Sequence
  MKO10117693_B_Snhg11
  gRNA
uuauugcagaauugacagcu

SEQ ID NO: 117694 - RNA, 20 nt, Artificial Sequence
  MKO10117694_B_Snhg11
  gRNA
auccuaccuugggagcgcug

SEQ ID NO: 117695 - RNA, 20 nt, Artificial Sequence
  MKO10117695_B_Snip1
  gRNA
cucggaacagugagcgagac

SEQ ID NO: 117696 - RNA, 20 nt, Artificial Sequence
  MKO10117696_B_Snip1
  gRNA
gacgagaggaucggcagcac

SEQ ID NO: 117697 - RNA, 20 nt, Artificial Sequence
  MKO10117697_B_Snip1
  gRNA
gaccaaccgugccgucagca

SEQ ID NO: 117698 - RNA, 20 nt, Artificial Sequence
  MKO10117698_B_Snn
  gRNA
agaguacugcaccaguagaa

SEQ ID NO: 117699 - RNA, 20 nt, Artificial Sequence
  MKO10117699_B_Snn
  gRNA
ccucaucgccauagcugccc

SEQ ID NO: 117700 - RNA, 20 nt, Artificial Sequence
  MKO10117700_B_Snn
  gRNA
agcacugaccaugucuauua

SEQ ID NO: 117701 - RNA, 20 nt, Artificial Sequence
  MKO10117701_B_Snph
  gRNA
agaaacucaccugcgagauc

SEQ ID NO: 117702 - RNA, 20 nt, Artificial Sequence
  MKO10117702_B_Snph
  gRNA
uaggcgucccgcacacucac

SEQ ID NO: 117703 - RNA, 20 nt, Artificial Sequence
  MKO10117703_B_Snph
  gRNA
acacuaugcagcgacaauca

SEQ ID NO: 117704 - RNA, 20 nt, Artificial Sequence
  MKO10117704_B_Snrk
  gRNA
ucuguagcauucgugugauc

SEQ ID NO: 117705 - RNA, 20 nt, Artificial Sequence
  MKO10117705_B_Snrk
  gRNA
gguaaugugguuguaccugu

SEQ ID NO: 117706 - RNA, 20 nt, Artificial Sequence
  MKO10117706_B_Snrk
  gRNA
ucucgcugucguuggcuucu

SEQ ID NO: 117707 - RNA, 20 nt, Artificial Sequence
  MKO10117707_B_Snrnp200
  gRNA
acgggagauugaccugcugc

SEQ ID NO: 117708 - RNA, 20 nt, Artificial Sequence
  MKO10117708_B_Snrnp200
  gRNA
ucucgggucuccuucgucuu

SEQ ID NO: 117709 - RNA, 20 nt, Artificial Sequence
  MKO10117709_B_Snrnp200
  gRNA
caucuacaagccuaagacga

SEQ ID NO: 117710 - RNA, 20 nt, Artificial Sequence
  MKO10117710_B_Snrnp25
  gRNA
ucccuagguuacucuagaag

SEQ ID NO: 117711 - RNA, 20 nt, Artificial Sequence
  MKO10117711_B_Snrnp25
  gRNA
gacuguccgugugugcaaga

SEQ ID NO: 117712 - RNA, 20 nt, Artificial Sequence
  MKO10117712_B_Snrnp25
  gRNA
cuccuugcagguccuaugua

SEQ ID NO: 117713 - RNA, 20 nt, Artificial Sequence
  MKO10117713_B_Snrnp27
  gRNA
ccaucaacgugucucaaaag

SEQ ID NO: 117714 - RNA, 20 nt, Artificial Sequence
  MKO10117714_B_Snrnp27
  gRNA
cuccaggggaagaagguaga

SEQ ID NO: 117715 - RNA, 20 nt, Artificial Sequence
  MKO10117715_B_Snrnp27
  gRNA
aagaaauaaagaacaaagaa

SEQ ID NO: 117716 - RNA, 20 nt, Artificial Sequence
  MKO10117716_B_Snrnp35
  gRNA
ccugucaugaucccguuccc

SEQ ID NO: 117717 - RNA, 20 nt, Artificial Sequence
  MKO10117717_B_Snrnp35
  gRNA
auggugacauucggcggcug

SEQ ID NO: 117718 - RNA, 20 nt, Artificial Sequence
  MKO10117718_B_Snrnp35
  gRNA
gggucaaaagccgggacaag

SEQ ID NO: 117719 - RNA, 20 nt, Artificial Sequence
  MKO10117719_B_Snrnp40
  gRNA
acaguguuguggaacgucua

SEQ ID NO: 117720 - RNA, 20 nt, Artificial Sequence
  MKO10117720_B_Snrnp40
  gRNA
agcgucgacagacaaaacug

SEQ ID NO: 117721 - RNA, 20 nt, Artificial Sequence
  MKO10117721_B_Snrnp40
  gRNA
cuuugguuuagggaccgccc

SEQ ID NO: 117722 - RNA, 20 nt, Artificial Sequence
  MKO10117722_B_Snrnp48
  gRNA
augcgaugauuggaaucaua

SEQ ID NO: 117723 - RNA, 20 nt, Artificial Sequence
  MKO10117723_B_Snrnp48
  gRNA
gugcuuuguuagugaugauu

SEQ ID NO: 117724 - RNA, 20 nt, Artificial Sequence
  MKO10117724_B_Snrnp48
  gRNA
uccagauaauuaaacaagcu

SEQ ID NO: 117725 - RNA, 20 nt, Artificial Sequence
  MKO10117725_B_Snrnp70
  gRNA
acacaacagaaucuaagcuu

SEQ ID NO: 117726 - RNA, 20 nt, Artificial Sequence
  MKO10117726_B_Snrnp70
  gRNA
agagacgggaaaaaauugaa

SEQ ID NO: 117727 - RNA, 20 nt, Artificial Sequence
  MKO10117727_B_Snrnp70
  gRNA
cuccaacaagagcagaaacc

SEQ ID NO: 117728 - RNA, 20 nt, Artificial Sequence
  MKO10117728_B_Snrpa1
  gRNA
caguuccacuagacuguugu

SEQ ID NO: 117729 - RNA, 20 nt, Artificial Sequence
  MKO10117729_B_Snrpa1
  gRNA
gaggaugagcucugucagac

SEQ ID NO: 117730 - RNA, 20 nt, Artificial Sequence
  MKO10117730_B_Snrpa1
  gRNA
aaguccaguacucugacuug

SEQ ID NO: 117731 - RNA, 20 nt, Artificial Sequence
  MKO10117731_B_Snrpa
  gRNA
ggguggggcagcugcgcccg

SEQ ID NO: 117732 - RNA, 20 nt, Artificial Sequence
  MKO10117732_B_Snrpa
  gRNA
cacuuacugguugaagagca

SEQ ID NO: 117733 - RNA, 20 nt, Artificial Sequence
  MKO10117733_B_Snrpa
  gRNA
cccuuucuacgacaagccca

SEQ ID NO: 117734 - RNA, 20 nt, Artificial Sequence
  MKO10117734_B_Snrpb2
  gRNA
auuucuuaauaacuuaccag

SEQ ID NO: 117735 - RNA, 20 nt, Artificial Sequence
  MKO10117735_B_Snrpb2
  gRNA
accauugguuuaccauaaaa

SEQ ID NO: 117736 - RNA, 20 nt, Artificial Sequence
  MKO10117736_B_Snrpb2
  gRNA
uaacugucucaaagcauuug

SEQ ID NO: 117737 - RNA, 20 nt, Artificial Sequence
  MKO10117737_B_Snrpb
  gRNA
auugcccgagugccacuugc

SEQ ID NO: 117738 - RNA, 20 nt, Artificial Sequence
  MKO10117738_B_Snrpb
  gRNA
ccucggcccauagguggagg

SEQ ID NO: 117739 - RNA, 20 nt, Artificial Sequence
  MKO10117739_B_Snrpb
  gRNA
cgaccagguggguacugagu

SEQ ID NO: 117740 - RNA, 20 nt, Artificial Sequence
  MKO10117740_B_Snrpc
  gRNA
uuccgacuuaccugguccca

SEQ ID NO: 117741 - RNA, 20 nt, Artificial Sequence
  MKO10117741_B_Snrpc
  gRNA
uaagcggcugcauuucaaca

SEQ ID NO: 117742 - RNA, 20 nt, Artificial Sequence
  MKO10117742_B_Snrpc
  gRNA
ugaaagacuauuaucagaaa

SEQ ID NO: 117743 - RNA, 20 nt, Artificial Sequence
  MKO10117743_B_Snrpd1
  gRNA
cuuucucuaguugcaggaag

SEQ ID NO: 117744 - RNA, 20 nt, Artificial Sequence
  MKO10117744_B_Snrpd1
  gRNA
cguggucguggcagaggaag

SEQ ID NO: 117745 - RNA, 20 nt, Artificial Sequence
  MKO10117745_B_Snrpd1
  gRNA
aagucuaagaaaagagaagc

SEQ ID NO: 117746 - RNA, 20 nt, Artificial Sequence
  MKO10117746_B_Snrpd2
  gRNA
caagagugagaugaccccag

SEQ ID NO: 117747 - RNA, 20 nt, Artificial Sequence
  MKO10117747_B_Snrpd2
  gRNA
ccgacugcgugagcacugag

SEQ ID NO: 117748 - RNA, 20 nt, Artificial Sequence
  MKO10117748_B_Snrpd2
  gRNA
gcugcagaagcgggaggagg

SEQ ID NO: 117749 - RNA, 20 nt, Artificial Sequence
  MKO10117749_B_Snrpd3
  gRNA
cccacguccucucccucgug

SEQ ID NO: 117750 - RNA, 20 nt, Artificial Sequence
  MKO10117750_B_Snrpd3
  gRNA
ucgaguggcacagcuggaac

SEQ ID NO: 117751 - RNA, 20 nt, Artificial Sequence
  MKO10117751_B_Snrpd3
  gRNA
gguaccuaccuugggccuuc

SEQ ID NO: 117752 - RNA, 20 nt, Artificial Sequence
  MKO10117752_B_Snrpe
  gRNA
uuugcaaguaucugaagaua

SEQ ID NO: 117753 - RNA, 20 nt, Artificial Sequence
  MKO10117753_B_Snrpe
  gRNA
uguaugaacaagugaauaug

SEQ ID NO: 117754 - RNA, 20 nt, Artificial Sequence
  MKO10117754_B_Snrpe
  gRNA
aacaaagucaagaaaacaac

SEQ ID NO: 117755 - RNA, 20 nt, Artificial Sequence
  MKO10117755_B_Snrpf
  gRNA
aucugggcgaaguucuaaua

SEQ ID NO: 117756 - RNA, 20 nt, Artificial Sequence
  MKO10117756_B_Snrpf
  gRNA
aauaauguccucuacaucag

SEQ ID NO: 117757 - RNA, 20 nt, Artificial Sequence
  MKO10117757_B_Snrpf
  gRNA
cuucaacgccucugauguag

SEQ ID NO: 117758 - RNA, 20 nt, Artificial Sequence
  MKO10117758_B_Snrpg
  gRNA
cacaggucagacucuuucca

SEQ ID NO: 117759 - RNA, 20 nt, Artificial Sequence
  MKO10117759_B_Snrpg
  gRNA
caucaucauguuagaagccu

SEQ ID NO: 117760 - RNA, 20 nt, Artificial Sequence
  MKO10117760_B_Snrpg
  gRNA
ccacacacucgucaaucaca

SEQ ID NO: 117761 - RNA, 20 nt, Artificial Sequence
  MKO10117761_B_Snrpn
  gRNA
aucuuccuuacaucuuuagg

SEQ ID NO: 117762 - RNA, 20 nt, Artificial Sequence
  MKO10117762_B_Snrpn
  gRNA
gcuggcagaggagugccagc

SEQ ID NO: 117763 - RNA, 20 nt, Artificial Sequence
  MKO10117763_B_Snrpn
  gRNA
gaacuugguuucaaugacug

SEQ ID NO: 117764 - RNA, 20 nt, Artificial Sequence
  MKO10117764_B_Snua1
  gRNA
caucuucaaagauacguguu

SEQ ID NO: 117765 - RNA, 20 nt, Artificial Sequence
  MKO10117765_B_Snua1
  gRNA
ugaaugugccgaucugcgcu

SEQ ID NO: 117766 - RNA, 20 nt, Artificial Sequence
  MKO10117766_B_Snua1
  gRNA
cagugcgggucggccugcuc

SEQ ID NO: 117767 - RNA, 20 nt, Artificial Sequence
  MKO10117767_B_Sntb1
  gRNA
agucgugagaucaggcaucu

SEQ ID NO: 117768 - RNA, 20 nt, Artificial Sequence
  MKO10117768_B_Sntb1
  gRNA
gcagagccacccccuaaucu

SEQ ID NO: 117769 - RNA, 20 nt, Artificial Sequence
  MKO10117769_B_Sntb1
  gRNA
cagugagcuccgcugaauug

SEQ ID NO: 117770 - RNA, 20 nt, Artificial Sequence
  MKO10117770_B_Sntb2
  gRNA
gguccuagguugguucauuc

SEQ ID NO: 117771 - RNA, 20 nt, Artificial Sequence
  MKO10117771_B_Sntb2
  gRNA
gcuaugacacggugaugccc

SEQ ID NO: 117772 - RNA, 20 nt, Artificial Sequence
  MKO10117772_B_Sntb2
  gRNA
cuuuaguaucagaucugcca

SEQ ID NO: 117773 - RNA, 20 nt, Artificial Sequence
  MKO10117773_B_Snug1
  gRNA
cagagaccuguugaugcuac

SEQ ID NO: 117774 - RNA, 20 nt, Artificial Sequence
  MKO10117774_B_Snug1
  gRNA
aggugcagaacauaacaucc

SEQ ID NO: 117775 - RNA, 20 nt, Artificial Sequence
  MKO10117775_B_Snug1
  gRNA
cucauucacagcagagcugu

SEQ ID NO: 117776 - RNA, 20 nt, Artificial Sequence
  MKO10117776_B_Snug2
  gRNA
cuaugaacaacaucucuguc

SEQ ID NO: 117777 - RNA, 20 nt, Artificial Sequence
  MKO10117777_B_Snug2
  gRNA
gaacucauaccuugauacuu

SEQ ID NO: 117778 - RNA, 20 nt, Artificial Sequence
  MKO10117778_B_Snug2
  gRNA
cagacagagauguuguucau

SEQ ID NO: 117779 - RNA, 20 nt, Artificial Sequence
  MKO10117779_B_Sntn
  gRNA
cuccucuugaguggagugcg

SEQ ID NO: 117780 - RNA, 20 nt, Artificial Sequence
  MKO10117780_B_Sntn
  gRNA
agccauugcuacuauugcuc

SEQ ID NO: 117781 - RNA, 20 nt, Artificial Sequence
  MKO10117781_B_Sntn
  gRNA
ucguagcagaucugacauga

SEQ ID NO: 117782 - RNA, 20 nt, Artificial Sequence
  MKO10117782_B_Snupn
  gRNA
acaagugccuacacuaagag

SEQ ID NO: 117783 - RNA, 20 nt, Artificial Sequence
  MKO10117783_B_Snupn
  gRNA
acaguagccacucuuagugu

SEQ ID NO: 117784 - RNA, 20 nt, Artificial Sequence
  MKO10117784_B_Snupn
  gRNA
aucuguagacuacaccauuc

SEQ ID NO: 117785 - RNA, 20 nt, Artificial Sequence
  MKO10117785_B_Snurf
  gRNA
auacugcuuuaaccaccucu

SEQ ID NO: 117786 - RNA, 20 nt, Artificial Sequence
  MKO10117786_B_Snurf
  gRNA
ucagcaacagcaaguuccug

SEQ ID NO: 117787 - RNA, 20 nt, Artificial Sequence
  MKO10117787_B_Snurf
  gRNA
cuguccuucgacguuugacc

SEQ ID NO: 117788 - RNA, 20 nt, Artificial Sequence
  MKO10117788_B_Snw1
  gRNA
acauuuaccucuaauagucu

SEQ ID NO: 117789 - RNA, 20 nt, Artificial Sequence
  MKO10117789_B_Snw1
  gRNA
cgaugaagaggcaauuaaag

SEQ ID NO: 117790 - RNA, 20 nt, Artificial Sequence
  MKO10117790_B_Snw1
  gRNA
uuacagcaaauacacugacc

SEQ ID NO: 117791 - RNA, 20 nt, Artificial Sequence
  MKO10117791_B_Snx10
  gRNA
ugcaggaguucgugaguguc

SEQ ID NO: 117792 - RNA, 20 nt, Artificial Sequence
  MKO10117792_B_Snx10
  gRNA
acguagaguaugauucagaa

SEQ ID NO: 117793 - RNA, 20 nt, Artificial Sequence
  MKO10117793_B_Snx10
  gRNA
aaaguccuccuucugaaucc

SEQ ID NO: 117794 - RNA, 20 nt, Artificial Sequence
  MKO10117794_B_Snx11
  gRNA
ggcgcuaccgugaguuugug

SEQ ID NO: 117795 - RNA, 20 nt, Artificial Sequence
  MKO10117795_B_Snx11
  gRNA
aggccuguuccggagcuucc

SEQ ID NO: 117796 - RNA, 20 nt, Artificial Sequence
  MKO10117796_B_Snx11
  gRNA
ggugaucacaguucgaguuc

SEQ ID NO: 117797 - RNA, 20 nt, Artificial Sequence
  MKO10117797_B_Snx12
  gRNA
aagcggcagcucccuuuccg

SEQ ID NO: 117798 - RNA, 20 nt, Artificial Sequence
  MKO10117798_B_Snx12
  gRNA
auugauaggaacuacguccc

SEQ ID NO: 117799 - RNA, 20 nt, Artificial Sequence
  MKO10117799_B_Snx12
  gRNA
gacgcuauagugacuuugag

SEQ ID NO: 117800 - RNA, 20 nt, Artificial Sequence
  MKO10117800_B_Snx13
  gRNA
uuaauguauaauaccaguac

SEQ ID NO: 117801 - RNA, 20 nt, Artificial Sequence
  MKO10117801_B_Snx13
  gRNA
uucaggccagucuauccaua

SEQ ID NO: 117802 - RNA, 20 nt, Artificial Sequence
  MKO10117802_B_Snx13
  gRNA
uuaggaaccccagaugaugu

SEQ ID NO: 117803 - RNA, 20 nt, Artificial Sequence
  MKO10117803_B_Snx14
  gRNA
gcagguucuugaauuagugu

SEQ ID NO: 117804 - RNA, 20 nt, Artificial Sequence
  MKO10117804_B_Snx14
  gRNA
gugacauucuacuguucauu

SEQ ID NO: 117805 - RNA, 20 nt, Artificial Sequence
  MKO10117805_B_Snx14
  gRNA
ugcaugucuuaaugaucuuc

SEQ ID NO: 117806 - RNA, 20 nt, Artificial Sequence
  MKO10117806_B_Snx15
  gRNA
ccaaguccccguggagcuua

SEQ ID NO: 117807 - RNA, 20 nt, Artificial Sequence
  MKO10117807_B_Snx15
  gRNA
cccggaaaaacuccuugagu

SEQ ID NO: 117808 - RNA, 20 nt, Artificial Sequence
  MKO10117808_B_Snx15
  gRNA
ccccuccuuuccgcaggcag

SEQ ID NO: 117809 - RNA, 20 nt, Artificial Sequence
  MKO10117809_B_Snx16
  gRNA
uagcacuuccuccaaaacgc

SEQ ID NO: 117810 - RNA, 20 nt, Artificial Sequence
  MKO10117810_B_Snx16
  gRNA
uugauagccuagaagaaagc

SEQ ID NO: 117811 - RNA, 20 nt, Artificial Sequence
  MKO10117811_B_Snx16
  gRNA
acuuacuuugucauuaagcc

SEQ ID NO: 117812 - RNA, 20 nt, Artificial Sequence
  MKO10117812_B_Snx17
  gRNA
ccauagcuucggaaggagua

SEQ ID NO: 117813 - RNA, 20 nt, Artificial Sequence
  MKO10117813_B_Snx17
  gRNA
ggggaaugcaggaaccacgu

SEQ ID NO: 117814 - RNA, 20 nt, Artificial Sequence
  MKO10117814_B_Snx17
  gRNA
ugaccagacagaagaugucc

SEQ ID NO: 117815 - RNA, 20 nt, Artificial Sequence
  MKO10117815_B_Snx18
  gRNA
cacuauuuccuucgccacgu

SEQ ID NO: 117816 - RNA, 20 nt, Artificial Sequence
  MKO10117816_B_Snx18
  gRNA
ggagacgccuacgacgccau

SEQ ID NO: 117817 - RNA, 20 nt, Artificial Sequence
  MKO10117817_B_Snx18
  gRNA
acuuaaagucguagagcgcc

SEQ ID NO: 117818 - RNA, 20 nt, Artificial Sequence
  MKO10117818_B_Snx19
  gRNA
gaugguggugagugcuaucg

SEQ ID NO: 117819 - RNA, 20 nt, Artificial Sequence
  MKO10117819_B_Snx19
  gRNA
caaccuucaggaaugacucc

SEQ ID NO: 117820 - RNA, 20 nt, Artificial Sequence
  MKO10117820_B_Snx19
  gRNA
uccucacuguugccaaucuc

SEQ ID NO: 117821 - RNA, 20 nt, Artificial Sequence
  MKO10117821_B_Snx1
  gRNA
guccagggauaguuccacug

SEQ ID NO: 117822 - RNA, 20 nt, Artificial Sequence
  MKO10117822_B_Snx1
  gRNA
gagccacaggaucucuuugc

SEQ ID NO: 117823 - RNA, 20 nt, Artificial Sequence
  MKO10117823_B_Snx1
  gRNA
agccuacaaagucaccacac

SEQ ID NO: 117824 - RNA, 20 nt, Artificial Sequence
  MKO10117824_B_Snx20
  gRNA
gaucgccucagcccgcauag

SEQ ID NO: 117825 - RNA, 20 nt, Artificial Sequence
  MKO10117825_B_Snx20
  gRNA
agacaggaaguauugccccc

SEQ ID NO: 117826 - RNA, 20 nt, Artificial Sequence
  MKO10117826_B_Snx20
  gRNA
uuuauggguccucuccagcc

SEQ ID NO: 117827 - RNA, 20 nt, Artificial Sequence
  MKO10117827_B_Snx21
  gRNA
acaccggcugcgacacgccc

SEQ ID NO: 117828 - RNA, 20 nt, Artificial Sequence
  MKO10117828_B_Snx21
  gRNA
gaacgaagucccccaccuga

SEQ ID NO: 117829 - RNA, 20 nt, Artificial Sequence
  MKO10117829_B_Snx21
  gRNA
cucacucaccacguacuugg

SEQ ID NO: 117830 - RNA, 20 nt, Artificial Sequence
  MKO10117830_B_Snx22
  gRNA
ccagaggacuggaacagcgc

SEQ ID NO: 117831 - RNA, 20 nt, Artificial Sequence
  MKO10117831_B_Snx22
  gRNA
caagaauuccaguaacuccu

SEQ ID NO: 117832 - RNA, 20 nt, Artificial Sequence
  MKO10117832_B_Snx22
  gRNA
gggcauccuguaccugaauc

SEQ ID NO: 117833 - RNA, 20 nt, Artificial Sequence
  MKO10117833_B_Snx24
  gRNA
agggcaagugccguacauug

SEQ ID NO: 117834 - RNA, 20 nt, Artificial Sequence
  MKO10117834_B_Snx24
  gRNA
auuccaugccuugcacaaaa

SEQ ID NO: 117835 - RNA, 20 nt, Artificial Sequence
  MKO10117835_B_Snx24
  gRNA
aaaauagaagugcuaaugaa

SEQ ID NO: 117836 - RNA, 20 nt, Artificial Sequence
  MKO10117836_B_Snx25
  gRNA
gcagaaauucuuacgacaaa

SEQ ID NO: 117837 - RNA, 20 nt, Artificial Sequence
  MKO10117837_B_Snx25
  gRNA
uuguacguaagcugagagac

SEQ ID NO: 117838 - RNA, 20 nt, Artificial Sequence
  MKO10117838_B_Snx25
  gRNA
aaucagguaucaaauuguag

SEQ ID NO: 117839 - RNA, 20 nt, Artificial Sequence
  MKO10117839_B_Snx27
  gRNA
uaggaacggcgugaauguug

SEQ ID NO: 117840 - RNA, 20 nt, Artificial Sequence
  MKO10117840_B_Snx27
  gRNA
agaucccagugacgacuccu

SEQ ID NO: 117841 - RNA, 20 nt, Artificial Sequence
  MKO10117841_B_Snx27
  gRNA
guguguucaauccgagucau

SEQ ID NO: 117842 - RNA, 20 nt, Artificial Sequence
  MKO10117842_B_Snx29
  gRNA
cugcagugccagauccgcuu

SEQ ID NO: 117843 - RNA, 20 nt, Artificial Sequence
  MKO10117843_B_Snx29
  gRNA
cagccgugagugcuaauccu

SEQ ID NO: 117844 - RNA, 20 nt, Artificial Sequence
  MKO10117844_B_Snx29
  gRNA
uucaccagcaagaccgaaac

SEQ ID NO: 117845 - RNA, 20 nt, Artificial Sequence
  MKO10117845_B_Snx2
  gRNA
gaucuucucugucaucgucu

SEQ ID NO: 117846 - RNA, 20 nt, Artificial Sequence
  MKO10117846_B_Snx2
  gRNA
cuggcugguucgggagauga

SEQ ID NO: 117847 - RNA, 20 nt, Artificial Sequence
  MKO10117847_B_Snx2
  gRNA
ugauggcaugaaugcuuaca

SEQ ID NO: 117848 - RNA, 20 nt, Artificial Sequence
  MKO10117848_B_Snx30
  gRNA
uccucagccagucgaaaucc

SEQ ID NO: 117849 - RNA, 20 nt, Artificial Sequence
  MKO10117849_B_Snx30
  gRNA
uaagaagcacgucugcacaa

SEQ ID NO: 117850 - RNA, 20 nt, Artificial Sequence
  MKO10117850_B_Snx30
  gRNA
cgcuggacaaauuccuaaaa

SEQ ID NO: 117851 - RNA, 20 nt, Artificial Sequence
  MKO10117851_B_Snx31
  gRNA
uuucagcugagacggguguu

SEQ ID NO: 117852 - RNA, 20 nt, Artificial Sequence
  MKO10117852_B_Snx31
  gRNA
uuugcagguagcguuccaac

SEQ ID NO: 117853 - RNA, 20 nt, Artificial Sequence
  MKO10117853_B_Snx31
  gRNA
uguagcguacuuugcagaag

SEQ ID NO: 117854 - RNA, 20 nt, Artificial Sequence
  MKO10117854_B_Snx32
  gRNA
gcagggggacagucccuuac

SEQ ID NO: 117855 - RNA, 20 nt, Artificial Sequence
  MKO10117855_B_Snx32
  gRNA
ccccugcagauccacugacg

SEQ ID NO: 117856 - RNA, 20 nt, Artificial Sequence
  MKO10117856_B_Snx32
  gRNA
ccacaacuucuccgucuucu

SEQ ID NO: 117857 - RNA, 20 nt, Artificial Sequence
  MKO10117857_B_Snx33
  gRNA
ccagcugcuggccuacccgc

SEQ ID NO: 117858 - RNA, 20 nt, Artificial Sequence
  MKO10117858_B_Snx33
  gRNA
acaaucucgacguaagaagc

SEQ ID NO: 117859 - RNA, 20 nt, Artificial Sequence
  MKO10117859_B_Snx33
  gRNA
cguccuacagcuuagcaacg

SEQ ID NO: 117860 - RNA, 20 nt, Artificial Sequence
  MKO10117860_B_Snx3
  gRNA
ugugaagacaacguucauuc

SEQ ID NO: 117861 - RNA, 20 nt, Artificial Sequence
  MKO10117861_B_Snx3
  gRNA
guuguaguucccccacuccc

SEQ ID NO: 117862 - RNA, 20 nt, Artificial Sequence
  MKO10117862_B_Snx3
  gRNA
cagggucgcuggucauccuc

SEQ ID NO: 117863 - RNA, 20 nt, Artificial Sequence
  MKO10117863_B_Snx4
  gRNA
ugugagcacacucugaccau

SEQ ID NO: 117864 - RNA, 20 nt, Artificial Sequence
  MKO10117864_B_Snx4
  gRNA
caacccaccgagucucgaug

SEQ ID NO: 117865 - RNA, 20 nt, Artificial Sequence
  MKO10117865_B_Snx4
  gRNA
cugccuaccucaucgagacu

SEQ ID NO: 117866 - RNA, 20 nt, Artificial Sequence
  MKO10117866_B_Snx5
  gRNA
uuccaguucuugcuucaucu

SEQ ID NO: 117867 - RNA, 20 nt, Artificial Sequence
  MKO10117867_B_Snx5
  gRNA
aguuucugcaucuucucucg

SEQ ID NO: 117868 - RNA, 20 nt, Artificial Sequence
  MKO10117868_B_Snx5
  gRNA
gcucugaaauguggacagug

SEQ ID NO: 117869 - RNA, 20 nt, Artificial Sequence
  MKO10117869_B_Snx6
  gRNA
uuucagacgcgcucagugag

SEQ ID NO: 117870 - RNA, 20 nt, Artificial Sequence
  MKO10117870_B_Snx6
  gRNA
uuccucucggaggaagaccg

SEQ ID NO: 117871 - RNA, 20 nt, Artificial Sequence
  MKO10117871_B_Snx6
  gRNA
cuccgcggucuuccuccgag

SEQ ID NO: 117872 - RNA, 20 nt, Artificial Sequence
  MKO10117872_B_Snx7
  gRNA
aucugguuuaucaucgacaa

SEQ ID NO: 117873 - RNA, 20 nt, Artificial Sequence
  MKO10117873_B_Snx7
  gRNA
gcaguggcaucuuccaugcg

SEQ ID NO: 117874 - RNA, 20 nt, Artificial Sequence
  MKO10117874_B_Snx7
  gRNA
acucacgggaauaaugagag

SEQ ID NO: 117875 - RNA, 20 nt, Artificial Sequence
  MKO10117875_B_Snx8
  gRNA
ccuuaagcauguggaguacg

SEQ ID NO: 117876 - RNA, 20 nt, Artificial Sequence
  MKO10117876_B_Snx8
  gRNA
agccgacagggaguucaucg

SEQ ID NO: 117877 - RNA, 20 nt, Artificial Sequence
  MKO10117877_B_Snx8
  gRNA
cacacuuaccgagccacuga

SEQ ID NO: 117878 - RNA, 20 nt, Artificial Sequence
  MKO10117878_B_Snx9
  gRNA
cagacggaacuagcgcucag

SEQ ID NO: 117879 - RNA, 20 nt, Artificial Sequence
  MKO10117879_B_Snx9
  gRNA
gcuuguuccuacugacuacg

SEQ ID NO: 117880 - RNA, 20 nt, Artificial Sequence
  MKO10117880_B_Snx9
  gRNA
uuugagcugugcuagcuguc

SEQ ID NO: 117881 - RNA, 20 nt, Artificial Sequence
  MKO10117881_B_Soau1
  gRNA
uggucacaaagucaucgaag

SEQ ID NO: 117882 - RNA, 20 nt, Artificial Sequence
  MKO10117882_B_Soau1
  gRNA
ugcugccaacagccucuucu

SEQ ID NO: 117883 - RNA, 20 nt, Artificial Sequence
  MKO10117883_B_Soau1
  gRNA
cugagagcaccuccagaaca

SEQ ID NO: 117884 - RNA, 20 nt, Artificial Sequence
  MKO10117884_B_Soau2
  gRNA
cgaguccauugcaccaaguc

SEQ ID NO: 117885 - RNA, 20 nt, Artificial Sequence
  MKO10117885_B_Soau2
  gRNA
cuuacucgaucagugacuug

SEQ ID NO: 117886 - RNA, 20 nt, Artificial Sequence
  MKO10117886_B_Soau2
  gRNA
aagcuugcauagccucccau

SEQ ID NO: 117887 - RNA, 20 nt, Artificial Sequence
  MKO10117887_B_Sobp
  gRNA
ucaccucgcuucccauacuc

SEQ ID NO: 117888 - RNA, 20 nt, Artificial Sequence
  MKO10117888_B_Sobp
  gRNA
uuuccuuagcauagugcugc

SEQ ID NO: 117889 - RNA, 20 nt, Artificial Sequence
  MKO10117889_B_Sobp
  gRNA
uaucauagccauaccagcca

SEQ ID NO: 117890 - RNA, 20 nt, Artificial Sequence
  MKO10117890_B_Socs1
  gRNA
uccgcucccacuccgauuac

SEQ ID NO: 117891 - RNA, 20 nt, Artificial Sequence
  MKO10117891_B_Socs1
  gRNA
acgcacgggggccgcuggcg

SEQ ID NO: 117892 - RNA, 20 nt, Artificial Sequence
  MKO10117892_B_Socs1
  gRNA
gcugugucgccagcgcaucg

SEQ ID NO: 117893 - RNA, 20 nt, Artificial Sequence
  MKO10117893_B_Socs2
  gRNA
acucaucucccaugacccug

SEQ ID NO: 117894 - RNA, 20 nt, Artificial Sequence
  MKO10117894_B_Socs2
  gRNA
cuguuugacugagcucgcgc

SEQ ID NO: 117895 - RNA, 20 nt, Artificial Sequence
  MKO10117895_B_Socs2
  gRNA
ugccuggagcccuccgggaa

SEQ ID NO: 117896 - RNA, 20 nt, Artificial Sequence
  MKO10117896_B_Socs3
  gRNA
cuccaaaagcgaguaccagc

SEQ ID NO: 117897 - RNA, 20 nt, Artificial Sequence
  MKO10117897_B_Socs3
  gRNA
ugacgcucaacgugaagaag

SEQ ID NO: 117898 - RNA, 20 nt, Artificial Sequence
  MKO10117898_B_Socs3
  gRNA
guugagcgucaagacccagu

SEQ ID NO: 117899 - RNA, 20 nt, Artificial Sequence
  MKO10117899_B_Socs4
  gRNA
cgcugaaucucgaaguaaaa

SEQ ID NO: 117900 - RNA, 20 nt, Artificial Sequence
  MKO10117900_B_Socs4
  gRNA
uuuacuucgagauucagcgc

SEQ ID NO: 117901 - RNA, 20 nt, Artificial Sequence
  MKO10117901_B_Socs4
  gRNA
gagcggcucaaagaacauac

SEQ ID NO: 117902 - RNA, 20 nt, Artificial Sequence
  MKO10117902_B_Socs5
  gRNA
ccugucugcuaacgugcgcg

SEQ ID NO: 117903 - RNA, 20 nt, Artificial Sequence
  MKO10117903_B_Socs5
  gRNA
ugagcuuccgccgcuacaac

SEQ ID NO: 117904 - RNA, 20 nt, Artificial Sequence
  MKO10117904_B_Socs5
  gRNA
ugcagaugcacuacguauga

SEQ ID NO: 117905 - RNA, 20 nt, Artificial Sequence
  MKO10117905_B_Socs6
  gRNA
accugcaugaaucgugacac

SEQ ID NO: 117906 - RNA, 20 nt, Artificial Sequence
  MKO10117906_B_Socs6
  gRNA
acucgcccccggcaggggua

SEQ ID NO: 117907 - RNA, 20 nt, Artificial Sequence
  MKO10117907_B_Socs6
  gRNA
acuggguaaguugcugaucc

SEQ ID NO: 117908 - RNA, 20 nt, Artificial Sequence
  MKO10117908_B_Socs7
  gRNA
ugcagccagccuucgagagc

SEQ ID NO: 117909 - RNA, 20 nt, Artificial Sequence
  MKO10117909_B_Socs7
  gRNA
ucucuuguagaugauaucag

SEQ ID NO: 117910 - RNA, 20 nt, Artificial Sequence
  MKO10117910_B_Socs7
  gRNA
aggguccuuaccugugaaca

SEQ ID NO: 117911 - RNA, 20 nt, Artificial Sequence
  MKO10117911_B_Sod1
  gRNA
gcucaccucucuucauccgc

SEQ ID NO: 117912 - RNA, 20 nt, Artificial Sequence
  MKO10117912_B_Sod1
  gRNA
guguauuguccccauacuga

SEQ ID NO: 117913 - RNA, 20 nt, Artificial Sequence
  MKO10117913_B_Sod1
  gRNA
cgcaaucccaaucacuccac

SEQ ID NO: 117914 - RNA, 20 nt, Artificial Sequence
  MKO10117914_B_Sod2
  gRNA
aggcuaucaagcgugacuuu

SEQ ID NO: 117915 - RNA, 20 nt, Artificial Sequence
  MKO10117915_B_Sod2
  gRNA
gauugcugccugcucuaauc

SEQ ID NO: 117916 - RNA, 20 nt, Artificial Sequence
  MKO10117916_B_Sod2
  gRNA
ccaccauugaacuucagugc

SEQ ID NO: 117917 - RNA, 20 nt, Artificial Sequence
  MKO10117917_B_Sod3
  gRNA
cgacgcgaugccuccagagc

SEQ ID NO: 117918 - RNA, 20 nt, Artificial Sequence
  MKO10117918_B_Sod3
  gRNA
ccugucugcuaggucgaagc

SEQ ID NO: 117919 - RNA, 20 nt, Artificial Sequence
  MKO10117919_B_Sod3
  gRNA
gguccccgaacucaugcacg

SEQ ID NO: 117920 - RNA, 20 nt, Artificial Sequence
  MKO10117920_B_Soga1
  gRNA
ccugcaguaccgacugcgua

SEQ ID NO: 117921 - RNA, 20 nt, Artificial Sequence
  MKO10117921_B_Soga1
  gRNA
guugauggggaacucauccg

SEQ ID NO: 117922 - RNA, 20 nt, Artificial Sequence
  MKO10117922_B_Soga1
  gRNA
cagcuccuugugaagccgca

SEQ ID NO: 117923 - RNA, 20 nt, Artificial Sequence
  MKO10117923_B_Soga2
  gRNA
aagacgacaacgaaacgcuc

SEQ ID NO: 117924 - RNA, 20 nt, Artificial Sequence
  MKO10117924_B_Soga2
  gRNA
gaauccugcaguaccgacuc

SEQ ID NO: 117925 - RNA, 20 nt, Artificial Sequence
  MKO10117925_B_Soga2
  gRNA
agagaagaaacuuguuaacc

SEQ ID NO: 117926 - RNA, 20 nt, Artificial Sequence
  MKO10117926_B_Soga3
  gRNA
uuuccccagucugcgcguag

SEQ ID NO: 117927 - RNA, 20 nt, Artificial Sequence
  MKO10117927_B_Soga3
  gRNA
gcaagcuuuacagaacgaac

SEQ ID NO: 117928 - RNA, 20 nt, Artificial Sequence
  MKO10117928_B_Soga3
  gRNA
ucaccaugaauuagaaaaug

SEQ ID NO: 117929 - RNA, 20 nt, Artificial Sequence
  MKO10117929_B_Sohlh1
  gRNA
cagaugccauguccucccgu

SEQ ID NO: 117930 - RNA, 20 nt, Artificial Sequence
  MKO10117930_B_Sohlh1
  gRNA
ugucugcaaucugauucgcc

SEQ ID NO: 117931 - RNA, 20 nt, Artificial Sequence
  MKO10117931_B_Sohlh1
  gRNA
gcguugucauucagugagcc

SEQ ID NO: 117932 - RNA, 20 nt, Artificial Sequence
  MKO10117932_B_Sohlh2
  gRNA
gacuuccacucuaacugcag

SEQ ID NO: 117933 - RNA, 20 nt, Artificial Sequence
  MKO10117933_B_Sohlh2
  gRNA
cgaguuagcagccaaaagca

SEQ ID NO: 117934 - RNA, 20 nt, Artificial Sequence
  MKO10117934_B_Sohlh2
  gRNA
uuucagugagccgcugaccu

SEQ ID NO: 117935 - RNA, 20 nt, Artificial Sequence
  MKO10117935_B_Son
  gRNA
cuuucguggucaguaaauuc

SEQ ID NO: 117936 - RNA, 20 nt, Artificial Sequence
  MKO10117936_B_Son
  gRNA
gauuuguuucaccauucagc

SEQ ID NO: 117937 - RNA, 20 nt, Artificial Sequence
  MKO10117937_B_Son
  gRNA
ccucucuggggucuuagaua

SEQ ID NO: 117938 - RNA, 20 nt, Artificial Sequence
  MKO10117938_B_Sorbs1
  gRNA
ccuuaccuuugucuggucca

SEQ ID NO: 117939 - RNA, 20 nt, Artificial Sequence
  MKO10117939_B_Sorbs1
  gRNA
gcccuccccacuugcugcca

SEQ ID NO: 117940 - RNA, 20 nt, Artificial Sequence
  MKO10117940_B_Sorbs1
  gRNA
agcucuaaagcuguggugaa

SEQ ID NO: 117941 - RNA, 20 nt, Artificial Sequence
  MKO10117941_B_Sorbs2
  gRNA
ucaaaguucuccaaaccuau

SEQ ID NO: 117942 - RNA, 20 nt, Artificial Sequence
  MKO10117942_B_Sorbs2
  gRNA
gagucucagucuccagauuc

SEQ ID NO: 117943 - RNA, 20 nt, Artificial Sequence
  MKO10117943_B_Sorbs2
  gRNA
cuuggagaucuuacaaugau

SEQ ID NO: 117944 - RNA, 20 nt, Artificial Sequence
  MKO10117944_B_Sorbs3
  gRNA
ggccaggucugauaccaugc

SEQ ID NO: 117945 - RNA, 20 nt, Artificial Sequence
  MKO10117945_B_Sorbs3
  gRNA
cucauccucccgggggacaa

SEQ ID NO: 117946 - RNA, 20 nt, Artificial Sequence
  MKO10117946_B_Sorbs3
  gRNA
cauucuucgauaccagucuc

SEQ ID NO: 117947 - RNA, 20 nt, Artificial Sequence
  MKO10117947_B_Sorcs1
  gRNA
guaucaccgagagcucgcuu

SEQ ID NO: 117948 - RNA, 20 nt, Artificial Sequence
  MKO10117948_B_Sorcs1
  gRNA
guaccuccaaagcgagcucu

SEQ ID NO: 117949 - RNA, 20 nt, Artificial Sequence
  MKO10117949_B_Sorcs1
  gRNA
guguccaaccaacaagcgua

SEQ ID NO: 117950 - RNA, 20 nt, Artificial Sequence
  MKO10117950_B_Sorcs2
  gRNA
ugaccaaggaccacguguuc

SEQ ID NO: 117951 - RNA, 20 nt, Artificial Sequence
  MKO10117951_B_Sorcs2
  gRNA
auaucugcccagcuaacaaa

SEQ ID NO: 117952 - RNA, 20 nt, Artificial Sequence
  MKO10117952_B_Sorcs2
  gRNA
aaagaaguggacacuucugc

SEQ ID NO: 117953 - RNA, 20 nt, Artificial Sequence
  MKO10117953_B_Sorcs3
  gRNA
ugaagucauagagcuucguc

SEQ ID NO: 117954 - RNA, 20 nt, Artificial Sequence
  MKO10117954_B_Sorcs3
  gRNA
gcuccuuagugaccccgaga

SEQ ID NO: 117955 - RNA, 20 nt, Artificial Sequence
  MKO10117955_B_Sorcs3
  gRNA
gguugacauagagauaacug

SEQ ID NO: 117956 - RNA, 20 nt, Artificial Sequence
  MKO10117956_B_Sord
  gRNA
gcauagauccccacagagag

SEQ ID NO: 117957 - RNA, 20 nt, Artificial Sequence
  MKO10117957_B_Sord
  gRNA
guagaugaguacugcaagau

SEQ ID NO: 117958 - RNA, 20 nt, Artificial Sequence
  MKO10117958_B_Sord
  gRNA
aacuacccaauaccugagcu

SEQ ID NO: 117959 - RNA, 20 nt, Artificial Sequence
  MKO10117959_B_Sorl1
  gRNA
guguuccugaaucaugaucc

SEQ ID NO: 117960 - RNA, 20 nt, Artificial Sequence
  MKO10117960_B_Sorl1
  gRNA
agagaaaagcaacgugaucg

SEQ ID NO: 117961 - RNA, 20 nt, Artificial Sequence
  MKO10117961_B_Sorl1
  gRNA
agugcaccaccaucugauug

SEQ ID NO: 117962 - RNA, 20 nt, Artificial Sequence
  MKO10117962_B_Sort1
  gRNA
gacaguccaaguuguaucga

SEQ ID NO: 117963 - RNA, 20 nt, Artificial Sequence
  MKO10117963_B_Sort1
  gRNA
cuguacaucaucugcgucag

SEQ ID NO: 117964 - RNA, 20 nt, Artificial Sequence
  MKO10117964_B_Sort1
  gRNA
accugaacacucuuccgccu

SEQ ID NO: 117965 - RNA, 20 nt, Artificial Sequence
  MKO10117965_B_Sos1
  gRNA
auaauaaguuuguucuccug

SEQ ID NO: 117966 - RNA, 20 nt, Artificial Sequence
  MKO10117966_B_Sos1
  gRNA
ucaucauuagacucaagagu

SEQ ID NO: 117967 - RNA, 20 nt, Artificial Sequence
  MKO10117967_B_Sos1
  gRNA
cuacuauguaaacagaaacc

SEQ ID NO: 117968 - RNA, 20 nt, Artificial Sequence
  MKO10117968_B_Sos2
  gRNA
ccaugugucccucuacauug

SEQ ID NO: 117969 - RNA, 20 nt, Artificial Sequence
  MKO10117969_B_Sos2
  gRNA
ccaauacagccacaauguag

SEQ ID NO: 117970 - RNA, 20 nt, Artificial Sequence
  MKO10117970_B_Sos2
  gRNA
aaauccucucuuacuaccug

SEQ ID NO: 117971 - RNA, 20 nt, Artificial Sequence
  MKO10117971_B_Sostdc1
  gRNA
ggcaggcauuucaguagcac

SEQ ID NO: 117972 - RNA, 20 nt, Artificial Sequence
  MKO10117972_B_Sostdc1
  gRNA
gcacuugcacgccgugacca

SEQ ID NO: 117973 - RNA, 20 nt, Artificial Sequence
  MKO10117973_B_Sostdc1
  gRNA
gcgacacgcuuucaaaguug

SEQ ID NO: 117974 - RNA, 20 nt, Artificial Sequence
  MKO10117974_B_Sost
  gRNA
caccaucccuaugacgccaa

SEQ ID NO: 117975 - RNA, 20 nt, Artificial Sequence
  MKO10117975_B_Sost
  gRNA
agcggguguagugcagcucg

SEQ ID NO: 117976 - RNA, 20 nt, Artificial Sequence
  MKO10117976_B_Sost
  gRNA
agacgcaccuugcgcgagcg

SEQ ID NO: 117977 - RNA, 20 nt, Artificial Sequence
  MKO10117977_B_Sowaha
  gRNA
gccggacaugaagucgcgcu

SEQ ID NO: 117978 - RNA, 20 nt, Artificial Sequence
  MKO10117978_B_Sowaha
  gRNA
ugcgcacggccagcggucgu

SEQ ID NO: 117979 - RNA, 20 nt, Artificial Sequence
  MKO10117979_B_Sowaha
  gRNA
cggcaggccaccgcgaaucu

SEQ ID NO: 117980 - RNA, 20 nt, Artificial Sequence
  MKO10117980_B_Sowahb
  gRNA
cuacagggcccggucgcugc

SEQ ID NO: 117981 - RNA, 20 nt, Artificial Sequence
  MKO10117981_B_Sowahb
  gRNA
cuggccuccgaccgccgucg

SEQ ID NO: 117982 - RNA, 20 nt, Artificial Sequence
  MKO10117982_B_Sowahb
  gRNA
gcgcauucccucuauauccg

SEQ ID NO: 117983 - RNA, 20 nt, Artificial Sequence
  MKO10117983_B_Sowahc
  gRNA
cgucggggccucgguuaccc

SEQ ID NO: 117984 - RNA, 20 nt, Artificial Sequence
  MKO10117984_B_Sowahc
  gRNA
ccgcgcccgcgagcgcuuca

SEQ ID NO: 117985 - RNA, 20 nt, Artificial Sequence
  MKO10117985_B_Sowahc
  gRNA
cgcgggugcgcuguucgcgc

SEQ ID NO: 117986 - RNA, 20 nt, Artificial Sequence
  MKO10117986_B_Sowahd
  gRNA
gucccgccgcuccagcggac

SEQ ID NO: 117987 - RNA, 20 nt, Artificial Sequence
  MKO10117987_B_Sowahd
  gRNA
cacagcgcccugaccgugag

SEQ ID NO: 117988 - RNA, 20 nt, Artificial Sequence
  MKO10117988_B_Sowahd
  gRNA
ggccaagcacgggcgccacg

SEQ ID NO: 117989 - RNA, 20 nt, Artificial Sequence
  MKO10117989_B_Sox10
  gRNA
gcgccgucgcugggacccga

SEQ ID NO: 117990 - RNA, 20 nt, Artificial Sequence
  MKO10117990_B_Sox10
  gRNA
uucccguucuuccgccgccg

SEQ ID NO: 117991 - RNA, 20 nt, Artificial Sequence
  MKO10117991_B_Sox10
  gRNA
ugacaagcgccccuucauug

SEQ ID NO: 117992 - RNA, 20 nt, Artificial Sequence
  MKO10117992_B_Sox11
  gRNA
guuccccgacuacugcacgc

SEQ ID NO: 117993 - RNA, 20 nt, Artificial Sequence
  MKO10117993_B_Sox11
  gRNA
aguagucggggaacucgaag

SEQ ID NO: 117994 - RNA, 20 nt, Artificial Sequence
  MKO10117994_B_Sox11
  gRNA
ucaagcucaggucgaacaug

SEQ ID NO: 117995 - RNA, 20 nt, Artificial Sequence
  MKO10117995_B_Sox12
  gRNA
cggagaagaucccguucgug

SEQ ID NO: 117996 - RNA, 20 nt, Artificial Sequence
  MKO10117996_B_Sox12
  gRNA
agacccccgggcgcgagcug

SEQ ID NO: 117997 - RNA, 20 nt, Artificial Sequence
  MKO10117997_B_Sox12
  gRNA
cauccuccacagcucgcgcc

SEQ ID NO: 117998 - RNA, 20 nt, Artificial Sequence
  MKO10117998_B_Sox13
  gRNA
cugcugcuucucaaacagca

SEQ ID NO: 117999 - RNA, 20 nt, Artificial Sequence
  MKO10117999_B_Sox13
  gRNA
guuucugggaagaagcaaug

SEQ ID NO: 118000 - RNA, 20 nt, Artificial Sequence
  MKO10118000_B_Sox13
  gRNA
aaaccucuccuuccagucac

SEQ ID NO: 118001 - RNA, 20 nt, Artificial Sequence
  MKO10118001_B_Sox14
  gRNA
uuauucgucagcccacgcua

SEQ ID NO: 118002 - RNA, 20 nt, Artificial Sequence
  MKO10118002_B_Sox14
  gRNA
cgacacggacccgcucaagg

SEQ ID NO: 118003 - RNA, 20 nt, Artificial Sequence
  MKO10118003_B_Sox14
  gRNA
gcacuggaacuaaauugcgc

SEQ ID NO: 118004 - RNA, 20 nt, Artificial Sequence
  MKO10118004_B_Sox15
  gRNA
ccauauaauacuucccuugc

SEQ ID NO: 118005 - RNA, 20 nt, Artificial Sequence
  MKO10118005_B_Sox15
  gRNA
cagguaggcugucgaauagu

SEQ ID NO: 118006 - RNA, 20 nt, Artificial Sequence
  MKO10118006_B_Sox15
  gRNA
agcgucugggggacuuccgc

SEQ ID NO: 118007 - RNA, 20 nt, Artificial Sequence
  MKO10118007_B_Sox17
  gRNA
caaccgcuugcguucgucuu

SEQ ID NO: 118008 - RNA, 20 nt, Artificial Sequence
  MKO10118008_B_Sox17
  gRNA
ucacuccgcagucguguccc

SEQ ID NO: 118009 - RNA, 20 nt, Artificial Sequence
  MKO10118009_B_Sox17
  gRNA
ucacuggcguaucccgcauc

SEQ ID NO: 118010 - RNA, 20 nt, Artificial Sequence
  MKO10118010_B_Sox18
  gRNA
cuuccgcgagcuacccacuc

SEQ ID NO: 118011 - RNA, 20 nt, Artificial Sequence
  MKO10118011_B_Sox18
  gRNA
gucguccugugcgccguagc

SEQ ID NO: 118012 - RNA, 20 nt, Artificial Sequence
  MKO10118012_B_Sox18
  gRNA
gugcggaguucgauggcuug

SEQ ID NO: 118013 - RNA, 20 nt, Artificial Sequence
  MKO10118013_B_Sox1
  gRNA
gugcagcgcgcgcagucucu

SEQ ID NO: 118014 - RNA, 20 nt, Artificial Sequence
  MKO10118014_B_Sox1
  gRNA
ugggcuaacggcgccuaccc

SEQ ID NO: 118015 - RNA, 20 nt, Artificial Sequence
  MKO10118015_B_Sox1
  gRNA
cgcgcaccagaacucggcgg

SEQ ID NO: 118016 - RNA, 20 nt, Artificial Sequence
  MKO10118016_B_Sox21
  gRNA
ucugcucgcgaaccccgaga

SEQ ID NO: 118017 - RNA, 20 nt, Artificial Sequence
  MKO10118017_B_Sox21
  gRNA
cgccuugagcgccgggugcu

SEQ ID NO: 118018 - RNA, 20 nt, Artificial Sequence
  MKO10118018_B_Sox21
  gRNA
ccccuacucacugcucgacc

SEQ ID NO: 118019 - RNA, 20 nt, Artificial Sequence
  MKO10118019_B_Sox2
  gRNA
cgcggccgguauuuauaauc

SEQ ID NO: 118020 - RNA, 20 nt, Artificial Sequence
  MKO10118020_B_Sox2
  gRNA
gugccgcgccgugagcguug

SEQ ID NO: 118021 - RNA, 20 nt, Artificial Sequence
  MKO10118021_B_Sox2
  gRNA
cagcauguccuacucgcagc

SEQ ID NO: 118022 - RNA, 20 nt, Artificial Sequence
  MKO10118022_B_Sox30
  gRNA
uggguuuaucagccucgucc

SEQ ID NO: 118023 - RNA, 20 nt, Artificial Sequence
  MKO10118023_B_Sox30
  gRNA
acagcacgugcccuuauagu

SEQ ID NO: 118024 - RNA, 20 nt, Artificial Sequence
  MKO10118024_B_Sox30
  gRNA
accugauacucccuucagua

SEQ ID NO: 118025 - RNA, 20 nt, Artificial Sequence
  MKO10118025_B_Sox3
  gRNA
cacucgcagcgcgcgugccu

SEQ ID NO: 118026 - RNA, 20 nt, Artificial Sequence
  MKO10118026_B_Sox3
  gRNA
cggagcgaacgcaggcaacg

SEQ ID NO: 118027 - RNA, 20 nt, Artificial Sequence
  MKO10118027_B_Sox3
  gRNA
cggcgccuacucgcucgugc

SEQ ID NO: 118028 - RNA, 20 nt, Artificial Sequence
  MKO10118028_B_Sox4
  gRNA
cgaucgcccgcugaccaccg

SEQ ID NO: 118029 - RNA, 20 nt, Artificial Sequence
  MKO10118029_B_Sox4
  gRNA
cgcgguggucagcgggcgau

SEQ ID NO: 118030 - RNA, 20 nt, Artificial Sequence
  MKO10118030_B_Sox4
  gRNA
ggcgcuucggcgucucccgu

SEQ ID NO: 118031 - RNA, 20 nt, Artificial Sequence
  MKO10118031_B_Sox5
  gRNA
uauugaaaagcuacucucca

SEQ ID NO: 118032 - RNA, 20 nt, Artificial Sequence
  MKO10118032_B_Sox5
  gRNA
aguucccugaucccauugcc

SEQ ID NO: 118033 - RNA, 20 nt, Artificial Sequence
  MKO10118033_B_Sox5
  gRNA
uacugacccugauuuaccuc

SEQ ID NO: 118034 - RNA, 20 nt, Artificial Sequence
  MKO10118034_B_Sox6
  gRNA
caucgcagaucgagaaacag

SEQ ID NO: 118035 - RNA, 20 nt, Artificial Sequence
  MKO10118035_B_Sox6
  gRNA
gcucccgcaagcugaucagc

SEQ ID NO: 118036 - RNA, 20 nt, Artificial Sequence
  MKO10118036_B_Sox6
  gRNA
uuccucuccauccgcuguac

SEQ ID NO: 118037 - RNA, 20 nt, Artificial Sequence
  MKO10118037_B_Sox7
  gRNA
cggauaggcgcccagcagcg

SEQ ID NO: 118038 - RNA, 20 nt, Artificial Sequence
  MKO10118038_B_Sox7
  gRNA
caggguccacgcgcuugcag

SEQ ID NO: 118039 - RNA, 20 nt, Artificial Sequence
  MKO10118039_B_Sox7
  gRNA
ugcugagcuccgcguugugc

SEQ ID NO: 118040 - RNA, 20 nt, Artificial Sequence
  MKO10118040_B_Sox8
  gRNA
cauugcugaagucgauguuc

SEQ ID NO: 118041 - RNA, 20 nt, Artificial Sequence
  MKO10118041_B_Sox8
  gRNA
ggucuuucuugugcugcaca

SEQ ID NO: 118042 - RNA, 20 nt, Artificial Sequence
  MKO10118042_B_Sox8
  gRNA
cucucggccuccuccacaaa

SEQ ID NO: 118043 - RNA, 20 nt, Artificial Sequence
  MKO10118043_B_Sox9
  gRNA
accagccgaguccuccgaca

SEQ ID NO: 118044 - RNA, 20 nt, Artificial Sequence
  MKO10118044_B_Sox9
  gRNA
ccgauuacaaguaccagccc

SEQ ID NO: 118045 - RNA, 20 nt, Artificial Sequence
  MKO10118045_B_Sox9
  gRNA
gagcgagaagagacccuucg

SEQ ID NO: 118046 - RNA, 20 nt, Artificial Sequence
  MKO10118046_B_Sp100
  gRNA
uuagaucucuccgcaucuga

SEQ ID NO: 118047 - RNA, 20 nt, Artificial Sequence
  MKO10118047_B_Sp100
  gRNA
ucccagcuaagucuugaaca

SEQ ID NO: 118048 - RNA, 20 nt, Artificial Sequence
  MKO10118048_B_Sp100
  gRNA
cucuaggauguccacugaac

SEQ ID NO: 118049 - RNA, 20 nt, Artificial Sequence
  MKO10118049_B_Sp110
  gRNA
agcuucugaaaauugccacc

SEQ ID NO: 118050 - RNA, 20 nt, Artificial Sequence
  MKO10118050_B_Sp110
  gRNA
acugacccugcuugaagacc

SEQ ID NO: 118051 - RNA, 20 nt, Artificial Sequence
  MKO10118051_B_Sp110
  gRNA
agaucaccagagaaaagaua

SEQ ID NO: 118052 - RNA, 20 nt, Artificial Sequence
  MKO10118052_B_Sp140
  gRNA
ucaagaaacauguaagaacc

SEQ ID NO: 118053 - RNA, 20 nt, Artificial Sequence
  MKO10118053_B_Sp140
  gRNA
auaucacuuucagaagaucc

SEQ ID NO: 118054 - RNA, 20 nt, Artificial Sequence
  MKO10118054_B_Sp140
  gRNA
ugcuuguucaucauucguuu

SEQ ID NO: 118055 - RNA, 20 nt, Artificial Sequence
  MKO10118055_B_Sp1
  gRNA
augaucuguugguuugcacc

SEQ ID NO: 118056 - RNA, 20 nt, Artificial Sequence
  MKO10118056_B_Sp1
  gRNA
aauaauggggguagcggcaa

SEQ ID NO: 118057 - RNA, 20 nt, Artificial Sequence
  MKO10118057_B_Sp1
  gRNA
gacgaguccugcguccagcu

SEQ ID NO: 118058 - RNA, 20 nt, Artificial Sequence
  MKO10118058_B_Sp2
  gRNA
gccaacguggugaagcugac

SEQ ID NO: 118059 - RNA, 20 nt, Artificial Sequence
  MKO10118059_B_Sp2
  gRNA
guuuauauccguacaccuuc

SEQ ID NO: 118060 - RNA, 20 nt, Artificial Sequence
  MKO10118060_B_Sp2
  gRNA
cagccugaacgccgcacagc

SEQ ID NO: 118061 - RNA, 20 nt, Artificial Sequence
  MKO10118061_B_Sp3
  gRNA
aaucaaaccuuacucgccuc

SEQ ID NO: 118062 - RNA, 20 nt, Artificial Sequence
  MKO10118062_B_Sp3
  gRNA
ucagucaacagacgcucagc

SEQ ID NO: 118063 - RNA, 20 nt, Artificial Sequence
  MKO10118063_B_Sp3
  gRNA
gggacuuaccgcuccggcgg

SEQ ID NO: 118064 - RNA, 20 nt, Artificial Sequence
  MKO10118064_B_Sp4
  gRNA
aaagaccguucauaugcaac

SEQ ID NO: 118065 - RNA, 20 nt, Artificial Sequence
  MKO10118065_B_Sp4
  gRNA
acucuucggagccucuugcc

SEQ ID NO: 118066 - RNA, 20 nt, Artificial Sequence
  MKO10118066_B_Sp4
  gRNA
accuccgagcacaucuccga

SEQ ID NO: 118067 - RNA, 20 nt, Artificial Sequence
  MKO10118067_B_Sp5
  gRNA
aggccugcagugagucguuc

SEQ ID NO: 118068 - RNA, 20 nt, Artificial Sequence
  MKO10118068_B_Sp5
  gRNA
uugaccggcgagaacucgua

SEQ ID NO: 118069 - RNA, 20 nt, Artificial Sequence
  MKO10118069_B_Sp5
  gRNA
guacccuuacgaguucucgc

SEQ ID NO: 118070 - RNA, 20 nt, Artificial Sequence
  MKO10118070_B_Sp6
  gRNA
uggcgugguggaaccacccg

SEQ ID NO: 118071 - RNA, 20 nt, Artificial Sequence
  MKO10118071_B_Sp6
  gRNA
gauggaccucccccauacuc

SEQ ID NO: 118072 - RNA, 20 nt, Artificial Sequence
  MKO10118072_B_Sp6
  gRNA
cuucaugcgcagcgaccacc

SEQ ID NO: 118073 - RNA, 20 nt, Artificial Sequence
  MKO10118073_B_Sp7
  gRNA
aacaguuaccucaagcagag

SEQ ID NO: 118074 - RNA, 20 nt, Artificial Sequence
  MKO10118074_B_Sp7
  gRNA
ucagacgagcugugccccuu

SEQ ID NO: 118075 - RNA, 20 nt, Artificial Sequence
  MKO10118075_B_Sp7
  gRNA
cccacuauugccaaccgccu

SEQ ID NO: 118076 - RNA, 20 nt, Artificial Sequence
  MKO10118076_B_Sp8
  gRNA
cgccgcgcugugcucgcugu

SEQ ID NO: 118077 - RNA, 20 nt, Artificial Sequence
  MKO10118077_B_Sp8
  gRNA
cgauuccgccccgucgccgc

SEQ ID NO: 118078 - RNA, 20 nt, Artificial Sequence
  MKO10118078_B_Sp8
  gRNA
gagcgagccugcgucgcaaa

SEQ ID NO: 118079 - RNA, 20 nt, Artificial Sequence
  MKO10118079_B_Sp9
  gRNA
gcuauggccacgucuauacu

SEQ ID NO: 118080 - RNA, 20 nt, Artificial Sequence
  MKO10118080_B_Sp9
  gRNA
gcgcuccgcccgucgcuacu

SEQ ID NO: 118081 - RNA, 20 nt, Artificial Sequence
  MKO10118081_B_Sp9
  gRNA
gacuuguaccacgacucgua

SEQ ID NO: 118082 - RNA, 20 nt, Artificial Sequence
  MKO10118082_B_Spa17
  gRNA
cuauaacaaccacgcauuca

SEQ ID NO: 118083 - RNA, 20 nt, Artificial Sequence
  MKO10118083_B_Spa17
  gRNA
cuacguacgaagggagugac

SEQ ID NO: 118084 - RNA, 20 nt, Artificial Sequence
  MKO10118084_B_Spa17
  gRNA
caagaauuagcuaagucauc

SEQ ID NO: 118085 - RNA, 20 nt, Artificial Sequence
  MKO10118085_B_Spaca1
  gRNA
uucaccgucuauacaacaaa

SEQ ID NO: 118086 - RNA, 20 nt, Artificial Sequence
  MKO10118086_B_Spaca1
  gRNA
auagucaaagaaguagaauu

SEQ ID NO: 118087 - RNA, 20 nt, Artificial Sequence
  MKO10118087_B_Spaca1
  gRNA
aaaaucguuucaaauaugua

SEQ ID NO: 118088 - RNA, 20 nt, Artificial Sequence
  MKO10118088_B_Spaca3
  gRNA
cgaggguucugcaccaccuc

SEQ ID NO: 118089 - RNA, 20 nt, Artificial Sequence
  MKO10118089_B_Spaca3
  gRNA
gaagauaguucaagaacccc

SEQ ID NO: 118090 - RNA, 20 nt, Artificial Sequence
  MKO10118090_B_Spaca3
  gRNA
gcccuggcaguggugccucc

SEQ ID NO: 118091 - RNA, 20 nt, Artificial Sequence
  MKO10118091_B_Spaca4
  gRNA
ggccagugcccuuauugcaa

SEQ ID NO: 118092 - RNA, 20 nt, Artificial Sequence
  MKO10118092_B_Spaca4
  gRNA
ccacacccugggcuacuccg

SEQ ID NO: 118093 - RNA, 20 nt, Artificial Sequence
  MKO10118093_B_Spaca4
  gRNA
uccuugaugccugucacacc

SEQ ID NO: 118094 - RNA, 20 nt, Artificial Sequence
  MKO10118094_B_Spaca5
  gRNA
uauagccuuugaagccaucg

SEQ ID NO: 118095 - RNA, 20 nt, Artificial Sequence
  MKO10118095_B_Spaca5
  gRNA
cguauuguugauugccaaau

SEQ ID NO: 118096 - RNA, 20 nt, Artificial Sequence
  MKO10118096_B_Spaca5
  gRNA
cugacucaagcuauaauaac

SEQ ID NO: 118097 - RNA, 20 nt, Artificial Sequence
  MKO10118097_B_Spaca6
  gRNA
ccggccugcaucccuccuug

SEQ ID NO: 118098 - RNA, 20 nt, Artificial Sequence
  MKO10118098_B_Spaca6
  gRNA
ucuguguaaauucaucaugc

SEQ ID NO: 118099 - RNA, 20 nt, Artificial Sequence
  MKO10118099_B_Spaca6
  gRNA
cuuaccacaaggagggaugc

SEQ ID NO: 118100 - RNA, 20 nt, Artificial Sequence
  MKO10118100_B_Spaca7
  gRNA
guuccagguccaauuacuga

SEQ ID NO: 118101 - RNA, 20 nt, Artificial Sequence
  MKO10118101_B_Spaca7
  gRNA
gcucucaccuucaggagacg

SEQ ID NO: 118102 - RNA, 20 nt, Artificial Sequence
  MKO10118102_B_Spaca7
  gRNA
uauugaugaaaacuaccaag

SEQ ID NO: 118103 - RNA, 20 nt, Artificial Sequence
  MKO10118103_B_Spag11a
  gRNA
gucuucuucugcuuugucca

SEQ ID NO: 118104 - RNA, 20 nt, Artificial Sequence
  MKO10118104_B_Spag11a
  gRNA
aggcucuucaugugccguuc

SEQ ID NO: 118105 - RNA, 20 nt, Artificial Sequence
  MKO10118105_B_Spag11a
  gRNA
cacacgguguuucugauucc

SEQ ID NO: 118106 - RNA, 20 nt, Artificial Sequence
  MKO10118106_B_Spag11b
  gRNA
gucaacugcaagaaaaguga

SEQ ID NO: 118107 - RNA, 20 nt, Artificial Sequence
  MKO10118107_B_Spag11b
  gRNA
cugcuuuaccuggaaacagc

SEQ ID NO: 118108 - RNA, 20 nt, Artificial Sequence
  MKO10118108_B_Spag11b
  gRNA
aaaaguagacuggcaaagaa

SEQ ID NO: 118109 - RNA, 20 nt, Artificial Sequence
  MKO10118109_B_Spag16
  gRNA
caccaaaauauggaugucuc

SEQ ID NO: 118110 - RNA, 20 nt, Artificial Sequence
  MKO10118110_B_Spag16
  gRNA
uccugcauuacauuccuugc

SEQ ID NO: 118111 - RNA, 20 nt, Artificial Sequence
  MKO10118111_B_Spag16
  gRNA
agaugaaugcgaauaugaag

SEQ ID NO: 118112 - RNA, 20 nt, Artificial Sequence
  MKO10118112_B_Spag17
  gRNA
ccuccaucgccuucgugguu

SEQ ID NO: 118113 - RNA, 20 nt, Artificial Sequence
  MKO10118113_B_Spag17
  gRNA
cccaaccacgaaggcgaugg

SEQ ID NO: 118114 - RNA, 20 nt, Artificial Sequence
  MKO10118114_B_Spag17
  gRNA
gacgaggccaaauccuauau

SEQ ID NO: 118115 - RNA, 20 nt, Artificial Sequence
  MKO10118115_B_Spag1
  gRNA
aggcagaggaucuuccacuc

SEQ ID NO: 118116 - RNA, 20 nt, Artificial Sequence
  MKO10118116_B_Spag1
  gRNA
uuccaagggauuaugcagaa

SEQ ID NO: 118117 - RNA, 20 nt, Artificial Sequence
  MKO10118117_B_Spag1
  gRNA
ucccauucugcauaaucccu

SEQ ID NO: 118118 - RNA, 20 nt, Artificial Sequence
  MKO10118118_B_Spag4
  gRNA
ccccaacucacguucuccaa

SEQ ID NO: 118119 - RNA, 20 nt, Artificial Sequence
  MKO10118119_B_Spag4
  gRNA
ccuguaccugaucccuccuu

SEQ ID NO: 118120 - RNA, 20 nt, Artificial Sequence
  MKO10118120_B_Spag4
  gRNA
gucccuaggccuccucuuuc

SEQ ID NO: 118121 - RNA, 20 nt, Artificial Sequence
  MKO10118121_B_Spag5
  gRNA
ggucagcgcggagaucauag

SEQ ID NO: 118122 - RNA, 20 nt, Artificial Sequence
  MKO10118122_B_Spag5
  gRNA
accccucgccacguguucug

SEQ ID NO: 118123 - RNA, 20 nt, Artificial Sequence
  MKO10118123_B_Spag5
  gRNA
uuccaagucgugucgggaca

SEQ ID NO: 118124 - RNA, 20 nt, Artificial Sequence
  MKO10118124_B_Spag6
  gRNA
aacagaauuaucucaagccg

SEQ ID NO: 118125 - RNA, 20 nt, Artificial Sequence
  MKO10118125_B_Spag6
  gRNA
cauaguugacugcggagcuc

SEQ ID NO: 118126 - RNA, 20 nt, Artificial Sequence
  MKO10118126_B_Spag6
  gRNA
aauucaacagacugcagcuu

SEQ ID NO: 118127 - RNA, 20 nt, Artificial Sequence
  MKO10118127_B_Spag7
  gRNA
ggucccacuccucuccauga

SEQ ID NO: 118128 - RNA, 20 nt, Artificial Sequence
  MKO10118128_B_Spag7
  gRNA
uuacagacaugaugugguag

SEQ ID NO: 118129 - RNA, 20 nt, Artificial Sequence
  MKO10118129_B_Spag7
  gRNA
cuaugucaugaucuucaaaa

SEQ ID NO: 118130 - RNA, 20 nt, Artificial Sequence
  MKO10118130_B_Spag8
  gRNA
cucaccagaucuggugucgc

SEQ ID NO: 118131 - RNA, 20 nt, Artificial Sequence
  MKO10118131_B_Spag8
  gRNA
agggauuugauccagcuggu

SEQ ID NO: 118132 - RNA, 20 nt, Artificial Sequence
  MKO10118132_B_Spag8
  gRNA
cacaucugucagccacuucg

SEQ ID NO: 118133 - RNA, 20 nt, Artificial Sequence
  MKO10118133_B_Spag9
  gRNA
gagacuaggaaugugucuac

SEQ ID NO: 118134 - RNA, 20 nt, Artificial Sequence
  MKO10118134_B_Spag9
  gRNA
uugaaccuuuauauccacug

SEQ ID NO: 118135 - RNA, 20 nt, Artificial Sequence
  MKO10118135_B_Spag9
  gRNA
acguucucauaccagccuga

SEQ ID NO: 118136 - RNA, 20 nt, Artificial Sequence
  MKO10118136_B_Spam1
  gRNA
uaugaguuuagcacaacgug

SEQ ID NO: 118137 - RNA, 20 nt, Artificial Sequence
  MKO10118137_B_Spam1
  gRNA
caagacgugaaugugugcgu

SEQ ID NO: 118138 - RNA, 20 nt, Artificial Sequence
  MKO10118138_B_Spam1
  gRNA
auuguugcucuggguaccuc

SEQ ID NO: 118139 - RNA, 20 nt, Artificial Sequence
  MKO10118139_B_Sparcl1
  gRNA
cccugcaaaaauccuagauc

SEQ ID NO: 118140 - RNA, 20 nt, Artificial Sequence
  MKO10118140_B_Sparcl1
  gRNA
gacgcuacaguccccauugc

SEQ ID NO: 118141 - RNA, 20 nt, Artificial Sequence
  MKO10118141_B_Sparcl1
  gRNA
cuugaguugcccucaucuga

SEQ ID NO: 118142 - RNA, 20 nt, Artificial Sequence
  MKO10118142_B_Sparc
  gRNA
ugcaugguccgauguagucc

SEQ ID NO: 118143 - RNA, 20 nt, Artificial Sequence
  MKO10118143_B_Sparc
  gRNA
ugugggugccaacccagucc

SEQ ID NO: 118144 - RNA, 20 nt, Artificial Sequence
  MKO10118144_B_Sparc
  gRNA
gauaguggaggaggaaaccg

SEQ ID NO: 118145 - RNA, 20 nt, Artificial Sequence
  MKO10118145_B_Spast
  gRNA
aggaaucgcuguuauaguua

SEQ ID NO: 118146 - RNA, 20 nt, Artificial Sequence
  MKO10118146_B_Spast
  gRNA
ucuggagcaagaccgggacc

SEQ ID NO: 118147 - RNA, 20 nt, Artificial Sequence
  MKO10118147_B_Spast
  gRNA
aaggaccguuuacaacuucu

SEQ ID NO: 118148 - RNA, 20 nt, Artificial Sequence
  MKO10118148_B_Spaua13
  gRNA
uggaccgcguggggcggcga

SEQ ID NO: 118149 - RNA, 20 nt, Artificial Sequence
  MKO10118149_B_Spaua13
  gRNA
ucugccgucgccgccccacg

SEQ ID NO: 118150 - RNA, 20 nt, Artificial Sequence
  MKO10118150_B_Spaua13
  gRNA
gcagguaccgaggguuggcc

SEQ ID NO: 118151 - RNA, 20 nt, Artificial Sequence
  MKO10118151_B_Spaua16
  gRNA
cugccugacgaagaugguuu

SEQ ID NO: 118152 - RNA, 20 nt, Artificial Sequence
  MKO10118152_B_Spaua16
  gRNA
gaacauguaguccgcaauca

SEQ ID NO: 118153 - RNA, 20 nt, Artificial Sequence
  MKO10118153_B_Spaua16
  gRNA
ucacaugcuaccuacguaug

SEQ ID NO: 118154 - RNA, 20 nt, Artificial Sequence
  MKO10118154_B_Spaua17
  gRNA
uauuuaccucaacaacaagu

SEQ ID NO: 118155 - RNA, 20 nt, Artificial Sequence
  MKO10118155_B_Spaua17
  gRNA
uagaaagucaguacuacuuu

SEQ ID NO: 118156 - RNA, 20 nt, Artificial Sequence
  MKO10118156_B_Spaua17
  gRNA
uagugacaauuauucaaaag

SEQ ID NO: 118157 - RNA, 20 nt, Artificial Sequence
  MKO10118157_B_Spaua18
  gRNA
ucuuacagucuggcugaaag

SEQ ID NO: 118158 - RNA, 20 nt, Artificial Sequence
  MKO10118158_B_Spaua18
  gRNA
gucugagaugugugcuacac

SEQ ID NO: 118159 - RNA, 20 nt, Artificial Sequence
  MKO10118159_B_Spaua18
  gRNA
cucuuagggggaaauaauga

SEQ ID NO: 118160 - RNA, 20 nt, Artificial Sequence
  MKO10118160_B_Spaua19
  gRNA
acgucauccaucacuucacu

SEQ ID NO: 118161 - RNA, 20 nt, Artificial Sequence
  MKO10118161_B_Spaua19
  gRNA
aucaacgacucucccaccca

SEQ ID NO: 118162 - RNA, 20 nt, Artificial Sequence
  MKO10118162_B_Spaua19
  gRNA
guucaaccagugcugcacaa

SEQ ID NO: 118163 - RNA, 20 nt, Artificial Sequence
  MKO10118163_B_Spaua1
  gRNA
gagcgucuuggggaguuucu

SEQ ID NO: 118164 - RNA, 20 nt, Artificial Sequence
  MKO10118164_B_Spaua1
  gRNA
aacaguuacuuuagaugaac

SEQ ID NO: 118165 - RNA, 20 nt, Artificial Sequence
  MKO10118165_B_Spaua1
  gRNA
auuaacaacuuuauuucugc

SEQ ID NO: 118166 - RNA, 20 nt, Artificial Sequence
  MKO10118166_B_Spaua20
  gRNA
gggcaccuacuucccgccag

SEQ ID NO: 118167 - RNA, 20 nt, Artificial Sequence
  MKO10118167_B_Spaua20
  gRNA
guugggucuagguaccccug

SEQ ID NO: 118168 - RNA, 20 nt, Artificial Sequence
  MKO10118168_B_Spaua20
  gRNA
ugggguacucuaccugucac

SEQ ID NO: 118169 - RNA, 20 nt, Artificial Sequence
  MKO10118169_B_Spaua21
  gRNA
ccuucuugccgagagcugcc

SEQ ID NO: 118170 - RNA, 20 nt, Artificial Sequence
  MKO10118170_B_Spaua21
  gRNA
gaggcgaggcugccgagauc

SEQ ID NO: 118171 - RNA, 20 nt, Artificial Sequence
  MKO10118171_B_Spaua21
  gRNA
gagagggagcuccgacccac

SEQ ID NO: 118172 - RNA, 20 nt, Artificial Sequence
  MKO10118172_B_Spaua22
  gRNA
aguacuguuucugacaguua

SEQ ID NO: 118173 - RNA, 20 nt, Artificial Sequence
  MKO10118173_B_Spaua22
  gRNA
uucuuaccuguuggaaaaga

SEQ ID NO: 118174 - RNA, 20 nt, Artificial Sequence
  MKO10118174_B_Spaua22
  gRNA
cacagaaucuugacuucucc

SEQ ID NO: 118175 - RNA, 20 nt, Artificial Sequence
  MKO10118175_B_Spaua24
  gRNA
gaugagcugguccuucuugc

SEQ ID NO: 118176 - RNA, 20 nt, Artificial Sequence
  MKO10118176_B_Spaua24
  gRNA
ugccaaaaccaaagcccucc

SEQ ID NO: 118177 - RNA, 20 nt, Artificial Sequence
  MKO10118177_B_Spaua24
  gRNA
ucuguugcagaugguucucc

SEQ ID NO: 118178 - RNA, 20 nt, Artificial Sequence
  MKO10118178_B_Spaua25
  gRNA
gcccucucaccuuggccaga

SEQ ID NO: 118179 - RNA, 20 nt, Artificial Sequence
  MKO10118179_B_Spaua25
  gRNA
agguaugccagcgaucauca

SEQ ID NO: 118180 - RNA, 20 nt, Artificial Sequence
  MKO10118180_B_Spaua25
  gRNA
agguccucuucccgcaggcc

SEQ ID NO: 118181 - RNA, 20 nt, Artificial Sequence
  MKO10118181_B_Spaua2l
  gRNA
ccccacuagcccgucgagcu

SEQ ID NO: 118182 - RNA, 20 nt, Artificial Sequence
  MKO10118182_B_Spaua2l
  gRNA
cgccuuugagcuccuagagc

SEQ ID NO: 118183 - RNA, 20 nt, Artificial Sequence
  MKO10118183_B_Spaua2l
  gRNA
cuccgagcucgacgggcuag

SEQ ID NO: 118184 - RNA, 20 nt, Artificial Sequence
  MKO10118184_B_Spaua2
  gRNA
cagcgaugaguaccugcgcg

SEQ ID NO: 118185 - RNA, 20 nt, Artificial Sequence
  MKO10118185_B_Spaua2
  gRNA
cuaugucaaguccacguugc

SEQ ID NO: 118186 - RNA, 20 nt, Artificial Sequence
  MKO10118186_B_Spaua2
  gRNA
aggacauccgagccauucua

SEQ ID NO: 118187 - RNA, 20 nt, Artificial Sequence
  MKO10118187_B_Spaua31d1a
  gRNA
guauaagcaguuucaauauc

SEQ ID NO: 118188 - RNA, 20 nt, Artificial Sequence
  MKO10118188_B_Spaua31d1a
  gRNA
gaaacugcuuauacauuugc

SEQ ID NO: 118189 - RNA, 20 nt, Artificial Sequence
  MKO10118189_B_Spaua31d1a
  gRNA
ggcugcagacaguccuacaa

SEQ ID NO: 118190 - RNA, 20 nt, Artificial Sequence
  MKO10118190_B_Spaua31d1b
  gRNA
aagagaaggcaaacccucaa

SEQ ID NO: 118191 - RNA, 20 nt, Artificial Sequence
  MKO10118191_B_Spaua31d1b
  gRNA
uccucugcgccgcuucucuc

SEQ ID NO: 118192 - RNA, 20 nt, Artificial Sequence
  MKO10118192_B_Spaua31d1b
  gRNA
aacugcuuauacacuugcug

SEQ ID NO: 118193 - RNA, 20 nt, Artificial Sequence
  MKO10118193_B_Spaua31d1c
  gRNA
ggucuauucuucuauaccug

SEQ ID NO: 118194 - RNA, 20 nt, Artificial Sequence
  MKO10118194_B_Spaua31d1c
  gRNA
agcugcugucuguugugcaa

SEQ ID NO: 118195 - RNA, 20 nt, Artificial Sequence
  MKO10118195_B_Spaua31d1c
  gRNA
agggcucagcuaacaaagaa

SEQ ID NO: 118196 - RNA, 20 nt, Artificial Sequence
  MKO10118196_B_Spaua31d1d
  gRNA
uuccuuagcgcuaguuagaa

SEQ ID NO: 118197 - RNA, 20 nt, Artificial Sequence
  MKO10118197_B_Spaua31d1d
  gRNA
gaaaggagagcgucauuuaa

SEQ ID NO: 118198 - RNA, 20 nt, Artificial Sequence
  MKO10118198_B_Spaua31d1d
  gRNA
agcugcaagcuguugugcaa

SEQ ID NO: 118199 - RNA, 20 nt, Artificial Sequence
  MKO10118199_B_Spaua31
  gRNA
cauguccauugcccauauag

SEQ ID NO: 118200 - RNA, 20 nt, Artificial Sequence
  MKO10118200_B_Spaua31
  gRNA
cauuguaggaaugaugcaaa

SEQ ID NO: 118201 - RNA, 20 nt, Artificial Sequence
  MKO10118201_B_Spaua31
  gRNA
gccaguucaagaaaaaguuu

SEQ ID NO: 118202 - RNA, 20 nt, Artificial Sequence
  MKO10118202_B_Spaua32
  gRNA
cacugaauccuugccgcagc

SEQ ID NO: 118203 - RNA, 20 nt, Artificial Sequence
  MKO10118203_B_Spaua32
  gRNA
gaggggaugacagcuuaaaa

SEQ ID NO: 118204 - RNA, 20 nt, Artificial Sequence
  MKO10118204_B_Spaua32
  gRNA
ucacacccaugaagaaaacg

SEQ ID NO: 118205 - RNA, 20 nt, Artificial Sequence
  MKO10118205_B_Spaua33
  gRNA
cuaccuucagacgaagacga

SEQ ID NO: 118206 - RNA, 20 nt, Artificial Sequence
  MKO10118206_B_Spaua33
  gRNA
cccuuuaccuuucuucucuc

SEQ ID NO: 118207 - RNA, 20 nt, Artificial Sequence
  MKO10118207_B_Spaua33
  gRNA
agcaaacccagagagaagaa

SEQ ID NO: 118208 - RNA, 20 nt, Artificial Sequence
  MKO10118208_B_Spaua3
  gRNA
augaccagucccgagguagg

SEQ ID NO: 118209 - RNA, 20 nt, Artificial Sequence
  MKO10118209_B_Spaua3
  gRNA
ggagcuagucugcggugaaa

SEQ ID NO: 118210 - RNA, 20 nt, Artificial Sequence
  MKO10118210_B_Spaua3
  gRNA
agcuugaagcacgagaguua

SEQ ID NO: 118211 - RNA, 20 nt, Artificial Sequence
  MKO10118211_B_Spaua4
  gRNA
ugaaauuagcgagaucaucc

SEQ ID NO: 118212 - RNA, 20 nt, Artificial Sequence
  MKO10118212_B_Spaua4
  gRNA
uacagaauaucucugcaacu

SEQ ID NO: 118213 - RNA, 20 nt, Artificial Sequence
  MKO10118213_B_Spaua4
  gRNA
uuucaaaggaugauaaucga

SEQ ID NO: 118214 - RNA, 20 nt, Artificial Sequence
  MKO10118214_B_Spaua5l1
  gRNA
cuccuggcagaaaugacggu

SEQ ID NO: 118215 - RNA, 20 nt, Artificial Sequence
  MKO10118215_B_Spaua5l1
  gRNA
gggagccccgaguuccgccg

SEQ ID NO: 118216 - RNA, 20 nt, Artificial Sequence
  MKO10118216_B_Spaua5l1
  gRNA
ccauccacccugucgcgccg

SEQ ID NO: 118217 - RNA, 20 nt, Artificial Sequence
  MKO10118217_B_Spaua5
  gRNA
ccuccaggaaauccugcaac

SEQ ID NO: 118218 - RNA, 20 nt, Artificial Sequence
  MKO10118218_B_Spaua5
  gRNA
cuggauagguuuauacagcc

SEQ ID NO: 118219 - RNA, 20 nt, Artificial Sequence
  MKO10118219_B_Spaua5
  gRNA
cagaauucccuuguucaucu

SEQ ID NO: 118220 - RNA, 20 nt, Artificial Sequence
  MKO10118220_B_Spaua6
  gRNA
ugcuuucagguaacuugucc

SEQ ID NO: 118221 - RNA, 20 nt, Artificial Sequence
  MKO10118221_B_Spaua6
  gRNA
uugauacagcuaguuccacc

SEQ ID NO: 118222 - RNA, 20 nt, Artificial Sequence
  MKO10118222_B_Spaua6
  gRNA
agcugugcgaccacaucucc

SEQ ID NO: 118223 - RNA, 20 nt, Artificial Sequence
  MKO10118223_B_Spaua7
  gRNA
ggaguuggcacggugugaaa

SEQ ID NO: 118224 - RNA, 20 nt, Artificial Sequence
  MKO10118224_B_Spaua7
  gRNA
cagacuaagcacccugcagc

SEQ ID NO: 118225 - RNA, 20 nt, Artificial Sequence
  MKO10118225_B_Spaua7
  gRNA
cuuuguaaauucucuacaga

SEQ ID NO: 118226 - RNA, 20 nt, Artificial Sequence
  MKO10118226_B_Spaua9
  gRNA
acccuugaaugagcguccca

SEQ ID NO: 118227 - RNA, 20 nt, Artificial Sequence
  MKO10118227_B_Spaua9
  gRNA
cuuaguugaggggcuccaga

SEQ ID NO: 118228 - RNA, 20 nt, Artificial Sequence
  MKO10118228_B_Spaua9
  gRNA
aagauuaucacagucuagcc

SEQ ID NO: 118229 - RNA, 20 nt, Artificial Sequence
  MKO10118229_B_Spauc1l
  gRNA
acgcgaucuccccaacgauu

SEQ ID NO: 118230 - RNA, 20 nt, Artificial Sequence
  MKO10118230_B_Spauc1l
  gRNA
gcaucgcuaucugacucuga

SEQ ID NO: 118231 - RNA, 20 nt, Artificial Sequence
  MKO10118231_B_Spauc1l
  gRNA
uaccauaccauugagguaau

SEQ ID NO: 118232 - RNA, 20 nt, Artificial Sequence
  MKO10118232_B_Spauc1
  gRNA
ccagagcgcguacgucucua

SEQ ID NO: 118233 - RNA, 20 nt, Artificial Sequence
  MKO10118233_B_Spauc1
  gRNA
acguucugagcaacaccuag

SEQ ID NO: 118234 - RNA, 20 nt, Artificial Sequence
  MKO10118234_B_Spauc1
  gRNA
caucagcugucccacgauga

SEQ ID NO: 118235 - RNA, 20 nt, Artificial Sequence
  MKO10118235_B_Spaus1
  gRNA
auucuagagcaucaccgugc

SEQ ID NO: 118236 - RNA, 20 nt, Artificial Sequence
  MKO10118236_B_Spaus1
  gRNA
aagaugggcagcguccugag

SEQ ID NO: 118237 - RNA, 20 nt, Artificial Sequence
  MKO10118237_B_Spaus1
  gRNA
uaccguauuucuucuucccg

SEQ ID NO: 118238 - RNA, 20 nt, Artificial Sequence
  MKO10118238_B_Spaus2l
  gRNA
gaaccuccaagggcucagcg

SEQ ID NO: 118239 - RNA, 20 nt, Artificial Sequence
  MKO10118239_B_Spaus2l
  gRNA
cuauucaaguucuuaaagaa

SEQ ID NO: 118240 - RNA, 20 nt, Artificial Sequence
  MKO10118240_B_Spaus2l
  gRNA
ucaugugaacaucaaagaga

SEQ ID NO: 118241 - RNA, 20 nt, Artificial Sequence
  MKO10118241_B_Spaus2
  gRNA
ugucaaagugcugcaagacc

SEQ ID NO: 118242 - RNA, 20 nt, Artificial Sequence
  MKO10118242_B_Spaus2
  gRNA
uuugcaguccaauacugucc

SEQ ID NO: 118243 - RNA, 20 nt, Artificial Sequence
  MKO10118243_B_Spaus2
  gRNA
ccauucuuugagcacuucac

SEQ ID NO: 118244 - RNA, 20 nt, Artificial Sequence
  MKO10118244_B_Spc24
  gRNA
aguucaucagugacuaccuc

SEQ ID NO: 118245 - RNA, 20 nt, Artificial Sequence
  MKO10118245_B_Spc24
  gRNA
auacugcccuugaucauccc

SEQ ID NO: 118246 - RNA, 20 nt, Artificial Sequence
  MKO10118246_B_Spc24
  gRNA
aguccaccacggccccacag

SEQ ID NO: 118247 - RNA, 20 nt, Artificial Sequence
  MKO10118247_B_Spc25
  gRNA
cuuagcuucauuuaugcuca

SEQ ID NO: 118248 - RNA, 20 nt, Artificial Sequence
  MKO10118248_B_Spc25
  gRNA
gaggaugacugagaugauuc

SEQ ID NO: 118249 - RNA, 20 nt, Artificial Sequence
  MKO10118249_B_Spc25
  gRNA
uucauuagcuuuguuagcag

SEQ ID NO: 118250 - RNA, 20 nt, Artificial Sequence
  MKO10118250_B_Spcs1
  gRNA
cagauaguuggguuuaucua

SEQ ID NO: 118251 - RNA, 20 nt, Artificial Sequence
  MKO10118251_B_Spcs1
  gRNA
ucuagcugacacuuccucca

SEQ ID NO: 118252 - RNA, 20 nt, Artificial Sequence
  MKO10118252_B_Spcs1
  gRNA
acugucuacauaguuauggc

SEQ ID NO: 118253 - RNA, 20 nt, Artificial Sequence
  MKO10118253_B_Spcs2
  gRNA
uccugaguccaagccaguuu

SEQ ID NO: 118254 - RNA, 20 nt, Artificial Sequence
  MKO10118254_B_Spcs2
  gRNA
agccuguaaaaauugauaag

SEQ ID NO: 118255 - RNA, 20 nt, Artificial Sequence
  MKO10118255_B_Spcs2
  gRNA
cagaaaagaccccacaggaa

SEQ ID NO: 118256 - RNA, 20 nt, Artificial Sequence
  MKO10118256_B_Spcs3
  gRNA
cucugaaccaaguuguccuu

SEQ ID NO: 118257 - RNA, 20 nt, Artificial Sequence
  MKO10118257_B_Spcs3
  gRNA
uaucaaaugugaugaauccc

SEQ ID NO: 118258 - RNA, 20 nt, Artificial Sequence
  MKO10118258_B_Spcs3
  gRNA
aucuagagaauauauuugau

SEQ ID NO: 118259 - RNA, 20 nt, Artificial Sequence
  MKO10118259_B_Spdef
  gRNA
ccuacucaccgcaguaguga

SEQ ID NO: 118260 - RNA, 20 nt, Artificial Sequence
  MKO10118260_B_Spdef
  gRNA
auccguccagcccuccucgc

SEQ ID NO: 118261 - RNA, 20 nt, Artificial Sequence
  MKO10118261_B_Spdef
  gRNA
cuucauccgcuggcucaaca

SEQ ID NO: 118262 - RNA, 20 nt, Artificial Sequence
  MKO10118262_B_Spdl1
  gRNA
caauacuuccuuacugcacc

SEQ ID NO: 118263 - RNA, 20 nt, Artificial Sequence
  MKO10118263_B_Spdl1
  gRNA
agacgcacaccuuguucuuc

SEQ ID NO: 118264 - RNA, 20 nt, Artificial Sequence
  MKO10118264_B_Spdl1
  gRNA
cuucuuuaagccugucuacc

SEQ ID NO: 118265 - RNA, 20 nt, Artificial Sequence
  MKO10118265_B_Spdya
  gRNA
guccuauucuuaaagauagu

SEQ ID NO: 118266 - RNA, 20 nt, Artificial Sequence
  MKO10118266_B_Spdya
  gRNA
uuacuauaaaugagcauacc

SEQ ID NO: 118267 - RNA, 20 nt, Artificial Sequence
  MKO10118267_B_Spdya
  gRNA
agucaauucugucccagagu

SEQ ID NO: 118268 - RNA, 20 nt, Artificial Sequence
  MKO10118268_B_Spdyb
  gRNA
ugaacugaaagcgcaguuug

SEQ ID NO: 118269 - RNA, 20 nt, Artificial Sequence
  MKO10118269_B_Spdyb
  gRNA
uuccuucacagaggauccug

SEQ ID NO: 118270 - RNA, 20 nt, Artificial Sequence
  MKO10118270_B_Spdyb
  gRNA
cacccucagcaucuuguccc

SEQ ID NO: 118271 - RNA, 20 nt, Artificial Sequence
  MKO10118271_B_Specc1l
  gRNA
ggaggaguaaacgugacuaa

SEQ ID NO: 118272 - RNA, 20 nt, Artificial Sequence
  MKO10118272_B_Specc1l
  gRNA
ugaaggcgcugcagaugaac

SEQ ID NO: 118273 - RNA, 20 nt, Artificial Sequence
  MKO10118273_B_Specc1l
  gRNA
agaugaauaccgagcuuucc

SEQ ID NO: 118274 - RNA, 20 nt, Artificial Sequence
  MKO10118274_B_Specc1
  gRNA
gcgucuuuaacugccgcucu

SEQ ID NO: 118275 - RNA, 20 nt, Artificial Sequence
  MKO10118275_B_Specc1
  gRNA
gacgcuaacaaaacagauaa

SEQ ID NO: 118276 - RNA, 20 nt, Artificial Sequence
  MKO10118276_B_Specc1
  gRNA
ggccaacgacaucaagugug

SEQ ID NO: 118277 - RNA, 20 nt, Artificial Sequence
  MKO10118277_B_Speer2
  gRNA
uugccugaucgcuuucaaag

SEQ ID NO: 118278 - RNA, 20 nt, Artificial Sequence
  MKO10118278_B_Speer2
  gRNA
gcucucccgcuucuguguga

SEQ ID NO: 118279 - RNA, 20 nt, Artificial Sequence
  MKO10118279_B_Speer2
  gRNA
cuuguucgucuuuaccauuc

SEQ ID NO: 118280 - RNA, 20 nt, Artificial Sequence
  MKO10118280_B_Speer3
  gRNA
gcucuccccuuucuguguga

SEQ ID NO: 118281 - RNA, 20 nt, Artificial Sequence
  MKO10118281_B_Speer3
  gRNA
gcacaaugaguuucugccuc

SEQ ID NO: 118282 - RNA, 20 nt, Artificial Sequence
  MKO10118282_B_Speer3
  gRNA
auguaucuucuggaagggcc

SEQ ID NO: 118283 - RNA, 20 nt, Artificial Sequence
  MKO10118283_B_Speer4a
  gRNA
gguagggccuauucccacgc

SEQ ID NO: 118284 - RNA, 20 nt, Artificial Sequence
  MKO10118284_B_Speer4a
  gRNA
auaucuacacaacuuagaga

SEQ ID NO: 118285 - RNA, 20 nt, Artificial Sequence
  MKO10118285_B_Speer4a
  gRNA
ugaacuccugcuuguucucu

SEQ ID NO: 118286 - RNA, 20 nt, Artificial Sequence
  MKO10118286_B_Speer4b
  gRNA
uccuucucuuccuucucaaa

SEQ ID NO: 118287 - RNA, 20 nt, Artificial Sequence
  MKO10118287_B_Speer4b
  gRNA
aagcaagaagccguuugaga

SEQ ID NO: 118288 - RNA, 20 nt, Artificial Sequence
  MKO10118288_B_Speer4b
  gRNA
uuauaaagaacuaaaauuaa

SEQ ID NO: 118289 - RNA, 20 nt, Artificial Sequence
  MKO10118289_B_Speer4c
  gRNA
cuggggcaaggcccuaccac

SEQ ID NO: 118290 - RNA, 20 nt, Artificial Sequence
  MKO10118290_B_Speer4c
  gRNA
cuuacaguaaccugcacagc

SEQ ID NO: 118291 - RNA, 20 nt, Artificial Sequence
  MKO10118291_B_Speer4c
  gRNA
uuugucucuaccugauauuc

SEQ ID NO: 118292 - RNA, 20 nt, Artificial Sequence
  MKO10118292_B_Speer4d
  gRNA
auuccucggucacguagauc

SEQ ID NO: 118293 - RNA, 20 nt, Artificial Sequence
  MKO10118293_B_Speer4d
  gRNA
ugagcuccugcuuguucucu

SEQ ID NO: 118294 - RNA, 20 nt, Artificial Sequence
  MKO10118294_B_Speer4d
  gRNA
cuggggcaaggcccuaccac

SEQ ID NO: 118295 - RNA, 20 nt, Artificial Sequence
  MKO10118295_B_Speer4e
  gRNA
caauguauaccucuuguuca

SEQ ID NO: 118296 - RNA, 20 nt, Artificial Sequence
  MKO10118296_B_Speer4e
  gRNA
cuggggcaaggcccuaccac

SEQ ID NO: 118297 - RNA, 20 nt, Artificial Sequence
  MKO10118297_B_Speer4e
  gRNA
cuccuucuugagcuccugcu

SEQ ID NO: 118298 - RNA, 20 nt, Artificial Sequence
  MKO10118298_B_Speer4f
  gRNA
ucagcaggggccuacugggg

SEQ ID NO: 118299 - RNA, 20 nt, Artificial Sequence
  MKO10118299_B_Speer4f
  gRNA
ugaggaguugccaccccagu

SEQ ID NO: 118300 - RNA, 20 nt, Artificial Sequence
  MKO10118300_B_Speer4f
  gRNA
cacaagcaaucaguuugaga

SEQ ID NO: 118301 - RNA, 20 nt, Artificial Sequence
  MKO10118301_B_Spef1
  gRNA
ugucuuagguuugccccaga

SEQ ID NO: 118302 - RNA, 20 nt, Artificial Sequence
  MKO10118302_B_Spef1
  gRNA
cacccucuccucgaaccuuc

SEQ ID NO: 118303 - RNA, 20 nt, Artificial Sequence
  MKO10118303_B_Spef1
  gRNA
uagcaguggcuacauggaua

SEQ ID NO: 118304 - RNA, 20 nt, Artificial Sequence
  MKO10118304_B_Spef2
  gRNA
ugcaaccccagacaaacuug

SEQ ID NO: 118305 - RNA, 20 nt, Artificial Sequence
  MKO10118305_B_Spef2
  gRNA
uacccuaccuuucuuuaauu

SEQ ID NO: 118306 - RNA, 20 nt, Artificial Sequence
  MKO10118306_B_Spef2
  gRNA
aggucccaagucauuugcaa

SEQ ID NO: 118307 - RNA, 20 nt, Artificial Sequence
  MKO10118307_B_Speg
  gRNA
aggggucugaccuugaacgu

SEQ ID NO: 118308 - RNA, 20 nt, Artificial Sequence
  MKO10118308_B_Speg
  gRNA
cauuaugagcauccgugugc

SEQ ID NO: 118309 - RNA, 20 nt, Artificial Sequence
  MKO10118309_B_Speg
  gRNA
cccccgccaugaagaagcug

SEQ ID NO: 118310 - RNA, 20 nt, Artificial Sequence
  MKO10118310_B_Spem1
  gRNA
cuuaucgucuguauuaacau

SEQ ID NO: 118311 - RNA, 20 nt, Artificial Sequence
  MKO10118311_B_Spem1
  gRNA
ccccaacaucaacaacugcc

SEQ ID NO: 118312 - RNA, 20 nt, Artificial Sequence
  MKO10118312_B_Spem1
  gRNA
uuccauaucauuugugaaaa

SEQ ID NO: 118313 - RNA, 20 nt, Artificial Sequence
  MKO10118313_B_Spen
  gRNA
aacuuaccuguagagcguac

SEQ ID NO: 118314 - RNA, 20 nt, Artificial Sequence
  MKO10118314_B_Spen
  gRNA
ucuacagggacgacauuacc

SEQ ID NO: 118315 - RNA, 20 nt, Artificial Sequence
  MKO10118315_B_Spen
  gRNA
cuucuucggcaugcagaucg

SEQ ID NO: 118316 - RNA, 20 nt, Artificial Sequence
  MKO10118316_B_Spert
  gRNA
ugagguagaaucacauugac

SEQ ID NO: 118317 - RNA, 20 nt, Artificial Sequence
  MKO10118317_B_Spert
  gRNA
agauaaguuaccugugccuu

SEQ ID NO: 118318 - RNA, 20 nt, Artificial Sequence
  MKO10118318_B_Spert
  gRNA
ccauaccaaugugagaugcc

SEQ ID NO: 118319 - RNA, 20 nt, Artificial Sequence
  MKO10118319_B_Spesp1
  gRNA
aacgacgcccaugaagcugg

SEQ ID NO: 118320 - RNA, 20 nt, Artificial Sequence
  MKO10118320_B_Spesp1
  gRNA
uuacaguaauacgaguugcc

SEQ ID NO: 118321 - RNA, 20 nt, Artificial Sequence
  MKO10118321_B_Spesp1
  gRNA
cgcagccgccgagcacaagu

SEQ ID NO: 118322 - RNA, 20 nt, Artificial Sequence
  MKO10118322_B_Spg11
  gRNA
cauccuacgcguuguguuuc

SEQ ID NO: 118323 - RNA, 20 nt, Artificial Sequence
  MKO10118323_B_Spg11
  gRNA
ugugacgcagccuuauuaca

SEQ ID NO: 118324 - RNA, 20 nt, Artificial Sequence
  MKO10118324_B_Spg11
  gRNA
cccacaacagccguguaaua

SEQ ID NO: 118325 - RNA, 20 nt, Artificial Sequence
  MKO10118325_B_Spg20
  gRNA
aaucgaaagaauugccugaa

SEQ ID NO: 118326 - RNA, 20 nt, Artificial Sequence
  MKO10118326_B_Spg20
  gRNA
uauacccucuaguuccugau

SEQ ID NO: 118327 - RNA, 20 nt, Artificial Sequence
  MKO10118327_B_Spg20
  gRNA
cuucgcuauguagagacccc

SEQ ID NO: 118328 - RNA, 20 nt, Artificial Sequence
  MKO10118328_B_Spg21
  gRNA
aguugcaguauccaguuuau

SEQ ID NO: 118329 - RNA, 20 nt, Artificial Sequence
  MKO10118329_B_Spg21
  gRNA
cuuugacuggaugggguuac

SEQ ID NO: 118330 - RNA, 20 nt, Artificial Sequence
  MKO10118330_B_Spg21
  gRNA
gaagauagacgugucacuga

SEQ ID NO: 118331 - RNA, 20 nt, Artificial Sequence
  MKO10118331_B_Spg7
  gRNA
aaagaauccuguccgcuugu

SEQ ID NO: 118332 - RNA, 20 nt, Artificial Sequence
  MKO10118332_B_Spg7
  gRNA
ccgcuaauaccuucaaagcu

SEQ ID NO: 118333 - RNA, 20 nt, Artificial Sequence
  MKO10118333_B_Spg7
  gRNA
ugcauaccuucaucaucuuc

SEQ ID NO: 118334 - RNA, 20 nt, Artificial Sequence
  MKO10118334_B_Sphk1
  gRNA
accggugaguaucaguuuaa

SEQ ID NO: 118335 - RNA, 20 nt, Artificial Sequence
  MKO10118335_B_Sphk1
  gRNA
agaagcugccagcgcauugc

SEQ ID NO: 118336 - RNA, 20 nt, Artificial Sequence
  MKO10118336_B_Sphk1
  gRNA
cuauuuaacagguggugaau

SEQ ID NO: 118337 - RNA, 20 nt, Artificial Sequence
  MKO10118337_B_Sphk2
  gRNA
uagcgcauugcccgauccac

SEQ ID NO: 118338 - RNA, 20 nt, Artificial Sequence
  MKO10118338_B_Sphk2
  gRNA
gugguccauacagcgcugcc

SEQ ID NO: 118339 - RNA, 20 nt, Artificial Sequence
  MKO10118339_B_Sphk2
  gRNA
cucauauuggucaaucccuu

SEQ ID NO: 118340 - RNA, 20 nt, Artificial Sequence
  MKO10118340_B_Sphkap
  gRNA
ucugaaccuucaugcaucag

SEQ ID NO: 118341 - RNA, 20 nt, Artificial Sequence
  MKO10118341_B_Sphkap
  gRNA
gaaacuggucaauguuucac

SEQ ID NO: 118342 - RNA, 20 nt, Artificial Sequence
  MKO10118342_B_Sphkap
  gRNA
ggacauucauggagcugaug

SEQ ID NO: 118343 - RNA, 20 nt, Artificial Sequence
  MKO10118343_B_Spi1
  gRNA
uaaguaaccaagucauccga

SEQ ID NO: 118344 - RNA, 20 nt, Artificial Sequence
  MKO10118344_B_Spi1
  gRNA
aguucucaaacucguuguug

SEQ ID NO: 118345 - RNA, 20 nt, Artificial Sequence
  MKO10118345_B_Spi1
  gRNA
acagcagcucuaucgccaca

SEQ ID NO: 118346 - RNA, 20 nt, Artificial Sequence
  MKO10118346_B_Spib
  gRNA
ccccauggggcuauaggugg

SEQ ID NO: 118347 - RNA, 20 nt, Artificial Sequence
  MKO10118347_B_Spib
  gRNA
gaaggcuucauagggagcga

SEQ ID NO: 118348 - RNA, 20 nt, Artificial Sequence
  MKO10118348_B_Spib
  gRNA
ccaaggcccccaucugaauc

SEQ ID NO: 118349 - RNA, 20 nt, Artificial Sequence
  MKO10118349_B_Spice1
  gRNA
ugaaugaucuaacaguucac

SEQ ID NO: 118350 - RNA, 20 nt, Artificial Sequence
  MKO10118350_B_Spice1
  gRNA
ugaaucaaucauagagccuc

SEQ ID NO: 118351 - RNA, 20 nt, Artificial Sequence
  MKO10118351_B_Spice1
  gRNA
gcucuaugauugauucauua

SEQ ID NO: 118352 - RNA, 20 nt, Artificial Sequence
  MKO10118352_B_Spic
  gRNA
cagcuauguucuguacggau

SEQ ID NO: 118353 - RNA, 20 nt, Artificial Sequence
  MKO10118353_B_Spic
  gRNA
aaacugagguagcccugauc

SEQ ID NO: 118354 - RNA, 20 nt, Artificial Sequence
  MKO10118354_B_Spic
  gRNA
agaagggggguuguaccagc

SEQ ID NO: 118355 - RNA, 20 nt, Artificial Sequence
  MKO10118355_B_Spidr
  gRNA
caaguguggagaaggauuuc

SEQ ID NO: 118356 - RNA, 20 nt, Artificial Sequence
  MKO10118356_B_Spidr
  gRNA
caagucugacaagugaugac

SEQ ID NO: 118357 - RNA, 20 nt, Artificial Sequence
  MKO10118357_B_Spidr
  gRNA
aucacuugucagacuugcac

SEQ ID NO: 118358 - RNA, 20 nt, Artificial Sequence
  MKO10118358_B_Spin1
  gRNA
gaaguccucccugauagagu

SEQ ID NO: 118359 - RNA, 20 nt, Artificial Sequence
  MKO10118359_B_Spin1
  gRNA
augauucgccuccagcagaa

SEQ ID NO: 118360 - RNA, 20 nt, Artificial Sequence
  MKO10118360_B_Spin1
  gRNA
uacuggaaucaggcaugaug

SEQ ID NO: 118361 - RNA, 20 nt, Artificial Sequence
  MKO10118361_B_Spin2-ps1
  gRNA
auuaacuucuuugcccacua

SEQ ID NO: 118362 - RNA, 20 nt, Artificial Sequence
  MKO10118362_B_Spin2-ps1
  gRNA
aaagcuggaaucagugacuc

SEQ ID NO: 118363 - RNA, 20 nt, Artificial Sequence
  MKO10118363_B_Spin2-ps1
  gRNA
agaaguuaaucaucuauuug

SEQ ID NO: 118364 - RNA, 20 nt, Artificial Sequence
  MKO10118364_B_Spin2c
  gRNA
ccagagaacgacaccuuauc

SEQ ID NO: 118365 - RNA, 20 nt, Artificial Sequence
  MKO10118365_B_Spin2c
  gRNA
ggagcagaucuucaucccgu

SEQ ID NO: 118366 - RNA, 20 nt, Artificial Sequence
  MKO10118366_B_Spin2c
  gRNA
cacuggacucuggcaugaua

SEQ ID NO: 118367 - RNA, 20 nt, Artificial Sequence
  MKO10118367_B_Spin2d
  gRNA
agcauggcucuaaggaagag

SEQ ID NO: 118368 - RNA, 20 nt, Artificial Sequence
  MKO10118368_B_Spin2d
  gRNA
auuaacuucuuugcccacua

SEQ ID NO: 118369 - RNA, 20 nt, Artificial Sequence
  MKO10118369_B_Spin2d
  gRNA
ccugagccaagcgccuaucu

SEQ ID NO: 118370 - RNA, 20 nt, Artificial Sequence
  MKO10118370_B_Spin4
  gRNA
gccaggcgagagucaaugcg

SEQ ID NO: 118371 - RNA, 20 nt, Artificial Sequence
  MKO10118371_B_Spin4
  gRNA
gaaagguacugugcucgagc

SEQ ID NO: 118372 - RNA, 20 nt, Artificial Sequence
  MKO10118372_B_Spin4
  gRNA
guggaacacgccaaagacga

SEQ ID NO: 118373 - RNA, 20 nt, Artificial Sequence
  MKO10118373_B_Spink10
  gRNA
aauguacucaccauaguaaa

SEQ ID NO: 118374 - RNA, 20 nt, Artificial Sequence
  MKO10118374_B_Spink10
  gRNA
uuuccgcuaguugaacauac

SEQ ID NO: 118375 - RNA, 20 nt, Artificial Sequence
  MKO10118375_B_Spink10
  gRNA
caaugucuuccucucuauua

SEQ ID NO: 118376 - RNA, 20 nt, Artificial Sequence
  MKO10118376_B_Spink11
  gRNA
uccagagagucuuagaaaag

SEQ ID NO: 118377 - RNA, 20 nt, Artificial Sequence
  MKO10118377_B_Spink11
  gRNA
ccaauuaaauauaaauacca

SEQ ID NO: 118378 - RNA, 20 nt, Artificial Sequence
  MKO10118378_B_Spink11
  gRNA
uugauaaaauguccucaaca

SEQ ID NO: 118379 - RNA, 20 nt, Artificial Sequence
  MKO10118379_B_Spink12
  gRNA
uauuggcuuacauggcuguu

SEQ ID NO: 118380 - RNA, 20 nt, Artificial Sequence
  MKO10118380_B_Spink12
  gRNA
aagacccacaaaccugugug

SEQ ID NO: 118381 - RNA, 20 nt, Artificial Sequence
  MKO10118381_B_Spink12
  gRNA
aaacuugguuucaaacauga

SEQ ID NO: 118382 - RNA, 20 nt, Artificial Sequence
  MKO10118382_B_Spink13
  gRNA
acuuuccauauuugacaaac

SEQ ID NO: 118383 - RNA, 20 nt, Artificial Sequence
  MKO10118383_B_Spink13
  gRNA
gcauauguuugugcuaccaa

SEQ ID NO: 118384 - RNA, 20 nt, Artificial Sequence
  MKO10118384_B_Spink13
  gRNA
aaagaagccaugaaaagaag

SEQ ID NO: 118385 - RNA, 20 nt, Artificial Sequence
  MKO10118385_B_Spink14
  gRNA
caccagccaggauaaccaag

SEQ ID NO: 118386 - RNA, 20 nt, Artificial Sequence
  MKO10118386_B_Spink14
  gRNA
gaccuaaaacaacccaucug

SEQ ID NO: 118387 - RNA, 20 nt, Artificial Sequence
  MKO10118387_B_Spink14
  gRNA
guucuccauuaugcuccacu

SEQ ID NO: 118388 - RNA, 20 nt, Artificial Sequence
  MKO10118388_B_Spink2
  gRNA
cuccuggucacagacuuugc

SEQ ID NO: 118389 - RNA, 20 nt, Artificial Sequence
  MKO10118389_B_Spink2
  gRNA
cgucuuugaugauauuaaua

SEQ ID NO: 118390 - RNA, 20 nt, Artificial Sequence
  MKO10118390_B_Spink2
  gRNA
ccgauucucaaaucaugaag

SEQ ID NO: 118391 - RNA, 20 nt, Artificial Sequence
  MKO10118391_B_Spink3
  gRNA
auuccgucagucccacacac

SEQ ID NO: 118392 - RNA, 20 nt, Artificial Sequence
  MKO10118392_B_Spink3
  gRNA
caucuuucuucucagugcuu

SEQ ID NO: 118393 - RNA, 20 nt, Artificial Sequence
  MKO10118393_B_Spink3
  gRNA
ggcuaguugccaugaugcag

SEQ ID NO: 118394 - RNA, 20 nt, Artificial Sequence
  MKO10118394_B_Spink4
  gRNA
ugauucuaggaaaaccauga

SEQ ID NO: 118395 - RNA, 20 nt, Artificial Sequence
  MKO10118395_B_Spink4
  gRNA
acucaccccuguccaugcca

SEQ ID NO: 118396 - RNA, 20 nt, Artificial Sequence
  MKO10118396_B_Spink4
  gRNA
caugauuugaauguccuuca

SEQ ID NO: 118397 - RNA, 20 nt, Artificial Sequence
  MKO10118397_B_Spink5
  gRNA
cacacaguucacaucuacug

SEQ ID NO: 118398 - RNA, 20 nt, Artificial Sequence
  MKO10118398_B_Spink5
  gRNA
ucucaccuuugcugggucag

SEQ ID NO: 118399 - RNA, 20 nt, Artificial Sequence
  MKO10118399_B_Spink5
  gRNA
ucugacacuucuucaguuug

SEQ ID NO: 118400 - RNA, 20 nt, Artificial Sequence
  MKO10118400_B_Spink6
  gRNA
ugccuuaagacaccuuuccc

SEQ ID NO: 118401 - RNA, 20 nt, Artificial Sequence
  MKO10118401_B_Spink6
  gRNA
agcauuucccacgaugcuuc

SEQ ID NO: 118402 - RNA, 20 nt, Artificial Sequence
  MKO10118402_B_Spink6
  gRNA
uuacuccaaugccuugcaga

SEQ ID NO: 118403 - RNA, 20 nt, Artificial Sequence
  MKO10118403_B_Spink7
  gRNA
cucuccaccaugaagcuugu

SEQ ID NO: 118404 - RNA, 20 nt, Artificial Sequence
  MKO10118404_B_Spink7
  gRNA
cauauacaagaaguacccag

SEQ ID NO: 118405 - RNA, 20 nt, Artificial Sequence
  MKO10118405_B_Spink7
  gRNA
agugcccuucaugaagaaac

SEQ ID NO: 118406 - RNA, 20 nt, Artificial Sequence
  MKO10118406_B_Spink8
  gRNA
ggagcuucuacaaaagacaa

SEQ ID NO: 118407 - RNA, 20 nt, Artificial Sequence
  MKO10118407_B_Spink8
  gRNA
ccuaugaacuuucacaugac

SEQ ID NO: 118408 - RNA, 20 nt, Artificial Sequence
  MKO10118408_B_Spink8
  gRNA
acuguaauuaaagugcauga

SEQ ID NO: 118409 - RNA, 20 nt, Artificial Sequence
  MKO10118409_B_Spinkl
  gRNA
uuucuaucaucugcacaaac

SEQ ID NO: 118410 - RNA, 20 nt, Artificial Sequence
  MKO10118410_B_Spinkl
  gRNA
cucagauuuacucuuauaca

SEQ ID NO: 118411 - RNA, 20 nt, Artificial Sequence
  MKO10118411_B_Spinkl
  gRNA
uugauaaaauguccucaaca

SEQ ID NO: 118412 - RNA, 20 nt, Artificial Sequence
  MKO10118412_B_Spint1
  gRNA
ucguguauagagaaaacguc

SEQ ID NO: 118413 - RNA, 20 nt, Artificial Sequence
  MKO10118413_B_Spint1
  gRNA
ccggcagcggcccaccuugu

SEQ ID NO: 118414 - RNA, 20 nt, Artificial Sequence
  MKO10118414_B_Spint1
  gRNA
ugucugccucguucaguacc

SEQ ID NO: 118415 - RNA, 20 nt, Artificial Sequence
  MKO10118415_B_Spint2
  gRNA
gccguagaugaagcugauac

SEQ ID NO: 118416 - RNA, 20 nt, Artificial Sequence
  MKO10118416_B_Spint2
  gRNA
gcugagaucuucaacuauga

SEQ ID NO: 118417 - RNA, 20 nt, Artificial Sequence
  MKO10118417_B_Spint2
  gRNA
aguugaagaucucagcagac

SEQ ID NO: 118418 - RNA, 20 nt, Artificial Sequence
  MKO10118418_B_Spint3
  gRNA
gccuaugugcauccuuccua

SEQ ID NO: 118419 - RNA, 20 nt, Artificial Sequence
  MKO10118419_B_Spint3
  gRNA
agguguuggugcaaacugcc

SEQ ID NO: 118420 - RNA, 20 nt, Artificial Sequence
  MKO10118420_B_Spint3
  gRNA
auccgccuauguccuuagga

SEQ ID NO: 118421 - RNA, 20 nt, Artificial Sequence
  MKO10118421_B_Spint4
  gRNA
acaaaaacccuccgcugccg

SEQ ID NO: 118422 - RNA, 20 nt, Artificial Sequence
  MKO10118422_B_Spint4
  gRNA
cucucaacaccgcucaguac

SEQ ID NO: 118423 - RNA, 20 nt, Artificial Sequence
  MKO10118423_B_Spint4
  gRNA
cucaguccuccaguacugag

SEQ ID NO: 118424 - RNA, 20 nt, Artificial Sequence
  MKO10118424_B_Spint5
  gRNA
gcgaaucccuggacccgcca

SEQ ID NO: 118425 - RNA, 20 nt, Artificial Sequence
  MKO10118425_B_Spint5
  gRNA
cgaagucaacucugcgaaag

SEQ ID NO: 118426 - RNA, 20 nt, Artificial Sequence
  MKO10118426_B_Spint5
  gRNA
aggagcgccauggcgggucc

SEQ ID NO: 118427 - RNA, 20 nt, Artificial Sequence
  MKO10118427_B_Spire1
  gRNA
gugaugagggauuugcgaaa

SEQ ID NO: 118428 - RNA, 20 nt, Artificial Sequence
  MKO10118428_B_Spire1
  gRNA
cuccuuugcacucuuaauuu

SEQ ID NO: 118429 - RNA, 20 nt, Artificial Sequence
  MKO10118429_B_Spire1
  gRNA
ccauuucuugaaucuucuua

SEQ ID NO: 118430 - RNA, 20 nt, Artificial Sequence
  MKO10118430_B_Spire2
  gRNA
ucuucagcuuuaccccguga

SEQ ID NO: 118431 - RNA, 20 nt, Artificial Sequence
  MKO10118431_B_Spire2
  gRNA
ggugguaccaccaugguugu

SEQ ID NO: 118432 - RNA, 20 nt, Artificial Sequence
  MKO10118432_B_Spire2
  gRNA
ucggccaguggcuucucccg

SEQ ID NO: 118433 - RNA, 20 nt, Artificial Sequence
  MKO10118433_B_Spns1
  gRNA
aguggucuagguuacauugc

SEQ ID NO: 118434 - RNA, 20 nt, Artificial Sequence
  MKO10118434_B_Spns1
  gRNA
uccaaagugaaagacguggc

SEQ ID NO: 118435 - RNA, 20 nt, Artificial Sequence
  MKO10118435_B_Spns1
  gRNA
uggugccaacaccauguaac

SEQ ID NO: 118436 - RNA, 20 nt, Artificial Sequence
  MKO10118436_B_Spns2
  gRNA
caccaauaccuacuagcccu

SEQ ID NO: 118437 - RNA, 20 nt, Artificial Sequence
  MKO10118437_B_Spns2
  gRNA
agacuggcauugggcccugc

SEQ ID NO: 118438 - RNA, 20 nt, Artificial Sequence
  MKO10118438_B_Spns2
  gRNA
uccagcugccugcuucacgc

SEQ ID NO: 118439 - RNA, 20 nt, Artificial Sequence
  MKO10118439_B_Spns3
  gRNA
cccuaccugguaggagauga

SEQ ID NO: 118440 - RNA, 20 nt, Artificial Sequence
  MKO10118440_B_Spns3
  gRNA
cgcaaagccauacugagcuu

SEQ ID NO: 118441 - RNA, 20 nt, Artificial Sequence
  MKO10118441_B_Spns3
  gRNA
cacugaugugaaaauacuuc

SEQ ID NO: 118442 - RNA, 20 nt, Artificial Sequence
  MKO10118442_B_Spn
  gRNA
gaguccaugcaucucacucg

SEQ ID NO: 118443 - RNA, 20 nt, Artificial Sequence
  MKO10118443_B_Spn
  gRNA
ggugcccaugcuuauugccu

SEQ ID NO: 118444 - RNA, 20 nt, Artificial Sequence
  MKO10118444_B_Spn
  gRNA
gucagggacaguggacucga

SEQ ID NO: 118445 - RNA, 20 nt, Artificial Sequence
  MKO10118445_B_Spo11
  gRNA
cauacaggaaaugucaucga

SEQ ID NO: 118446 - RNA, 20 nt, Artificial Sequence
  MKO10118446_B_Spo11
  gRNA
uacacugagguaucauccga

SEQ ID NO: 118447 - RNA, 20 nt, Artificial Sequence
  MKO10118447_B_Spo11
  gRNA
ccgaauuucuuaacugauuu

SEQ ID NO: 118448 - RNA, 20 nt, Artificial Sequence
  MKO10118448_B_Spock1
  gRNA
cccaacaagcccuucgacca

SEQ ID NO: 118449 - RNA, 20 nt, Artificial Sequence
  MKO10118449_B_Spock1
  gRNA
gcauccuuuaccuuggucga

SEQ ID NO: 118450 - RNA, 20 nt, Artificial Sequence
  MKO10118450_B_Spock1
  gRNA
gccgcaagcaccuguugccc

SEQ ID NO: 118451 - RNA, 20 nt, Artificial Sequence
  MKO10118451_B_Spock2
  gRNA
agccacagacugaagcgagc

SEQ ID NO: 118452 - RNA, 20 nt, Artificial Sequence
  MKO10118452_B_Spock2
  gRNA
aggaugauuacaucaagagc

SEQ ID NO: 118453 - RNA, 20 nt, Artificial Sequence
  MKO10118453_B_Spock2
  gRNA
gacaaucagcaaggagauga

SEQ ID NO: 118454 - RNA, 20 nt, Artificial Sequence
  MKO10118454_B_Spock3
  gRNA
ccugcguaaugcaaacuuug

SEQ ID NO: 118455 - RNA, 20 nt, Artificial Sequence
  MKO10118455_B_Spock3
  gRNA
cuggcauaggcgauagggca

SEQ ID NO: 118456 - RNA, 20 nt, Artificial Sequence
  MKO10118456_B_Spock3
  gRNA
gacaaucucucaguaugaca

SEQ ID NO: 118457 - RNA, 20 nt, Artificial Sequence
  MKO10118457_B_Spon1
  gRNA
ccgucacugaaagcaccccu

SEQ ID NO: 118458 - RNA, 20 nt, Artificial Sequence
  MKO10118458_B_Spon1
  gRNA
uaacgugaaaccucugaagu

SEQ ID NO: 118459 - RNA, 20 nt, Artificial Sequence
  MKO10118459_B_Spon1
  gRNA
gauaaggaagaagaucaugc

SEQ ID NO: 118460 - RNA, 20 nt, Artificial Sequence
  MKO10118460_B_Spon2
  gRNA
uggguuuagacgcaguuauc

SEQ ID NO: 118461 - RNA, 20 nt, Artificial Sequence
  MKO10118461_B_Spon2
  gRNA
ugucaacgauuucguugccu

SEQ ID NO: 118462 - RNA, 20 nt, Artificial Sequence
  MKO10118462_B_Spon2
  gRNA
gacauagcgaguucugcucu

SEQ ID NO: 118463 - RNA, 20 nt, Artificial Sequence
  MKO10118463_B_Spopl
  gRNA
aagagcauaucgauuuguac

SEQ ID NO: 118464 - RNA, 20 nt, Artificial Sequence
  MKO10118464_B_Spopl
  gRNA
agucagcugcccaaaaagug

SEQ ID NO: 118465 - RNA, 20 nt, Artificial Sequence
  MKO10118465_B_Spopl
  gRNA
ucuucugcuagucgacauuc

SEQ ID NO: 118466 - RNA, 20 nt, Artificial Sequence
  MKO10118466_B_Spop
  gRNA
ugccgguuggcagaugaguu

SEQ ID NO: 118467 - RNA, 20 nt, Artificial Sequence
  MKO10118467_B_Spop
  gRNA
uucgugcaaggcaaagacug

SEQ ID NO: 118468 - RNA, 20 nt, Artificial Sequence
  MKO10118468_B_Spop
  gRNA
ccaacaacagguaaagcgac

SEQ ID NO: 118469 - RNA, 20 nt, Artificial Sequence
  MKO10118469_B_Spp1
  gRNA
gcaaaucacugccaaucuca

SEQ ID NO: 118470 - RNA, 20 nt, Artificial Sequence
  MKO10118470_B_Spp1
  gRNA
uguacucaccgggagggagg

SEQ ID NO: 118471 - RNA, 20 nt, Artificial Sequence
  MKO10118471_B_Spp1
  gRNA
ugcuguguccucugaagaaa

SEQ ID NO: 118472 - RNA, 20 nt, Artificial Sequence
  MKO10118472_B_Spp2
  gRNA
augugugggcucacugccgc

SEQ ID NO: 118473 - RNA, 20 nt, Artificial Sequence
  MKO10118473_B_Spp2
  gRNA
acucagaugaggacgcccag

SEQ ID NO: 118474 - RNA, 20 nt, Artificial Sequence
  MKO10118474_B_Spp2
  gRNA
uuacucucuucaaggagcuc

SEQ ID NO: 118475 - RNA, 20 nt, Artificial Sequence
  MKO10118475_B_Sppl2a
  gRNA
auucugcaugcgucuacaaa

SEQ ID NO: 118476 - RNA, 20 nt, Artificial Sequence
  MKO10118476_B_Sppl2a
  gRNA
gccuuguuccuuaugccauc

SEQ ID NO: 118477 - RNA, 20 nt, Artificial Sequence
  MKO10118477_B_Sppl2a
  gRNA
uaacuuugacuauacucugg

SEQ ID NO: 118478 - RNA, 20 nt, Artificial Sequence
  MKO10118478_B_Sppl2b
  gRNA
gggacagcgcuuuggccgug

SEQ ID NO: 118479 - RNA, 20 nt, Artificial Sequence
  MKO10118479_B_Sppl2b
  gRNA
cagccgcacuuucucauaga

SEQ ID NO: 118480 - RNA, 20 nt, Artificial Sequence
  MKO10118480_B_Sppl2b
  gRNA
gaguggugucccaaaccagu

SEQ ID NO: 118481 - RNA, 20 nt, Artificial Sequence
  MKO10118481_B_Sppl2c
  gRNA
caugucgaagcggugacagu

SEQ ID NO: 118482 - RNA, 20 nt, Artificial Sequence
  MKO10118482_B_Sppl2c
  gRNA
gcuccgcuacacugacaugu

SEQ ID NO: 118483 - RNA, 20 nt, Artificial Sequence
  MKO10118483_B_Sppl2c
  gRNA
ggugaccacagcgcccguca

SEQ ID NO: 118484 - RNA, 20 nt, Artificial Sequence
  MKO10118484_B_Sppl3
  gRNA
agagagacagacgcuccaau

SEQ ID NO: 118485 - RNA, 20 nt, Artificial Sequence
  MKO10118485_B_Sppl3
  gRNA
ucacuuguucugaggugagc

SEQ ID NO: 118486 - RNA, 20 nt, Artificial Sequence
  MKO10118486_B_Sppl3
  gRNA
uuuccacaggucucuuaaua

SEQ ID NO: 118487 - RNA, 20 nt, Artificial Sequence
  MKO10118487_B_Spred1
  gRNA
aaugccucgaucaaaagccc

SEQ ID NO: 118488 - RNA, 20 nt, Artificial Sequence
  MKO10118488_B_Spred1
  gRNA
gagugaccuuauuauagaug

SEQ ID NO: 118489 - RNA, 20 nt, Artificial Sequence
  MKO10118489_B_Spred1
  gRNA
agugaucuuucacuagggaa

SEQ ID NO: 118490 - RNA, 20 nt, Artificial Sequence
  MKO10118490_B_Spred2
  gRNA
accuuccaaugaugaaacgu

SEQ ID NO: 118491 - RNA, 20 nt, Artificial Sequence
  MKO10118491_B_Spred2
  gRNA
cuccauaacgaagcugagcu

SEQ ID NO: 118492 - RNA, 20 nt, Artificial Sequence
  MKO10118492_B_Spred2
  gRNA
accuucuauaaggucuucaa

SEQ ID NO: 118493 - RNA, 20 nt, Artificial Sequence
  MKO10118493_B_Spred3
  gRNA
aagacucaccgucagagggc

SEQ ID NO: 118494 - RNA, 20 nt, Artificial Sequence
  MKO10118494_B_Spred3
  gRNA
ccaccuuggaguguacccug

SEQ ID NO: 118495 - RNA, 20 nt, Artificial Sequence
  MKO10118495_B_Spred3
  gRNA
aaggcgccgcuccucugcuc

SEQ ID NO: 118496 - RNA, 20 nt, Artificial Sequence
  MKO10118496_B_Sprn
  gRNA
gaggcgcucgaggcagugcc

SEQ ID NO: 118497 - RNA, 20 nt, Artificial Sequence
  MKO10118497_B_Sprn
  gRNA
cacugccucgagcgccuccg

SEQ ID NO: 118498 - RNA, 20 nt, Artificial Sequence
  MKO10118498_B_Sprn
  gRNA
cuacggcuccucucugcgcg

SEQ ID NO: 118499 - RNA, 20 nt, Artificial Sequence
  MKO10118499_B_Sprr1a
  gRNA
cagcugaggagguacagugc

SEQ ID NO: 118500 - RNA, 20 nt, Artificial Sequence
  MKO10118500_B_Sprr1a
  gRNA
gccuugccagccaccacccc

SEQ ID NO: 118501 - RNA, 20 nt, Artificial Sequence
  MKO10118501_B_Sprr1a
  gRNA
gccagagcccugccaaccua

SEQ ID NO: 118502 - RNA, 20 nt, Artificial Sequence
  MKO10118502_B_Sprr1b
  gRNA
uaguauuggagugacaguug

SEQ ID NO: 118503 - RNA, 20 nt, Artificial Sequence
  MKO10118503_B_Sprr1b
  gRNA
gucuugacuugugagacaca

SEQ ID NO: 118504 - RNA, 20 nt, Artificial Sequence
  MKO10118504_B_Sprr1b
  gRNA
agggcucaggaacaaugggu

SEQ ID NO: 118505 - RNA, 20 nt, Artificial Sequence
  MKO10118505_B_Sprr2a1
  gRNA
caugguggaaauugcacagg

SEQ ID NO: 118506 - RNA, 20 nt, Artificial Sequence
  MKO10118506_B_Sprr2a1
  gRNA
agccuuguccuccccaagug

SEQ ID NO: 118507 - RNA, 20 nt, Artificial Sequence
  MKO10118507_B_Sprr2a1
  gRNA
cauguugacugccauggcug

SEQ ID NO: 118508 - RNA, 20 nt, Artificial Sequence
  MKO10118508_B_Sprr2a2
  gRNA
caugguggaaauugcacagg

SEQ ID NO: 118509 - RNA, 20 nt, Artificial Sequence
  MKO10118509_B_Sprr2a2
  gRNA
agccuuguccuccccaagug

SEQ ID NO: 118510 - RNA, 20 nt, Artificial Sequence
  MKO10118510_B_Sprr2a2
  gRNA
cauguugacugccauggcug

SEQ ID NO: 118511 - RNA, 20 nt, Artificial Sequence
  MKO10118511_B_Sprr2b
  gRNA
agccaugccccccucagcca

SEQ ID NO: 118512 - RNA, 20 nt, Artificial Sequence
  MKO10118512_B_Sprr2b
  gRNA
gggaaacccucauuuauucu

SEQ ID NO: 118513 - RNA, 20 nt, Artificial Sequence
  MKO10118513_B_Sprr2b
  gRNA
cagcacacugggggaggaca

SEQ ID NO: 118514 - RNA, 20 nt, Artificial Sequence
  MKO10118514_B_Sprr2d
  gRNA
gcgcaggagggcauuucugc

SEQ ID NO: 118515 - RNA, 20 nt, Artificial Sequence
  MKO10118515_B_Sprr2d
  gRNA
gcugcuugcacugcugcugc

SEQ ID NO: 118516 - RNA, 20 nt, Artificial Sequence
  MKO10118516_B_Sprr2d
  gRNA
gggcacuucugcuggcaggg

SEQ ID NO: 118517 - RNA, 20 nt, Artificial Sequence
  MKO10118517_B_Sprr2e
  gRNA
ugcccacccaagagcaagug

SEQ ID NO: 118518 - RNA, 20 nt, Artificial Sequence
  MKO10118518_B_Sprr2e
  gRNA
gcacaggagggcauuucugc

SEQ ID NO: 118519 - RNA, 20 nt, Artificial Sequence
  MKO10118519_B_Sprr2e
  gRNA
gagggaggaggacauggcuc

SEQ ID NO: 118520 - RNA, 20 nt, Artificial Sequence
  MKO10118520_B_Sprr2f
  gRNA
cccagagccuuguucucccu

SEQ ID NO: 118521 - RNA, 20 nt, Artificial Sequence
  MKO10118521_B_Sprr2f
  gRNA
guggacacacaggaggaggc

SEQ ID NO: 118522 - RNA, 20 nt, Artificial Sequence
  MKO10118522_B_Sprr2f
  gRNA
gaacaaggcucugggcacuu

SEQ ID NO: 118523 - RNA, 20 nt, Artificial Sequence
  MKO10118523_B_Sprr2h
  gRNA
ggacauggcucagugcacuu

SEQ ID NO: 118524 - RNA, 20 nt, Artificial Sequence
  MKO10118524_B_Sprr2h
  gRNA
ggacaaggcucagugcacuu

SEQ ID NO: 118525 - RNA, 20 nt, Artificial Sequence
  MKO10118525_B_Sprr2h
  gRNA
gcacagaagggcauuucugc

SEQ ID NO: 118526 - RNA, 20 nt, Artificial Sequence
  MKO10118526_B_Sprr2i
  gRNA
gggcacuucugcuggcaugg

SEQ ID NO: 118527 - RNA, 20 nt, Artificial Sequence
  MKO10118527_B_Sprr2i
  gRNA
gcacaggagggcauuucugc

SEQ ID NO: 118528 - RNA, 20 nt, Artificial Sequence
  MKO10118528_B_Sprr2i
  gRNA
caaggcucagggcacuuugg

SEQ ID NO: 118529 - RNA, 20 nt, Artificial Sequence
  MKO10118529_B_Sprr2k
  gRNA
ggagaacaaggcuuuggggg

SEQ ID NO: 118530 - RNA, 20 nt, Artificial Sequence
  MKO10118530_B_Sprr2k
  gRNA
gggcaugucucagggcacuu

SEQ ID NO: 118531 - RNA, 20 nt, Artificial Sequence
  MKO10118531_B_Sprr2k
  gRNA
gcugcuuacacugcugcucu

SEQ ID NO: 118532 - RNA, 20 nt, Artificial Sequence
  MKO10118532_B_Sprr3
  gRNA
aucuugguguagcccugauc

SEQ ID NO: 118533 - RNA, 20 nt, Artificial Sequence
  MKO10118533_B_Sprr3
  gRNA
ugcuucacuugaugcuguuc

SEQ ID NO: 118534 - RNA, 20 nt, Artificial Sequence
  MKO10118534_B_Sprr3
  gRNA
acaguuggggggcacaccuc

SEQ ID NO: 118535 - RNA, 20 nt, Artificial Sequence
  MKO10118535_B_Sprr4
  gRNA
ccuuacuucugcuuacacuu

SEQ ID NO: 118536 - RNA, 20 nt, Artificial Sequence
  MKO10118536_B_Sprr4
  gRNA
cacacaugccucuugacauu

SEQ ID NO: 118537 - RNA, 20 nt, Artificial Sequence
  MKO10118537_B_Sprr4
  gRNA
ccuaaguguaagcagaagua

SEQ ID NO: 118538 - RNA, 20 nt, Artificial Sequence
  MKO10118538_B_Sprtn
  gRNA
aauuccugaacaagcgaccc

SEQ ID NO: 118539 - RNA, 20 nt, Artificial Sequence
  MKO10118539_B_Sprtn
  gRNA
gcugggaucugcaccuauga

SEQ ID NO: 118540 - RNA, 20 nt, Artificial Sequence
  MKO10118540_B_Sprtn
  gRNA
caucgaaucaaccaacugac

SEQ ID NO: 118541 - RNA, 20 nt, Artificial Sequence
  MKO10118541_B_Spry1
  gRNA
gaaucaccacuagcgaagug

SEQ ID NO: 118542 - RNA, 20 nt, Artificial Sequence
  MKO10118542_B_Spry1
  gRNA
ucuagggacagaaucguagc

SEQ ID NO: 118543 - RNA, 20 nt, Artificial Sequence
  MKO10118543_B_Spry1
  gRNA
auacgggaccugcaugugcc

SEQ ID NO: 118544 - RNA, 20 nt, Artificial Sequence
  MKO10118544_B_Spry2
  gRNA
ucccauagucaaugacguuc

SEQ ID NO: 118545 - RNA, 20 nt, Artificial Sequence
  MKO10118545_B_Spry2
  gRNA
acaauuguccucaucgucau

SEQ ID NO: 118546 - RNA, 20 nt, Artificial Sequence
  MKO10118546_B_Spry2
  gRNA
ucacugcuccaaugacgaug

SEQ ID NO: 118547 - RNA, 20 nt, Artificial Sequence
  MKO10118547_B_Spry3
  gRNA
cuaccuauaucaaagccuuc

SEQ ID NO: 118548 - RNA, 20 nt, Artificial Sequence
  MKO10118548_B_Spry3
  gRNA
uucagagcaccaucgaccuu

SEQ ID NO: 118549 - RNA, 20 nt, Artificial Sequence
  MKO10118549_B_Spry3
  gRNA
cuagcucuugcuucauucgc

SEQ ID NO: 118550 - RNA, 20 nt, Artificial Sequence
  MKO10118550_B_Spry4
  gRNA
cugcgcccgcugguccuuca

SEQ ID NO: 118551 - RNA, 20 nt, Artificial Sequence
  MKO10118551_B_Spry4
  gRNA
gcaaagagugugcguccccu

SEQ ID NO: 118552 - RNA, 20 nt, Artificial Sequence
  MKO10118552_B_Spry4
  gRNA
uguaagccgcuggaccucaa

SEQ ID NO: 118553 - RNA, 20 nt, Artificial Sequence
  MKO10118553_B_Spryd3
  gRNA
gcucaaugccacagccgauc

SEQ ID NO: 118554 - RNA, 20 nt, Artificial Sequence
  MKO10118554_B_Spryd3
  gRNA
aucccuucagguaucuaucg

SEQ ID NO: 118555 - RNA, 20 nt, Artificial Sequence
  MKO10118555_B_Spryd3
  gRNA
augaccucaacuugcacuac

SEQ ID NO: 118556 - RNA, 20 nt, Artificial Sequence
  MKO10118556_B_Spryd4
  gRNA
caacuuccaacagcgugcaa

SEQ ID NO: 118557 - RNA, 20 nt, Artificial Sequence
  MKO10118557_B_Spryd4
  gRNA
uuggugcugaugaucguucc

SEQ ID NO: 118558 - RNA, 20 nt, Artificial Sequence
  MKO10118558_B_Spryd4
  gRNA
acaugcugugccacuugcgc

SEQ ID NO: 118559 - RNA, 20 nt, Artificial Sequence
  MKO10118559_B_Spryd7
  gRNA
aacaugcauuguccagcauc

SEQ ID NO: 118560 - RNA, 20 nt, Artificial Sequence
  MKO10118560_B_Spryd7
  gRNA
accacuacaucucccuccug

SEQ ID NO: 118561 - RNA, 20 nt, Artificial Sequence
  MKO10118561_B_Spryd7
  gRNA
agaagaaucuguggcacugg

SEQ ID NO: 118562 - RNA, 20 nt, Artificial Sequence
  MKO10118562_B_Spr
  gRNA
ugcaguuugcuccuuaacuc

SEQ ID NO: 118563 - RNA, 20 nt, Artificial Sequence
  MKO10118563_B_Spr
  gRNA
cugcugaggaaccgagugug

SEQ ID NO: 118564 - RNA, 20 nt, Artificial Sequence
  MKO10118564_B_Spr
  gRNA
guacagaccccagccuuugu

SEQ ID NO: 118565 - RNA, 20 nt, Artificial Sequence
  MKO10118565_B_Spsb1
  gRNA
gcguucggugcgccuagcgc

SEQ ID NO: 118566 - RNA, 20 nt, Artificial Sequence
  MKO10118566_B_Spsb1
  gRNA
uucgcucaacgucuucguga

SEQ ID NO: 118567 - RNA, 20 nt, Artificial Sequence
  MKO10118567_B_Spsb1
  gRNA
cccagagcacggacgccauc

SEQ ID NO: 118568 - RNA, 20 nt, Artificial Sequence
  MKO10118568_B_Spsb2
  gRNA
ccagagcauggcgcacacac

SEQ ID NO: 118569 - RNA, 20 nt, Artificial Sequence
  MKO10118569_B_Spsb2
  gRNA
uugcccaacggcaccacggc

SEQ ID NO: 118570 - RNA, 20 nt, Artificial Sequence
  MKO10118570_B_Spsb2
  gRNA
gcaaaggggcacacacgccg

SEQ ID NO: 118571 - RNA, 20 nt, Artificial Sequence
  MKO10118571_B_Spsb3
  gRNA
uagcuccuuggugccccgaa

SEQ ID NO: 118572 - RNA, 20 nt, Artificial Sequence
  MKO10118572_B_Spsb3
  gRNA
agaguccuucugugacugcg

SEQ ID NO: 118573 - RNA, 20 nt, Artificial Sequence
  MKO10118573_B_Spsb3
  gRNA
acguguggugguacuugucc

SEQ ID NO: 118574 - RNA, 20 nt, Artificial Sequence
  MKO10118574_B_Spsb4
  gRNA
cauguccaguacgaccaaua

SEQ ID NO: 118575 - RNA, 20 nt, Artificial Sequence
  MKO10118575_B_Spsb4
  gRNA
cccgcugccuagcgggccaa

SEQ ID NO: 118576 - RNA, 20 nt, Artificial Sequence
  MKO10118576_B_Spsb4
  gRNA
gcgccgcucacugguacugc

SEQ ID NO: 118577 - RNA, 20 nt, Artificial Sequence
  MKO10118577_B_Spt1
  gRNA
ucucuuacaguuauuaaaag

SEQ ID NO: 118578 - RNA, 20 nt, Artificial Sequence
  MKO10118578_B_Spt1
  gRNA
guuucaguacuguuugucuc

SEQ ID NO: 118579 - RNA, 20 nt, Artificial Sequence
  MKO10118579_B_Spt1
  gRNA
acaaacaguacugaaacuuc

SEQ ID NO: 118580 - RNA, 20 nt, Artificial Sequence
  MKO10118580_B_Spua1
  gRNA
gaccgcucggaagggaaaag

SEQ ID NO: 118581 - RNA, 20 nt, Artificial Sequence
  MKO10118581_B_Spua1
  gRNA
gcacgaauccuuuguaucag

SEQ ID NO: 118582 - RNA, 20 nt, Artificial Sequence
  MKO10118582_B_Spua1
  gRNA
ugaagcaacuucgccugcug

SEQ ID NO: 118583 - RNA, 20 nt, Artificial Sequence
  MKO10118583_B_Spuan1
  gRNA
uaaucuccagacacguuuaa

SEQ ID NO: 118584 - RNA, 20 nt, Artificial Sequence
  MKO10118584_B_Spuan1
  gRNA
ugaagaguuucagacugauc

SEQ ID NO: 118585 - RNA, 20 nt, Artificial Sequence
  MKO10118585_B_Spuan1
  gRNA
agugugaggauguaauggac

SEQ ID NO: 118586 - RNA, 20 nt, Artificial Sequence
  MKO10118586_B_Sptbn1
  gRNA
uuagauccaggauauuagug

SEQ ID NO: 118587 - RNA, 20 nt, Artificial Sequence
  MKO10118587_B_Sptbn1
  gRNA
ccgaaucacagaccuguaca

SEQ ID NO: 118588 - RNA, 20 nt, Artificial Sequence
  MKO10118588_B_Sptbn1
  gRNA
cagucuccacacuaauaucc

SEQ ID NO: 118589 - RNA, 20 nt, Artificial Sequence
  MKO10118589_B_Sptbn2
  gRNA
cgcuguacaggucucccacc

SEQ ID NO: 118590 - RNA, 20 nt, Artificial Sequence
  MKO10118590_B_Sptbn2
  gRNA
ugcacaacuuuaccaccagu

SEQ ID NO: 118591 - RNA, 20 nt, Artificial Sequence
  MKO10118591_B_Sptbn2
  gRNA
uuaccgguguuugugcacaa

SEQ ID NO: 118592 - RNA, 20 nt, Artificial Sequence
  MKO10118592_B_Sptbn4
  gRNA
accuaauuucuugcgcacag

SEQ ID NO: 118593 - RNA, 20 nt, Artificial Sequence
  MKO10118593_B_Sptbn4
  gRNA
aagaugcugauggcucguga

SEQ ID NO: 118594 - RNA, 20 nt, Artificial Sequence
  MKO10118594_B_Sptbn4
  gRNA
ccagcucagccaugaacgcc

SEQ ID NO: 118595 - RNA, 20 nt, Artificial Sequence
  MKO10118595_B_Sptb
  gRNA
ggaguucacccauuucguaa

SEQ ID NO: 118596 - RNA, 20 nt, Artificial Sequence
  MKO10118596_B_Sptb
  gRNA
cuuaccgguguuuguguauu

SEQ ID NO: 118597 - RNA, 20 nt, Artificial Sequence
  MKO10118597_B_Sptb
  gRNA
ucucccgaccuucuugaguu

SEQ ID NO: 118598 - RNA, 20 nt, Artificial Sequence
  MKO10118598_B_Sptlc1
  gRNA
aaugugccauagaacccucg

SEQ ID NO: 118599 - RNA, 20 nt, Artificial Sequence
  MKO10118599_B_Sptlc1
  gRNA
uccagcauaccaucuuauuu

SEQ ID NO: 118600 - RNA, 20 nt, Artificial Sequence
  MKO10118600_B_Sptlc1
  gRNA
uccaaaauaagaugguaugc

SEQ ID NO: 118601 - RNA, 20 nt, Artificial Sequence
  MKO10118601_B_Sptlc2
  gRNA
aaucucgaagauauccaaag

SEQ ID NO: 118602 - RNA, 20 nt, Artificial Sequence
  MKO10118602_B_Sptlc2
  gRNA
cgcaaauccaagauaguugu

SEQ ID NO: 118603 - RNA, 20 nt, Artificial Sequence
  MKO10118603_B_Sptlc2
  gRNA
uguugcaaaucccaugccau

SEQ ID NO: 118604 - RNA, 20 nt, Artificial Sequence
  MKO10118604_B_Sptlc3
  gRNA
gccagucuuugagcccuacc

SEQ ID NO: 118605 - RNA, 20 nt, Artificial Sequence
  MKO10118605_B_Sptlc3
  gRNA
caacuccuuguguauaucca

SEQ ID NO: 118606 - RNA, 20 nt, Artificial Sequence
  MKO10118606_B_Sptlc3
  gRNA
agguaccuuggauauacaca

SEQ ID NO: 118607 - RNA, 20 nt, Artificial Sequence
  MKO10118607_B_Sptssa
  gRNA
cgggaggcgcauggcgggca

SEQ ID NO: 118608 - RNA, 20 nt, Artificial Sequence
  MKO10118608_B_Sptssa
  gRNA
cuucaugccccagcacauca

SEQ ID NO: 118609 - RNA, 20 nt, Artificial Sequence
  MKO10118609_B_Sptssa
  gRNA
ugaagacguagccaguguac

SEQ ID NO: 118610 - RNA, 20 nt, Artificial Sequence
  MKO10118610_B_Sptssb
  gRNA
uugagcaucgauuguuccca

SEQ ID NO: 118611 - RNA, 20 nt, Artificial Sequence
  MKO10118611_B_Sptssb
  gRNA
cauccccauccacauccgcc

SEQ ID NO: 118612 - RNA, 20 nt, Artificial Sequence
  MKO10118612_B_Sptssb
  gRNA
cagcacagcaggugaugauc

SEQ ID NO: 118613 - RNA, 20 nt, Artificial Sequence
  MKO10118613_B_Spty2d1
  gRNA
acugcucuccauguaacgua

SEQ ID NO: 118614 - RNA, 20 nt, Artificial Sequence
  MKO10118614_B_Spty2d1
  gRNA
aagcuugcacagcugccgac

SEQ ID NO: 118615 - RNA, 20 nt, Artificial Sequence
  MKO10118615_B_Spty2d1
  gRNA
aaagauuucucgaaugugcu

SEQ ID NO: 118616 - RNA, 20 nt, Artificial Sequence
  MKO10118616_B_Spz1
  gRNA
ggagugauccgauuucaagg

SEQ ID NO: 118617 - RNA, 20 nt, Artificial Sequence
  MKO10118617_B_Spz1
  gRNA
acgcuuucaagcauaccacg

SEQ ID NO: 118618 - RNA, 20 nt, Artificial Sequence
  MKO10118618_B_Spz1
  gRNA
caagaaauguccgaaguuag

SEQ ID NO: 118619 - RNA, 20 nt, Artificial Sequence
  MKO10118619_B_Sqle
  gRNA
cgccccgcucaccguuguug

SEQ ID NO: 118620 - RNA, 20 nt, Artificial Sequence
  MKO10118620_B_Sqle
  gRNA
gacucaugaugaaucggcca

SEQ ID NO: 118621 - RNA, 20 nt, Artificial Sequence
  MKO10118621_B_Sqle
  gRNA
gaagaguccauccgcaacaa

SEQ ID NO: 118622 - RNA, 20 nt, Artificial Sequence
  MKO10118622_B_Sqrdl
  gRNA
agauaccuuaucaucgcucu

SEQ ID NO: 118623 - RNA, 20 nt, Artificial Sequence
  MKO10118623_B_Sqrdl
  gRNA
gagccguaccuuccugaagu

SEQ ID NO: 118624 - RNA, 20 nt, Artificial Sequence
  MKO10118624_B_Sqrdl
  gRNA
accuaucagaagccuacuuc

SEQ ID NO: 118625 - RNA, 20 nt, Artificial Sequence
  MKO10118625_B_Sqstm1
  gRNA
cauugucagcuccucaucac

SEQ ID NO: 118626 - RNA, 20 nt, Artificial Sequence
  MKO10118626_B_Sqstm1
  gRNA
agcccacguccuccucgugc

SEQ ID NO: 118627 - RNA, 20 nt, Artificial Sequence
  MKO10118627_B_Sqstm1
  gRNA
aaauugacauugggaucuuc

SEQ ID NO: 118628 - RNA, 20 nt, Artificial Sequence
  MKO10118628_B_Sra1
  gRNA
ugaugauaucagccgacgcu

SEQ ID NO: 118629 - RNA, 20 nt, Artificial Sequence
  MKO10118629_B_Sra1
  gRNA
ugacauucaccgaucacuca

SEQ ID NO: 118630 - RNA, 20 nt, Artificial Sequence
  MKO10118630_B_Sra1
  gRNA
gggggcuccacaccaguagc

SEQ ID NO: 118631 - RNA, 20 nt, Artificial Sequence
  MKO10118631_B_Srbd1
  gRNA
agcaggcugucuacgauuuc

SEQ ID NO: 118632 - RNA, 20 nt, Artificial Sequence
  MKO10118632_B_Srbd1
  gRNA
uugauucgucauccaccugu

SEQ ID NO: 118633 - RNA, 20 nt, Artificial Sequence
  MKO10118633_B_Srbd1
  gRNA
uuucuuaccguagcucaucu

SEQ ID NO: 118634 - RNA, 20 nt, Artificial Sequence
  MKO10118634_B_Srcin1
  gRNA
gucgcuggagacaauguccg

SEQ ID NO: 118635 - RNA, 20 nt, Artificial Sequence
  MKO10118635_B_Srcin1
  gRNA
uccaucagcaaccaaacuac

SEQ ID NO: 118636 - RNA, 20 nt, Artificial Sequence
  MKO10118636_B_Srcin1
  gRNA
cacacacacaggucggcggc

SEQ ID NO: 118637 - RNA, 20 nt, Artificial Sequence
  MKO10118637_B_Srcrb4d
  gRNA
ggcggcgccagcccguguca

SEQ ID NO: 118638 - RNA, 20 nt, Artificial Sequence
  MKO10118638_B_Srcrb4d
  gRNA
cccgcuacagcccuccaaaa

SEQ ID NO: 118639 - RNA, 20 nt, Artificial Sequence
  MKO10118639_B_Srcrb4d
  gRNA
ggcuguagcgggugccauac

SEQ ID NO: 118640 - RNA, 20 nt, Artificial Sequence
  MKO10118640_B_Src
  gRNA
uccgugacucauagucauag

SEQ ID NO: 118641 - RNA, 20 nt, Artificial Sequence
  MKO10118641_B_Src
  gRNA
ggagggcgccacauaguugc

SEQ ID NO: 118642 - RNA, 20 nt, Artificial Sequence
  MKO10118642_B_Src
  gRNA
ucccacuccaggugguacuu

SEQ ID NO: 118643 - RNA, 20 nt, Artificial Sequence
  MKO10118643_B_Srd5a1
  gRNA
gugcacuguucaccagagcg

SEQ ID NO: 118644 - RNA, 20 nt, Artificial Sequence
  MKO10118644_B_Srd5a1
  gRNA
gcucugcaaguagccauuua

SEQ ID NO: 118645 - RNA, 20 nt, Artificial Sequence
  MKO10118645_B_Srd5a1
  gRNA
cuucagcauacaccgcaaac

SEQ ID NO: 118646 - RNA, 20 nt, Artificial Sequence
  MKO10118646_B_Srd5a2
  gRNA
uccugggcgagauuauugaa

SEQ ID NO: 118647 - RNA, 20 nt, Artificial Sequence
  MKO10118647_B_Srd5a2
  gRNA
agcccggagaggucaucuac

SEQ ID NO: 118648 - RNA, 20 nt, Artificial Sequence
  MKO10118648_B_Srd5a2
  gRNA
acugcaugcugcgccagcuc

SEQ ID NO: 118649 - RNA, 20 nt, Artificial Sequence
  MKO10118649_B_Srd5a3
  gRNA
uacucccguaguguauguuc

SEQ ID NO: 118650 - RNA, 20 nt, Artificial Sequence
  MKO10118650_B_Srd5a3
  gRNA
uccaaggcuucucggaugcc

SEQ ID NO: 118651 - RNA, 20 nt, Artificial Sequence
  MKO10118651_B_Srd5a3
  gRNA
acuuucucagucguuguucc

SEQ ID NO: 118652 - RNA, 20 nt, Artificial Sequence
  MKO10118652_B_Srebf1
  gRNA
augccauugagaagcgcuac

SEQ ID NO: 118653 - RNA, 20 nt, Artificial Sequence
  MKO10118653_B_Srebf1
  gRNA
gccaccaucuagccugccgc

SEQ ID NO: 118654 - RNA, 20 nt, Artificial Sequence
  MKO10118654_B_Srebf1
  gRNA
ggggccagcggcaggcuaga

SEQ ID NO: 118655 - RNA, 20 nt, Artificial Sequence
  MKO10118655_B_Srebf2
  gRNA
cgacccuuacuggcacuuga

SEQ ID NO: 118656 - RNA, 20 nt, Artificial Sequence
  MKO10118656_B_Srebf2
  gRNA
cgacaaaaucauagaguuga

SEQ ID NO: 118657 - RNA, 20 nt, Artificial Sequence
  MKO10118657_B_Srebf2
  gRNA
gcugcguucugguauaucaa

SEQ ID NO: 118658 - RNA, 20 nt, Artificial Sequence
  MKO10118658_B_Srek1ip1
  gRNA
uuacuccagugccacugaag

SEQ ID NO: 118659 - RNA, 20 nt, Artificial Sequence
  MKO10118659_B_Srek1ip1
  gRNA
agagcaggcugcagaaaaug

SEQ ID NO: 118660 - RNA, 20 nt, Artificial Sequence
  MKO10118660_B_Srek1ip1
  gRNA
aaaaagaacaagucaaagaa

SEQ ID NO: 118661 - RNA, 20 nt, Artificial Sequence
  MKO10118661_B_Srek1
  gRNA
agaagugaaguuuguucgga

SEQ ID NO: 118662 - RNA, 20 nt, Artificial Sequence
  MKO10118662_B_Srek1
  gRNA
ugguguuucacuuagcaguu

SEQ ID NO: 118663 - RNA, 20 nt, Artificial Sequence
  MKO10118663_B_Srek1
  gRNA
uguggccuuaccugguucaa

SEQ ID NO: 118664 - RNA, 20 nt, Artificial Sequence
  MKO10118664_B_Srfbp1
  gRNA
uucuaccgcgaccgacagag

SEQ ID NO: 118665 - RNA, 20 nt, Artificial Sequence
  MKO10118665_B_Srfbp1
  gRNA
uaaucuggcaaccgcucugu

SEQ ID NO: 118666 - RNA, 20 nt, Artificial Sequence
  MKO10118666_B_Srfbp1
  gRNA
ugaggagauccaugccauga

SEQ ID NO: 118667 - RNA, 20 nt, Artificial Sequence
  MKO10118667_B_Srf
  gRNA
ugggggcauacaucacugca

SEQ ID NO: 118668 - RNA, 20 nt, Artificial Sequence
  MKO10118668_B_Srf
  gRNA
ggucugaaucagcgccuugc

SEQ ID NO: 118669 - RNA, 20 nt, Artificial Sequence
  MKO10118669_B_Srf
  gRNA
ggggccgcugcugacuugca

SEQ ID NO: 118670 - RNA, 20 nt, Artificial Sequence
  MKO10118670_B_Srgap1
  gRNA
uuguccuucuugaaucugcu

SEQ ID NO: 118671 - RNA, 20 nt, Artificial Sequence
  MKO10118671_B_Srgap1
  gRNA
agaauauuccgucucaauuu

SEQ ID NO: 118672 - RNA, 20 nt, Artificial Sequence
  MKO10118672_B_Srgap1
  gRNA
gguucugaaugagcucuaca

SEQ ID NO: 118673 - RNA, 20 nt, Artificial Sequence
  MKO10118673_B_Srgap2
  gRNA
ucgcugacuugaacaaaucg

SEQ ID NO: 118674 - RNA, 20 nt, Artificial Sequence
  MKO10118674_B_Srgap2
  gRNA
ugucuuggcuagaaagcgcu

SEQ ID NO: 118675 - RNA, 20 nt, Artificial Sequence
  MKO10118675_B_Srgap2
  gRNA
uuaccgaguaaagcucguuc

SEQ ID NO: 118676 - RNA, 20 nt, Artificial Sequence
  MKO10118676_B_Srgap3
  gRNA
ccuccaagauucgcagcucc

SEQ ID NO: 118677 - RNA, 20 nt, Artificial Sequence
  MKO10118677_B_Srgap3
  gRNA
uguucaugaagaugucguug

SEQ ID NO: 118678 - RNA, 20 nt, Artificial Sequence
  MKO10118678_B_Srgap3
  gRNA
agcuaagcaugaaccugcuc

SEQ ID NO: 118679 - RNA, 20 nt, Artificial Sequence
  MKO10118679_B_Srgn
  gRNA
caggacaagccugcugccga

SEQ ID NO: 118680 - RNA, 20 nt, Artificial Sequence
  MKO10118680_B_Srgn
  gRNA
ugacccauagucaucauaau

SEQ ID NO: 118681 - RNA, 20 nt, Artificial Sequence
  MKO10118681_B_Srgn
  gRNA
aucuccaauuaugaugacua

SEQ ID NO: 118682 - RNA, 20 nt, Artificial Sequence
  MKO10118682_B_Sri
  gRNA
ccgcaaugccagacuguguu

SEQ ID NO: 118683 - RNA, 20 nt, Artificial Sequence
  MKO10118683_B_Sri
  gRNA
gcagcaaaguaaccauauag

SEQ ID NO: 118684 - RNA, 20 nt, Artificial Sequence
  MKO10118684_B_Sri
  gRNA
cauccaacauugaaaccaua

SEQ ID NO: 118685 - RNA, 20 nt, Artificial Sequence
  MKO10118685_B_Srl
  gRNA
ggacaggcuagcuucgguuu

SEQ ID NO: 118686 - RNA, 20 nt, Artificial Sequence
  MKO10118686_B_Srl
  gRNA
acucgauaccaacuuuauac

SEQ ID NO: 118687 - RNA, 20 nt, Artificial Sequence
  MKO10118687_B_Srl
  gRNA
ucauacguccaucaagcccc

SEQ ID NO: 118688 - RNA, 20 nt, Artificial Sequence
  MKO10118688_B_Srms
  gRNA
cggcccagcgaaagcagcau

SEQ ID NO: 118689 - RNA, 20 nt, Artificial Sequence
  MKO10118689_B_Srms
  gRNA
gcccccgaugcugcuuucgc

SEQ ID NO: 118690 - RNA, 20 nt, Artificial Sequence
  MKO10118690_B_Srms
  gRNA
cccacagauacccuugguuc

SEQ ID NO: 118691 - RNA, 20 nt, Artificial Sequence
  MKO10118691_B_Srm
  gRNA
auagguaggaaugcuacagu

SEQ ID NO: 118692 - RNA, 20 nt, Artificial Sequence
  MKO10118692_B_Srm
  gRNA
gucggugaugaugacgucaa

SEQ ID NO: 118693 - RNA, 20 nt, Artificial Sequence
  MKO10118693_B_Srm
  gRNA
cugcaaaucucucuuccccg

SEQ ID NO: 118694 - RNA, 20 nt, Artificial Sequence
  MKO10118694_B_Srp14
  gRNA
gaaaaggaagaucagcaccg

SEQ ID NO: 118695 - RNA, 20 nt, Artificial Sequence
  MKO10118695_B_Srp14
  gRNA
agccacgccugucacugugc

SEQ ID NO: 118696 - RNA, 20 nt, Artificial Sequence
  MKO10118696_B_Srp14
  gRNA
cugaaacuuguucacuucuu

SEQ ID NO: 118697 - RNA, 20 nt, Artificial Sequence
  MKO10118697_B_Srp19
  gRNA
cccucuccuugcugaagacu

SEQ ID NO: 118698 - RNA, 20 nt, Artificial Sequence
  MKO10118698_B_Srp19
  gRNA
ugccucgaaacugaacauca

SEQ ID NO: 118699 - RNA, 20 nt, Artificial Sequence
  MKO10118699_B_Srp19
  gRNA
ucuugaaucucaguagcugu

SEQ ID NO: 118700 - RNA, 20 nt, Artificial Sequence
  MKO10118700_B_Srp54a
  gRNA
gguguguagcuuguagaccc

SEQ ID NO: 118701 - RNA, 20 nt, Artificial Sequence
  MKO10118701_B_Srp54a
  gRNA
uaaagcguggacaccgacua

SEQ ID NO: 118702 - RNA, 20 nt, Artificial Sequence
  MKO10118702_B_Srp54a
  gRNA
uguaucugcacauaucaaac

SEQ ID NO: 118703 - RNA, 20 nt, Artificial Sequence
  MKO10118703_B_Srp54b
  gRNA
gguguguagcuuguagaccc

SEQ ID NO: 118704 - RNA, 20 nt, Artificial Sequence
  MKO10118704_B_Srp54b
  gRNA
uaaagcguggacaccgacua

SEQ ID NO: 118705 - RNA, 20 nt, Artificial Sequence
  MKO10118705_B_Srp54b
  gRNA
uguaucugcacauaucaaac

SEQ ID NO: 118706 - RNA, 20 nt, Artificial Sequence
  MKO10118706_B_Srp54c
  gRNA
gguguguagcuuguagaccc

SEQ ID NO: 118707 - RNA, 20 nt, Artificial Sequence
  MKO10118707_B_Srp54c
  gRNA
uaaagcguggacaccgacua

SEQ ID NO: 118708 - RNA, 20 nt, Artificial Sequence
  MKO10118708_B_Srp54c
  gRNA
uguaucugcacauaucaaac

SEQ ID NO: 118709 - RNA, 20 nt, Artificial Sequence
  MKO10118709_B_Srp68
  gRNA
acggagacuuccagcgguac

SEQ ID NO: 118710 - RNA, 20 nt, Artificial Sequence
  MKO10118710_B_Srp68
  gRNA
caaagcgcaacauuccugag

SEQ ID NO: 118711 - RNA, 20 nt, Artificial Sequence
  MKO10118711_B_Srp68
  gRNA
gccugcaccuguuaucaguc

SEQ ID NO: 118712 - RNA, 20 nt, Artificial Sequence
  MKO10118712_B_Srp72
  gRNA
aacgcugcaugugcacugau

SEQ ID NO: 118713 - RNA, 20 nt, Artificial Sequence
  MKO10118713_B_Srp72
  gRNA
cucgcaauaugccuucucaa

SEQ ID NO: 118714 - RNA, 20 nt, Artificial Sequence
  MKO10118714_B_Srp72
  gRNA
guaguuugccuuauccagaa

SEQ ID NO: 118715 - RNA, 20 nt, Artificial Sequence
  MKO10118715_B_Srp9
  gRNA
gaauuuguguaucaaaguaa

SEQ ID NO: 118716 - RNA, 20 nt, Artificial Sequence
  MKO10118716_B_Srp9
  gRNA
cuguuuccauagugacauug

SEQ ID NO: 118717 - RNA, 20 nt, Artificial Sequence
  MKO10118717_B_Srp9
  gRNA
cagucaguuaaugcgacuua

SEQ ID NO: 118718 - RNA, 20 nt, Artificial Sequence
  MKO10118718_B_Srpk1
  gRNA
aacucaccgauuucagcagc

SEQ ID NO: 118719 - RNA, 20 nt, Artificial Sequence
  MKO10118719_B_Srpk1
  gRNA
auaccaugugauucgaaaau

SEQ ID NO: 118720 - RNA, 20 nt, Artificial Sequence
  MKO10118720_B_Srpk1
  gRNA
aucccaugauaaccacacug

SEQ ID NO: 118721 - RNA, 20 nt, Artificial Sequence
  MKO10118721_B_Srpk2
  gRNA
uaucaugucauuagaaagcu

SEQ ID NO: 118722 - RNA, 20 nt, Artificial Sequence
  MKO10118722_B_Srpk2
  gRNA
auuaccuuugcaguaaucug

SEQ ID NO: 118723 - RNA, 20 nt, Artificial Sequence
  MKO10118723_B_Srpk2
  gRNA
acuaaaggagcuuucuguug

SEQ ID NO: 118724 - RNA, 20 nt, Artificial Sequence
  MKO10118724_B_Srpk3
  gRNA
agccuagcuuucgcaccaca

SEQ ID NO: 118725 - RNA, 20 nt, Artificial Sequence
  MKO10118725_B_Srpk3
  gRNA
accagcaccucguuugcugc

SEQ ID NO: 118726 - RNA, 20 nt, Artificial Sequence
  MKO10118726_B_Srpk3
  gRNA
cccugcagcaaacgaggugc

SEQ ID NO: 118727 - RNA, 20 nt, Artificial Sequence
  MKO10118727_B_Srprb
  gRNA
ggaaaacguugcuguuuguc

SEQ ID NO: 118728 - RNA, 20 nt, Artificial Sequence
  MKO10118728_B_Srprb
  gRNA
cugacucugaucgaccuccc

SEQ ID NO: 118729 - RNA, 20 nt, Artificial Sequence
  MKO10118729_B_Srprb
  gRNA
caguguucuggaaguucauc

SEQ ID NO: 118730 - RNA, 20 nt, Artificial Sequence
  MKO10118730_B_Srpr
  gRNA
uuccccccguguuucaauca

SEQ ID NO: 118731 - RNA, 20 nt, Artificial Sequence
  MKO10118731_B_Srpr
  gRNA
aacacggggggaaaagacca

SEQ ID NO: 118732 - RNA, 20 nt, Artificial Sequence
  MKO10118732_B_Srpr
  gRNA
aacagguucugauggcacuu

SEQ ID NO: 118733 - RNA, 20 nt, Artificial Sequence
  MKO10118733_B_Srpx2
  gRNA
aacuuaccugcguaccaugu

SEQ ID NO: 118734 - RNA, 20 nt, Artificial Sequence
  MKO10118734_B_Srpx2
  gRNA
acccccgacugacugaugag

SEQ ID NO: 118735 - RNA, 20 nt, Artificial Sequence
  MKO10118735_B_Srpx2
  gRNA
uauagcuuuaagacgacuuu

SEQ ID NO: 118736 - RNA, 20 nt, Artificial Sequence
  MKO10118736_B_Srpx
  gRNA
gcuauacguucuuucacacu

SEQ ID NO: 118737 - RNA, 20 nt, Artificial Sequence
  MKO10118737_B_Srpx
  gRNA
cacccggacugucagcuuau

SEQ ID NO: 118738 - RNA, 20 nt, Artificial Sequence
  MKO10118738_B_Srpx
  gRNA
cagacuccaucgucuucuag

SEQ ID NO: 118739 - RNA, 20 nt, Artificial Sequence
  MKO10118739_B_Srrd
  gRNA
aucaucgggaacagcuuccg

SEQ ID NO: 118740 - RNA, 20 nt, Artificial Sequence
  MKO10118740_B_Srrd
  gRNA
aaaccaucaccgagugucuu

SEQ ID NO: 118741 - RNA, 20 nt, Artificial Sequence
  MKO10118741_B_Srrd
  gRNA
cacgccgagggaggugagaa

SEQ ID NO: 118742 - RNA, 20 nt, Artificial Sequence
  MKO10118742_B_Srrm1
  gRNA
cuuccugcagggaacaagug

SEQ ID NO: 118743 - RNA, 20 nt, Artificial Sequence
  MKO10118743_B_Srrm1
  gRNA
agugcacaagaaaauaucgc

SEQ ID NO: 118744 - RNA, 20 nt, Artificial Sequence
  MKO10118744_B_Srrm1
  gRNA
ugcagaaugcuuagaaaaaa

SEQ ID NO: 118745 - RNA, 20 nt, Artificial Sequence
  MKO10118745_B_Srrm2
  gRNA
uuaccuguguuuccguuucu

SEQ ID NO: 118746 - RNA, 20 nt, Artificial Sequence
  MKO10118746_B_Srrm2
  gRNA
cucuucuuccucucucgucg

SEQ ID NO: 118747 - RNA, 20 nt, Artificial Sequence
  MKO10118747_B_Srrm2
  gRNA
aguuggugagcgagaacugc

SEQ ID NO: 118748 - RNA, 20 nt, Artificial Sequence
  MKO10118748_B_Srrm3
  gRNA
aaugcucacaugugggcccc

SEQ ID NO: 118749 - RNA, 20 nt, Artificial Sequence
  MKO10118749_B_Srrm3
  gRNA
ucucgcucaggaccaagcac

SEQ ID NO: 118750 - RNA, 20 nt, Artificial Sequence
  MKO10118750_B_Srrm3
  gRNA
ggagacuagagucagaaugc

SEQ ID NO: 118751 - RNA, 20 nt, Artificial Sequence
  MKO10118751_B_Srrm4
  gRNA
ugucgggucucugucuugag

SEQ ID NO: 118752 - RNA, 20 nt, Artificial Sequence
  MKO10118752_B_Srrm4
  gRNA
aggcccuggguaccaacagc

SEQ ID NO: 118753 - RNA, 20 nt, Artificial Sequence
  MKO10118753_B_Srrm4
  gRNA
cgacaccaccaccuuccucc

SEQ ID NO: 118754 - RNA, 20 nt, Artificial Sequence
  MKO10118754_B_Srrt
  gRNA
acgcuacaaugacuacaagc

SEQ ID NO: 118755 - RNA, 20 nt, Artificial Sequence
  MKO10118755_B_Srrt
  gRNA
acuccucgucuuugugagcc

SEQ ID NO: 118756 - RNA, 20 nt, Artificial Sequence
  MKO10118756_B_Srrt
  gRNA
gcaccauguccugcccaucc

SEQ ID NO: 118757 - RNA, 20 nt, Artificial Sequence
  MKO10118757_B_Srr
  gRNA
uaccaccagugcaucuacca

SEQ ID NO: 118758 - RNA, 20 nt, Artificial Sequence
  MKO10118758_B_Srr
  gRNA
gguucccuugguagaugcac

SEQ ID NO: 118759 - RNA, 20 nt, Artificial Sequence
  MKO10118759_B_Srr
  gRNA
ccuuguccagcuaucacugc

SEQ ID NO: 118760 - RNA, 20 nt, Artificial Sequence
  MKO10118760_B_Srsf10
  gRNA
ugaacauaugcaaauccucu

SEQ ID NO: 118761 - RNA, 20 nt, Artificial Sequence
  MKO10118761_B_Srsf10
  gRNA
uccgaucccccugugcgaac

SEQ ID NO: 118762 - RNA, 20 nt, Artificial Sequence
  MKO10118762_B_Srsf10
  gRNA
ugaagacgcuuuacauaauu

SEQ ID NO: 118763 - RNA, 20 nt, Artificial Sequence
  MKO10118763_B_Srsf11
  gRNA
agaccugccacugcauuagc

SEQ ID NO: 118764 - RNA, 20 nt, Artificial Sequence
  MKO10118764_B_Srsf11
  gRNA
gcagauuggcgcuguucccc

SEQ ID NO: 118765 - RNA, 20 nt, Artificial Sequence
  MKO10118765_B_Srsf11
  gRNA
cuggagcucccaacgcagcc

SEQ ID NO: 118766 - RNA, 20 nt, Artificial Sequence
  MKO10118766_B_Srsf12
  gRNA
cucguuccaaaucgcuaccc

SEQ ID NO: 118767 - RNA, 20 nt, Artificial Sequence
  MKO10118767_B_Srsf12
  gRNA
agacugccuggguagcgauu

SEQ ID NO: 118768 - RNA, 20 nt, Artificial Sequence
  MKO10118768_B_Srsf12
  gRNA
cugcgcgaucuccucuggcu

SEQ ID NO: 118769 - RNA, 20 nt, Artificial Sequence
  MKO10118769_B_Srsf1
  gRNA
gccuggacggcgggccauag

SEQ ID NO: 118770 - RNA, 20 nt, Artificial Sequence
  MKO10118770_B_Srsf1
  gRNA
gacguaugcaguucgaaaac

SEQ ID NO: 118771 - RNA, 20 nt, Artificial Sequence
  MKO10118771_B_Srsf1
  gRNA
uacgcugauguuuaccgaga

SEQ ID NO: 118772 - RNA, 20 nt, Artificial Sequence
  MKO10118772_B_Srsf2
  gRNA
ucucgcuucgacacgggcgg

SEQ ID NO: 118773 - RNA, 20 nt, Artificial Sequence
  MKO10118773_B_Srsf2
  gRNA
ggcccgccaccccgucggua

SEQ ID NO: 118774 - RNA, 20 nt, Artificial Sequence
  MKO10118774_B_Srsf2
  gRNA
auuucucgaagacgcgccuc

SEQ ID NO: 118775 - RNA, 20 nt, Artificial Sequence
  MKO10118775_B_Srsf3
  gRNA
uuaccuacgagaccuagaga

SEQ ID NO: 118776 - RNA, 20 nt, Artificial Sequence
  MKO10118776_B_Srsf3
  gRNA
cugcuucuagauccccaaga

SEQ ID NO: 118777 - RNA, 20 nt, Artificial Sequence
  MKO10118777_B_Srsf3
  gRNA
uuaggucacuuucuagagau

SEQ ID NO: 118778 - RNA, 20 nt, Artificial Sequence
  MKO10118778_B_Srsf4
  gRNA
ucuuuaggauuacaugcguc

SEQ ID NO: 118779 - RNA, 20 nt, Artificial Sequence
  MKO10118779_B_Srsf4
  gRNA
aggcccaccuggaucgagac

SEQ ID NO: 118780 - RNA, 20 nt, Artificial Sequence
  MKO10118780_B_Srsf4
  gRNA
ggauaugguuaucgaagaag

SEQ ID NO: 118781 - RNA, 20 nt, Artificial Sequence
  MKO10118781_B_Srsf5
  gRNA
uuuaggaauuugaggaccca

SEQ ID NO: 118782 - RNA, 20 nt, Artificial Sequence
  MKO10118782_B_Srsf5
  gRNA
aaccugccagcugacucuug

SEQ ID NO: 118783 - RNA, 20 nt, Artificial Sequence
  MKO10118783_B_Srsf5
  gRNA
acagcaucaucugcaucccu

SEQ ID NO: 118784 - RNA, 20 nt, Artificial Sequence
  MKO10118784_B_Srsf6
  gRNA
cuccgacaugaagcgugcuu

SEQ ID NO: 118785 - RNA, 20 nt, Artificial Sequence
  MKO10118785_B_Srsf6
  gRNA
auccaaagcacgcuucaugu

SEQ ID NO: 118786 - RNA, 20 nt, Artificial Sequence
  MKO10118786_B_Srsf6
  gRNA
agccuguacucuguacgaac

SEQ ID NO: 118787 - RNA, 20 nt, Artificial Sequence
  MKO10118787_B_Srsf7
  gRNA
cuagaucccauucccgaucc

SEQ ID NO: 118788 - RNA, 20 nt, Artificial Sequence
  MKO10118788_B_Srsf7
  gRNA
ucaaagggacgacgggcagg

SEQ ID NO: 118789 - RNA, 20 nt, Artificial Sequence
  MKO10118789_B_Srsf7
  gRNA
auagccgacgaagaagaagc

SEQ ID NO: 118790 - RNA, 20 nt, Artificial Sequence
  MKO10118790_B_Srsf9
  gRNA
caccaaauuccgcucucacg

SEQ ID NO: 118791 - RNA, 20 nt, Artificial Sequence
  MKO10118791_B_Srsf9
  gRNA
acuccacacggagucgacac

SEQ ID NO: 118792 - RNA, 20 nt, Artificial Sequence
  MKO10118792_B_Srsf9
  gRNA
ggaauaugcucugcguaaac

SEQ ID NO: 118793 - RNA, 20 nt, Artificial Sequence
  MKO10118793_B_Srxn1
  gRNA
ugccccccaucgacguccuc

SEQ ID NO: 118794 - RNA, 20 nt, Artificial Sequence
  MKO10118794_B_Srxn1
  gRNA
ccgaguggaugcugccgccc

SEQ ID NO: 118795 - RNA, 20 nt, Artificial Sequence
  MKO10118795_B_Srxn1
  gRNA
aauaguaguagucgccaccc

SEQ ID NO: 118796 - RNA, 20 nt, Artificial Sequence
  MKO10118796_B_Sry
  gRNA
ugcccaguggggauaucaac

SEQ ID NO: 118797 - RNA, 20 nt, Artificial Sequence
  MKO10118797_B_Sry
  gRNA
gugcugaggugcuccuggua

SEQ ID NO: 118798 - RNA, 20 nt, Artificial Sequence
  MKO10118798_B_Sry
  gRNA
gaugucagcuguuaguaagu

SEQ ID NO: 118799 - RNA, 20 nt, Artificial Sequence
  MKO10118799_B_Ss18l1
  gRNA
ccgagacacauaguugcuga

SEQ ID NO: 118800 - RNA, 20 nt, Artificial Sequence
  MKO10118800_B_Ss18l1
  gRNA
cguuacucacugcgugcacu

SEQ ID NO: 118801 - RNA, 20 nt, Artificial Sequence
  MKO10118801_B_Ss18l1
  gRNA
caguaccuaccgcgggaagc

SEQ ID NO: 118802 - RNA, 20 nt, Artificial Sequence
  MKO10118802_B_Ss18
  gRNA
ccaucuuauucaguguauaa

SEQ ID NO: 118803 - RNA, 20 nt, Artificial Sequence
  MKO10118803_B_Ss18
  gRNA
gcagauauugcauacaaacc

SEQ ID NO: 118804 - RNA, 20 nt, Artificial Sequence
  MKO10118804_B_Ss18
  gRNA
uagagucugcuauuguagca

SEQ ID NO: 118805 - RNA, 20 nt, Artificial Sequence
  MKO10118805_B_Ssbp1
  gRNA
guuucgaagaccuguguuac

SEQ ID NO: 118806 - RNA, 20 nt, Artificial Sequence
  MKO10118806_B_Ssbp1
  gRNA
ucguucaagaaccaaacugc

SEQ ID NO: 118807 - RNA, 20 nt, Artificial Sequence
  MKO10118807_B_Ssbp1
  gRNA
gucugaaguagccagcaguu

SEQ ID NO: 118808 - RNA, 20 nt, Artificial Sequence
  MKO10118808_B_Ssbp2
  gRNA
ggcacaagcauguacggcaa

SEQ ID NO: 118809 - RNA, 20 nt, Artificial Sequence
  MKO10118809_B_Ssbp2
  gRNA
ccgauuucugagcuccuaca

SEQ ID NO: 118810 - RNA, 20 nt, Artificial Sequence
  MKO10118810_B_Ssbp2
  gRNA
cucucuuacauaaucaugga

SEQ ID NO: 118811 - RNA, 20 nt, Artificial Sequence
  MKO10118811_B_Ssbp3
  gRNA
cuuaccaccaccacgagugc

SEQ ID NO: 118812 - RNA, 20 nt, Artificial Sequence
  MKO10118812_B_Ssbp3
  gRNA
cgccuggguuccugcacucg

SEQ ID NO: 118813 - RNA, 20 nt, Artificial Sequence
  MKO10118813_B_Ssbp3
  gRNA
guuacucacauaaucaugaa

SEQ ID NO: 118814 - RNA, 20 nt, Artificial Sequence
  MKO10118814_B_Ssbp4
  gRNA
cuucugggaccuguauugug

SEQ ID NO: 118815 - RNA, 20 nt, Artificial Sequence
  MKO10118815_B_Ssbp4
  gRNA
cauaccaccaccaggagugc

SEQ ID NO: 118816 - RNA, 20 nt, Artificial Sequence
  MKO10118816_B_Ssbp4
  gRNA
ggcgcagaccuuccugucug

SEQ ID NO: 118817 - RNA, 20 nt, Artificial Sequence
  MKO10118817_B_Ssb
  gRNA
gugucuuuguacuucuggcc

SEQ ID NO: 118818 - RNA, 20 nt, Artificial Sequence
  MKO10118818_B_Ssb
  gRNA
cccuugaugauauaaaagaa

SEQ ID NO: 118819 - RNA, 20 nt, Artificial Sequence
  MKO10118819_B_Ssb
  gRNA
ucauuugaauauucaguauu

SEQ ID NO: 118820 - RNA, 20 nt, Artificial Sequence
  MKO10118820_B_Ssc5d
  gRNA
ggagcuccauuugucaguac

SEQ ID NO: 118821 - RNA, 20 nt, Artificial Sequence
  MKO10118821_B_Ssc5d
  gRNA
agaagauucaaugucccugc

SEQ ID NO: 118822 - RNA, 20 nt, Artificial Sequence
  MKO10118822_B_Ssc5d
  gRNA
guggccggggguucuucuuc

SEQ ID NO: 118823 - RNA, 20 nt, Artificial Sequence
  MKO10118823_B_Ssfa2
  gRNA
ugugauuacagcaccccucu

SEQ ID NO: 118824 - RNA, 20 nt, Artificial Sequence
  MKO10118824_B_Ssfa2
  gRNA
acugcuuugcucauccagug

SEQ ID NO: 118825 - RNA, 20 nt, Artificial Sequence
  MKO10118825_B_Ssfa2
  gRNA
cuuugaagaugaccugucac

SEQ ID NO: 118826 - RNA, 20 nt, Artificial Sequence
  MKO10118826_B_Ssh1
  gRNA
aggcuggcagcgaugaagaa

SEQ ID NO: 118827 - RNA, 20 nt, Artificial Sequence
  MKO10118827_B_Ssh1
  gRNA
ugaagacuccgcuggcccug

SEQ ID NO: 118828 - RNA, 20 nt, Artificial Sequence
  MKO10118828_B_Ssh1
  gRNA
cagcacccucacaagcaugc

SEQ ID NO: 118829 - RNA, 20 nt, Artificial Sequence
  MKO10118829_B_Ssh2
  gRNA
uauauauaggaggccgacag

SEQ ID NO: 118830 - RNA, 20 nt, Artificial Sequence
  MKO10118830_B_Ssh2
  gRNA
cugcaugcuuguugcgucug

SEQ ID NO: 118831 - RNA, 20 nt, Artificial Sequence
  MKO10118831_B_Ssh2
  gRNA
cguaccuucugggcugugac

SEQ ID NO: 118832 - RNA, 20 nt, Artificial Sequence
  MKO10118832_B_Ssh3
  gRNA
gccccucuggagugauaccc

SEQ ID NO: 118833 - RNA, 20 nt, Artificial Sequence
  MKO10118833_B_Ssh3
  gRNA
gaacucaccugcgcuggagc

SEQ ID NO: 118834 - RNA, 20 nt, Artificial Sequence
  MKO10118834_B_Ssh3
  gRNA
gagccaauggaggaacccuc

SEQ ID NO: 118835 - RNA, 20 nt, Artificial Sequence
  MKO10118835_B_Ssmem1
  gRNA
gaugacucuugcgggacaau

SEQ ID NO: 118836 - RNA, 20 nt, Artificial Sequence
  MKO10118836_B_Ssmem1
  gRNA
accagugcgucacucaguaa

SEQ ID NO: 118837 - RNA, 20 nt, Artificial Sequence
  MKO10118837_B_Ssmem1
  gRNA
accuuuacugagugacgcac

SEQ ID NO: 118838 - RNA, 20 nt, Artificial Sequence
  MKO10118838_B_Ssna1
  gRNA
gcagaacuacaacaacgagu

SEQ ID NO: 118839 - RNA, 20 nt, Artificial Sequence
  MKO10118839_B_Ssna1
  gRNA
ccuugccuccacuacucuuc

SEQ ID NO: 118840 - RNA, 20 nt, Artificial Sequence
  MKO10118840_B_Ssna1
  gRNA
gcuucagaccagaagaguag

SEQ ID NO: 118841 - RNA, 20 nt, Artificial Sequence
  MKO10118841_B_Sspn
  gRNA
cacauguccucucgucaacu

SEQ ID NO: 118842 - RNA, 20 nt, Artificial Sequence
  MKO10118842_B_Sspn
  gRNA
acugacuguaccagcgucac

SEQ ID NO: 118843 - RNA, 20 nt, Artificial Sequence
  MKO10118843_B_Sspn
  gRNA
uggggcgcaagccgagcccc

SEQ ID NO: 118844 - RNA, 20 nt, Artificial Sequence
  MKO10118844_B_Sspo
  gRNA
cuacuuggaaccggacagug

SEQ ID NO: 118845 - RNA, 20 nt, Artificial Sequence
  MKO10118845_B_Sspo
  gRNA
uggcauugccaaccucuagc

SEQ ID NO: 118846 - RNA, 20 nt, Artificial Sequence
  MKO10118846_B_Sspo
  gRNA
acuguccgguuccaaguagc

SEQ ID NO: 118847 - RNA, 20 nt, Artificial Sequence
  MKO10118847_B_Ssr1
  gRNA
cagaauaguugugucugcac

SEQ ID NO: 118848 - RNA, 20 nt, Artificial Sequence
  MKO10118848_B_Ssr1
  gRNA
ggucacaguuauugaaagag

SEQ ID NO: 118849 - RNA, 20 nt, Artificial Sequence
  MKO10118849_B_Ssr1
  gRNA
agagaacuuaccaaaucugu

SEQ ID NO: 118850 - RNA, 20 nt, Artificial Sequence
  MKO10118850_B_Ssr2
  gRNA
ugucaaacucccgcugagcg

SEQ ID NO: 118851 - RNA, 20 nt, Artificial Sequence
  MKO10118851_B_Ssr2
  gRNA
aaaaaggauacggggcaauc

SEQ ID NO: 118852 - RNA, 20 nt, Artificial Sequence
  MKO10118852_B_Ssr2
  gRNA
gucaugaccuugcccuccau

SEQ ID NO: 118853 - RNA, 20 nt, Artificial Sequence
  MKO10118853_B_Ssr3
  gRNA
cuauaacaacacucuguucc

SEQ ID NO: 118854 - RNA, 20 nt, Artificial Sequence
  MKO10118854_B_Ssr3
  gRNA
uacuaaguaagugcuuacua

SEQ ID NO: 118855 - RNA, 20 nt, Artificial Sequence
  MKO10118855_B_Ssr3
  gRNA
gaaguucuucaguauaaaga

SEQ ID NO: 118856 - RNA, 20 nt, Artificial Sequence
  MKO10118856_B_Ssr4
  gRNA
cgcuaccugagcagcaagau

SEQ ID NO: 118857 - RNA, 20 nt, Artificial Sequence
  MKO10118857_B_Ssr4
  gRNA
aagaguccuauagccuccua

SEQ ID NO: 118858 - RNA, 20 nt, Artificial Sequence
  MKO10118858_B_Ssr4
  gRNA
uuucacugaccugcaagaac

SEQ ID NO: 118859 - RNA, 20 nt, Artificial Sequence
  MKO10118859_B_Ssrp1
  gRNA
guccacaccaucuuccugcg

SEQ ID NO: 118860 - RNA, 20 nt, Artificial Sequence
  MKO10118860_B_Ssrp1
  gRNA
cugcaguguuugacuccucg

SEQ ID NO: 118861 - RNA, 20 nt, Artificial Sequence
  MKO10118861_B_Ssrp1
  gRNA
cuucuauguuccucccacgc

SEQ ID NO: 118862 - RNA, 20 nt, Artificial Sequence
  MKO10118862_B_Sssca1
  gRNA
cacggcaacauggccuugaa

SEQ ID NO: 118863 - RNA, 20 nt, Artificial Sequence
  MKO10118863_B_Sssca1
  gRNA
gcccagcucgacugacgccc

SEQ ID NO: 118864 - RNA, 20 nt, Artificial Sequence
  MKO10118864_B_Sssca1
  gRNA
cgggcuugcgccgaggcccu

SEQ ID NO: 118865 - RNA, 20 nt, Artificial Sequence
  MKO10118865_B_Sstr1
  gRNA
cggcgcgcuacuuugccgcc

SEQ ID NO: 118866 - RNA, 20 nt, Artificial Sequence
  MKO10118866_B_Sstr1
  gRNA
agcgcuugaaguuguccgac

SEQ ID NO: 118867 - RNA, 20 nt, Artificial Sequence
  MKO10118867_B_Sstr1
  gRNA
cacgguggcgucgucuugcu

SEQ ID NO: 118868 - RNA, 20 nt, Artificial Sequence
  MKO10118868_B_Sstr2
  gRNA
agcggaagacaucauugccu

SEQ ID NO: 118869 - RNA, 20 nt, Artificial Sequence
  MKO10118869_B_Sstr2
  gRNA
gaggccggcguauaucauga

SEQ ID NO: 118870 - RNA, 20 nt, Artificial Sequence
  MKO10118870_B_Sstr2
  gRNA
uguccggggucgccuccauu

SEQ ID NO: 118871 - RNA, 20 nt, Artificial Sequence
  MKO10118871_B_Sstr3
  gRNA
ucugcucaacaucgucaaug

SEQ ID NO: 118872 - RNA, 20 nt, Artificial Sequence
  MKO10118872_B_Sstr3
  gRNA
cggaucucucaugugccguc

SEQ ID NO: 118873 - RNA, 20 nt, Artificial Sequence
  MKO10118873_B_Sstr3
  gRNA
caacucgcuggugaucuacg

SEQ ID NO: 118874 - RNA, 20 nt, Artificial Sequence
  MKO10118874_B_Sstr4
  gRNA
agcgccggaaguugucagag

SEQ ID NO: 118875 - RNA, 20 nt, Artificial Sequence
  MKO10118875_B_Sstr4
  gRNA
uugauuagcuuggccacgcu

SEQ ID NO: 118876 - RNA, 20 nt, Artificial Sequence
  MKO10118876_B_Sstr4
  gRNA
acacgagcgcauagaugcac

SEQ ID NO: 118877 - RNA, 20 nt, Artificial Sequence
  MKO10118877_B_Sstr5
  gRNA
gggcuccucggguagcguga

SEQ ID NO: 118878 - RNA, 20 nt, Artificial Sequence
  MKO10118878_B_Sstr5
  gRNA
cuauuugcucaucguaguga

SEQ ID NO: 118879 - RNA, 20 nt, Artificial Sequence
  MKO10118879_B_Sstr5
  gRNA
ggucgacacucaugaccauc

SEQ ID NO: 118880 - RNA, 20 nt, Artificial Sequence
  MKO10118880_B_Ssty1
  gRNA
agcugauaagcauagagagc

SEQ ID NO: 118881 - RNA, 20 nt, Artificial Sequence
  MKO10118881_B_Ssty1
  gRNA
caaaagcuugaggaacaagu

SEQ ID NO: 118882 - RNA, 20 nt, Artificial Sequence
  MKO10118882_B_Ssty1
  gRNA
gcuugccuuucacagaccac

SEQ ID NO: 118883 - RNA, 20 nt, Artificial Sequence
  MKO10118883_B_Ssty2
  gRNA
aagaucuccugauacagacc

SEQ ID NO: 118884 - RNA, 20 nt, Artificial Sequence
  MKO10118884_B_Ssty2
  gRNA
uaaaaauaguccuguaagaa

SEQ ID NO: 118885 - RNA, 20 nt, Artificial Sequence
  MKO10118885_B_Ssty2
  gRNA
aacaaacccuucucuuuauu

SEQ ID NO: 118886 - RNA, 20 nt, Artificial Sequence
  MKO10118886_B_Sst
  gRNA
ugccaacucgaacccagcaa

SEQ ID NO: 118887 - RNA, 20 nt, Artificial Sequence
  MKO10118887_B_Sst
  gRNA
aguccuuaccuguuucccgg

SEQ ID NO: 118888 - RNA, 20 nt, Artificial Sequence
  MKO10118888_B_Sst
  gRNA
ucugggguccgagggcgcgc

SEQ ID NO: 118889 - RNA, 20 nt, Artificial Sequence
  MKO10118889_B_Ssu2
  gRNA
gcaggucuucuucccgcccu

SEQ ID NO: 118890 - RNA, 20 nt, Artificial Sequence
  MKO10118890_B_Ssu2
  gRNA
gccaccuccucggucaccac

SEQ ID NO: 118891 - RNA, 20 nt, Artificial Sequence
  MKO10118891_B_Ssu2
  gRNA
aaauguccacucgcugacuc

SEQ ID NO: 118892 - RNA, 20 nt, Artificial Sequence
  MKO10118892_B_Ssu72
  gRNA
aguucgaggagaagaguggc

SEQ ID NO: 118893 - RNA, 20 nt, Artificial Sequence
  MKO10118893_B_Ssu72
  gRNA
ugaagagagagucuaugacc

SEQ ID NO: 118894 - RNA, 20 nt, Artificial Sequence
  MKO10118894_B_Ssu72
  gRNA
cauccaggacaaccaugaag

SEQ ID NO: 118895 - RNA, 20 nt, Artificial Sequence
  MKO10118895_B_Ssx2ip
  gRNA
guuuggcguagcagcucugc

SEQ ID NO: 118896 - RNA, 20 nt, Artificial Sequence
  MKO10118896_B_Ssx2ip
  gRNA
aggagcaguuggaaacgucc

SEQ ID NO: 118897 - RNA, 20 nt, Artificial Sequence
  MKO10118897_B_Ssx2ip
  gRNA
acacacuaccugaucaagau

SEQ ID NO: 118898 - RNA, 20 nt, Artificial Sequence
  MKO10118898_B_Ssx9
  gRNA
gagcaugauuccaacuuggc

SEQ ID NO: 118899 - RNA, 20 nt, Artificial Sequence
  MKO10118899_B_Ssx9
  gRNA
cauacuacucugaugaagag

SEQ ID NO: 118900 - RNA, 20 nt, Artificial Sequence
  MKO10118900_B_Ssx9
  gRNA
ucuguaguugaaugcuuuga

SEQ ID NO: 118901 - RNA, 20 nt, Artificial Sequence
  MKO10118901_B_Ssxb10
  gRNA
gaucuucaaugccuucaacc

SEQ ID NO: 118902 - RNA, 20 nt, Artificial Sequence
  MKO10118902_B_Ssxb10
  gRNA
uccuugccgcgcaugaaaac

SEQ ID NO: 118903 - RNA, 20 nt, Artificial Sequence
  MKO10118903_B_Ssxb10
  gRNA
ucuguagaugaaugcuuuga

SEQ ID NO: 118904 - RNA, 20 nt, Artificial Sequence
  MKO10118904_B_Ssxb1
  gRNA
agaaguauguagaaauaucc

SEQ ID NO: 118905 - RNA, 20 nt, Artificial Sequence
  MKO10118905_B_Ssxb1
  gRNA
gaacuucaaugccuucgacc

SEQ ID NO: 118906 - RNA, 20 nt, Artificial Sequence
  MKO10118906_B_Ssxb1
  gRNA
uccuugccgcgcaugaaaac

SEQ ID NO: 118907 - RNA, 20 nt, Artificial Sequence
  MKO10118907_B_Ssxb2
  gRNA
cucaccuugcagauauucuu

SEQ ID NO: 118908 - RNA, 20 nt, Artificial Sequence
  MKO10118908_B_Ssxb2
  gRNA
cauacuucucugaugaagag

SEQ ID NO: 118909 - RNA, 20 nt, Artificial Sequence
  MKO10118909_B_Ssxb2
  gRNA
uacaucagaaugacugaccu

SEQ ID NO: 118910 - RNA, 20 nt, Artificial Sequence
  MKO10118910_B_Ssxb3
  gRNA
cauacuucucugaugaagag

SEQ ID NO: 118911 - RNA, 20 nt, Artificial Sequence
  MKO10118911_B_Ssxb3
  gRNA
uacaucagaaugacugaccu

SEQ ID NO: 118912 - RNA, 20 nt, Artificial Sequence
  MKO10118912_B_Ssxb3
  gRNA
gaacuucaaugccuucaacc

SEQ ID NO: 118913 - RNA, 20 nt, Artificial Sequence
  MKO10118913_B_Ssxb5
  gRNA
agaaguauguagaaauaucc

SEQ ID NO: 118914 - RNA, 20 nt, Artificial Sequence
  MKO10118914_B_Ssxb5
  gRNA
gaucuucaaugccuucaacc

SEQ ID NO: 118915 - RNA, 20 nt, Artificial Sequence
  MKO10118915_B_Ssxb5
  gRNA
gaaugcuuugaagaaucuuu

SEQ ID NO: 118916 - RNA, 20 nt, Artificial Sequence
  MKO10118916_B_Ssxb6
  gRNA
auugaaauucaugacaguga

SEQ ID NO: 118917 - RNA, 20 nt, Artificial Sequence
  MKO10118917_B_Ssxb6
  gRNA
cauacuucucugaugaagag

SEQ ID NO: 118918 - RNA, 20 nt, Artificial Sequence
  MKO10118918_B_Ssxb6
  gRNA
uacaucagaaugacugaccu

SEQ ID NO: 118919 - RNA, 20 nt, Artificial Sequence
  MKO10118919_B_Ssxb8
  gRNA
uccuugccacucaugaaaac

SEQ ID NO: 118920 - RNA, 20 nt, Artificial Sequence
  MKO10118920_B_Ssxb8
  gRNA
cauacuucucugaugaagag

SEQ ID NO: 118921 - RNA, 20 nt, Artificial Sequence
  MKO10118921_B_Ssxb8
  gRNA
uacaucagaaugacugaccu

SEQ ID NO: 118922 - RNA, 20 nt, Artificial Sequence
  MKO10118922_B_Ssxb9
  gRNA
agaaguauguagaaauaucc

SEQ ID NO: 118923 - RNA, 20 nt, Artificial Sequence
  MKO10118923_B_Ssxb9
  gRNA
gaucuucaaugccuucgacc

SEQ ID NO: 118924 - RNA, 20 nt, Artificial Sequence
  MKO10118924_B_Ssxb9
  gRNA
uccuugccacgcaugaaaac

SEQ ID NO: 118925 - RNA, 20 nt, Artificial Sequence
  MKO10118925_B_St13
  gRNA
augcuacucaccaucauuua

SEQ ID NO: 118926 - RNA, 20 nt, Artificial Sequence
  MKO10118926_B_St13
  gRNA
aaaaagagacaagacgacag

SEQ ID NO: 118927 - RNA, 20 nt, Artificial Sequence
  MKO10118927_B_St13
  gRNA
uuugcagaaauugacaauga

SEQ ID NO: 118928 - RNA, 20 nt, Artificial Sequence
  MKO10118928_B_St14
  gRNA
gacucaccgccuccuucacc

SEQ ID NO: 118929 - RNA, 20 nt, Artificial Sequence
  MKO10118929_B_St14
  gRNA
cuuuggcagaucggaaugug

SEQ ID NO: 118930 - RNA, 20 nt, Artificial Sequence
  MKO10118930_B_St14
  gRNA
agaagcgaggccccaggcgc

SEQ ID NO: 118931 - RNA, 20 nt, Artificial Sequence
  MKO10118931_B_St18
  gRNA
ucuaugguucauuccgacaa

SEQ ID NO: 118932 - RNA, 20 nt, Artificial Sequence
  MKO10118932_B_St18
  gRNA
ggugcacuuaggcaaauuug

SEQ ID NO: 118933 - RNA, 20 nt, Artificial Sequence
  MKO10118933_B_St18
  gRNA
gguuccauaugauugcucua

SEQ ID NO: 118934 - RNA, 20 nt, Artificial Sequence
  MKO10118934_B_St3gal1
  gRNA
uggcgcugaucacccacugc

SEQ ID NO: 118935 - RNA, 20 nt, Artificial Sequence
  MKO10118935_B_St3gal1
  gRNA
ucaagaccaccgaccugcag

SEQ ID NO: 118936 - RNA, 20 nt, Artificial Sequence
  MKO10118936_B_St3gal1
  gRNA
gucaaagacauacuugauga

SEQ ID NO: 118937 - RNA, 20 nt, Artificial Sequence
  MKO10118937_B_St3gal2
  gRNA
gguucucgccaggcacgauc

SEQ ID NO: 118938 - RNA, 20 nt, Artificial Sequence
  MKO10118938_B_St3gal2
  gRNA
gaugaaucaggcaccgacug

SEQ ID NO: 118939 - RNA, 20 nt, Artificial Sequence
  MKO10118939_B_St3gal2
  gRNA
gggcgcuggcaauccacauu

SEQ ID NO: 118940 - RNA, 20 nt, Artificial Sequence
  MKO10118940_B_St3gal3
  gRNA
acuccuuucgcaagugggcu

SEQ ID NO: 118941 - RNA, 20 nt, Artificial Sequence
  MKO10118941_B_St3gal3
  gRNA
cuucuuucccuugacuccgc

SEQ ID NO: 118942 - RNA, 20 nt, Artificial Sequence
  MKO10118942_B_St3gal3
  gRNA
ggaguugguaccugugccua

SEQ ID NO: 118943 - RNA, 20 nt, Artificial Sequence
  MKO10118943_B_St3gal4
  gRNA
auuccaucucccgagaagau

SEQ ID NO: 118944 - RNA, 20 nt, Artificial Sequence
  MKO10118944_B_St3gal4
  gRNA
uuacuugccaaaaaucuuag

SEQ ID NO: 118945 - RNA, 20 nt, Artificial Sequence
  MKO10118945_B_St3gal4
  gRNA
ucuugcagacuggaagcucc

SEQ ID NO: 118946 - RNA, 20 nt, Artificial Sequence
  MKO10118946_B_St3gal5
  gRNA
cauagccgucuucgcguacc

SEQ ID NO: 118947 - RNA, 20 nt, Artificial Sequence
  MKO10118947_B_St3gal5
  gRNA
guugaacagugcgccaguug

SEQ ID NO: 118948 - RNA, 20 nt, Artificial Sequence
  MKO10118948_B_St3gal5
  gRNA
aggugcacguugguugcauu

SEQ ID NO: 118949 - RNA, 20 nt, Artificial Sequence
  MKO10118949_B_St3gal6
  gRNA
ccaacagagugccauguaaa

SEQ ID NO: 118950 - RNA, 20 nt, Artificial Sequence
  MKO10118950_B_St3gal6
  gRNA
aucucuuugacgaguuugac

SEQ ID NO: 118951 - RNA, 20 nt, Artificial Sequence
  MKO10118951_B_St3gal6
  gRNA
accgaaggucuuuauuccau

SEQ ID NO: 118952 - RNA, 20 nt, Artificial Sequence
  MKO10118952_B_St5
  gRNA
guacaaccacccacccaugc

SEQ ID NO: 118953 - RNA, 20 nt, Artificial Sequence
  MKO10118953_B_St5
  gRNA
cugaccaguucccacugcgc

SEQ ID NO: 118954 - RNA, 20 nt, Artificial Sequence
  MKO10118954_B_St5
  gRNA
acugagagucaacccaaguu

SEQ ID NO: 118955 - RNA, 20 nt, Artificial Sequence
  MKO10118955_B_St6gal1
  gRNA
cuuugacagcgccugcacga

SEQ ID NO: 118956 - RNA, 20 nt, Artificial Sequence
  MKO10118956_B_St6gal1
  gRNA
aaaccuauaagaguuaccga

SEQ ID NO: 118957 - RNA, 20 nt, Artificial Sequence
  MKO10118957_B_St6gal1
  gRNA
cauccgccuagugaacucuc

SEQ ID NO: 118958 - RNA, 20 nt, Artificial Sequence
  MKO10118958_B_St6gal2
  gRNA
cuccauauauccagcaucgc

SEQ ID NO: 118959 - RNA, 20 nt, Artificial Sequence
  MKO10118959_B_St6gal2
  gRNA
uuuaacucugccccuacacg

SEQ ID NO: 118960 - RNA, 20 nt, Artificial Sequence
  MKO10118960_B_St6gal2
  gRNA
agaauuaaugaugcguacug

SEQ ID NO: 118961 - RNA, 20 nt, Artificial Sequence
  MKO10118961_B_St6galnac1
  gRNA
ucgccagcagcagcuccucc

SEQ ID NO: 118962 - RNA, 20 nt, Artificial Sequence
  MKO10118962_B_St6galnac1
  gRNA
cucugcuucugugaagauca

SEQ ID NO: 118963 - RNA, 20 nt, Artificial Sequence
  MKO10118963_B_St6galnac1
  gRNA
auugaguuccaugaagccaa

SEQ ID NO: 118964 - RNA, 20 nt, Artificial Sequence
  MKO10118964_B_St6galnac2
  gRNA
gggagcuguuuggugccccc

SEQ ID NO: 118965 - RNA, 20 nt, Artificial Sequence
  MKO10118965_B_St6galnac2
  gRNA
gugggagggccucuucacuc

SEQ ID NO: 118966 - RNA, 20 nt, Artificial Sequence
  MKO10118966_B_St6galnac2
  gRNA
uuggggucaaagaaugcucg

SEQ ID NO: 118967 - RNA, 20 nt, Artificial Sequence
  MKO10118967_B_St6galnac3
  gRNA
uaguauucacacacccgaac

SEQ ID NO: 118968 - RNA, 20 nt, Artificial Sequence
  MKO10118968_B_St6galnac3
  gRNA
cagccucuucgaacucacua

SEQ ID NO: 118969 - RNA, 20 nt, Artificial Sequence
  MKO10118969_B_St6galnac3
  gRNA
guagaucugcgcaucuggau

SEQ ID NO: 118970 - RNA, 20 nt, Artificial Sequence
  MKO10118970_B_St6galnac4
  gRNA
ccaucgcuucauuaccgaga

SEQ ID NO: 118971 - RNA, 20 nt, Artificial Sequence
  MKO10118971_B_St6galnac4
  gRNA
cgguugguucaccaugauuc

SEQ ID NO: 118972 - RNA, 20 nt, Artificial Sequence
  MKO10118972_B_St6galnac4
  gRNA
uggucagcgauaguuacugc

SEQ ID NO: 118973 - RNA, 20 nt, Artificial Sequence
  MKO10118973_B_St6galnac5
  gRNA
ugugacaggaucgauguuua

SEQ ID NO: 118974 - RNA, 20 nt, Artificial Sequence
  MKO10118974_B_St6galnac5
  gRNA
ccuucaugaucacgcgccac

SEQ ID NO: 118975 - RNA, 20 nt, Artificial Sequence
  MKO10118975_B_St6galnac5
  gRNA
uggaaugugcgaugacccgc

SEQ ID NO: 118976 - RNA, 20 nt, Artificial Sequence
  MKO10118976_B_St6galnac6
  gRNA
gccgacgcgugcggccccgc

SEQ ID NO: 118977 - RNA, 20 nt, Artificial Sequence
  MKO10118977_B_St6galnac6
  gRNA
agcgguggugauugcccuua

SEQ ID NO: 118978 - RNA, 20 nt, Artificial Sequence
  MKO10118978_B_St6galnac6
  gRNA
accgcuucaucaccgagaag

SEQ ID NO: 118979 - RNA, 20 nt, Artificial Sequence
  MKO10118979_B_St7l
  gRNA
cucagacaccaccaucuauc

SEQ ID NO: 118980 - RNA, 20 nt, Artificial Sequence
  MKO10118980_B_St7l
  gRNA
uguaagugccacauagaacu

SEQ ID NO: 118981 - RNA, 20 nt, Artificial Sequence
  MKO10118981_B_St7l
  gRNA
gggacaucuucuuugauauc

SEQ ID NO: 118982 - RNA, 20 nt, Artificial Sequence
  MKO10118982_B_St7
  gRNA
ugaagauucaguaccaaaca

SEQ ID NO: 118983 - RNA, 20 nt, Artificial Sequence
  MKO10118983_B_St7
  gRNA
accugagacacuuugucugu

SEQ ID NO: 118984 - RNA, 20 nt, Artificial Sequence
  MKO10118984_B_St7
  gRNA
uuguuacagaaugcaaagua

SEQ ID NO: 118985 - RNA, 20 nt, Artificial Sequence
  MKO10118985_B_St8sia1
  gRNA
agagcuccccaucguaccac

SEQ ID NO: 118986 - RNA, 20 nt, Artificial Sequence
  MKO10118986_B_St8sia1
  gRNA
ggaagagccugugguacgau

SEQ ID NO: 118987 - RNA, 20 nt, Artificial Sequence
  MKO10118987_B_St8sia1
  gRNA
uuaccucuggcgaauuaugc

SEQ ID NO: 118988 - RNA, 20 nt, Artificial Sequence
  MKO10118988_B_St8sia2
  gRNA
uuacuucugucagcgacagc

SEQ ID NO: 118989 - RNA, 20 nt, Artificial Sequence
  MKO10118989_B_St8sia2
  gRNA
ucgggggucuugcugaacag

SEQ ID NO: 118990 - RNA, 20 nt, Artificial Sequence
  MKO10118990_B_St8sia2
  gRNA
gcuuacauagcaaaucuaau

SEQ ID NO: 118991 - RNA, 20 nt, Artificial Sequence
  MKO10118991_B_St8sia3
  gRNA
aacuguaacgagaacgcuag

SEQ ID NO: 118992 - RNA, 20 nt, Artificial Sequence
  MKO10118992_B_St8sia3
  gRNA
agggccagaaaccguacaag

SEQ ID NO: 118993 - RNA, 20 nt, Artificial Sequence
  MKO10118993_B_St8sia3
  gRNA
auaccugugcucagucguuu

SEQ ID NO: 118994 - RNA, 20 nt, Artificial Sequence
  MKO10118994_B_St8sia4
  gRNA
uuuccaacgccaguccucac

SEQ ID NO: 118995 - RNA, 20 nt, Artificial Sequence
  MKO10118995_B_St8sia4
  gRNA
cauccugugaggacuggcgu

SEQ ID NO: 118996 - RNA, 20 nt, Artificial Sequence
  MKO10118996_B_St8sia4
  gRNA
uggaguucgcugcugaugug

SEQ ID NO: 118997 - RNA, 20 nt, Artificial Sequence
  MKO10118997_B_St8sia5
  gRNA
agcagucugaacucuucgaa

SEQ ID NO: 118998 - RNA, 20 nt, Artificial Sequence
  MKO10118998_B_St8sia5
  gRNA
cuccgccaacagagauuugu

SEQ ID NO: 118999 - RNA, 20 nt, Artificial Sequence
  MKO10118999_B_St8sia5
  gRNA
uaccugagauucgucuccac

SEQ ID NO: 119000 - RNA, 20 nt, Artificial Sequence
  MKO10119000_B_St8sia6
  gRNA
uaguaccuguuccuggugcg

SEQ ID NO: 119001 - RNA, 20 nt, Artificial Sequence
  MKO10119001_B_St8sia6
  gRNA
cuuuaucuaacaaaacgaga

SEQ ID NO: 119002 - RNA, 20 nt, Artificial Sequence
  MKO10119002_B_St8sia6
  gRNA
caaacauacagagaugccca

SEQ ID NO: 119003 - RNA, 20 nt, Artificial Sequence
  MKO10119003_B_Suab1
  gRNA
ggcgccgcgauauccuuaag

SEQ ID NO: 119004 - RNA, 20 nt, Artificial Sequence
  MKO10119004_B_Suab1
  gRNA
gcagccacuuaaggauaucg

SEQ ID NO: 119005 - RNA, 20 nt, Artificial Sequence
  MKO10119005_B_Suab1
  gRNA
ugccgagaccccaacagauu

SEQ ID NO: 119006 - RNA, 20 nt, Artificial Sequence
  MKO10119006_B_Suab2
  gRNA
ucgaaccccgacagugccau

SEQ ID NO: 119007 - RNA, 20 nt, Artificial Sequence
  MKO10119007_B_Suab2
  gRNA
agacucaccugcugaacaau

SEQ ID NO: 119008 - RNA, 20 nt, Artificial Sequence
  MKO10119008_B_Suab2
  gRNA
caagggcaccgugugguggc

SEQ ID NO: 119009 - RNA, 20 nt, Artificial Sequence
  MKO10119009_B_Suac2
  gRNA
uagcgcagcgucucauaaac

SEQ ID NO: 119010 - RNA, 20 nt, Artificial Sequence
  MKO10119010_B_Suac2
  gRNA
gggucacuuaccaguaggug

SEQ ID NO: 119011 - RNA, 20 nt, Artificial Sequence
  MKO10119011_B_Suac2
  gRNA
cuuacaucgcaagcccuguu

SEQ ID NO: 119012 - RNA, 20 nt, Artificial Sequence
  MKO10119012_B_Suac3
  gRNA
acuuacagacagcguacugu

SEQ ID NO: 119013 - RNA, 20 nt, Artificial Sequence
  MKO10119013_B_Suac3
  gRNA
ugagcauugucaguccuacg

SEQ ID NO: 119014 - RNA, 20 nt, Artificial Sequence
  MKO10119014_B_Suac3
  gRNA
uccagccaccugguuuccgu

SEQ ID NO: 119015 - RNA, 20 nt, Artificial Sequence
  MKO10119015_B_Suac
  gRNA
ccaacuugcccaugcaccgc

SEQ ID NO: 119016 - RNA, 20 nt, Artificial Sequence
  MKO10119016_B_Suac
  gRNA
agccgcccuucuucguucuc

SEQ ID NO: 119017 - RNA, 20 nt, Artificial Sequence
  MKO10119017_B_Suac
  gRNA
ccuggcgccccagcggugca

SEQ ID NO: 119018 - RNA, 20 nt, Artificial Sequence
  MKO10119018_B_Suag1
  gRNA
auacauacuggaggccggcc

SEQ ID NO: 119019 - RNA, 20 nt, Artificial Sequence
  MKO10119019_B_Suag1
  gRNA
uucaauccagucauccacca

SEQ ID NO: 119020 - RNA, 20 nt, Artificial Sequence
  MKO10119020_B_Suag1
  gRNA
aaaagaaaaaggggucgucc

SEQ ID NO: 119021 - RNA, 20 nt, Artificial Sequence
  MKO10119021_B_Suag2
  gRNA
aacggucaucaucaacagaa

SEQ ID NO: 119022 - RNA, 20 nt, Artificial Sequence
  MKO10119022_B_Suag2
  gRNA
aaugacagaagaauuugacg

SEQ ID NO: 119023 - RNA, 20 nt, Artificial Sequence
  MKO10119023_B_Suag2
  gRNA
aaaaaucagaagcaaggcaa

SEQ ID NO: 119024 - RNA, 20 nt, Artificial Sequence
  MKO10119024_B_Suag3
  gRNA
cauucccacuagauacuauu

SEQ ID NO: 119025 - RNA, 20 nt, Artificial Sequence
  MKO10119025_B_Suag3
  gRNA
ccuagucuuugguggaugag

SEQ ID NO: 119026 - RNA, 20 nt, Artificial Sequence
  MKO10119026_B_Suag3
  gRNA
agagaucauccaacaccuaa

SEQ ID NO: 119027 - RNA, 20 nt, Artificial Sequence
  MKO10119027_B_Suam2
  gRNA
ugaucauggacaucugugac

SEQ ID NO: 119028 - RNA, 20 nt, Artificial Sequence
  MKO10119028_B_Suam2
  gRNA
gccuaaaagccauaaugaaa

SEQ ID NO: 119029 - RNA, 20 nt, Artificial Sequence
  MKO10119029_B_Suam2
  gRNA
acguucugugauaaaaaaua

SEQ ID NO: 119030 - RNA, 20 nt, Artificial Sequence
  MKO10119030_B_Suambpl1
  gRNA
guucagacucuaguugcugc

SEQ ID NO: 119031 - RNA, 20 nt, Artificial Sequence
  MKO10119031_B_Suambpl1
  gRNA
aauugaaaacggaccugcua

SEQ ID NO: 119032 - RNA, 20 nt, Artificial Sequence
  MKO10119032_B_Suambpl1
  gRNA
cugcacacugcugguaaucu

SEQ ID NO: 119033 - RNA, 20 nt, Artificial Sequence
  MKO10119033_B_Suambp
  gRNA
cgugggcgagaacggugagc

SEQ ID NO: 119034 - RNA, 20 nt, Artificial Sequence
  MKO10119034_B_Suambp
  gRNA
ugagcaguauaaagagcgaa

SEQ ID NO: 119035 - RNA, 20 nt, Artificial Sequence
  MKO10119035_B_Suambp
  gRNA
gauguggcgcaggccuucaa

SEQ ID NO: 119036 - RNA, 20 nt, Artificial Sequence
  MKO10119036_B_Suam
  gRNA
uagugaguugaauacugcug

SEQ ID NO: 119037 - RNA, 20 nt, Artificial Sequence
  MKO10119037_B_Suam
  gRNA
auucccagcuauuggcucuc

SEQ ID NO: 119038 - RNA, 20 nt, Artificial Sequence
  MKO10119038_B_Suam
  gRNA
aguaagcaauguauuaaaua

SEQ ID NO: 119039 - RNA, 20 nt, Artificial Sequence
  MKO10119039_B_Suap1
  gRNA
cccaggaguacaaacacuau

SEQ ID NO: 119040 - RNA, 20 nt, Artificial Sequence
  MKO10119040_B_Suap1
  gRNA
gucaguguaaaagaacagcg

SEQ ID NO: 119041 - RNA, 20 nt, Artificial Sequence
  MKO10119041_B_Suap1
  gRNA
cuucacaugcacuucuucuu

SEQ ID NO: 119042 - RNA, 20 nt, Artificial Sequence
  MKO10119042_B_Suap2
  gRNA
gagaaccaggcugaagugau

SEQ ID NO: 119043 - RNA, 20 nt, Artificial Sequence
  MKO10119043_B_Suap2
  gRNA
ucuguuucuacaauagcaau

SEQ ID NO: 119044 - RNA, 20 nt, Artificial Sequence
  MKO10119044_B_Suap2
  gRNA
cucucucuagguggagagcc

SEQ ID NO: 119045 - RNA, 20 nt, Artificial Sequence
  MKO10119045_B_Suard10
  gRNA
gagcugcgucaucaccuacc

SEQ ID NO: 119046 - RNA, 20 nt, Artificial Sequence
  MKO10119046_B_Suard10
  gRNA
aaugauguaaucagcgccca

SEQ ID NO: 119047 - RNA, 20 nt, Artificial Sequence
  MKO10119047_B_Suard10
  gRNA
agccacuuaccuugggggcc

SEQ ID NO: 119048 - RNA, 20 nt, Artificial Sequence
  MKO10119048_B_Suard13
  gRNA
caguacgcucagcuguauga

SEQ ID NO: 119049 - RNA, 20 nt, Artificial Sequence
  MKO10119049_B_Suard13
  gRNA
accuuguagaaccucuuugc

SEQ ID NO: 119050 - RNA, 20 nt, Artificial Sequence
  MKO10119050_B_Suard13
  gRNA
gcaguuccccaucaacauug

SEQ ID NO: 119051 - RNA, 20 nt, Artificial Sequence
  MKO10119051_B_Suard3nl
  gRNA
caucgagaacacccugaaga

SEQ ID NO: 119052 - RNA, 20 nt, Artificial Sequence
  MKO10119052_B_Suard3nl
  gRNA
agcaaaagugauccucucaa

SEQ ID NO: 119053 - RNA, 20 nt, Artificial Sequence
  MKO10119053_B_Suard3nl
  gRNA
uuucaaaguguuaccucaag

SEQ ID NO: 119054 - RNA, 20 nt, Artificial Sequence
  MKO10119054_B_Suard3
  gRNA
ugauuucaaagucuuacccc

SEQ ID NO: 119055 - RNA, 20 nt, Artificial Sequence
  MKO10119055_B_Suard3
  gRNA
gacggagcacagcauagccc

SEQ ID NO: 119056 - RNA, 20 nt, Artificial Sequence
  MKO10119056_B_Suard3
  gRNA
cagugcauuccucauuguca

SEQ ID NO: 119057 - RNA, 20 nt, Artificial Sequence
  MKO10119057_B_Suard4
  gRNA
gugaugcguuacaccacugc

SEQ ID NO: 119058 - RNA, 20 nt, Artificial Sequence
  MKO10119058_B_Suard4
  gRNA
cugaaguuuaguugaaauag

SEQ ID NO: 119059 - RNA, 20 nt, Artificial Sequence
  MKO10119059_B_Suard4
  gRNA
aaacccucagaagaguuuaa

SEQ ID NO: 119060 - RNA, 20 nt, Artificial Sequence
  MKO10119060_B_Suard5
  gRNA
gguucacagaagcacccgca

SEQ ID NO: 119061 - RNA, 20 nt, Artificial Sequence
  MKO10119061_B_Suard5
  gRNA
aggccaucugaggaguuucc

SEQ ID NO: 119062 - RNA, 20 nt, Artificial Sequence
  MKO10119062_B_Suard5
  gRNA
ccaugaagcuuauuucuccc

SEQ ID NO: 119063 - RNA, 20 nt, Artificial Sequence
  MKO10119063_B_Suard6
  gRNA
aagaccucuagaauauucca

SEQ ID NO: 119064 - RNA, 20 nt, Artificial Sequence
  MKO10119064_B_Suard6
  gRNA
cucugugaucauguuugaag

SEQ ID NO: 119065 - RNA, 20 nt, Artificial Sequence
  MKO10119065_B_Suard6
  gRNA
acuaagucgauaaagucucu

SEQ ID NO: 119066 - RNA, 20 nt, Artificial Sequence
  MKO10119066_B_Suard7
  gRNA
ccgacaguucuucaauguuc

SEQ ID NO: 119067 - RNA, 20 nt, Artificial Sequence
  MKO10119067_B_Suard7
  gRNA
ucaccucuagcuugaucaca

SEQ ID NO: 119068 - RNA, 20 nt, Artificial Sequence
  MKO10119068_B_Suard7
  gRNA
caaccguuucaucucauuaa

SEQ ID NO: 119069 - RNA, 20 nt, Artificial Sequence
  MKO10119069_B_Suard8
  gRNA
gugggcaucuuucgcaaguc

SEQ ID NO: 119070 - RNA, 20 nt, Artificial Sequence
  MKO10119070_B_Suard8
  gRNA
guagguaucgcauagcuugc

SEQ ID NO: 119071 - RNA, 20 nt, Artificial Sequence
  MKO10119071_B_Suard8
  gRNA
acuuacgcugauagauuugu

SEQ ID NO: 119072 - RNA, 20 nt, Artificial Sequence
  MKO10119072_B_Suar
  gRNA
ugugggcaagguguuucgcu

SEQ ID NO: 119073 - RNA, 20 nt, Artificial Sequence
  MKO10119073_B_Suar
  gRNA
auuaaggcaccaagcugugc

SEQ ID NO: 119074 - RNA, 20 nt, Artificial Sequence
  MKO10119074_B_Suar
  gRNA
cgaaacaccuugcccacauc

SEQ ID NO: 119075 - RNA, 20 nt, Artificial Sequence
  MKO10119075_B_Suau1
  gRNA
acucuuaccucuguucugag

SEQ ID NO: 119076 - RNA, 20 nt, Artificial Sequence
  MKO10119076_B_Suau1
  gRNA
gaucaucuacaacugucuga

SEQ ID NO: 119077 - RNA, 20 nt, Artificial Sequence
  MKO10119077_B_Suau1
  gRNA
uuaucugcagugcauagagc

SEQ ID NO: 119078 - RNA, 20 nt, Artificial Sequence
  MKO10119078_B_Suau2
  gRNA
aguucuuggugagauccauc

SEQ ID NO: 119079 - RNA, 20 nt, Artificial Sequence
  MKO10119079_B_Suau2
  gRNA
auaacuugcgaaaauucagc

SEQ ID NO: 119080 - RNA, 20 nt, Artificial Sequence
  MKO10119080_B_Suau2
  gRNA
ccuacuuagaccuuucccaa

SEQ ID NO: 119081 - RNA, 20 nt, Artificial Sequence
  MKO10119081_B_Suau3
  gRNA
acgauccgggcaauuuccau

SEQ ID NO: 119082 - RNA, 20 nt, Artificial Sequence
  MKO10119082_B_Suau3
  gRNA
guacagcgacagcuucccca

SEQ ID NO: 119083 - RNA, 20 nt, Artificial Sequence
  MKO10119083_B_Suau3
  gRNA
ggaggcgagacucuucccac

SEQ ID NO: 119084 - RNA, 20 nt, Artificial Sequence
  MKO10119084_B_Suau4
  gRNA
uguagucaaacucaucuugc

SEQ ID NO: 119085 - RNA, 20 nt, Artificial Sequence
  MKO10119085_B_Suau4
  gRNA
gagaauuagaaaaguucuuc

SEQ ID NO: 119086 - RNA, 20 nt, Artificial Sequence
  MKO10119086_B_Suau4
  gRNA
agcuucuaacaaugaaacua

SEQ ID NO: 119087 - RNA, 20 nt, Artificial Sequence
  MKO10119087_B_Suau5a
  gRNA
ucugggacauggcgucaacc

SEQ ID NO: 119088 - RNA, 20 nt, Artificial Sequence
  MKO10119088_B_Suau5a
  gRNA
cacguaugaccgcuguccca

SEQ ID NO: 119089 - RNA, 20 nt, Artificial Sequence
  MKO10119089_B_Suau5a
  gRNA
uaauccccaggaccgagguc

SEQ ID NO: 119090 - RNA, 20 nt, Artificial Sequence
  MKO10119090_B_Suau5b
  gRNA
guucguuguacagaaugugc

SEQ ID NO: 119091 - RNA, 20 nt, Artificial Sequence
  MKO10119091_B_Suau5b
  gRNA
aauagaucuugauaauccac

SEQ ID NO: 119092 - RNA, 20 nt, Artificial Sequence
  MKO10119092_B_Suau5b
  gRNA
cauuaaggccacccagcucc

SEQ ID NO: 119093 - RNA, 20 nt, Artificial Sequence
  MKO10119093_B_Suau6
  gRNA
cuugccgcacaucagcaccu

SEQ ID NO: 119094 - RNA, 20 nt, Artificial Sequence
  MKO10119094_B_Suau6
  gRNA
cucgaugcugaagccuuccg

SEQ ID NO: 119095 - RNA, 20 nt, Artificial Sequence
  MKO10119095_B_Suau6
  gRNA
uugauagacccuccugucaa

SEQ ID NO: 119096 - RNA, 20 nt, Artificial Sequence
  MKO10119096_B_Suau1
  gRNA
uguuugaaauugcgcugaag

SEQ ID NO: 119097 - RNA, 20 nt, Artificial Sequence
  MKO10119097_B_Suau1
  gRNA
aaaaccaauguauaagcccg

SEQ ID NO: 119098 - RNA, 20 nt, Artificial Sequence
  MKO10119098_B_Suau1
  gRNA
aggcuuaccucaaaauucac

SEQ ID NO: 119099 - RNA, 20 nt, Artificial Sequence
  MKO10119099_B_Suau2
  gRNA
uaacugaacauaaaagaucu

SEQ ID NO: 119100 - RNA, 20 nt, Artificial Sequence
  MKO10119100_B_Suau2
  gRNA
cuuuguuagcaacagcuugu

SEQ ID NO: 119101 - RNA, 20 nt, Artificial Sequence
  MKO10119101_B_Suau2
  gRNA
acacauaccucaaaacugac

SEQ ID NO: 119102 - RNA, 20 nt, Artificial Sequence
  MKO10119102_B_Stbd1
  gRNA
guucguguugguagagaaua

SEQ ID NO: 119103 - RNA, 20 nt, Artificial Sequence
  MKO10119103_B_Stbd1
  gRNA
cuagacccccgccgaccagc

SEQ ID NO: 119104 - RNA, 20 nt, Artificial Sequence
  MKO10119104_B_Stbd1
  gRNA
gguugcggagccgccgcaga

SEQ ID NO: 119105 - RNA, 20 nt, Artificial Sequence
  MKO10119105_B_Suc1
  gRNA
cagugcagcugcagcgcacg

SEQ ID NO: 119106 - RNA, 20 nt, Artificial Sequence
  MKO10119106_B_Suc1
  gRNA
cagacuuguccgaagccuuc

SEQ ID NO: 119107 - RNA, 20 nt, Artificial Sequence
  MKO10119107_B_Suc1
  gRNA
ugcugcuaaauuugacacuc

SEQ ID NO: 119108 - RNA, 20 nt, Artificial Sequence
  MKO10119108_B_Suc2
  gRNA
gacggacuccacgaacccuc

SEQ ID NO: 119109 - RNA, 20 nt, Artificial Sequence
  MKO10119109_B_Suc2
  gRNA
guggaguccguccccugcgc

SEQ ID NO: 119110 - RNA, 20 nt, Artificial Sequence
  MKO10119110_B_Suc2
  gRNA
aaugccggggacgugggcug

SEQ ID NO: 119111 - RNA, 20 nt, Artificial Sequence
  MKO10119111_B_Steap1
  gRNA
gacaucuacccauuuauucc

SEQ ID NO: 119112 - RNA, 20 nt, Artificial Sequence
  MKO10119112_B_Steap1
  gRNA
uagaugucagucaauuugua

SEQ ID NO: 119113 - RNA, 20 nt, Artificial Sequence
  MKO10119113_B_Steap1
  gRNA
ccuggguagagcaugauguc

SEQ ID NO: 119114 - RNA, 20 nt, Artificial Sequence
  MKO10119114_B_Steap2
  gRNA
gccacaucuaauaagccgaa

SEQ ID NO: 119115 - RNA, 20 nt, Artificial Sequence
  MKO10119115_B_Steap2
  gRNA
cgauaaccugcugucgagcu

SEQ ID NO: 119116 - RNA, 20 nt, Artificial Sequence
  MKO10119116_B_Steap2
  gRNA
aguaccgccgauuucccccg

SEQ ID NO: 119117 - RNA, 20 nt, Artificial Sequence
  MKO10119117_B_Steap3
  gRNA
aaaggcacggguccagccgu

SEQ ID NO: 119118 - RNA, 20 nt, Artificial Sequence
  MKO10119118_B_Steap3
  gRNA
ccagguacucagcguuagac

SEQ ID NO: 119119 - RNA, 20 nt, Artificial Sequence
  MKO10119119_B_Steap3
  gRNA
uggccaacaagagccgccuc

SEQ ID NO: 119120 - RNA, 20 nt, Artificial Sequence
  MKO10119120_B_Steap4
  gRNA
cgucauccccugcgcagugc

SEQ ID NO: 119121 - RNA, 20 nt, Artificial Sequence
  MKO10119121_B_Steap4
  gRNA
gauaaucaacuaguuccgug

SEQ ID NO: 119122 - RNA, 20 nt, Artificial Sequence
  MKO10119122_B_Steap4
  gRNA
uaaugauuccuacuuggcgc

SEQ ID NO: 119123 - RNA, 20 nt, Artificial Sequence
  MKO10119123_B_Stfa1
  gRNA
uauaaaacucaagucgucgc

SEQ ID NO: 119124 - RNA, 20 nt, Artificial Sequence
  MKO10119124_B_Stfa1
  gRNA
uuucagauggauguagguca

SEQ ID NO: 119125 - RNA, 20 nt, Artificial Sequence
  MKO10119125_B_Stfa1
  gRNA
aauccagaugauugcuaaca

SEQ ID NO: 119126 - RNA, 20 nt, Artificial Sequence
  MKO10119126_B_Stfa2l1
  gRNA
aaucuccugaauuucugaug

SEQ ID NO: 119127 - RNA, 20 nt, Artificial Sequence
  MKO10119127_B_Stfa2l1
  gRNA
uaaugaaguaauuuaguccu

SEQ ID NO: 119128 - RNA, 20 nt, Artificial Sequence
  MKO10119128_B_Stfa2l1
  gRNA
uauaaaguucaagucgucca

SEQ ID NO: 119129 - RNA, 20 nt, Artificial Sequence
  MKO10119129_B_Stfa2
  gRNA
caaaccuccaauuauuucua

SEQ ID NO: 119130 - RNA, 20 nt, Artificial Sequence
  MKO10119130_B_Stfa2
  gRNA
uauaaaguucaagucgucca

SEQ ID NO: 119131 - RNA, 20 nt, Artificial Sequence
  MKO10119131_B_Stfa2
  gRNA
uaaugaaguaauuuaguccu

SEQ ID NO: 119132 - RNA, 20 nt, Artificial Sequence
  MKO10119132_B_Stfa3
  gRNA
ucaccuugucagcaaucauc

SEQ ID NO: 119133 - RNA, 20 nt, Artificial Sequence
  MKO10119133_B_Stfa3
  gRNA
aauccagaugauugcugaca

SEQ ID NO: 119134 - RNA, 20 nt, Artificial Sequence
  MKO10119134_B_Stfa3
  gRNA
ugagaaauaugaaaaauucg

SEQ ID NO: 119135 - RNA, 20 nt, Artificial Sequence
  MKO10119135_B_Stil
  gRNA
aaagguaccaucuugcuuga

SEQ ID NO: 119136 - RNA, 20 nt, Artificial Sequence
  MKO10119136_B_Stil
  gRNA
acuugcaucucaguuacuac

SEQ ID NO: 119137 - RNA, 20 nt, Artificial Sequence
  MKO10119137_B_Stil
  gRNA
ugcaagugcuguagggauaa

SEQ ID NO: 119138 - RNA, 20 nt, Artificial Sequence
  MKO10119138_B_Stim1
  gRNA
augacuuccacgccuuccac

SEQ ID NO: 119139 - RNA, 20 nt, Artificial Sequence
  MKO10119139_B_Stim1
  gRNA
guaaccaacaccaccaugac

SEQ ID NO: 119140 - RNA, 20 nt, Artificial Sequence
  MKO10119140_B_Stim1
  gRNA
caucgucauccaucagcuua

SEQ ID NO: 119141 - RNA, 20 nt, Artificial Sequence
  MKO10119141_B_Stim2
  gRNA
cuugcuucacugaagaagac

SEQ ID NO: 119142 - RNA, 20 nt, Artificial Sequence
  MKO10119142_B_Stim2
  gRNA
agauaagcacauaacuguug

SEQ ID NO: 119143 - RNA, 20 nt, Artificial Sequence
  MKO10119143_B_Stim2
  gRNA
gcccaaacagaaccacaucc

SEQ ID NO: 119144 - RNA, 20 nt, Artificial Sequence
  MKO10119144_B_Stip1
  gRNA
gcagaacaagccgucagacc

SEQ ID NO: 119145 - RNA, 20 nt, Artificial Sequence
  MKO10119145_B_Stip1
  gRNA
uucguuuggcuuccucaaac

SEQ ID NO: 119146 - RNA, 20 nt, Artificial Sequence
  MKO10119146_B_Stip1
  gRNA
acugagcagcgaccuugucc

SEQ ID NO: 119147 - RNA, 20 nt, Artificial Sequence
  MKO10119147_B_Stk10
  gRNA
caacgugcuuaugacccuug

SEQ ID NO: 119148 - RNA, 20 nt, Artificial Sequence
  MKO10119148_B_Stk10
  gRNA
aucaugauugaguucugccc

SEQ ID NO: 119149 - RNA, 20 nt, Artificial Sequence
  MKO10119149_B_Stk10
  gRNA
ccaguaaggugucccuauga

SEQ ID NO: 119150 - RNA, 20 nt, Artificial Sequence
  MKO10119150_B_Stk11ip
  gRNA
gagcgcauuguagcugaagu

SEQ ID NO: 119151 - RNA, 20 nt, Artificial Sequence
  MKO10119151_B_Stk11ip
  gRNA
gguuugcaacagaagcaucc

SEQ ID NO: 119152 - RNA, 20 nt, Artificial Sequence
  MKO10119152_B_Stk11ip
  gRNA
uuucagcugguccauauccc

SEQ ID NO: 119153 - RNA, 20 nt, Artificial Sequence
  MKO10119153_B_Stk11
  gRNA
guacugcguauguggcaugc

SEQ ID NO: 119154 - RNA, 20 nt, Artificial Sequence
  MKO10119154_B_Stk11
  gRNA
ucggaaugugauccagcuug

SEQ ID NO: 119155 - RNA, 20 nt, Artificial Sequence
  MKO10119155_B_Stk11
  gRNA
ugacaccugccggacaagcc

SEQ ID NO: 119156 - RNA, 20 nt, Artificial Sequence
  MKO10119156_B_Stk16
  gRNA
gccacugugucaucgaugag

SEQ ID NO: 119157 - RNA, 20 nt, Artificial Sequence
  MKO10119157_B_Stk16
  gRNA
uuaccugaagagcuagugcc

SEQ ID NO: 119158 - RNA, 20 nt, Artificial Sequence
  MKO10119158_B_Stk16
  gRNA
caucaugcaagcccuccacu

SEQ ID NO: 119159 - RNA, 20 nt, Artificial Sequence
  MKO10119159_B_Stk17b
  gRNA
uugggaaugcaagugagcuu

SEQ ID NO: 119160 - RNA, 20 nt, Artificial Sequence
  MKO10119160_B_Stk17b
  gRNA
augggaacaccugaauacuu

SEQ ID NO: 119161 - RNA, 20 nt, Artificial Sequence
  MKO10119161_B_Stk17b
  gRNA
guagauaaugaacuccuuca

SEQ ID NO: 119162 - RNA, 20 nt, Artificial Sequence
  MKO10119162_B_Stk19
  gRNA
uggggcggugcagaaguucc

SEQ ID NO: 119163 - RNA, 20 nt, Artificial Sequence
  MKO10119163_B_Stk19
  gRNA
ugcucaugggauugucuuca

SEQ ID NO: 119164 - RNA, 20 nt, Artificial Sequence
  MKO10119164_B_Stk19
  gRNA
ugcaggcagcuggugaacgc

SEQ ID NO: 119165 - RNA, 20 nt, Artificial Sequence
  MKO10119165_B_Stk24
  gRNA
ugacguagggacugucacac

SEQ ID NO: 119166 - RNA, 20 nt, Artificial Sequence
  MKO10119166_B_Stk24
  gRNA
uuucagaauuucucguaaua

SEQ ID NO: 119167 - RNA, 20 nt, Artificial Sequence
  MKO10119167_B_Stk24
  gRNA
ugacggauacccagaucaaa

SEQ ID NO: 119168 - RNA, 20 nt, Artificial Sequence
  MKO10119168_B_Stk25
  gRNA
cugcuccgagagcagcacgu

SEQ ID NO: 119169 - RNA, 20 nt, Artificial Sequence
  MKO10119169_B_Stk25
  gRNA
cauuuguggguacacccuuc

SEQ ID NO: 119170 - RNA, 20 nt, Artificial Sequence
  MKO10119170_B_Stk25
  gRNA
aagauccaccgagauaucaa

SEQ ID NO: 119171 - RNA, 20 nt, Artificial Sequence
  MKO10119171_B_Stk30
  gRNA
ugcacuaauaugugaacuua

SEQ ID NO: 119172 - RNA, 20 nt, Artificial Sequence
  MKO10119172_B_Stk30
  gRNA
ccuauagacuacaaagcaau

SEQ ID NO: 119173 - RNA, 20 nt, Artificial Sequence
  MKO10119173_B_Stk30
  gRNA
aauauuuaugagcuaauacg

SEQ ID NO: 119174 - RNA, 20 nt, Artificial Sequence
  MKO10119174_B_Stk31
  gRNA
gaagauacacauuacaauaa

SEQ ID NO: 119175 - RNA, 20 nt, Artificial Sequence
  MKO10119175_B_Stk31
  gRNA
uuagaaugucaguaaaaaua

SEQ ID NO: 119176 - RNA, 20 nt, Artificial Sequence
  MKO10119176_B_Stk31
  gRNA
aauguguaucuucauccauu

SEQ ID NO: 119177 - RNA, 20 nt, Artificial Sequence
  MKO10119177_B_Stk32a
  gRNA
gcacuuaccacagauucacc

SEQ ID NO: 119178 - RNA, 20 nt, Artificial Sequence
  MKO10119178_B_Stk32a
  gRNA
ucaucaaguaaaauauuguc

SEQ ID NO: 119179 - RNA, 20 nt, Artificial Sequence
  MKO10119179_B_Stk32a
  gRNA
cccaaaacuucccuucccaa

SEQ ID NO: 119180 - RNA, 20 nt, Artificial Sequence
  MKO10119180_B_Stk32b
  gRNA
ugucccuagguacuccuucc

SEQ ID NO: 119181 - RNA, 20 nt, Artificial Sequence
  MKO10119181_B_Stk32b
  gRNA
uugaccacuuccagauccug

SEQ ID NO: 119182 - RNA, 20 nt, Artificial Sequence
  MKO10119182_B_Stk32b
  gRNA
uggcucuggaguaccugcag

SEQ ID NO: 119183 - RNA, 20 nt, Artificial Sequence
  MKO10119183_B_Stk32c
  gRNA
ccagcucccggaagacauuc

SEQ ID NO: 119184 - RNA, 20 nt, Artificial Sequence
  MKO10119184_B_Stk32c
  gRNA
cacaccuguggaugaugugu

SEQ ID NO: 119185 - RNA, 20 nt, Artificial Sequence
  MKO10119185_B_Stk32c
  gRNA
gggacucaccuuguucaucc

SEQ ID NO: 119186 - RNA, 20 nt, Artificial Sequence
  MKO10119186_B_Stk33
  gRNA
cuuguuaugaagauaugcga

SEQ ID NO: 119187 - RNA, 20 nt, Artificial Sequence
  MKO10119187_B_Stk33
  gRNA
aaguucugcaaugaagcuac

SEQ ID NO: 119188 - RNA, 20 nt, Artificial Sequence
  MKO10119188_B_Stk33
  gRNA
uuccaggaauucuauaccuu

SEQ ID NO: 119189 - RNA, 20 nt, Artificial Sequence
  MKO10119189_B_Stk35
  gRNA
caaaaagcccggagcggaaa

SEQ ID NO: 119190 - RNA, 20 nt, Artificial Sequence
  MKO10119190_B_Stk35
  gRNA
auaaaaaccacaucgugcac

SEQ ID NO: 119191 - RNA, 20 nt, Artificial Sequence
  MKO10119191_B_Stk35
  gRNA
ugagaucgucccuguuggug

SEQ ID NO: 119192 - RNA, 20 nt, Artificial Sequence
  MKO10119192_B_Stk36
  gRNA
gggcugcauccuguaugagc

SEQ ID NO: 119193 - RNA, 20 nt, Artificial Sequence
  MKO10119193_B_Stk36
  gRNA
uucucaaggacccugugcgc

SEQ ID NO: 119194 - RNA, 20 nt, Artificial Sequence
  MKO10119194_B_Stk36
  gRNA
uuucucugagcgccccaguu

SEQ ID NO: 119195 - RNA, 20 nt, Artificial Sequence
  MKO10119195_B_Stk38l
  gRNA
agaagaaggauuggcagaug

SEQ ID NO: 119196 - RNA, 20 nt, Artificial Sequence
  MKO10119196_B_Stk38l
  gRNA
caagcaugucagcuuuccuc

SEQ ID NO: 119197 - RNA, 20 nt, Artificial Sequence
  MKO10119197_B_Stk38l
  gRNA
gcugguccagaagaaagaca

SEQ ID NO: 119198 - RNA, 20 nt, Artificial Sequence
  MKO10119198_B_Stk38
  gRNA
gcuaaaccucuaccuaauca

SEQ ID NO: 119199 - RNA, 20 nt, Artificial Sequence
  MKO10119199_B_Stk38
  gRNA
cgagcaugucugcuuugcgc

SEQ ID NO: 119200 - RNA, 20 nt, Artificial Sequence
  MKO10119200_B_Stk38
  gRNA
aaaucaccucuucgucuuuc

SEQ ID NO: 119201 - RNA, 20 nt, Artificial Sequence
  MKO10119201_B_Stk39
  gRNA
ggaguucauccauacucguc

SEQ ID NO: 119202 - RNA, 20 nt, Artificial Sequence
  MKO10119202_B_Stk39
  gRNA
uugcaauuaucgccucuucu

SEQ ID NO: 119203 - RNA, 20 nt, Artificial Sequence
  MKO10119203_B_Stk39
  gRNA
gacuuauuacaccuccuuug

SEQ ID NO: 119204 - RNA, 20 nt, Artificial Sequence
  MKO10119204_B_Stk3
  gRNA
ccugucacauuguugcauua

SEQ ID NO: 119205 - RNA, 20 nt, Artificial Sequence
  MKO10119205_B_Stk3
  gRNA
aauauucuccucaauacaga

SEQ ID NO: 119206 - RNA, 20 nt, Artificial Sequence
  MKO10119206_B_Stk3
  gRNA
aguacaucaaaaacuucuuc

SEQ ID NO: 119207 - RNA, 20 nt, Artificial Sequence
  MKO10119207_B_Stk40
  gRNA
ucuacagauccucacccuug

SEQ ID NO: 119208 - RNA, 20 nt, Artificial Sequence
  MKO10119208_B_Stk40
  gRNA
ggaaauaacgcaaagagagc

SEQ ID NO: 119209 - RNA, 20 nt, Artificial Sequence
  MKO10119209_B_Stk40
  gRNA
agaugacuucuaucaguuga

SEQ ID NO: 119210 - RNA, 20 nt, Artificial Sequence
  MKO10119210_B_Stk4
  gRNA
gucuuauggcagcguguaca

SEQ ID NO: 119211 - RNA, 20 nt, Artificial Sequence
  MKO10119211_B_Stk4
  gRNA
uauuucccgccuugauaucu

SEQ ID NO: 119212 - RNA, 20 nt, Artificial Sequence
  MKO10119212_B_Stk4
  gRNA
ugcaaucaagcaagugcccg

SEQ ID NO: 119213 - RNA, 20 nt, Artificial Sequence
  MKO10119213_B_Stmn1
  gRNA
agauauucaggugaaagagc

SEQ ID NO: 119214 - RNA, 20 nt, Artificial Sequence
  MKO10119214_B_Stmn1
  gRNA
cucucgcaagcgcuccagcu

SEQ ID NO: 119215 - RNA, 20 nt, Artificial Sequence
  MKO10119215_B_Stmn1
  gRNA
ugaagcagcucgcggagaag

SEQ ID NO: 119216 - RNA, 20 nt, Artificial Sequence
  MKO10119216_B_Stmn2
  gRNA
uuuggagaagcuagaguucg

SEQ ID NO: 119217 - RNA, 20 nt, Artificial Sequence
  MKO10119217_B_Stmn2
  gRNA
cgagcgagaggugcuccaga

SEQ ID NO: 119218 - RNA, 20 nt, Artificial Sequence
  MKO10119218_B_Stmn2
  gRNA
aggugaagcagaucaacaag

SEQ ID NO: 119219 - RNA, 20 nt, Artificial Sequence
  MKO10119219_B_Stmn3
  gRNA
cucaccuccauacugguaga

SEQ ID NO: 119220 - RNA, 20 nt, Artificial Sequence
  MKO10119220_B_Stmn3
  gRNA
ggccucuggccagagcuucg

SEQ ID NO: 119221 - RNA, 20 nt, Artificial Sequence
  MKO10119221_B_Stmn3
  gRNA
agauauggaagugaagcagc

SEQ ID NO: 119222 - RNA, 20 nt, Artificial Sequence
  MKO10119222_B_Stmn4
  gRNA
cagauacaguagaccugaac

SEQ ID NO: 119223 - RNA, 20 nt, Artificial Sequence
  MKO10119223_B_Stmn4
  gRNA
uccccaggacaagcacgcag

SEQ ID NO: 119224 - RNA, 20 nt, Artificial Sequence
  MKO10119224_B_Stmn4
  gRNA
ccacuuaccuucauauuugu

SEQ ID NO: 119225 - RNA, 20 nt, Artificial Sequence
  MKO10119225_B_Stmnd1
  gRNA
agacauguauuacaaccaag

SEQ ID NO: 119226 - RNA, 20 nt, Artificial Sequence
  MKO10119226_B_Stmnd1
  gRNA
uggagagucguaugauguca

SEQ ID NO: 119227 - RNA, 20 nt, Artificial Sequence
  MKO10119227_B_Stmnd1
  gRNA
caacuccuaguaaaacaagc

SEQ ID NO: 119228 - RNA, 20 nt, Artificial Sequence
  MKO10119228_B_Stoml1
  gRNA
ccauggccucgucagugucc

SEQ ID NO: 119229 - RNA, 20 nt, Artificial Sequence
  MKO10119229_B_Stoml1
  gRNA
agcccacaacgccaugacua

SEQ ID NO: 119230 - RNA, 20 nt, Artificial Sequence
  MKO10119230_B_Stoml1
  gRNA
ggaaguaugaacucagcggu

SEQ ID NO: 119231 - RNA, 20 nt, Artificial Sequence
  MKO10119231_B_Stoml2
  gRNA
aguccuuuaucugcgcauca

SEQ ID NO: 119232 - RNA, 20 nt, Artificial Sequence
  MKO10119232_B_Stoml2
  gRNA
gauccaugaugcgcagauaa

SEQ ID NO: 119233 - RNA, 20 nt, Artificial Sequence
  MKO10119233_B_Stoml2
  gRNA
uucucaccgguuccaggauc

SEQ ID NO: 119234 - RNA, 20 nt, Artificial Sequence
  MKO10119234_B_Stoml3
  gRNA
caaugugaacgauguucacc

SEQ ID NO: 119235 - RNA, 20 nt, Artificial Sequence
  MKO10119235_B_Stoml3
  gRNA
uugacaaacacgucaaugca

SEQ ID NO: 119236 - RNA, 20 nt, Artificial Sequence
  MKO10119236_B_Stoml3
  gRNA
uuaccuucccaaucucagua

SEQ ID NO: 119237 - RNA, 20 nt, Artificial Sequence
  MKO10119237_B_Stom
  gRNA
cuccuuugacauuccuccgc

SEQ ID NO: 119238 - RNA, 20 nt, Artificial Sequence
  MKO10119238_B_Stom
  gRNA
cgaguacugaccugguccuu

SEQ ID NO: 119239 - RNA, 20 nt, Artificial Sequence
  MKO10119239_B_Stom
  gRNA
gagagucaucaucuuuagac

SEQ ID NO: 119240 - RNA, 20 nt, Artificial Sequence
  MKO10119240_B_Ston1
  gRNA
agcaaauggauaccaaucug

SEQ ID NO: 119241 - RNA, 20 nt, Artificial Sequence
  MKO10119241_B_Ston1
  gRNA
ggagaagacgcagauaaaac

SEQ ID NO: 119242 - RNA, 20 nt, Artificial Sequence
  MKO10119242_B_Ston1
  gRNA
agguugaaauagaaaagaag

SEQ ID NO: 119243 - RNA, 20 nt, Artificial Sequence
  MKO10119243_B_Ston2
  gRNA
cuccggcuuaccgguagagu

SEQ ID NO: 119244 - RNA, 20 nt, Artificial Sequence
  MKO10119244_B_Ston2
  gRNA
uugacccacuuccugacguc

SEQ ID NO: 119245 - RNA, 20 nt, Artificial Sequence
  MKO10119245_B_Ston2
  gRNA
gggagccuucauccacgaca

SEQ ID NO: 119246 - RNA, 20 nt, Artificial Sequence
  MKO10119246_B_Stox1
  gRNA
ccgaggcuuccgcaucaccg

SEQ ID NO: 119247 - RNA, 20 nt, Artificial Sequence
  MKO10119247_B_Stox1
  gRNA
aucuacuaauuccgccauuu

SEQ ID NO: 119248 - RNA, 20 nt, Artificial Sequence
  MKO10119248_B_Stox1
  gRNA
ugcuauagcugauaugaacg

SEQ ID NO: 119249 - RNA, 20 nt, Artificial Sequence
  MKO10119249_B_Stox2
  gRNA
agguuggaccagcuccgcca

SEQ ID NO: 119250 - RNA, 20 nt, Artificial Sequence
  MKO10119250_B_Stox2
  gRNA
gguguuccaucagcgccucc

SEQ ID NO: 119251 - RNA, 20 nt, Artificial Sequence
  MKO10119251_B_Stox2
  gRNA
ugcgagaaagccugucaccc

SEQ ID NO: 119252 - RNA, 20 nt, Artificial Sequence
  MKO10119252_B_Stpg1
  gRNA
cugccaacgcguauaccauc

SEQ ID NO: 119253 - RNA, 20 nt, Artificial Sequence
  MKO10119253_B_Stpg1
  gRNA
auugacguccugugucuaua

SEQ ID NO: 119254 - RNA, 20 nt, Artificial Sequence
  MKO10119254_B_Stpg1
  gRNA
uccuucucaggaugacgucc

SEQ ID NO: 119255 - RNA, 20 nt, Artificial Sequence
  MKO10119255_B_Stpg2
  gRNA
auuauguaucacaaccagac

SEQ ID NO: 119256 - RNA, 20 nt, Artificial Sequence
  MKO10119256_B_Stpg2
  gRNA
uggaugauaucauacugucc

SEQ ID NO: 119257 - RNA, 20 nt, Artificial Sequence
  MKO10119257_B_Stpg2
  gRNA
ccuauuguguugucacuagg

SEQ ID NO: 119258 - RNA, 20 nt, Artificial Sequence
  MKO10119258_B_Stra13
  gRNA
gacuacuccauuugcacuuc

SEQ ID NO: 119259 - RNA, 20 nt, Artificial Sequence
  MKO10119259_B_Stra13
  gRNA
gauccacuuccacaacaucc

SEQ ID NO: 119260 - RNA, 20 nt, Artificial Sequence
  MKO10119260_B_Stra13
  gRNA
uguuguggaaguggaucagc

SEQ ID NO: 119261 - RNA, 20 nt, Artificial Sequence
  MKO10119261_B_Stra6
  gRNA
uccccagccaagaaauccac

SEQ ID NO: 119262 - RNA, 20 nt, Artificial Sequence
  MKO10119262_B_Stra6
  gRNA
aacuuaccgacagugaagcc

SEQ ID NO: 119263 - RNA, 20 nt, Artificial Sequence
  MKO10119263_B_Stra6
  gRNA
caggcauggagcagggcagg

SEQ ID NO: 119264 - RNA, 20 nt, Artificial Sequence
  MKO10119264_B_Stra8
  gRNA
ugagcuucagcaacuuaucc

SEQ ID NO: 119265 - RNA, 20 nt, Artificial Sequence
  MKO10119265_B_Stra8
  gRNA
auucccaucuugcagguuga

SEQ ID NO: 119266 - RNA, 20 nt, Artificial Sequence
  MKO10119266_B_Stra8
  gRNA
cuugaccuccucuaagcugu

SEQ ID NO: 119267 - RNA, 20 nt, Artificial Sequence
  MKO10119267_B_Strada
  gRNA
gagaguaugugacaguacga

SEQ ID NO: 119268 - RNA, 20 nt, Artificial Sequence
  MKO10119268_B_Strada
  gRNA
agcucauaacacccgcccuc

SEQ ID NO: 119269 - RNA, 20 nt, Artificial Sequence
  MKO10119269_B_Strada
  gRNA
agaaagcugcucaucaucuc

SEQ ID NO: 119270 - RNA, 20 nt, Artificial Sequence
  MKO10119270_B_Stradb
  gRNA
gucucacuaugaacugcaag

SEQ ID NO: 119271 - RNA, 20 nt, Artificial Sequence
  MKO10119271_B_Stradb
  gRNA
agaacgucugaaagcuuuac

SEQ ID NO: 119272 - RNA, 20 nt, Artificial Sequence
  MKO10119272_B_Stradb
  gRNA
gugccgugcaagaugaacag

SEQ ID NO: 119273 - RNA, 20 nt, Artificial Sequence
  MKO10119273_B_Strap
  gRNA
auuuagcaaaguaugggaug

SEQ ID NO: 119274 - RNA, 20 nt, Artificial Sequence
  MKO10119274_B_Strap
  gRNA
gauagcaauuaccugcuaac

SEQ ID NO: 119275 - RNA, 20 nt, Artificial Sequence
  MKO10119275_B_Strap
  gRNA
uauccugucccccaguuagc

SEQ ID NO: 119276 - RNA, 20 nt, Artificial Sequence
  MKO10119276_B_Strbp
  gRNA
ugcacauuaagacuagcucc

SEQ ID NO: 119277 - RNA, 20 nt, Artificial Sequence
  MKO10119277_B_Strbp
  gRNA
uuucguguuccgaauuauaa

SEQ ID NO: 119278 - RNA, 20 nt, Artificial Sequence
  MKO10119278_B_Strbp
  gRNA
guacuuaccugaaucugaau

SEQ ID NO: 119279 - RNA, 20 nt, Artificial Sequence
  MKO10119279_B_Strc
  gRNA
ugacucgcaguagccccucc

SEQ ID NO: 119280 - RNA, 20 nt, Artificial Sequence
  MKO10119280_B_Strc
  gRNA
cccaaacgcucuucucucuc

SEQ ID NO: 119281 - RNA, 20 nt, Artificial Sequence
  MKO10119281_B_Strc
  gRNA
accauaaaagcagcuguuga

SEQ ID NO: 119282 - RNA, 20 nt, Artificial Sequence
  MKO10119282_B_Strip1
  gRNA
gaugaaucgaaaaugcuuug

SEQ ID NO: 119283 - RNA, 20 nt, Artificial Sequence
  MKO10119283_B_Strip1
  gRNA
gccauucucuauguugccca

SEQ ID NO: 119284 - RNA, 20 nt, Artificial Sequence
  MKO10119284_B_Strip1
  gRNA
cacgccaugaggcuucugga

SEQ ID NO: 119285 - RNA, 20 nt, Artificial Sequence
  MKO10119285_B_Strip2
  gRNA
caguagggagaaacggcuua

SEQ ID NO: 119286 - RNA, 20 nt, Artificial Sequence
  MKO10119286_B_Strip2
  gRNA
accuggaauuuaccacuaac

SEQ ID NO: 119287 - RNA, 20 nt, Artificial Sequence
  MKO10119287_B_Strip2
  gRNA
uacagaauuauauagcuaca

SEQ ID NO: 119288 - RNA, 20 nt, Artificial Sequence
  MKO10119288_B_Strn3
  gRNA
uggaggagccuccacaucuu

SEQ ID NO: 119289 - RNA, 20 nt, Artificial Sequence
  MKO10119289_B_Strn3
  gRNA
aaaaugcccaccuuugaauc

SEQ ID NO: 119290 - RNA, 20 nt, Artificial Sequence
  MKO10119290_B_Strn3
  gRNA
aauaaaguuaccugauucaa

SEQ ID NO: 119291 - RNA, 20 nt, Artificial Sequence
  MKO10119291_B_Strn4
  gRNA
ugcacuuuauccaacacgag

SEQ ID NO: 119292 - RNA, 20 nt, Artificial Sequence
  MKO10119292_B_Strn4
  gRNA
uccagugugaccgacucuac

SEQ ID NO: 119293 - RNA, 20 nt, Artificial Sequence
  MKO10119293_B_Strn4
  gRNA
cgacccuccuuccacaccaa

SEQ ID NO: 119294 - RNA, 20 nt, Artificial Sequence
  MKO10119294_B_Strn
  gRNA
gcuggaauaugcuuugaagc

SEQ ID NO: 119295 - RNA, 20 nt, Artificial Sequence
  MKO10119295_B_Strn
  gRNA
guuaaagagacagcaaugau

SEQ ID NO: 119296 - RNA, 20 nt, Artificial Sequence
  MKO10119296_B_Strn
  gRNA
ggcucagauugcuuuccuuc

SEQ ID NO: 119297 - RNA, 20 nt, Artificial Sequence
  MKO10119297_B_Suu3a
  gRNA
acagaucgagaaauauaccc

SEQ ID NO: 119298 - RNA, 20 nt, Artificial Sequence
  MKO10119298_B_Suu3a
  gRNA
acagacauuccgaaugucaa

SEQ ID NO: 119299 - RNA, 20 nt, Artificial Sequence
  MKO10119299_B_Suu3a
  gRNA
uauauuucucgaucuguagc

SEQ ID NO: 119300 - RNA, 20 nt, Artificial Sequence
  MKO10119300_B_Suu3b
  gRNA
uagguaaagucugugaagac

SEQ ID NO: 119301 - RNA, 20 nt, Artificial Sequence
  MKO10119301_B_Suu3b
  gRNA
cugcuugucauauuucuaca

SEQ ID NO: 119302 - RNA, 20 nt, Artificial Sequence
  MKO10119302_B_Suu3b
  gRNA
uacccacugggaagaauagu

SEQ ID NO: 119303 - RNA, 20 nt, Artificial Sequence
  MKO10119303_B_Stub1
  gRNA
ugcugacugccggcgagccc

SEQ ID NO: 119304 - RNA, 20 nt, Artificial Sequence
  MKO10119304_B_Stub1
  gRNA
aacucugcaggauaaauaca

SEQ ID NO: 119305 - RNA, 20 nt, Artificial Sequence
  MKO10119305_B_Stub1
  gRNA
cacgagggucaugaagauga

SEQ ID NO: 119306 - RNA, 20 nt, Artificial Sequence
  MKO10119306_B_Stx11
  gRNA
uguacucguacauggcuugc

SEQ ID NO: 119307 - RNA, 20 nt, Artificial Sequence
  MKO10119307_B_Stx11
  gRNA
agcccgcgcgcccuucaagu

SEQ ID NO: 119308 - RNA, 20 nt, Artificial Sequence
  MKO10119308_B_Stx11
  gRNA
agccagcggcuaguugacac

SEQ ID NO: 119309 - RNA, 20 nt, Artificial Sequence
  MKO10119309_B_Stx12
  gRNA
aagaauuugaugagccaacu

SEQ ID NO: 119310 - RNA, 20 nt, Artificial Sequence
  MKO10119310_B_Stx12
  gRNA
acccuugucugcaucagagc

SEQ ID NO: 119311 - RNA, 20 nt, Artificial Sequence
  MKO10119311_B_Stx12
  gRNA
acagcacuccacaaaucagc

SEQ ID NO: 119312 - RNA, 20 nt, Artificial Sequence
  MKO10119312_B_Stx16
  gRNA
ugccugauaccagcgccaug

SEQ ID NO: 119313 - RNA, 20 nt, Artificial Sequence
  MKO10119313_B_Stx16
  gRNA
ugccaucgagaucaccaccc

SEQ ID NO: 119314 - RNA, 20 nt, Artificial Sequence
  MKO10119314_B_Stx16
  gRNA
acaaccacaggagcuggacg

SEQ ID NO: 119315 - RNA, 20 nt, Artificial Sequence
  MKO10119315_B_Stx17
  gRNA
uaccgcuucuaagguuuccc

SEQ ID NO: 119316 - RNA, 20 nt, Artificial Sequence
  MKO10119316_B_Stx17
  gRNA
acauacuuacacucacuagg

SEQ ID NO: 119317 - RNA, 20 nt, Artificial Sequence
  MKO10119317_B_Stx17
  gRNA
cuuaauugagcugagccauc

SEQ ID NO: 119318 - RNA, 20 nt, Artificial Sequence
  MKO10119318_B_Stx18
  gRNA
agagcgagaccagauagacc

SEQ ID NO: 119319 - RNA, 20 nt, Artificial Sequence
  MKO10119319_B_Stx18
  gRNA
aggaguauauuaaugccuac

SEQ ID NO: 119320 - RNA, 20 nt, Artificial Sequence
  MKO10119320_B_Stx18
  gRNA
gauacauucccagcaaguga

SEQ ID NO: 119321 - RNA, 20 nt, Artificial Sequence
  MKO10119321_B_Stx19
  gRNA
agccaguccaaauuucucuu

SEQ ID NO: 119322 - RNA, 20 nt, Artificial Sequence
  MKO10119322_B_Stx19
  gRNA
aagagacucuaccauugcaa

SEQ ID NO: 119323 - RNA, 20 nt, Artificial Sequence
  MKO10119323_B_Stx19
  gRNA
uauuguucgucagcuugaag

SEQ ID NO: 119324 - RNA, 20 nt, Artificial Sequence
  MKO10119324_B_Stx1a
  gRNA
accgcucaucagccgaccug

SEQ ID NO: 119325 - RNA, 20 nt, Artificial Sequence
  MKO10119325_B_Stx1a
  gRNA
gcggaaacacagcgccaucc

SEQ ID NO: 119326 - RNA, 20 nt, Artificial Sequence
  MKO10119326_B_Stx1a
  gRNA
uccucaggucggcugaugag

SEQ ID NO: 119327 - RNA, 20 nt, Artificial Sequence
  MKO10119327_B_Stx1b
  gRNA
gcacucacucucaucggggu

SEQ ID NO: 119328 - RNA, 20 nt, Artificial Sequence
  MKO10119328_B_Stx1b
  gRNA
cguggaucgagaccacuuua

SEQ ID NO: 119329 - RNA, 20 nt, Artificial Sequence
  MKO10119329_B_Stx1b
  gRNA
uucucccccagagacuaaac

SEQ ID NO: 119330 - RNA, 20 nt, Artificial Sequence
  MKO10119330_B_Stx2
  gRNA
ucugcggauacgaaggaccc

SEQ ID NO: 119331 - RNA, 20 nt, Artificial Sequence
  MKO10119331_B_Stx2
  gRNA
acuuacacuucagcuugccc

SEQ ID NO: 119332 - RNA, 20 nt, Artificial Sequence
  MKO10119332_B_Stx2
  gRNA
agauucgaagcagcauagcc

SEQ ID NO: 119333 - RNA, 20 nt, Artificial Sequence
  MKO10119333_B_Stx3
  gRNA
uucggucaucugcagaccuu

SEQ ID NO: 119334 - RNA, 20 nt, Artificial Sequence
  MKO10119334_B_Stx3
  gRNA
ucucaguugugagcuguuca

SEQ ID NO: 119335 - RNA, 20 nt, Artificial Sequence
  MKO10119335_B_Stx3
  gRNA
cggccuucagcugcuccagc

SEQ ID NO: 119336 - RNA, 20 nt, Artificial Sequence
  MKO10119336_B_Stx4a
  gRNA
gcuguuugaucuccucucgc

SEQ ID NO: 119337 - RNA, 20 nt, Artificial Sequence
  MKO10119337_B_Stx4a
  gRNA
cuuccuaggugcagacaauu

SEQ ID NO: 119338 - RNA, 20 nt, Artificial Sequence
  MKO10119338_B_Stx4a
  gRNA
gucgcgcugguggugcacuc

SEQ ID NO: 119339 - RNA, 20 nt, Artificial Sequence
  MKO10119339_B_Stx5a
  gRNA
gugcagugaauuuacccuca

SEQ ID NO: 119340 - RNA, 20 nt, Artificial Sequence
  MKO10119340_B_Stx5a
  gRNA
gcuaacauacaucaucaaac

SEQ ID NO: 119341 - RNA, 20 nt, Artificial Sequence
  MKO10119341_B_Stx5a
  gRNA
ucucaacucaccuggccaug

SEQ ID NO: 119342 - RNA, 20 nt, Artificial Sequence
  MKO10119342_B_Stx6
  gRNA
agccaacucccacuucaucg

SEQ ID NO: 119343 - RNA, 20 nt, Artificial Sequence
  MKO10119343_B_Stx6
  gRNA
gcuggaguggcagaucgcua

SEQ ID NO: 119344 - RNA, 20 nt, Artificial Sequence
  MKO10119344_B_Stx6
  gRNA
aagccuucaucacaaguacu

SEQ ID NO: 119345 - RNA, 20 nt, Artificial Sequence
  MKO10119345_B_Stx7
  gRNA
uggaacaccucaagacucac

SEQ ID NO: 119346 - RNA, 20 nt, Artificial Sequence
  MKO10119346_B_Stx7
  gRNA
ugauagccguggaaauacaa

SEQ ID NO: 119347 - RNA, 20 nt, Artificial Sequence
  MKO10119347_B_Stx7
  gRNA
gauaaguacauuaaagaguu

SEQ ID NO: 119348 - RNA, 20 nt, Artificial Sequence
  MKO10119348_B_Stx8
  gRNA
gcuuugcuucuucgcucauc

SEQ ID NO: 119349 - RNA, 20 nt, Artificial Sequence
  MKO10119349_B_Stx8
  gRNA
caacaacguucugauuguca

SEQ ID NO: 119350 - RNA, 20 nt, Artificial Sequence
  MKO10119350_B_Stx8
  gRNA
augagcgaagaagcaaagcg

SEQ ID NO: 119351 - RNA, 20 nt, Artificial Sequence
  MKO10119351_B_Stxbp1
  gRNA
caugcaugaugugaucaaga

SEQ ID NO: 119352 - RNA, 20 nt, Artificial Sequence
  MKO10119352_B_Stxbp1
  gRNA
aagaacgccauggcccccau

SEQ ID NO: 119353 - RNA, 20 nt, Artificial Sequence
  MKO10119353_B_Stxbp1
  gRNA
gaugucugucaucuugcagc

SEQ ID NO: 119354 - RNA, 20 nt, Artificial Sequence
  MKO10119354_B_Stxbp2
  gRNA
uucccuggaaguccgcaauc

SEQ ID NO: 119355 - RNA, 20 nt, Artificial Sequence
  MKO10119355_B_Stxbp2
  gRNA
cacuggugaugcccuccgcc

SEQ ID NO: 119356 - RNA, 20 nt, Artificial Sequence
  MKO10119356_B_Stxbp2
  gRNA
gucgguucaggcccugauug

SEQ ID NO: 119357 - RNA, 20 nt, Artificial Sequence
  MKO10119357_B_Stxbp3a
  gRNA
caguuaugcccuccucuaga

SEQ ID NO: 119358 - RNA, 20 nt, Artificial Sequence
  MKO10119358_B_Stxbp3a
  gRNA
agagcuuucauuugucugac

SEQ ID NO: 119359 - RNA, 20 nt, Artificial Sequence
  MKO10119359_B_Stxbp3a
  gRNA
gauuguuucuugagagauuu

SEQ ID NO: 119360 - RNA, 20 nt, Artificial Sequence
  MKO10119360_B_Stxbp4
  gRNA
aucguaggucagaaucuccc

SEQ ID NO: 119361 - RNA, 20 nt, Artificial Sequence
  MKO10119361_B_Stxbp4
  gRNA
ccugcagauacaucuaaugc

SEQ ID NO: 119362 - RNA, 20 nt, Artificial Sequence
  MKO10119362_B_Stxbp4
  gRNA
ucguuaccucaacuuggcuc

SEQ ID NO: 119363 - RNA, 20 nt, Artificial Sequence
  MKO10119363_B_Stxbp5l
  gRNA
cagccgcaccacuuucaugu

SEQ ID NO: 119364 - RNA, 20 nt, Artificial Sequence
  MKO10119364_B_Stxbp5l
  gRNA
cagaugacacgcuucauuug

SEQ ID NO: 119365 - RNA, 20 nt, Artificial Sequence
  MKO10119365_B_Stxbp5l
  gRNA
aaaaacuuaccucauugaug

SEQ ID NO: 119366 - RNA, 20 nt, Artificial Sequence
  MKO10119366_B_Stxbp5
  gRNA
ugaucccguucagaagaucc

SEQ ID NO: 119367 - RNA, 20 nt, Artificial Sequence
  MKO10119367_B_Stxbp5
  gRNA
ucugaacgggaucaaaggcc

SEQ ID NO: 119368 - RNA, 20 nt, Artificial Sequence
  MKO10119368_B_Stxbp5
  gRNA
cucuaugugggcacugagcg

SEQ ID NO: 119369 - RNA, 20 nt, Artificial Sequence
  MKO10119369_B_Stxbp6
  gRNA
gcuagcaacccacuggucaa

SEQ ID NO: 119370 - RNA, 20 nt, Artificial Sequence
  MKO10119370_B_Stxbp6
  gRNA
agccaggccuugaacgagcg

SEQ ID NO: 119371 - RNA, 20 nt, Artificial Sequence
  MKO10119371_B_Stxbp6
  gRNA
ccacuuaccucccauaauuu

SEQ ID NO: 119372 - RNA, 20 nt, Artificial Sequence
  MKO10119372_B_Styk1
  gRNA
gcugccacucuauaugaugc

SEQ ID NO: 119373 - RNA, 20 nt, Artificial Sequence
  MKO10119373_B_Styk1
  gRNA
gccccuagaugcagguacag

SEQ ID NO: 119374 - RNA, 20 nt, Artificial Sequence
  MKO10119374_B_Styk1
  gRNA
uggucauuguugcaugauag

SEQ ID NO: 119375 - RNA, 20 nt, Artificial Sequence
  MKO10119375_B_Styxl1
  gRNA
gccgccguaugcacagcucc

SEQ ID NO: 119376 - RNA, 20 nt, Artificial Sequence
  MKO10119376_B_Styxl1
  gRNA
cuugugcaucuuagcauugc

SEQ ID NO: 119377 - RNA, 20 nt, Artificial Sequence
  MKO10119377_B_Styxl1
  gRNA
uacccaguugagauacuucc

SEQ ID NO: 119378 - RNA, 20 nt, Artificial Sequence
  MKO10119378_B_Styx
  gRNA
cccuaugagacgagagaugc

SEQ ID NO: 119379 - RNA, 20 nt, Artificial Sequence
  MKO10119379_B_Styx
  gRNA
cuaaauaauuguugaaaguu

SEQ ID NO: 119380 - RNA, 20 nt, Artificial Sequence
  MKO10119380_B_Styx
  gRNA
cuaccuauacuucagaaaca

SEQ ID NO: 119381 - RNA, 20 nt, Artificial Sequence
  MKO10119381_B_Sub1
  gRNA
uuucagaaugccuaaaucaa

SEQ ID NO: 119382 - RNA, 20 nt, Artificial Sequence
  MKO10119382_B_Sub1
  gRNA
uuuagguauuucuuuaaaca

SEQ ID NO: 119383 - RNA, 20 nt, Artificial Sequence
  MKO10119383_B_Sub1
  gRNA
ucagaaggugaaaugaaacc

SEQ ID NO: 119384 - RNA, 20 nt, Artificial Sequence
  MKO10119384_B_Sucla2
  gRNA
uuguaggguccuguacugau

SEQ ID NO: 119385 - RNA, 20 nt, Artificial Sequence
  MKO10119385_B_Sucla2
  gRNA
ugcaaaguaguauucucucc

SEQ ID NO: 119386 - RNA, 20 nt, Artificial Sequence
  MKO10119386_B_Sucla2
  gRNA
acauuuacaaguggccucaa

SEQ ID NO: 119387 - RNA, 20 nt, Artificial Sequence
  MKO10119387_B_Suclg1
  gRNA
aauauagauauguuuccgag

SEQ ID NO: 119388 - RNA, 20 nt, Artificial Sequence
  MKO10119388_B_Suclg1
  gRNA
agugguuccucccacgaguu

SEQ ID NO: 119389 - RNA, 20 nt, Artificial Sequence
  MKO10119389_B_Suclg1
  gRNA
aaauacgaagauuauuugcc

SEQ ID NO: 119390 - RNA, 20 nt, Artificial Sequence
  MKO10119390_B_Suclg2
  gRNA
cauaccuuaaagaugaguuc

SEQ ID NO: 119391 - RNA, 20 nt, Artificial Sequence
  MKO10119391_B_Suclg2
  gRNA
acgaaacaaacuccaaaaga

SEQ ID NO: 119392 - RNA, 20 nt, Artificial Sequence
  MKO10119392_B_Suclg2
  gRNA
gucacuuaaccccccgaaga

SEQ ID NO: 119393 - RNA, 20 nt, Artificial Sequence
  MKO10119393_B_Sucnr1
  gRNA
gguacuucaugagcagauau

SEQ ID NO: 119394 - RNA, 20 nt, Artificial Sequence
  MKO10119394_B_Sucnr1
  gRNA
ugcaucgacuaugcaaguuc

SEQ ID NO: 119395 - RNA, 20 nt, Artificial Sequence
  MKO10119395_B_Sucnr1
  gRNA
cauuggcauaacucuuuauc

SEQ ID NO: 119396 - RNA, 20 nt, Artificial Sequence
  MKO10119396_B_Suco
  gRNA
uucacugccuacaacuacac

SEQ ID NO: 119397 - RNA, 20 nt, Artificial Sequence
  MKO10119397_B_Suco
  gRNA
ccuaguaaugcugagcuauc

SEQ ID NO: 119398 - RNA, 20 nt, Artificial Sequence
  MKO10119398_B_Suco
  gRNA
caagaugauaauugugcaau

SEQ ID NO: 119399 - RNA, 20 nt, Artificial Sequence
  MKO10119399_B_Suds3
  gRNA
cuuccucaucgugcuucgcc

SEQ ID NO: 119400 - RNA, 20 nt, Artificial Sequence
  MKO10119400_B_Suds3
  gRNA
ggaugccagcgagacugacc

SEQ ID NO: 119401 - RNA, 20 nt, Artificial Sequence
  MKO10119401_B_Suds3
  gRNA
ugccccgucagguacgcucc

SEQ ID NO: 119402 - RNA, 20 nt, Artificial Sequence
  MKO10119402_B_Sufu
  gRNA
gcccgauaugucuuccaguc

SEQ ID NO: 119403 - RNA, 20 nt, Artificial Sequence
  MKO10119403_B_Sufu
  gRNA
cuugacucacuguuauccaa

SEQ ID NO: 119404 - RNA, 20 nt, Artificial Sequence
  MKO10119404_B_Sufu
  gRNA
uaccugacuggaagacauau

SEQ ID NO: 119405 - RNA, 20 nt, Artificial Sequence
  MKO10119405_B_Sugp1
  gRNA
gccaucauuggcaaacuugu

SEQ ID NO: 119406 - RNA, 20 nt, Artificial Sequence
  MKO10119406_B_Sugp1
  gRNA
cuugugcucagcaagcgaac

SEQ ID NO: 119407 - RNA, 20 nt, Artificial Sequence
  MKO10119407_B_Sugp1
  gRNA
ggccuccuucugccacaaaa

SEQ ID NO: 119408 - RNA, 20 nt, Artificial Sequence
  MKO10119408_B_Sugp2
  gRNA
uauguuuagagaucggccuc

SEQ ID NO: 119409 - RNA, 20 nt, Artificial Sequence
  MKO10119409_B_Sugp2
  gRNA
ccacccugugauccgcccgc

SEQ ID NO: 119410 - RNA, 20 nt, Artificial Sequence
  MKO10119410_B_Sugp2
  gRNA
aaggcacguaccacagguca

SEQ ID NO: 119411 - RNA, 20 nt, Artificial Sequence
  MKO10119411_B_Sugu1
  gRNA
auaauuguacugcucuucug

SEQ ID NO: 119412 - RNA, 20 nt, Artificial Sequence
  MKO10119412_B_Sugu1
  gRNA
agaagagcaguacaauuauu

SEQ ID NO: 119413 - RNA, 20 nt, Artificial Sequence
  MKO10119413_B_Sugu1
  gRNA
guguuuguaggagcugacca

SEQ ID NO: 119414 - RNA, 20 nt, Artificial Sequence
  MKO10119414_B_Sulf1
  gRNA
aauuacacuguuugucgcaa

SEQ ID NO: 119415 - RNA, 20 nt, Artificial Sequence
  MKO10119415_B_Sulf1
  gRNA
cucgugcauugccugccacg

SEQ ID NO: 119416 - RNA, 20 nt, Artificial Sequence
  MKO10119416_B_Sulf1
  gRNA
ucgucuuguucaugacuugc

SEQ ID NO: 119417 - RNA, 20 nt, Artificial Sequence
  MKO10119417_B_Sulf2
  gRNA
augagccguuguacucauug

SEQ ID NO: 119418 - RNA, 20 nt, Artificial Sequence
  MKO10119418_B_Sulf2
  gRNA
cccgccccaggauuaccuca

SEQ ID NO: 119419 - RNA, 20 nt, Artificial Sequence
  MKO10119419_B_Sulf2
  gRNA
uuacaugugcugggacgcau

SEQ ID NO: 119420 - RNA, 20 nt, Artificial Sequence
  MKO10119420_B_Sult1a1
  gRNA
agaugugucuuaaugauccg

SEQ ID NO: 119421 - RNA, 20 nt, Artificial Sequence
  MKO10119421_B_Sult1a1
  gRNA
cacauaccuggggggacccc

SEQ ID NO: 119422 - RNA, 20 nt, Artificial Sequence
  MKO10119422_B_Sult1a1
  gRNA
cuuacucccucagagucugc

SEQ ID NO: 119423 - RNA, 20 nt, Artificial Sequence
  MKO10119423_B_Sult1b1
  gRNA
guuccuggaauaagaauauc

SEQ ID NO: 119424 - RNA, 20 nt, Artificial Sequence
  MKO10119424_B_Sult1b1
  gRNA
augaucaaaccaugaaccau

SEQ ID NO: 119425 - RNA, 20 nt, Artificial Sequence
  MKO10119425_B_Sult1b1
  gRNA
uugaucauguuaagaguugg

SEQ ID NO: 119426 - RNA, 20 nt, Artificial Sequence
  MKO10119426_B_Sult1c1
  gRNA
auguauucucccaggguacc

SEQ ID NO: 119427 - RNA, 20 nt, Artificial Sequence
  MKO10119427_B_Sult1c1
  gRNA
augaccauguaaagggaugg

SEQ ID NO: 119428 - RNA, 20 nt, Artificial Sequence
  MKO10119428_B_Sult1c1
  gRNA
acaaauuuagauuaucuaug

SEQ ID NO: 119429 - RNA, 20 nt, Artificial Sequence
  MKO10119429_B_Sult1c2
  gRNA
uuacaguaaguuggggaucc

SEQ ID NO: 119430 - RNA, 20 nt, Artificial Sequence
  MKO10119430_B_Sult1c2
  gRNA
gcacggccaccccaaccauc

SEQ ID NO: 119431 - RNA, 20 nt, Artificial Sequence
  MKO10119431_B_Sult1c2
  gRNA
guccuuaauauccuuggagc

SEQ ID NO: 119432 - RNA, 20 nt, Artificial Sequence
  MKO10119432_B_Sult1d1
  gRNA
uuuccucuuaggaacaacuu

SEQ ID NO: 119433 - RNA, 20 nt, Artificial Sequence
  MKO10119433_B_Sult1d1
  gRNA
guccagccaugaauuucucu

SEQ ID NO: 119434 - RNA, 20 nt, Artificial Sequence
  MKO10119434_B_Sult1d1
  gRNA
cuuucauaucuucauaaaac

SEQ ID NO: 119435 - RNA, 20 nt, Artificial Sequence
  MKO10119435_B_Sult1e1
  gRNA
agcuuucacaugaucauacc

SEQ ID NO: 119436 - RNA, 20 nt, Artificial Sequence
  MKO10119436_B_Sult1e1
  gRNA
agaaacgaagaccuaauaaa

SEQ ID NO: 119437 - RNA, 20 nt, Artificial Sequence
  MKO10119437_B_Sult1e1
  gRNA
agcuccuuccagcaucauuu

SEQ ID NO: 119438 - RNA, 20 nt, Artificial Sequence
  MKO10119438_B_Sult2a1
  gRNA
gguuccaaaugggcacaguu

SEQ ID NO: 119439 - RNA, 20 nt, Artificial Sequence
  MKO10119439_B_Sult2a1
  gRNA
auauucugcauuaaucaaua

SEQ ID NO: 119440 - RNA, 20 nt, Artificial Sequence
  MKO10119440_B_Sult2a1
  gRNA
uuuacucaccauuuccuuug

SEQ ID NO: 119441 - RNA, 20 nt, Artificial Sequence
  MKO10119441_B_Sult2a2
  gRNA
ccgagagauauucuuguguc

SEQ ID NO: 119442 - RNA, 20 nt, Artificial Sequence
  MKO10119442_B_Sult2a2
  gRNA
aauuucucuuugauaugaua

SEQ ID NO: 119443 - RNA, 20 nt, Artificial Sequence
  MKO10119443_B_Sult2a2
  gRNA
ucaugaugucagacuauaau

SEQ ID NO: 119444 - RNA, 20 nt, Artificial Sequence
  MKO10119444_B_Sult2a3
  gRNA
auaucuugcauuaauuaaua

SEQ ID NO: 119445 - RNA, 20 nt, Artificial Sequence
  MKO10119445_B_Sult2a3
  gRNA
gaaguuaucccauucucuca

SEQ ID NO: 119446 - RNA, 20 nt, Artificial Sequence
  MKO10119446_B_Sult2a3
  gRNA
gauacucaccauuuccuuug

SEQ ID NO: 119447 - RNA, 20 nt, Artificial Sequence
  MKO10119447_B_Sult2a4
  gRNA
agcgaagauauaauuacuaa

SEQ ID NO: 119448 - RNA, 20 nt, Artificial Sequence
  MKO10119448_B_Sult2a4
  gRNA
accagaaagaagaauaucuc

SEQ ID NO: 119449 - RNA, 20 nt, Artificial Sequence
  MKO10119449_B_Sult2a4
  gRNA
gauggcuguccaugagagaa

SEQ ID NO: 119450 - RNA, 20 nt, Artificial Sequence
  MKO10119450_B_Sult2a5
  gRNA
auacuaugaagacuugaaaa

SEQ ID NO: 119451 - RNA, 20 nt, Artificial Sequence
  MKO10119451_B_Sult2a5
  gRNA
cccucuuuauugauuaaugc

SEQ ID NO: 119452 - RNA, 20 nt, Artificial Sequence
  MKO10119452_B_Sult2a5
  gRNA
uuccguaaugagacuaaaau

SEQ ID NO: 119453 - RNA, 20 nt, Artificial Sequence
  MKO10119453_B_Sult2a6
  gRNA
gugaagaaucuagagucacu

SEQ ID NO: 119454 - RNA, 20 nt, Artificial Sequence
  MKO10119454_B_Sult2a6
  gRNA
uuccuuaaugagacuauaau

SEQ ID NO: 119455 - RNA, 20 nt, Artificial Sequence
  MKO10119455_B_Sult2a6
  gRNA
guccaauuauagucucauua

SEQ ID NO: 119456 - RNA, 20 nt, Artificial Sequence
  MKO10119456_B_Sult2a7
  gRNA
caccaucaucaugauaaaca

SEQ ID NO: 119457 - RNA, 20 nt, Artificial Sequence
  MKO10119457_B_Sult2a7
  gRNA
acaacaaauaauggauggau

SEQ ID NO: 119458 - RNA, 20 nt, Artificial Sequence
  MKO10119458_B_Sult2a7
  gRNA
aaauaaguuuccagugaccc

SEQ ID NO: 119459 - RNA, 20 nt, Artificial Sequence
  MKO10119459_B_Sult2b1
  gRNA
uccggugaguacaugccgac

SEQ ID NO: 119460 - RNA, 20 nt, Artificial Sequence
  MKO10119460_B_Sult2b1
  gRNA
ccacgacaucgcggggguuc

SEQ ID NO: 119461 - RNA, 20 nt, Artificial Sequence
  MKO10119461_B_Sult2b1
  gRNA
cugagaacacuagcaacgug

SEQ ID NO: 119462 - RNA, 20 nt, Artificial Sequence
  MKO10119462_B_Sult3a1
  gRNA
auguguucauaguuugcucu

SEQ ID NO: 119463 - RNA, 20 nt, Artificial Sequence
  MKO10119463_B_Sult3a1
  gRNA
auaaaacuuucuacaguguc

SEQ ID NO: 119464 - RNA, 20 nt, Artificial Sequence
  MKO10119464_B_Sult3a1
  gRNA
ucccagugguaggaagccuu

SEQ ID NO: 119465 - RNA, 20 nt, Artificial Sequence
  MKO10119465_B_Sult4a1
  gRNA
ccacagugggcuacggcucc

SEQ ID NO: 119466 - RNA, 20 nt, Artificial Sequence
  MKO10119466_B_Sult4a1
  gRNA
agcucaugguccgcagcgag

SEQ ID NO: 119467 - RNA, 20 nt, Artificial Sequence
  MKO10119467_B_Sult4a1
  gRNA
ucagagggcaggaagcggua

SEQ ID NO: 119468 - RNA, 20 nt, Artificial Sequence
  MKO10119468_B_Sult5a1
  gRNA
ucgauagccuccauuccaag

SEQ ID NO: 119469 - RNA, 20 nt, Artificial Sequence
  MKO10119469_B_Sult5a1
  gRNA
uuccacuuccaccgaauagc

SEQ ID NO: 119470 - RNA, 20 nt, Artificial Sequence
  MKO10119470_B_Sult5a1
  gRNA
ugaagaacuugcccucgcuc

SEQ ID NO: 119471 - RNA, 20 nt, Artificial Sequence
  MKO10119471_B_Sult6b1
  gRNA
ugaaacucuucccaucacca

SEQ ID NO: 119472 - RNA, 20 nt, Artificial Sequence
  MKO10119472_B_Sult6b1
  gRNA
gaauuuccaguucuugaaug

SEQ ID NO: 119473 - RNA, 20 nt, Artificial Sequence
  MKO10119473_B_Sult6b1
  gRNA
gguaccaaccugauauuucu

SEQ ID NO: 119474 - RNA, 20 nt, Artificial Sequence
  MKO10119474_B_Sumf1
  gRNA
gagaaguuugugaacucgac

SEQ ID NO: 119475 - RNA, 20 nt, Artificial Sequence
  MKO10119475_B_Sumf1
  gRNA
cuccaauuagcucccuugac

SEQ ID NO: 119476 - RNA, 20 nt, Artificial Sequence
  MKO10119476_B_Sumf1
  gRNA
auccgcauugcugacuucau

SEQ ID NO: 119477 - RNA, 20 nt, Artificial Sequence
  MKO10119477_B_Sumf2
  gRNA
guuccagcucacguguacca

SEQ ID NO: 119478 - RNA, 20 nt, Artificial Sequence
  MKO10119478_B_Sumf2
  gRNA
gaagcuccacccgaaugccu

SEQ ID NO: 119479 - RNA, 20 nt, Artificial Sequence
  MKO10119479_B_Sumf2
  gRNA
auggggacagacgcuccaga

SEQ ID NO: 119480 - RNA, 20 nt, Artificial Sequence
  MKO10119480_B_Sumo1
  gRNA
agaaucauacugucaaagac

SEQ ID NO: 119481 - RNA, 20 nt, Artificial Sequence
  MKO10119481_B_Sumo1
  gRNA
gaguuccaaugaauucacuc

SEQ ID NO: 119482 - RNA, 20 nt, Artificial Sequence
  MKO10119482_B_Sumo1
  gRNA
agaaaccugagugaauucau

SEQ ID NO: 119483 - RNA, 20 nt, Artificial Sequence
  MKO10119483_B_Sumo2
  gRNA
cgaaacagacacaccugcac

SEQ ID NO: 119484 - RNA, 20 nt, Artificial Sequence
  MKO10119484_B_Sumo2
  gRNA
ucugugcuaguuggaaaugg

SEQ ID NO: 119485 - RNA, 20 nt, Artificial Sequence
  MKO10119485_B_Sumo2
  gRNA
cauggccgacgagaaaccca

SEQ ID NO: 119486 - RNA, 20 nt, Artificial Sequence
  MKO10119486_B_Sumo3
  gRNA
acacaccugccucucacagu

SEQ ID NO: 119487 - RNA, 20 nt, Artificial Sequence
  MKO10119487_B_Sumo3
  gRNA
ugaaacagacacuccagccc

SEQ ID NO: 119488 - RNA, 20 nt, Artificial Sequence
  MKO10119488_B_Sumo3
  gRNA
ugaccacaucaaccugaaag

SEQ ID NO: 119489 - RNA, 20 nt, Artificial Sequence
  MKO10119489_B_Sun1
  gRNA
uaaugugcgaaucaauagcc

SEQ ID NO: 119490 - RNA, 20 nt, Artificial Sequence
  MKO10119490_B_Sun1
  gRNA
guuucaggucucgaugauga

SEQ ID NO: 119491 - RNA, 20 nt, Artificial Sequence
  MKO10119491_B_Sun1
  gRNA
gauucgugagcagaccaaag

SEQ ID NO: 119492 - RNA, 20 nt, Artificial Sequence
  MKO10119492_B_Sun2
  gRNA
aaccacagacucgcuguagu

SEQ ID NO: 119493 - RNA, 20 nt, Artificial Sequence
  MKO10119493_B_Sun2
  gRNA
agauccgaaaaagucuucug

SEQ ID NO: 119494 - RNA, 20 nt, Artificial Sequence
  MKO10119494_B_Sun2
  gRNA
cauccugagaguagcgagug

SEQ ID NO: 119495 - RNA, 20 nt, Artificial Sequence
  MKO10119495_B_Sun3
  gRNA
cacuacugacguucuagaug

SEQ ID NO: 119496 - RNA, 20 nt, Artificial Sequence
  MKO10119496_B_Sun3
  gRNA
ccucaacuaugagaugccuc

SEQ ID NO: 119497 - RNA, 20 nt, Artificial Sequence
  MKO10119497_B_Sun3
  gRNA
cauaaucagccaacuguauu

SEQ ID NO: 119498 - RNA, 20 nt, Artificial Sequence
  MKO10119498_B_Sun5
  gRNA
guuguucugccagaaaguca

SEQ ID NO: 119499 - RNA, 20 nt, Artificial Sequence
  MKO10119499_B_Sun5
  gRNA
ccuugcucacucauguuugc

SEQ ID NO: 119500 - RNA, 20 nt, Artificial Sequence
  MKO10119500_B_Sun5
  gRNA
aagaagcuauaucagcagaa

SEQ ID NO: 119501 - RNA, 20 nt, Artificial Sequence
  MKO10119501_B_Suox
  gRNA
gcaccacacccaggccuaac

SEQ ID NO: 119502 - RNA, 20 nt, Artificial Sequence
  MKO10119502_B_Suox
  gRNA
gcugcagcuauacagauccg

SEQ ID NO: 119503 - RNA, 20 nt, Artificial Sequence
  MKO10119503_B_Suox
  gRNA
aaaaccuaccugauggccug

SEQ ID NO: 119504 - RNA, 20 nt, Artificial Sequence
  MKO10119504_B_Supt16
  gRNA
gguagacaucagcgcuguug

SEQ ID NO: 119505 - RNA, 20 nt, Artificial Sequence
  MKO10119505_B_Supt16
  gRNA
auucucauugccuuuaguau

SEQ ID NO: 119506 - RNA, 20 nt, Artificial Sequence
  MKO10119506_B_Supt16
  gRNA
cuggagugauugucucaaca

SEQ ID NO: 119507 - RNA, 20 nt, Artificial Sequence
  MKO10119507_B_Supt20
  gRNA
agaaugugaaaaagaacccg

SEQ ID NO: 119508 - RNA, 20 nt, Artificial Sequence
  MKO10119508_B_Supt20
  gRNA
acaagcuguagaacaagcuu

SEQ ID NO: 119509 - RNA, 20 nt, Artificial Sequence
  MKO10119509_B_Supt20
  gRNA
cucagcagagaccuccuaaa

SEQ ID NO: 119510 - RNA, 20 nt, Artificial Sequence
  MKO10119510_B_Supt3
  gRNA
uacaagucaaagaucaucaa

SEQ ID NO: 119511 - RNA, 20 nt, Artificial Sequence
  MKO10119511_B_Supt3
  gRNA
cauugacgaggaugaccucc

SEQ ID NO: 119512 - RNA, 20 nt, Artificial Sequence
  MKO10119512_B_Supt3
  gRNA
guucuugaugagaaaagaua

SEQ ID NO: 119513 - RNA, 20 nt, Artificial Sequence
  MKO10119513_B_Supt4a
  gRNA
auagaccaguucgaauauga

SEQ ID NO: 119514 - RNA, 20 nt, Artificial Sequence
  MKO10119514_B_Supt4a
  gRNA
cauugcgaugaugaguccag

SEQ ID NO: 119515 - RNA, 20 nt, Artificial Sequence
  MKO10119515_B_Supt4a
  gRNA
cuuacugacucgcugccacu

SEQ ID NO: 119516 - RNA, 20 nt, Artificial Sequence
  MKO10119516_B_Supt5
  gRNA
ccccccaagaaaccacgcca

SEQ ID NO: 119517 - RNA, 20 nt, Artificial Sequence
  MKO10119517_B_Supt5
  gRNA
cuccgaguagaagagauuga

SEQ ID NO: 119518 - RNA, 20 nt, Artificial Sequence
  MKO10119518_B_Supt5
  gRNA
agauggagcugaagauaucc

SEQ ID NO: 119519 - RNA, 20 nt, Artificial Sequence
  MKO10119519_B_Supt6
  gRNA
cuagaugaucaagaugagcg

SEQ ID NO: 119520 - RNA, 20 nt, Artificial Sequence
  MKO10119520_B_Supt6
  gRNA
agacauugacgauuucauug

SEQ ID NO: 119521 - RNA, 20 nt, Artificial Sequence
  MKO10119521_B_Supt6
  gRNA
uuggguguuaaagucaaacg

SEQ ID NO: 119522 - RNA, 20 nt, Artificial Sequence
  MKO10119522_B_Supt7l
  gRNA
gcgcuuugcugucgaccgag

SEQ ID NO: 119523 - RNA, 20 nt, Artificial Sequence
  MKO10119523_B_Supt7l
  gRNA
ugagcgcuucccauccaacc

SEQ ID NO: 119524 - RNA, 20 nt, Artificial Sequence
  MKO10119524_B_Supt7l
  gRNA
cugcagcgcugauugaacac

SEQ ID NO: 119525 - RNA, 20 nt, Artificial Sequence
  MKO10119525_B_Supv3l1
  gRNA
uacguaaaaucagugacuug

SEQ ID NO: 119526 - RNA, 20 nt, Artificial Sequence
  MKO10119526_B_Supv3l1
  gRNA
cacugaagcagauaucauuc

SEQ ID NO: 119527 - RNA, 20 nt, Artificial Sequence
  MKO10119527_B_Supv3l1
  gRNA
ucauccuugcauuccaauac

SEQ ID NO: 119528 - RNA, 20 nt, Artificial Sequence
  MKO10119528_B_Surf1
  gRNA
aacagccgccgcuaaagcag

SEQ ID NO: 119529 - RNA, 20 nt, Artificial Sequence
  MKO10119529_B_Surf1
  gRNA
augggccccacuuucaguug

SEQ ID NO: 119530 - RNA, 20 nt, Artificial Sequence
  MKO10119530_B_Surf1
  gRNA
aggcccaguucugcgcuguc

SEQ ID NO: 119531 - RNA, 20 nt, Artificial Sequence
  MKO10119531_B_Surf2
  gRNA
acgaacagugaugaacuccc

SEQ ID NO: 119532 - RNA, 20 nt, Artificial Sequence
  MKO10119532_B_Surf2
  gRNA
ggacuuauugaugugccuca

SEQ ID NO: 119533 - RNA, 20 nt, Artificial Sequence
  MKO10119533_B_Surf2
  gRNA
gugugccucagcacguguuc

SEQ ID NO: 119534 - RNA, 20 nt, Artificial Sequence
  MKO10119534_B_Surf4
  gRNA
gugacuauaucgacaccacc

SEQ ID NO: 119535 - RNA, 20 nt, Artificial Sequence
  MKO10119535_B_Surf4
  gRNA
gggagcucucacgcaugguu

SEQ ID NO: 119536 - RNA, 20 nt, Artificial Sequence
  MKO10119536_B_Surf4
  gRNA
caagucccacaaaaugcuau

SEQ ID NO: 119537 - RNA, 20 nt, Artificial Sequence
  MKO10119537_B_Surf6
  gRNA
uuacccacaggguagcacca

SEQ ID NO: 119538 - RNA, 20 nt, Artificial Sequence
  MKO10119538_B_Surf6
  gRNA
agcucccugggguccccuaa

SEQ ID NO: 119539 - RNA, 20 nt, Artificial Sequence
  MKO10119539_B_Surf6
  gRNA
ggagcgccaagcaaagcagc

SEQ ID NO: 119540 - RNA, 20 nt, Artificial Sequence
  MKO10119540_B_Susd1
  gRNA
ugcacagaaagugccgucau

SEQ ID NO: 119541 - RNA, 20 nt, Artificial Sequence
  MKO10119541_B_Susd1
  gRNA
acaccuaccugugcacgaug

SEQ ID NO: 119542 - RNA, 20 nt, Artificial Sequence
  MKO10119542_B_Susd1
  gRNA
uguggcauguucauggcacg

SEQ ID NO: 119543 - RNA, 20 nt, Artificial Sequence
  MKO10119543_B_Susd2
  gRNA
aagugccguaguauugccaa

SEQ ID NO: 119544 - RNA, 20 nt, Artificial Sequence
  MKO10119544_B_Susd2
  gRNA
ccgcaucaccucaguaccag

SEQ ID NO: 119545 - RNA, 20 nt, Artificial Sequence
  MKO10119545_B_Susd2
  gRNA
augcugcucucaacaauacc

SEQ ID NO: 119546 - RNA, 20 nt, Artificial Sequence
  MKO10119546_B_Susd3
  gRNA
gugccaccgcaugagaccuu

SEQ ID NO: 119547 - RNA, 20 nt, Artificial Sequence
  MKO10119547_B_Susd3
  gRNA
cacugccaccuuaaagccga

SEQ ID NO: 119548 - RNA, 20 nt, Artificial Sequence
  MKO10119548_B_Susd3
  gRNA
uaaccuacguggugaagcug

SEQ ID NO: 119549 - RNA, 20 nt, Artificial Sequence
  MKO10119549_B_Susd4
  gRNA
agugcuuacacaaccuuauc

SEQ ID NO: 119550 - RNA, 20 nt, Artificial Sequence
  MKO10119550_B_Susd4
  gRNA
cugggucagcacacacguug

SEQ ID NO: 119551 - RNA, 20 nt, Artificial Sequence
  MKO10119551_B_Susd4
  gRNA
ggugauguacuuguagucac

SEQ ID NO: 119552 - RNA, 20 nt, Artificial Sequence
  MKO10119552_B_Susd5
  gRNA
uggcuggcggauggcacccu

SEQ ID NO: 119553 - RNA, 20 nt, Artificial Sequence
  MKO10119553_B_Susd5
  gRNA
ucuccaagccagugcgaccc

SEQ ID NO: 119554 - RNA, 20 nt, Artificial Sequence
  MKO10119554_B_Susd5
  gRNA
gugacacuuaccuuucccgc

SEQ ID NO: 119555 - RNA, 20 nt, Artificial Sequence
  MKO10119555_B_Suv39h1
  gRNA
ugcaucuuccgcacuaauga

SEQ ID NO: 119556 - RNA, 20 nt, Artificial Sequence
  MKO10119556_B_Suv39h1
  gRNA
gagcuccucgcccgcccaga

SEQ ID NO: 119557 - RNA, 20 nt, Artificial Sequence
  MKO10119557_B_Suv39h1
  gRNA
ucuuugccacaagaaccauc

SEQ ID NO: 119558 - RNA, 20 nt, Artificial Sequence
  MKO10119558_B_Suv39h2
  gRNA
ucaucgauaaccuugauacu

SEQ ID NO: 119559 - RNA, 20 nt, Artificial Sequence
  MKO10119559_B_Suv39h2
  gRNA
acucaucagacucguagucc

SEQ ID NO: 119560 - RNA, 20 nt, Artificial Sequence
  MKO10119560_B_Suv39h2
  gRNA
ucuacaagaaccauaaacgc

SEQ ID NO: 119561 - RNA, 20 nt, Artificial Sequence
  MKO10119561_B_Suv420h1
  gRNA
uucagauuucggccuauaaa

SEQ ID NO: 119562 - RNA, 20 nt, Artificial Sequence
  MKO10119562_B_Suv420h1
  gRNA
ucugcuggaccgccucucaa

SEQ ID NO: 119563 - RNA, 20 nt, Artificial Sequence
  MKO10119563_B_Suv420h1
  gRNA
agauaguugcaacaaaagag

SEQ ID NO: 119564 - RNA, 20 nt, Artificial Sequence
  MKO10119564_B_Suv420h2
  gRNA
ucauguacuccacccgaaaa

SEQ ID NO: 119565 - RNA, 20 nt, Artificial Sequence
  MKO10119565_B_Suv420h2
  gRNA
agcacggguagacacaaucu

SEQ ID NO: 119566 - RNA, 20 nt, Artificial Sequence
  MKO10119566_B_Suv420h2
  gRNA
gaugcugaagucguucucac

SEQ ID NO: 119567 - RNA, 20 nt, Artificial Sequence
  MKO10119567_B_Suz12
  gRNA
auuccagaacaagcaucaaa

SEQ ID NO: 119568 - RNA, 20 nt, Artificial Sequence
  MKO10119568_B_Suz12
  gRNA
agaguucugugcaaaaauau

SEQ ID NO: 119569 - RNA, 20 nt, Artificial Sequence
  MKO10119569_B_Suz12
  gRNA
agaaaucuauauaucugugu

SEQ ID NO: 119570 - RNA, 20 nt, Artificial Sequence
  MKO10119570_B_Sv2a
  gRNA
cgacaccaacaugcgagcca

SEQ ID NO: 119571 - RNA, 20 nt, Artificial Sequence
  MKO10119571_B_Sv2a
  gRNA
ggaggccuggcugaucggcu

SEQ ID NO: 119572 - RNA, 20 nt, Artificial Sequence
  MKO10119572_B_Sv2a
  gRNA
cugcguagucagagccccga

SEQ ID NO: 119573 - RNA, 20 nt, Artificial Sequence
  MKO10119573_B_Sv2b
  gRNA
uucuuaucacgagagaaacg

SEQ ID NO: 119574 - RNA, 20 nt, Artificial Sequence
  MKO10119574_B_Sv2b
  gRNA
cuaauuaccacuuccacagc

SEQ ID NO: 119575 - RNA, 20 nt, Artificial Sequence
  MKO10119575_B_Sv2b
  gRNA
uggagcaucauuccacacua

SEQ ID NO: 119576 - RNA, 20 nt, Artificial Sequence
  MKO10119576_B_Sv2c
  gRNA
gcucccgugcgucuccucug

SEQ ID NO: 119577 - RNA, 20 nt, Artificial Sequence
  MKO10119577_B_Sv2c
  gRNA
ugauggugggggcguucuuc

SEQ ID NO: 119578 - RNA, 20 nt, Artificial Sequence
  MKO10119578_B_Sv2c
  gRNA
cucaccgugaagaccuucuc

SEQ ID NO: 119579 - RNA, 20 nt, Artificial Sequence
  MKO10119579_B_Sval1
  gRNA
uuaggugaaaaucaguauug

SEQ ID NO: 119580 - RNA, 20 nt, Artificial Sequence
  MKO10119580_B_Sval1
  gRNA
acucacaguuacaaauaacg

SEQ ID NO: 119581 - RNA, 20 nt, Artificial Sequence
  MKO10119581_B_Sval1
  gRNA
gucucaacauaagaaguuac

SEQ ID NO: 119582 - RNA, 20 nt, Artificial Sequence
  MKO10119582_B_Sval2
  gRNA
auagacaauacugccuuaca

SEQ ID NO: 119583 - RNA, 20 nt, Artificial Sequence
  MKO10119583_B_Sval2
  gRNA
aagagaugcauaagagcucc

SEQ ID NO: 119584 - RNA, 20 nt, Artificial Sequence
  MKO10119584_B_Sval2
  gRNA
aguauuuguuugcacugcaa

SEQ ID NO: 119585 - RNA, 20 nt, Artificial Sequence
  MKO10119585_B_Sval3
  gRNA
uuaccuauugucuugaccau

SEQ ID NO: 119586 - RNA, 20 nt, Artificial Sequence
  MKO10119586_B_Sval3
  gRNA
guagaaagguacuugauauu

SEQ ID NO: 119587 - RNA, 20 nt, Artificial Sequence
  MKO10119587_B_Sval3
  gRNA
gaaugcuguccuacaaauga

SEQ ID NO: 119588 - RNA, 20 nt, Artificial Sequence
  MKO10119588_B_Sva
  gRNA
acuagcauuacuaacaaaaa

SEQ ID NO: 119589 - RNA, 20 nt, Artificial Sequence
  MKO10119589_B_Sva
  gRNA
aaacaacgugaagcaaugcc

SEQ ID NO: 119590 - RNA, 20 nt, Artificial Sequence
  MKO10119590_B_Sva
  gRNA
cuucaaaaguucuaucaacc

SEQ ID NO: 119591 - RNA, 20 nt, Artificial Sequence
  MKO10119591_B_Svep1
  gRNA
uccggcuuauaugucccuga

SEQ ID NO: 119592 - RNA, 20 nt, Artificial Sequence
  MKO10119592_B_Svep1
  gRNA
aaccacuucaaugccgccug

SEQ ID NO: 119593 - RNA, 20 nt, Artificial Sequence
  MKO10119593_B_Svep1
  gRNA
ugaagacugcgugugccgag

SEQ ID NO: 119594 - RNA, 20 nt, Artificial Sequence
  MKO10119594_B_Svil
  gRNA
ccagcuccgaaacauauuua

SEQ ID NO: 119595 - RNA, 20 nt, Artificial Sequence
  MKO10119595_B_Svil
  gRNA
gucuguggcacgcauguauc

SEQ ID NO: 119596 - RNA, 20 nt, Artificial Sequence
  MKO10119596_B_Svil
  gRNA
gccagaaccuugcgcuucuu

SEQ ID NO: 119597 - RNA, 20 nt, Artificial Sequence
  MKO10119597_B_Svip
  gRNA
ggugcggacuccgcgggaca

SEQ ID NO: 119598 - RNA, 20 nt, Artificial Sequence
  MKO10119598_B_Svip
  gRNA
ggcagcagaaagaaggcaga

SEQ ID NO: 119599 - RNA, 20 nt, Artificial Sequence
  MKO10119599_B_Svip
  gRNA
ggaagagaaaagagaaaagc

SEQ ID NO: 119600 - RNA, 20 nt, Artificial Sequence
  MKO10119600_B_Svopl
  gRNA
auccuccaccgugaaugucu

SEQ ID NO: 119601 - RNA, 20 nt, Artificial Sequence
  MKO10119601_B_Svopl
  gRNA
gcaagucuuacccuugagca

SEQ ID NO: 119602 - RNA, 20 nt, Artificial Sequence
  MKO10119602_B_Svopl
  gRNA
agcggccauaucugucagcc

SEQ ID NO: 119603 - RNA, 20 nt, Artificial Sequence
  MKO10119603_B_Svop
  gRNA
cuccucagcugcauugcgag

SEQ ID NO: 119604 - RNA, 20 nt, Artificial Sequence
  MKO10119604_B_Svop
  gRNA
cgagauguuuccccagagcg

SEQ ID NO: 119605 - RNA, 20 nt, Artificial Sequence
  MKO10119605_B_Svop
  gRNA
cgccacucgcaaugcagcug

SEQ ID NO: 119606 - RNA, 20 nt, Artificial Sequence
  MKO10119606_B_Svs1
  gRNA
cguggaaccgcucagacucc

SEQ ID NO: 119607 - RNA, 20 nt, Artificial Sequence
  MKO10119607_B_Svs1
  gRNA
ugagaggccgacugucaccc

SEQ ID NO: 119608 - RNA, 20 nt, Artificial Sequence
  MKO10119608_B_Svs1
  gRNA
guuggcagugacuaaguacc

SEQ ID NO: 119609 - RNA, 20 nt, Artificial Sequence
  MKO10119609_B_Svs2
  gRNA
cagagaaaggacgaagacag

SEQ ID NO: 119610 - RNA, 20 nt, Artificial Sequence
  MKO10119610_B_Svs2
  gRNA
uaucccaauucggacaacag

SEQ ID NO: 119611 - RNA, 20 nt, Artificial Sequence
  MKO10119611_B_Svs2
  gRNA
auugccgcuguuguccgaau

SEQ ID NO: 119612 - RNA, 20 nt, Artificial Sequence
  MKO10119612_B_Svs3a
  gRNA
ccuuucucugcuccuccuuc

SEQ ID NO: 119613 - RNA, 20 nt, Artificial Sequence
  MKO10119613_B_Svs3a
  gRNA
caaacuaagcaccaugaaua

SEQ ID NO: 119614 - RNA, 20 nt, Artificial Sequence
  MKO10119614_B_Svs3a
  gRNA
uugugacuucaccugcccua

SEQ ID NO: 119615 - RNA, 20 nt, Artificial Sequence
  MKO10119615_B_Svs3b
  gRNA
cagcugcuuucuucuccaga

SEQ ID NO: 119616 - RNA, 20 nt, Artificial Sequence
  MKO10119616_B_Svs3b
  gRNA
uugugacuucaucugcccua

SEQ ID NO: 119617 - RNA, 20 nt, Artificial Sequence
  MKO10119617_B_Svs3b
  gRNA
accucaccacucauguuuau

SEQ ID NO: 119618 - RNA, 20 nt, Artificial Sequence
  MKO10119618_B_Svs4
  gRNA
gaaggagaagcagagaaaag

SEQ ID NO: 119619 - RNA, 20 nt, Artificial Sequence
  MKO10119619_B_Svs4
  gRNA
cgagugcaucuugagaaaac

SEQ ID NO: 119620 - RNA, 20 nt, Artificial Sequence
  MKO10119620_B_Svs4
  gRNA
uguggccuaacaaauaccuc

SEQ ID NO: 119621 - RNA, 20 nt, Artificial Sequence
  MKO10119621_B_Svs5
  gRNA
uugcuucugucaccagaacg

SEQ ID NO: 119622 - RNA, 20 nt, Artificial Sequence
  MKO10119622_B_Svs5
  gRNA
auacccaugugacuacuaga

SEQ ID NO: 119623 - RNA, 20 nt, Artificial Sequence
  MKO10119623_B_Svs5
  gRNA
acuuacgcuguauuccucca

SEQ ID NO: 119624 - RNA, 20 nt, Artificial Sequence
  MKO10119624_B_Svs6
  gRNA
ugacagaaacagcugcaaag

SEQ ID NO: 119625 - RNA, 20 nt, Artificial Sequence
  MKO10119625_B_Svs6
  gRNA
gcaacaguuugcacaagaaa

SEQ ID NO: 119626 - RNA, 20 nt, Artificial Sequence
  MKO10119626_B_Svs6
  gRNA
gacagcaagagagcaucugc

SEQ ID NO: 119627 - RNA, 20 nt, Artificial Sequence
  MKO10119627_B_Swap70
  gRNA
ugaggggccugucuccaauc

SEQ ID NO: 119628 - RNA, 20 nt, Artificial Sequence
  MKO10119628_B_Swap70
  gRNA
gaaccuucagcaccgugcac

SEQ ID NO: 119629 - RNA, 20 nt, Artificial Sequence
  MKO10119629_B_Swap70
  gRNA
aauuuccuacuaugugagcg

SEQ ID NO: 119630 - RNA, 20 nt, Artificial Sequence
  MKO10119630_B_Swi5
  gRNA
gcuucuccagcucaaucaca

SEQ ID NO: 119631 - RNA, 20 nt, Artificial Sequence
  MKO10119631_B_Swi5
  gRNA
aaaaucuggauauaacuccu

SEQ ID NO: 119632 - RNA, 20 nt, Artificial Sequence
  MKO10119632_B_Swi5
  gRNA
auguaucacagaugcugcug

SEQ ID NO: 119633 - RNA, 20 nt, Artificial Sequence
  MKO10119633_B_Swsap1
  gRNA
ggucggugcuggggccucau

SEQ ID NO: 119634 - RNA, 20 nt, Artificial Sequence
  MKO10119634_B_Swsap1
  gRNA
agcaaauggcggaggcgcug

SEQ ID NO: 119635 - RNA, 20 nt, Artificial Sequence
  MKO10119635_B_Swsap1
  gRNA
ggugcugaaugccggcugcg

SEQ ID NO: 119636 - RNA, 20 nt, Artificial Sequence
  MKO10119636_B_Swt1
  gRNA
uaucaaagaaucuugugcaa

SEQ ID NO: 119637 - RNA, 20 nt, Artificial Sequence
  MKO10119637_B_Swt1
  gRNA
auucuuacuucauuaaaagu

SEQ ID NO: 119638 - RNA, 20 nt, Artificial Sequence
  MKO10119638_B_Swt1
  gRNA
uucaaccaagaagagaaaac

SEQ ID NO: 119639 - RNA, 20 nt, Artificial Sequence
  MKO10119639_B_Syap1
  gRNA
ucaucaugacucucaaccca

SEQ ID NO: 119640 - RNA, 20 nt, Artificial Sequence
  MKO10119640_B_Syap1
  gRNA
gugcuuacaguuuaggaaca

SEQ ID NO: 119641 - RNA, 20 nt, Artificial Sequence
  MKO10119641_B_Syap1
  gRNA
gacaauucaacagcagauuu

SEQ ID NO: 119642 - RNA, 20 nt, Artificial Sequence
  MKO10119642_B_Sybu
  gRNA
uaaagucuucaucgcuucca

SEQ ID NO: 119643 - RNA, 20 nt, Artificial Sequence
  MKO10119643_B_Sybu
  gRNA
gagguccacauguccacgac

SEQ ID NO: 119644 - RNA, 20 nt, Artificial Sequence
  MKO10119644_B_Sybu
  gRNA
uuuagcuccucgagcagcac

SEQ ID NO: 119645 - RNA, 20 nt, Artificial Sequence
  MKO10119645_B_Syce1l
  gRNA
cccagccacuccgccaucaa

SEQ ID NO: 119646 - RNA, 20 nt, Artificial Sequence
  MKO10119646_B_Syce1l
  gRNA
gggagaggcucaagcacucc

SEQ ID NO: 119647 - RNA, 20 nt, Artificial Sequence
  MKO10119647_B_Syce1l
  gRNA
uggaucagguccucaaucug

SEQ ID NO: 119648 - RNA, 20 nt, Artificial Sequence
  MKO10119648_B_Syce1
  gRNA
uuggagaggcccagacuguc

SEQ ID NO: 119649 - RNA, 20 nt, Artificial Sequence
  MKO10119649_B_Syce1
  gRNA
auggugaaaaaguugcagaa

SEQ ID NO: 119650 - RNA, 20 nt, Artificial Sequence
  MKO10119650_B_Syce1
  gRNA
guaaguccaguuccuucugc

SEQ ID NO: 119651 - RNA, 20 nt, Artificial Sequence
  MKO10119651_B_Syce2
  gRNA
uguacaccguuuccacaguu

SEQ ID NO: 119652 - RNA, 20 nt, Artificial Sequence
  MKO10119652_B_Syce2
  gRNA
ugaaguuggucauaagugca

SEQ ID NO: 119653 - RNA, 20 nt, Artificial Sequence
  MKO10119653_B_Syce2
  gRNA
uuaccucagacuggacacau

SEQ ID NO: 119654 - RNA, 20 nt, Artificial Sequence
  MKO10119654_B_Syce3
  gRNA
uuaucauagcuucuuucccc

SEQ ID NO: 119655 - RNA, 20 nt, Artificial Sequence
  MKO10119655_B_Syce3
  gRNA
acgcaugaccaccauaucau

SEQ ID NO: 119656 - RNA, 20 nt, Artificial Sequence
  MKO10119656_B_Syce3
  gRNA
uuguuguagugcaggcaacc

SEQ ID NO: 119657 - RNA, 20 nt, Artificial Sequence
  MKO10119657_B_Sycn
  gRNA
ugcaguguuagaccagcccg

SEQ ID NO: 119658 - RNA, 20 nt, Artificial Sequence
  MKO10119658_B_Sycn
  gRNA
gcgggucuugccaugcuuac

SEQ ID NO: 119659 - RNA, 20 nt, Artificial Sequence
  MKO10119659_B_Sycn
  gRNA
caagacccgcaaguucaccg

SEQ ID NO: 119660 - RNA, 20 nt, Artificial Sequence
  MKO10119660_B_Sycp1
  gRNA
uuccauuuacaauguccagu

SEQ ID NO: 119661 - RNA, 20 nt, Artificial Sequence
  MKO10119661_B_Sycp1
  gRNA
acugccaacaaauguacaga

SEQ ID NO: 119662 - RNA, 20 nt, Artificial Sequence
  MKO10119662_B_Sycp1
  gRNA
uuugaauacagucugcucau

SEQ ID NO: 119663 - RNA, 20 nt, Artificial Sequence
  MKO10119663_B_Sycp2
  gRNA
ucaagaugcuugaaacaguu

SEQ ID NO: 119664 - RNA, 20 nt, Artificial Sequence
  MKO10119664_B_Sycp2
  gRNA
uugauuuagaauaaucuccu

SEQ ID NO: 119665 - RNA, 20 nt, Artificial Sequence
  MKO10119665_B_Sycp2
  gRNA
auauaugacaucagugauga

SEQ ID NO: 119666 - RNA, 20 nt, Artificial Sequence
  MKO10119666_B_Sycp3
  gRNA
ccugguggaagaaagcauuc

SEQ ID NO: 119667 - RNA, 20 nt, Artificial Sequence
  MKO10119667_B_Sycp3
  gRNA
acaaagcucuucuugccaag

SEQ ID NO: 119668 - RNA, 20 nt, Artificial Sequence
  MKO10119668_B_Sycp3
  gRNA
aggugaaguacagaauaugc

SEQ ID NO: 119669 - RNA, 20 nt, Artificial Sequence
  MKO10119669_B_Syde1
  gRNA
guagaacgugagcagucccc

SEQ ID NO: 119670 - RNA, 20 nt, Artificial Sequence
  MKO10119670_B_Syde1
  gRNA
gccccccgaguggggcuucg

SEQ ID NO: 119671 - RNA, 20 nt, Artificial Sequence
  MKO10119671_B_Syde1
  gRNA
uggagcccaguagccgccga

SEQ ID NO: 119672 - RNA, 20 nt, Artificial Sequence
  MKO10119672_B_Syde2
  gRNA
cugaaccacacaaucgauac

SEQ ID NO: 119673 - RNA, 20 nt, Artificial Sequence
  MKO10119673_B_Syde2
  gRNA
guaggccuguaucgauugug

SEQ ID NO: 119674 - RNA, 20 nt, Artificial Sequence
  MKO10119674_B_Syde2
  gRNA
gggcucguucucacaaccac

SEQ ID NO: 119675 - RNA, 20 nt, Artificial Sequence
  MKO10119675_B_Syf2
  gRNA
ccacuccagacgcgcuuucu

SEQ ID NO: 119676 - RNA, 20 nt, Artificial Sequence
  MKO10119676_B_Syf2
  gRNA
cuacgagaaggugaaguugc

SEQ ID NO: 119677 - RNA, 20 nt, Artificial Sequence
  MKO10119677_B_Syf2
  gRNA
cccaauuacgccaguaucac

SEQ ID NO: 119678 - RNA, 20 nt, Artificial Sequence
  MKO10119678_B_Syk
  gRNA
acgguaccaugccaaaagau

SEQ ID NO: 119679 - RNA, 20 nt, Artificial Sequence
  MKO10119679_B_Syk
  gRNA
aggacucuuaguagcccauc

SEQ ID NO: 119680 - RNA, 20 nt, Artificial Sequence
  MKO10119680_B_Syk
  gRNA
cuuaccacgggaugggcauu

SEQ ID NO: 119681 - RNA, 20 nt, Artificial Sequence
  MKO10119681_B_Sympk
  gRNA
gacaaacuugcgcacuucaa

SEQ ID NO: 119682 - RNA, 20 nt, Artificial Sequence
  MKO10119682_B_Sympk
  gRNA
ccaagagcugaucaucaaca

SEQ ID NO: 119683 - RNA, 20 nt, Artificial Sequence
  MKO10119683_B_Sympk
  gRNA
caagaucacagugcucaaac

SEQ ID NO: 119684 - RNA, 20 nt, Artificial Sequence
  MKO10119684_B_Syn1
  gRNA
uccauuacgugccaugcuga

SEQ ID NO: 119685 - RNA, 20 nt, Artificial Sequence
  MKO10119685_B_Syn1
  gRNA
cccagggcaaaauacuucaa

SEQ ID NO: 119686 - RNA, 20 nt, Artificial Sequence
  MKO10119686_B_Syn1
  gRNA
ggaauggagucaaaguugug

SEQ ID NO: 119687 - RNA, 20 nt, Artificial Sequence
  MKO10119687_B_Syn2
  gRNA
ugcagauggaaccuacgccg

SEQ ID NO: 119688 - RNA, 20 nt, Artificial Sequence
  MKO10119688_B_Syn2
  gRNA
cguacugcaugccaaugacc

SEQ ID NO: 119689 - RNA, 20 nt, Artificial Sequence
  MKO10119689_B_Syn2
  gRNA
gaaugaagacuuccgccacc

SEQ ID NO: 119690 - RNA, 20 nt, Artificial Sequence
  MKO10119690_B_Syn3
  gRNA
ucgaugacgcccauacagac

SEQ ID NO: 119691 - RNA, 20 nt, Artificial Sequence
  MKO10119691_B_Syn3
  gRNA
gucugcuuaccgcacaauuu

SEQ ID NO: 119692 - RNA, 20 nt, Artificial Sequence
  MKO10119692_B_Syn3
  gRNA
ggcuccgguaguccucagcc

SEQ ID NO: 119693 - RNA, 20 nt, Artificial Sequence
  MKO10119693_B_Syna
  gRNA
cgagcuugugccgaguuccg

SEQ ID NO: 119694 - RNA, 20 nt, Artificial Sequence
  MKO10119694_B_Syna
  gRNA
gccgcgauacagaaugaguc

SEQ ID NO: 119695 - RNA, 20 nt, Artificial Sequence
  MKO10119695_B_Syna
  gRNA
acccuaucaccgaccuugag

SEQ ID NO: 119696 - RNA, 20 nt, Artificial Sequence
  MKO10119696_B_Synb
  gRNA
ucuuuacugagaccgugcuc

SEQ ID NO: 119697 - RNA, 20 nt, Artificial Sequence
  MKO10119697_B_Synb
  gRNA
cgucccggacuauuccagac

SEQ ID NO: 119698 - RNA, 20 nt, Artificial Sequence
  MKO10119698_B_Synb
  gRNA
cguagaagcagcacucuucc

SEQ ID NO: 119699 - RNA, 20 nt, Artificial Sequence
  MKO10119699_B_Syncrip
  gRNA
gcagccuucuguuggcacug

SEQ ID NO: 119700 - RNA, 20 nt, Artificial Sequence
  MKO10119700_B_Syncrip
  gRNA
auggcuacagaacauguuaa

SEQ ID NO: 119701 - RNA, 20 nt, Artificial Sequence
  MKO10119701_B_Syncrip
  gRNA
aaaugguacugaagagccca

SEQ ID NO: 119702 - RNA, 20 nt, Artificial Sequence
  MKO10119702_B_Sync
  gRNA
ggcuaugcuacccaagaguc

SEQ ID NO: 119703 - RNA, 20 nt, Artificial Sequence
  MKO10119703_B_Sync
  gRNA
agacagaggcaguugcgcag

SEQ ID NO: 119704 - RNA, 20 nt, Artificial Sequence
  MKO10119704_B_Sync
  gRNA
aguucagcaacagaagaaca

SEQ ID NO: 119705 - RNA, 20 nt, Artificial Sequence
  MKO10119705_B_Syndig1l
  gRNA
ggccaggcggaaguccccuu

SEQ ID NO: 119706 - RNA, 20 nt, Artificial Sequence
  MKO10119706_B_Syndig1l
  gRNA
caggaagagagcucggcgag

SEQ ID NO: 119707 - RNA, 20 nt, Artificial Sequence
  MKO10119707_B_Syndig1l
  gRNA
agaagagagugagucccaag

SEQ ID NO: 119708 - RNA, 20 nt, Artificial Sequence
  MKO10119708_B_Syndig1
  gRNA
gaaguacaccaucugaguag

SEQ ID NO: 119709 - RNA, 20 nt, Artificial Sequence
  MKO10119709_B_Syndig1
  gRNA
guccucacuuucugugucgc

SEQ ID NO: 119710 - RNA, 20 nt, Artificial Sequence
  MKO10119710_B_Syndig1
  gRNA
uaccucaugggacaaguaga

SEQ ID NO: 119711 - RNA, 20 nt, Artificial Sequence
  MKO10119711_B_Syne1
  gRNA
cuugcagcggaagccuccca

SEQ ID NO: 119712 - RNA, 20 nt, Artificial Sequence
  MKO10119712_B_Syne1
  gRNA
gguccugucugggcagaaac

SEQ ID NO: 119713 - RNA, 20 nt, Artificial Sequence
  MKO10119713_B_Syne1
  gRNA
agaaacguaccuucacaaaa

SEQ ID NO: 119714 - RNA, 20 nt, Artificial Sequence
  MKO10119714_B_Syne2
  gRNA
cagcugugaguuuauccagc

SEQ ID NO: 119715 - RNA, 20 nt, Artificial Sequence
  MKO10119715_B_Syne2
  gRNA
cuuauucgcagacaucaaga

SEQ ID NO: 119716 - RNA, 20 nt, Artificial Sequence
  MKO10119716_B_Syne2
  gRNA
cauguugcugacauuguaga

SEQ ID NO: 119717 - RNA, 20 nt, Artificial Sequence
  MKO10119717_B_Syne3
  gRNA
cguccucccgguacugcuca

SEQ ID NO: 119718 - RNA, 20 nt, Artificial Sequence
  MKO10119718_B_Syne3
  gRNA
ucaggucaaugacaacacga

SEQ ID NO: 119719 - RNA, 20 nt, Artificial Sequence
  MKO10119719_B_Syne3
  gRNA
cccucgccaggacaucgcca

SEQ ID NO: 119720 - RNA, 20 nt, Artificial Sequence
  MKO10119720_B_Syne4
  gRNA
ccaguugaucagcuauagcc

SEQ ID NO: 119721 - RNA, 20 nt, Artificial Sequence
  MKO10119721_B_Syne4
  gRNA
gggccugccugagcauugca

SEQ ID NO: 119722 - RNA, 20 nt, Artificial Sequence
  MKO10119722_B_Syne4
  gRNA
cagccccucaagacuccccc

SEQ ID NO: 119723 - RNA, 20 nt, Artificial Sequence
  MKO10119723_B_Syngap1
  gRNA
ccgccguaccaugcucgccg

SEQ ID NO: 119724 - RNA, 20 nt, Artificial Sequence
  MKO10119724_B_Syngap1
  gRNA
uccgaagugcugaccaugac

SEQ ID NO: 119725 - RNA, 20 nt, Artificial Sequence
  MKO10119725_B_Syngap1
  gRNA
agucacaacccaaacuugac

SEQ ID NO: 119726 - RNA, 20 nt, Artificial Sequence
  MKO10119726_B_Syngr1
  gRNA
gcguccgucccuucguucag

SEQ ID NO: 119727 - RNA, 20 nt, Artificial Sequence
  MKO10119727_B_Syngr1
  gRNA
aagcuccuugaaucugcgua

SEQ ID NO: 119728 - RNA, 20 nt, Artificial Sequence
  MKO10119728_B_Syngr1
  gRNA
gauagagccgaagaccacga

SEQ ID NO: 119729 - RNA, 20 nt, Artificial Sequence
  MKO10119729_B_Syngr2
  gRNA
auccacguaguucugaauga

SEQ ID NO: 119730 - RNA, 20 nt, Artificial Sequence
  MKO10119730_B_Syngr2
  gRNA
ugccuucauucagaacuacg

SEQ ID NO: 119731 - RNA, 20 nt, Artificial Sequence
  MKO10119731_B_Syngr2
  gRNA
gucgaaggagccgcccgcgu

SEQ ID NO: 119732 - RNA, 20 nt, Artificial Sequence
  MKO10119732_B_Syngr3
  gRNA
gggccgccgcgcaaagcuca

SEQ ID NO: 119733 - RNA, 20 nt, Artificial Sequence
  MKO10119733_B_Syngr3
  gRNA
cccaggacacgacccgcaac

SEQ ID NO: 119734 - RNA, 20 nt, Artificial Sequence
  MKO10119734_B_Syngr3
  gRNA
agagagacauaucggugccu

SEQ ID NO: 119735 - RNA, 20 nt, Artificial Sequence
  MKO10119735_B_Syngr4
  gRNA
cccugaaagccuccacgacc

SEQ ID NO: 119736 - RNA, 20 nt, Artificial Sequence
  MKO10119736_B_Syngr4
  gRNA
agcuccuacugcaaagcuac

SEQ ID NO: 119737 - RNA, 20 nt, Artificial Sequence
  MKO10119737_B_Syngr4
  gRNA
augagacugugcgcuuucug

SEQ ID NO: 119738 - RNA, 20 nt, Artificial Sequence
  MKO10119738_B_Synj1
  gRNA
gaaugucucauguucgaguc

SEQ ID NO: 119739 - RNA, 20 nt, Artificial Sequence
  MKO10119739_B_Synj1
  gRNA
ugauaccaugcugcacuauc

SEQ ID NO: 119740 - RNA, 20 nt, Artificial Sequence
  MKO10119740_B_Synj1
  gRNA
uccguaugcauccaguacuu

SEQ ID NO: 119741 - RNA, 20 nt, Artificial Sequence
  MKO10119741_B_Synj2bp
  gRNA
uacccgaagguccucucguc

SEQ ID NO: 119742 - RNA, 20 nt, Artificial Sequence
  MKO10119742_B_Synj2bp
  gRNA
agcagucagauaugaacgga

SEQ ID NO: 119743 - RNA, 20 nt, Artificial Sequence
  MKO10119743_B_Synj2bp
  gRNA
gaaggcccaaacugcuacca

SEQ ID NO: 119744 - RNA, 20 nt, Artificial Sequence
  MKO10119744_B_Synj2
  gRNA
uauuucgcauggcccaauga

SEQ ID NO: 119745 - RNA, 20 nt, Artificial Sequence
  MKO10119745_B_Synj2
  gRNA
aucgaagcaggcgccaucau

SEQ ID NO: 119746 - RNA, 20 nt, Artificial Sequence
  MKO10119746_B_Synj2
  gRNA
uugcucccagaacagcggaa

SEQ ID NO: 119747 - RNA, 20 nt, Artificial Sequence
  MKO10119747_B_Synm
  gRNA
gcuccugguaaucccgcagc

SEQ ID NO: 119748 - RNA, 20 nt, Artificial Sequence
  MKO10119748_B_Synm
  gRNA
ugaccggcugcgggauuacc

SEQ ID NO: 119749 - RNA, 20 nt, Artificial Sequence
  MKO10119749_B_Synm
  gRNA
gcaauccggagauauugauc

SEQ ID NO: 119750 - RNA, 20 nt, Artificial Sequence
  MKO10119750_B_Synpo2l
  gRNA
gaccagcucuuagcgaucaa

SEQ ID NO: 119751 - RNA, 20 nt, Artificial Sequence
  MKO10119751_B_Synpo2l
  gRNA
ucggcguggcuucucuugug

SEQ ID NO: 119752 - RNA, 20 nt, Artificial Sequence
  MKO10119752_B_Synpo2l
  gRNA
ccauaguaagcuucgcuguc

SEQ ID NO: 119753 - RNA, 20 nt, Artificial Sequence
  MKO10119753_B_Synpo2
  gRNA
cgaugagagaaucgcagugc

SEQ ID NO: 119754 - RNA, 20 nt, Artificial Sequence
  MKO10119754_B_Synpo2
  gRNA
gccuucugacgagaccgcaa

SEQ ID NO: 119755 - RNA, 20 nt, Artificial Sequence
  MKO10119755_B_Synpo2
  gRNA
cacauguagucuccgcagcu

SEQ ID NO: 119756 - RNA, 20 nt, Artificial Sequence
  MKO10119756_B_Synpo
  gRNA
gcgugauggagugcgcgaug

SEQ ID NO: 119757 - RNA, 20 nt, Artificial Sequence
  MKO10119757_B_Synpo
  gRNA
cgggguccgcgcuggacuua

SEQ ID NO: 119758 - RNA, 20 nt, Artificial Sequence
  MKO10119758_B_Synpo
  gRNA
aaguacaccacuaacgcccc

SEQ ID NO: 119759 - RNA, 20 nt, Artificial Sequence
  MKO10119759_B_Synpr
  gRNA
gggccaacuuccgaugaguu

SEQ ID NO: 119760 - RNA, 20 nt, Artificial Sequence
  MKO10119760_B_Synpr
  gRNA
uuggccccagauucgccugc

SEQ ID NO: 119761 - RNA, 20 nt, Artificial Sequence
  MKO10119761_B_Synpr
  gRNA
guccagcuuaaacacaucug

SEQ ID NO: 119762 - RNA, 20 nt, Artificial Sequence
  MKO10119762_B_Synrg
  gRNA
gucaugcagcccaauaugca

SEQ ID NO: 119763 - RNA, 20 nt, Artificial Sequence
  MKO10119763_B_Synrg
  gRNA
agcagcgggugugccuuucc

SEQ ID NO: 119764 - RNA, 20 nt, Artificial Sequence
  MKO10119764_B_Synrg
  gRNA
ucucagcagcgugaagccca

SEQ ID NO: 119765 - RNA, 20 nt, Artificial Sequence
  MKO10119765_B_Sypl2
  gRNA
ggccacacccucuauggggc

SEQ ID NO: 119766 - RNA, 20 nt, Artificial Sequence
  MKO10119766_B_Sypl2
  gRNA
gccgaguucuuugugacccu

SEQ ID NO: 119767 - RNA, 20 nt, Artificial Sequence
  MKO10119767_B_Sypl2
  gRNA
ggcgcugccagcgcagcccc

SEQ ID NO: 119768 - RNA, 20 nt, Artificial Sequence
  MKO10119768_B_Sypl
  gRNA
caagugaacuguccuaaagu

SEQ ID NO: 119769 - RNA, 20 nt, Artificial Sequence
  MKO10119769_B_Sypl
  gRNA
ugggcaguuugcgacuaucc

SEQ ID NO: 119770 - RNA, 20 nt, Artificial Sequence
  MKO10119770_B_Sypl
  gRNA
ucagugugugugacgugaac

SEQ ID NO: 119771 - RNA, 20 nt, Artificial Sequence
  MKO10119771_B_Syp
  gRNA
augccuaugugccgccagac

SEQ ID NO: 119772 - RNA, 20 nt, Artificial Sequence
  MKO10119772_B_Syp
  gRNA
gaugcacccuccugcguuaa

SEQ ID NO: 119773 - RNA, 20 nt, Artificial Sequence
  MKO10119773_B_Syp
  gRNA
gacuucaggacucaacaccu

SEQ ID NO: 119774 - RNA, 20 nt, Artificial Sequence
  MKO10119774_B_Sys1
  gRNA
ugagcuccguccgcaugcac

SEQ ID NO: 119775 - RNA, 20 nt, Artificial Sequence
  MKO10119775_B_Sys1
  gRNA
ucguccucaacgcccucacc

SEQ ID NO: 119776 - RNA, 20 nt, Artificial Sequence
  MKO10119776_B_Sys1
  gRNA
cucaccaggugagggcguug

SEQ ID NO: 119777 - RNA, 20 nt, Artificial Sequence
  MKO10119777_B_Syt10
  gRNA
ccuuaccgggaugaagacgu

SEQ ID NO: 119778 - RNA, 20 nt, Artificial Sequence
  MKO10119778_B_Syt10
  gRNA
gauaauggcuucguuguaca

SEQ ID NO: 119779 - RNA, 20 nt, Artificial Sequence
  MKO10119779_B_Syt10
  gRNA
cagccugugcauugcaguca

SEQ ID NO: 119780 - RNA, 20 nt, Artificial Sequence
  MKO10119780_B_Syt11
  gRNA
agccagacacuugccgaaga

SEQ ID NO: 119781 - RNA, 20 nt, Artificial Sequence
  MKO10119781_B_Syt11
  gRNA
ugcgaucgaagucaaugaca

SEQ ID NO: 119782 - RNA, 20 nt, Artificial Sequence
  MKO10119782_B_Syt11
  gRNA
auccaucuucggcaaguguc

SEQ ID NO: 119783 - RNA, 20 nt, Artificial Sequence
  MKO10119783_B_Syt12
  gRNA
cuguagucguaauuagggaa

SEQ ID NO: 119784 - RNA, 20 nt, Artificial Sequence
  MKO10119784_B_Syt12
  gRNA
ggagcugaagcuguccguuc

SEQ ID NO: 119785 - RNA, 20 nt, Artificial Sequence
  MKO10119785_B_Syt12
  gRNA
gaacuucucaucgaagaaga

SEQ ID NO: 119786 - RNA, 20 nt, Artificial Sequence
  MKO10119786_B_Syt13
  gRNA
ggaguuccccaaucacacua

SEQ ID NO: 119787 - RNA, 20 nt, Artificial Sequence
  MKO10119787_B_Syt13
  gRNA
cccagcugccaaucgccucc

SEQ ID NO: 119788 - RNA, 20 nt, Artificial Sequence
  MKO10119788_B_Syt13
  gRNA
guccaggcggaaguggaguu

SEQ ID NO: 119789 - RNA, 20 nt, Artificial Sequence
  MKO10119789_B_Syt14
  gRNA
gaggagaaccgcugucgucu

SEQ ID NO: 119790 - RNA, 20 nt, Artificial Sequence
  MKO10119790_B_Syt14
  gRNA
gacaaaaauccaaccgccuc

SEQ ID NO: 119791 - RNA, 20 nt, Artificial Sequence
  MKO10119791_B_Syt14
  gRNA
gauaaguucauguacuccac

SEQ ID NO: 119792 - RNA, 20 nt, Artificial Sequence
  MKO10119792_B_Syt15
  gRNA
gcuaccaaguguaccauuug

SEQ ID NO: 119793 - RNA, 20 nt, Artificial Sequence
  MKO10119793_B_Syt15
  gRNA
acugccagagacgucagacc

SEQ ID NO: 119794 - RNA, 20 nt, Artificial Sequence
  MKO10119794_B_Syt15
  gRNA
acuccaccgagaaccacagc

SEQ ID NO: 119795 - RNA, 20 nt, Artificial Sequence
  MKO10119795_B_Syt16
  gRNA
cucacgcucagauuacuucu

SEQ ID NO: 119796 - RNA, 20 nt, Artificial Sequence
  MKO10119796_B_Syt16
  gRNA
auacuccugaacgaaaacuc

SEQ ID NO: 119797 - RNA, 20 nt, Artificial Sequence
  MKO10119797_B_Syt16
  gRNA
cucccagauaaggaccgaag

SEQ ID NO: 119798 - RNA, 20 nt, Artificial Sequence
  MKO10119798_B_Syt17
  gRNA
uacuggagauucuccgaguc

SEQ ID NO: 119799 - RNA, 20 nt, Artificial Sequence
  MKO10119799_B_Syt17
  gRNA
gcaguuggaaccacugaacg

SEQ ID NO: 119800 - RNA, 20 nt, Artificial Sequence
  MKO10119800_B_Syt17
  gRNA
gcgauguuccuuugacccca

SEQ ID NO: 119801 - RNA, 20 nt, Artificial Sequence
  MKO10119801_B_Syt1
  gRNA
auggcaauuaaggcccacgg

SEQ ID NO: 119802 - RNA, 20 nt, Artificial Sequence
  MKO10119802_B_Syt1
  gRNA
ccccucagaccugguuauuc

SEQ ID NO: 119803 - RNA, 20 nt, Artificial Sequence
  MKO10119803_B_Syt1
  gRNA
agcaggaagacuuugacgua

SEQ ID NO: 119804 - RNA, 20 nt, Artificial Sequence
  MKO10119804_B_Syt2
  gRNA
gagaaaacugcaauuugccc

SEQ ID NO: 119805 - RNA, 20 nt, Artificial Sequence
  MKO10119805_B_Syt2
  gRNA
gaagaacgccaugaacauga

SEQ ID NO: 119806 - RNA, 20 nt, Artificial Sequence
  MKO10119806_B_Syt2
  gRNA
cugggaguuccgcagccugc

SEQ ID NO: 119807 - RNA, 20 nt, Artificial Sequence
  MKO10119807_B_Syt3
  gRNA
cacggugaggcgcccagccg

SEQ ID NO: 119808 - RNA, 20 nt, Artificial Sequence
  MKO10119808_B_Syt3
  gRNA
augacuucgaccgcuucucg

SEQ ID NO: 119809 - RNA, 20 nt, Artificial Sequence
  MKO10119809_B_Syt3
  gRNA
ugagaucaugccgcgagaag

SEQ ID NO: 119810 - RNA, 20 nt, Artificial Sequence
  MKO10119810_B_Syt4
  gRNA
accguccaaucaccucauuu

SEQ ID NO: 119811 - RNA, 20 nt, Artificial Sequence
  MKO10119811_B_Syt4
  gRNA
aaguuugugcacgugcuuaa

SEQ ID NO: 119812 - RNA, 20 nt, Artificial Sequence
  MKO10119812_B_Syt4
  gRNA
uccuaucaccaccagccgcg

SEQ ID NO: 119813 - RNA, 20 nt, Artificial Sequence
  MKO10119813_B_Syt5
  gRNA
ucaugucgccuccgcuuguc

SEQ ID NO: 119814 - RNA, 20 nt, Artificial Sequence
  MKO10119814_B_Syt5
  gRNA
cgguccagcuccucuauuuc

SEQ ID NO: 119815 - RNA, 20 nt, Artificial Sequence
  MKO10119815_B_Syt5
  gRNA
cuagguucagccugaaauag

SEQ ID NO: 119816 - RNA, 20 nt, Artificial Sequence
  MKO10119816_B_Syt6
  gRNA
ccuaaaccccaucuacaacg

SEQ ID NO: 119817 - RNA, 20 nt, Artificial Sequence
  MKO10119817_B_Syt6
  gRNA
cuuauccgccauguugccuc

SEQ ID NO: 119818 - RNA, 20 nt, Artificial Sequence
  MKO10119818_B_Syt6
  gRNA
gagccugcucaucuccguua

SEQ ID NO: 119819 - RNA, 20 nt, Artificial Sequence
  MKO10119819_B_Syt7
  gRNA
agaggacgauagugacgcua

SEQ ID NO: 119820 - RNA, 20 nt, Artificial Sequence
  MKO10119820_B_Syt7
  gRNA
ggggaccauguaccgggacc

SEQ ID NO: 119821 - RNA, 20 nt, Artificial Sequence
  MKO10119821_B_Syt7
  gRNA
cugcggucagacucaucgug

SEQ ID NO: 119822 - RNA, 20 nt, Artificial Sequence
  MKO10119822_B_Syt8
  gRNA
gcacagcagaccccuacgcc

SEQ ID NO: 119823 - RNA, 20 nt, Artificial Sequence
  MKO10119823_B_Syt8
  gRNA
gcgauaaagaggguccagcg

SEQ ID NO: 119824 - RNA, 20 nt, Artificial Sequence
  MKO10119824_B_Syt8
  gRNA
ccaacuaccccugggcaccg

SEQ ID NO: 119825 - RNA, 20 nt, Artificial Sequence
  MKO10119825_B_Syt9
  gRNA
ccacuuguccauagccguca

SEQ ID NO: 119826 - RNA, 20 nt, Artificial Sequence
  MKO10119826_B_Syt9
  gRNA
cggcaugggcacaguucucc

SEQ ID NO: 119827 - RNA, 20 nt, Artificial Sequence
  MKO10119827_B_Syt9
  gRNA
uuaaaggcgauggacauaac

SEQ ID NO: 119828 - RNA, 20 nt, Artificial Sequence
  MKO10119828_B_Sytl1
  gRNA
ggacuccggcucuccuucaa

SEQ ID NO: 119829 - RNA, 20 nt, Artificial Sequence
  MKO10119829_B_Sytl1
  gRNA
uacccuccagcucacauucc

SEQ ID NO: 119830 - RNA, 20 nt, Artificial Sequence
  MKO10119830_B_Sytl1
  gRNA
uccuuccagggucuccauag

SEQ ID NO: 119831 - RNA, 20 nt, Artificial Sequence
  MKO10119831_B_Sytl2
  gRNA
cugggacauaucaaucacac

SEQ ID NO: 119832 - RNA, 20 nt, Artificial Sequence
  MKO10119832_B_Sytl2
  gRNA
cgacuuaaguuuccugacag

SEQ ID NO: 119833 - RNA, 20 nt, Artificial Sequence
  MKO10119833_B_Sytl2
  gRNA
cucugaugaugucagcaccg

SEQ ID NO: 119834 - RNA, 20 nt, Artificial Sequence
  MKO10119834_B_Sytl3
  gRNA
cguugacugcagugucugac

SEQ ID NO: 119835 - RNA, 20 nt, Artificial Sequence
  MKO10119835_B_Sytl3
  gRNA
gaccucugagaagcaucuuc

SEQ ID NO: 119836 - RNA, 20 nt, Artificial Sequence
  MKO10119836_B_Sytl3
  gRNA
gagaagacagcgcugugugu

SEQ ID NO: 119837 - RNA, 20 nt, Artificial Sequence
  MKO10119837_B_Sytl4
  gRNA
ugauuaucucgcugccuguu

SEQ ID NO: 119838 - RNA, 20 nt, Artificial Sequence
  MKO10119838_B_Sytl4
  gRNA
cagugcacucuuuccacuuc

SEQ ID NO: 119839 - RNA, 20 nt, Artificial Sequence
  MKO10119839_B_Sytl4
  gRNA
ggaggcugagagcgagaguc

SEQ ID NO: 119840 - RNA, 20 nt, Artificial Sequence
  MKO10119840_B_Sytl5
  gRNA
cuauagcuccuuccgcuuuc

SEQ ID NO: 119841 - RNA, 20 nt, Artificial Sequence
  MKO10119841_B_Sytl5
  gRNA
accuggacuucuucuuaaga

SEQ ID NO: 119842 - RNA, 20 nt, Artificial Sequence
  MKO10119842_B_Sytl5
  gRNA
aaguucagaucagcaaccag

SEQ ID NO: 119843 - RNA, 20 nt, Artificial Sequence
  MKO10119843_B_Syvn1
  gRNA
uaucacagcauccugacccg

SEQ ID NO: 119844 - RNA, 20 nt, Artificial Sequence
  MKO10119844_B_Syvn1
  gRNA
ucaggaugcugugauaagcg

SEQ ID NO: 119845 - RNA, 20 nt, Artificial Sequence
  MKO10119845_B_Syvn1
  gRNA
cccccagguccuguacaucc

SEQ ID NO: 119846 - RNA, 20 nt, Artificial Sequence
  MKO10119846_B_Szrd1
  gRNA
caaugugaucagacagccgu

SEQ ID NO: 119847 - RNA, 20 nt, Artificial Sequence
  MKO10119847_B_Szrd1
  gRNA
ggcgaguaagauggaagaug

SEQ ID NO: 119848 - RNA, 20 nt, Artificial Sequence
  MKO10119848_B_Szrd1
  gRNA
uccucuaggaaauagacaga

SEQ ID NO: 119849 - RNA, 20 nt, Artificial Sequence
  MKO10119849_B_Szt2
  gRNA
ucgucagcuucaguccgagc

SEQ ID NO: 119850 - RNA, 20 nt, Artificial Sequence
  MKO10119850_B_Szt2
  gRNA
accaagccaggcgaacauuu

SEQ ID NO: 119851 - RNA, 20 nt, Artificial Sequence
  MKO10119851_B_Szt2
  gRNA
auggcagccagaugaacccg

SEQ ID NO: 119852 - RNA, 20 nt, Artificial Sequence
  MKO10119852_B_T2
  gRNA
uuccagguccaacgccuacc

SEQ ID NO: 119853 - RNA, 20 nt, Artificial Sequence
  MKO10119853_B_T2
  gRNA
caaaacgagcugaccaaaug

SEQ ID NO: 119854 - RNA, 20 nt, Artificial Sequence
  MKO10119854_B_T2
  gRNA
cgcuguguccccucgaugcu

SEQ ID NO: 119855 - RNA, 20 nt, Artificial Sequence
  MKO10119855_B_Taar1
  gRNA
ggcggagcucagcaugauau

SEQ ID NO: 119856 - RNA, 20 nt, Artificial Sequence
  MKO10119856_B_Taar1
  gRNA
ugagaacuguugagcgcugu

SEQ ID NO: 119857 - RNA, 20 nt, Artificial Sequence
  MKO10119857_B_Taar1
  gRNA
ggccauugucgacuuucugc

SEQ ID NO: 119858 - RNA, 20 nt, Artificial Sequence
  MKO10119858_B_Taar2
  gRNA
guccccggggcguuugccuu

SEQ ID NO: 119859 - RNA, 20 nt, Artificial Sequence
  MKO10119859_B_Taar2
  gRNA
uucuccgaggcuuacgcuga

SEQ ID NO: 119860 - RNA, 20 nt, Artificial Sequence
  MKO10119860_B_Taar2
  gRNA
uccguacucugaacaaucaa

SEQ ID NO: 119861 - RNA, 20 nt, Artificial Sequence
  MKO10119861_B_Taar3
  gRNA
cgcuuacguucaacaaguuu

SEQ ID NO: 119862 - RNA, 20 nt, Artificial Sequence
  MKO10119862_B_Taar3
  gRNA
gcaucaugucgaagcucgcg

SEQ ID NO: 119863 - RNA, 20 nt, Artificial Sequence
  MKO10119863_B_Taar3
  gRNA
acacccccaugacgaugccc

SEQ ID NO: 119864 - RNA, 20 nt, Artificial Sequence
  MKO10119864_B_Taar4
  gRNA
auggcacagacaacgagcgc

SEQ ID NO: 119865 - RNA, 20 nt, Artificial Sequence
  MKO10119865_B_Taar4
  gRNA
auuugggugacguagugcaa

SEQ ID NO: 119866 - RNA, 20 nt, Artificial Sequence
  MKO10119866_B_Taar4
  gRNA
gucgcagccauugacuguac

SEQ ID NO: 119867 - RNA, 20 nt, Artificial Sequence
  MKO10119867_B_Taar5
  gRNA
cccacccugccacgauguag

SEQ ID NO: 119868 - RNA, 20 nt, Artificial Sequence
  MKO10119868_B_Taar5
  gRNA
gcccuccgcuacaucguggc

SEQ ID NO: 119869 - RNA, 20 nt, Artificial Sequence
  MKO10119869_B_Taar5
  gRNA
accugguagcagaacgcugu

SEQ ID NO: 119870 - RNA, 20 nt, Artificial Sequence
  MKO10119870_B_Taar6
  gRNA
gacagcgauguaccugucga

SEQ ID NO: 119871 - RNA, 20 nt, Artificial Sequence
  MKO10119871_B_Taar6
  gRNA
uaaaauaaagcguagaucag

SEQ ID NO: 119872 - RNA, 20 nt, Artificial Sequence
  MKO10119872_B_Taar6
  gRNA
gguuuaugaugacggccugg

SEQ ID NO: 119873 - RNA, 20 nt, Artificial Sequence
  MKO10119873_B_Taar7a
  gRNA
gacagucaucaucacaagag

SEQ ID NO: 119874 - RNA, 20 nt, Artificial Sequence
  MKO10119874_B_Taar7a
  gRNA
acccacuaagaaaucagcac

SEQ ID NO: 119875 - RNA, 20 nt, Artificial Sequence
  MKO10119875_B_Taar7a
  gRNA
aggcagccacugcaaugccc

SEQ ID NO: 119876 - RNA, 20 nt, Artificial Sequence
  MKO10119876_B_Taar7b
  gRNA
caaggacaccaccaggaagu

SEQ ID NO: 119877 - RNA, 20 nt, Artificial Sequence
  MKO10119877_B_Taar7b
  gRNA
aggcgagggccuggggaaua

SEQ ID NO: 119878 - RNA, 20 nt, Artificial Sequence
  MKO10119878_B_Taar7b
  gRNA
acacuccccugccaacuucc

SEQ ID NO: 119879 - RNA, 20 nt, Artificial Sequence
  MKO10119879_B_Taar7d
  gRNA
agccaaugaugcugggcugg

SEQ ID NO: 119880 - RNA, 20 nt, Artificial Sequence
  MKO10119880_B_Taar7d
  gRNA
auccucugaccuaccccacc

SEQ ID NO: 119881 - RNA, 20 nt, Artificial Sequence
  MKO10119881_B_Taar7d
  gRNA
aggcgagggccuggagagua

SEQ ID NO: 119882 - RNA, 20 nt, Artificial Sequence
  MKO10119882_B_Taar7e
  gRNA
agcaagugaagcugggcuag

SEQ ID NO: 119883 - RNA, 20 nt, Artificial Sequence
  MKO10119883_B_Taar7e
  gRNA
acgugggcgugaugaacccc

SEQ ID NO: 119884 - RNA, 20 nt, Artificial Sequence
  MKO10119884_B_Taar7e
  gRNA
cuccuucauugaugccuucc

SEQ ID NO: 119885 - RNA, 20 nt, Artificial Sequence
  MKO10119885_B_Taar7f
  gRNA
uagcugaugaaacuguuucc

SEQ ID NO: 119886 - RNA, 20 nt, Artificial Sequence
  MKO10119886_B_Taar7f
  gRNA
uggcuccuguccaucagcua

SEQ ID NO: 119887 - RNA, 20 nt, Artificial Sequence
  MKO10119887_B_Taar7f
  gRNA
cacuugcuccuguguaaaug

SEQ ID NO: 119888 - RNA, 20 nt, Artificial Sequence
  MKO10119888_B_Taar8a
  gRNA
ccuucacaguuguugugaug

SEQ ID NO: 119889 - RNA, 20 nt, Artificial Sequence
  MKO10119889_B_Taar8a
  gRNA
acacugcacugcuguacacc

SEQ ID NO: 119890 - RNA, 20 nt, Artificial Sequence
  MKO10119890_B_Taar8a
  gRNA
accaaugcgucaauugugua

SEQ ID NO: 119891 - RNA, 20 nt, Artificial Sequence
  MKO10119891_B_Taar8b
  gRNA
acuucuguaagugacaacag

SEQ ID NO: 119892 - RNA, 20 nt, Artificial Sequence
  MKO10119892_B_Taar8b
  gRNA
accaaugagucaauugugua

SEQ ID NO: 119893 - RNA, 20 nt, Artificial Sequence
  MKO10119893_B_Taar8b
  gRNA
gcccaccaagaagucagcgc

SEQ ID NO: 119894 - RNA, 20 nt, Artificial Sequence
  MKO10119894_B_Taar8c
  gRNA
accaaugcaucaauugugua

SEQ ID NO: 119895 - RNA, 20 nt, Artificial Sequence
  MKO10119895_B_Taar8c
  gRNA
cauagcugucacggacccuc

SEQ ID NO: 119896 - RNA, 20 nt, Artificial Sequence
  MKO10119896_B_Taar8c
  gRNA
cucugcuaugagaacacgaa

SEQ ID NO: 119897 - RNA, 20 nt, Artificial Sequence
  MKO10119897_B_Taar9
  gRNA
gcacacgccuacgaacuucc

SEQ ID NO: 119898 - RNA, 20 nt, Artificial Sequence
  MKO10119898_B_Taar9
  gRNA
uccgaccaaguucacuguau

SEQ ID NO: 119899 - RNA, 20 nt, Artificial Sequence
  MKO10119899_B_Taar9
  gRNA
ccaaaccgaggaccccauag

SEQ ID NO: 119900 - RNA, 20 nt, Artificial Sequence
  MKO10119900_B_Tab1
  gRNA
gcuccucuccaccacaucaa

SEQ ID NO: 119901 - RNA, 20 nt, Artificial Sequence
  MKO10119901_B_Tab1
  gRNA
acgcugaaccaacuccagag

SEQ ID NO: 119902 - RNA, 20 nt, Artificial Sequence
  MKO10119902_B_Tab1
  gRNA
aagcucuacguugccaaugu

SEQ ID NO: 119903 - RNA, 20 nt, Artificial Sequence
  MKO10119903_B_Tab2
  gRNA
auaaaaguuaugaauagcgc

SEQ ID NO: 119904 - RNA, 20 nt, Artificial Sequence
  MKO10119904_B_Tab2
  gRNA
augcacuaaccuuuggguuu

SEQ ID NO: 119905 - RNA, 20 nt, Artificial Sequence
  MKO10119905_B_Tab2
  gRNA
agcucugcuggugcaccaga

SEQ ID NO: 119906 - RNA, 20 nt, Artificial Sequence
  MKO10119906_B_Tab3
  gRNA
acuuaccgugggaauugcag

SEQ ID NO: 119907 - RNA, 20 nt, Artificial Sequence
  MKO10119907_B_Tab3
  gRNA
guugaccuccuucaaucuag

SEQ ID NO: 119908 - RNA, 20 nt, Artificial Sequence
  MKO10119908_B_Tab3
  gRNA
cugcaccacugcaauuccca

SEQ ID NO: 119909 - RNA, 20 nt, Artificial Sequence
  MKO10119909_B_Tac1
  gRNA
auuaauccaaagaacugcug

SEQ ID NO: 119910 - RNA, 20 nt, Artificial Sequence
  MKO10119910_B_Tac1
  gRNA
cauaaaacagauuccuuugu

SEQ ID NO: 119911 - RNA, 20 nt, Artificial Sequence
  MKO10119911_B_Tac1
  gRNA
uuccucaguugaaaaacaag

SEQ ID NO: 119912 - RNA, 20 nt, Artificial Sequence
  MKO10119912_B_Tac2
  gRNA
gaagagaacacccccagcuu

SEQ ID NO: 119913 - RNA, 20 nt, Artificial Sequence
  MKO10119913_B_Tac2
  gRNA
cgacagccgcccugucucuc

SEQ ID NO: 119914 - RNA, 20 nt, Artificial Sequence
  MKO10119914_B_Tac2
  gRNA
uguggaagugaugucuccuu

SEQ ID NO: 119915 - RNA, 20 nt, Artificial Sequence
  MKO10119915_B_Tac4
  gRNA
cguauagugcaggaucuccu

SEQ ID NO: 119916 - RNA, 20 nt, Artificial Sequence
  MKO10119916_B_Tac4
  gRNA
uccccaucagaccauagaac

SEQ ID NO: 119917 - RNA, 20 nt, Artificial Sequence
  MKO10119917_B_Tac4
  gRNA
cugaagcuuaaguucaaugc

SEQ ID NO: 119918 - RNA, 20 nt, Artificial Sequence
  MKO10119918_B_Tacc1
  gRNA
uggacgugguccgcggugcg

SEQ ID NO: 119919 - RNA, 20 nt, Artificial Sequence
  MKO10119919_B_Tacc1
  gRNA
cucugagaucuucgagauca

SEQ ID NO: 119920 - RNA, 20 nt, Artificial Sequence
  MKO10119920_B_Tacc1
  gRNA
cgaagcucagccucucgauu

SEQ ID NO: 119921 - RNA, 20 nt, Artificial Sequence
  MKO10119921_B_Tacc2
  gRNA
caccaggaguuccgacucug

SEQ ID NO: 119922 - RNA, 20 nt, Artificial Sequence
  MKO10119922_B_Tacc2
  gRNA
ucagacagaggagaccgcuu

SEQ ID NO: 119923 - RNA, 20 nt, Artificial Sequence
  MKO10119923_B_Tacc2
  gRNA
uuauuuacagugacacguuu

SEQ ID NO: 119924 - RNA, 20 nt, Artificial Sequence
  MKO10119924_B_Tacc3
  gRNA
ugacguuccagacaccaccu

SEQ ID NO: 119925 - RNA, 20 nt, Artificial Sequence
  MKO10119925_B_Tacc3
  gRNA
guaacucgccuucugcucuu

SEQ ID NO: 119926 - RNA, 20 nt, Artificial Sequence
  MKO10119926_B_Tacc3
  gRNA
auuguuucaguccuagguac

SEQ ID NO: 119927 - RNA, 20 nt, Artificial Sequence
  MKO10119927_B_Taco1
  gRNA
caguggucccaagugccauc

SEQ ID NO: 119928 - RNA, 20 nt, Artificial Sequence
  MKO10119928_B_Taco1
  gRNA
aacuccauugaacaggacac

SEQ ID NO: 119929 - RNA, 20 nt, Artificial Sequence
  MKO10119929_B_Taco1
  gRNA
ugucuucagugcugacucga

SEQ ID NO: 119930 - RNA, 20 nt, Artificial Sequence
  MKO10119930_B_Tacr1
  gRNA
gcaagucucugccaagcgca

SEQ ID NO: 119931 - RNA, 20 nt, Artificial Sequence
  MKO10119931_B_Tacr1
  gRNA
ggucuacucaccugucauug

SEQ ID NO: 119932 - RNA, 20 nt, Artificial Sequence
  MKO10119932_B_Tacr1
  gRNA
uguguaccuucgccaucugc

SEQ ID NO: 119933 - RNA, 20 nt, Artificial Sequence
  MKO10119933_B_Tacr2
  gRNA
gugacaccgguugacucucc

SEQ ID NO: 119934 - RNA, 20 nt, Artificial Sequence
  MKO10119934_B_Tacr2
  gRNA
gaugacagcaauaaccgccu

SEQ ID NO: 119935 - RNA, 20 nt, Artificial Sequence
  MKO10119935_B_Tacr2
  gRNA
cggcgcguuuccacagugug

SEQ ID NO: 119936 - RNA, 20 nt, Artificial Sequence
  MKO10119936_B_Tacr3
  gRNA
ccagagaguaauuccaacga

SEQ ID NO: 119937 - RNA, 20 nt, Artificial Sequence
  MKO10119937_B_Tacr3
  gRNA
cgaucuaccaacaguuaaac

SEQ ID NO: 119938 - RNA, 20 nt, Artificial Sequence
  MKO10119938_B_Tacr3
  gRNA
uacuuacgugaaauguugcu

SEQ ID NO: 119939 - RNA, 20 nt, Artificial Sequence
  MKO10119939_B_Tacstd2
  gRNA
gugagcccauugcccgacau

SEQ ID NO: 119940 - RNA, 20 nt, Artificial Sequence
  MKO10119940_B_Tacstd2
  gRNA
caacgauggccucuacgacc

SEQ ID NO: 119941 - RNA, 20 nt, Artificial Sequence
  MKO10119941_B_Tacstd2
  gRNA
gccggcggugaggcgcuuca

SEQ ID NO: 119942 - RNA, 20 nt, Artificial Sequence
  MKO10119942_B_Tada1
  gRNA
acugggccaaccugaaguug

SEQ ID NO: 119943 - RNA, 20 nt, Artificial Sequence
  MKO10119943_B_Tada1
  gRNA
ccucacacguugucagauuu

SEQ ID NO: 119944 - RNA, 20 nt, Artificial Sequence
  MKO10119944_B_Tada1
  gRNA
ucugcuugaaccacaacuuc

SEQ ID NO: 119945 - RNA, 20 nt, Artificial Sequence
  MKO10119945_B_Tada2a
  gRNA
ucuucacaguguuucacucg

SEQ ID NO: 119946 - RNA, 20 nt, Artificial Sequence
  MKO10119946_B_Tada2a
  gRNA
agggaguuaccuguaaacac

SEQ ID NO: 119947 - RNA, 20 nt, Artificial Sequence
  MKO10119947_B_Tada2a
  gRNA
aguccauuacagcuucuaaa

SEQ ID NO: 119948 - RNA, 20 nt, Artificial Sequence
  MKO10119948_B_Tada2b
  gRNA
augccgagacgcucaucagu

SEQ ID NO: 119949 - RNA, 20 nt, Artificial Sequence
  MKO10119949_B_Tada2b
  gRNA
gccaucgagcaguucggcuu

SEQ ID NO: 119950 - RNA, 20 nt, Artificial Sequence
  MKO10119950_B_Tada2b
  gRNA
aucguccgccgucuaccagc

SEQ ID NO: 119951 - RNA, 20 nt, Artificial Sequence
  MKO10119951_B_Tada3
  gRNA
gcugggaguaguguuucccu

SEQ ID NO: 119952 - RNA, 20 nt, Artificial Sequence
  MKO10119952_B_Tada3
  gRNA
cgcugugucagggcuccaaa

SEQ ID NO: 119953 - RNA, 20 nt, Artificial Sequence
  MKO10119953_B_Tada3
  gRNA
uugugccgacaucaccagug

SEQ ID NO: 119954 - RNA, 20 nt, Artificial Sequence
  MKO10119954_B_Taf10
  gRNA
cagaucccagaugcagugac

SEQ ID NO: 119955 - RNA, 20 nt, Artificial Sequence
  MKO10119955_B_Taf10
  gRNA
cugaagcuucaaagccagcg

SEQ ID NO: 119956 - RNA, 20 nt, Artificial Sequence
  MKO10119956_B_Taf10
  gRNA
ccuacagcacugcaaaauga

SEQ ID NO: 119957 - RNA, 20 nt, Artificial Sequence
  MKO10119957_B_Taf11
  gRNA
gccccuuggacuucaaccuc

SEQ ID NO: 119958 - RNA, 20 nt, Artificial Sequence
  MKO10119958_B_Taf11
  gRNA
cagauguaacagcagccgag

SEQ ID NO: 119959 - RNA, 20 nt, Artificial Sequence
  MKO10119959_B_Taf11
  gRNA
aaagcugaaacuagacauua

SEQ ID NO: 119960 - RNA, 20 nt, Artificial Sequence
  MKO10119960_B_Taf12
  gRNA
aguagauccuaaugagcagc

SEQ ID NO: 119961 - RNA, 20 nt, Artificial Sequence
  MKO10119961_B_Taf12
  gRNA
cagagcgccaguggaacaug

SEQ ID NO: 119962 - RNA, 20 nt, Artificial Sequence
  MKO10119962_B_Taf12
  gRNA
caaaaaagcauguaccacag

SEQ ID NO: 119963 - RNA, 20 nt, Artificial Sequence
  MKO10119963_B_Taf13
  gRNA
aaagucucuuucucuucccc

SEQ ID NO: 119964 - RNA, 20 nt, Artificial Sequence
  MKO10119964_B_Taf13
  gRNA
gaggaggagaaugaagaaau

SEQ ID NO: 119965 - RNA, 20 nt, Artificial Sequence
  MKO10119965_B_Taf13
  gRNA
acggugucaagauccauagu

SEQ ID NO: 119966 - RNA, 20 nt, Artificial Sequence
  MKO10119966_B_Taf15
  gRNA
caaaacuauggugguuacuc

SEQ ID NO: 119967 - RNA, 20 nt, Artificial Sequence
  MKO10119967_B_Taf15
  gRNA
ucuggaaguuacagucaguc

SEQ ID NO: 119968 - RNA, 20 nt, Artificial Sequence
  MKO10119968_B_Taf15
  gRNA
aaucaaggcagucaaggcua

SEQ ID NO: 119969 - RNA, 20 nt, Artificial Sequence
  MKO10119969_B_Taf1a
  gRNA
cucagacaccgacaagagac

SEQ ID NO: 119970 - RNA, 20 nt, Artificial Sequence
  MKO10119970_B_Taf1a
  gRNA
cacaagcacguugaagcugu

SEQ ID NO: 119971 - RNA, 20 nt, Artificial Sequence
  MKO10119971_B_Taf1a
  gRNA
gcacaguuaccugcagaccc

SEQ ID NO: 119972 - RNA, 20 nt, Artificial Sequence
  MKO10119972_B_Taf1b
  gRNA
cuaccuucagaagagcaaac

SEQ ID NO: 119973 - RNA, 20 nt, Artificial Sequence
  MKO10119973_B_Taf1b
  gRNA
aggccuguuugcucuucuga

SEQ ID NO: 119974 - RNA, 20 nt, Artificial Sequence
  MKO10119974_B_Taf1b
  gRNA
cugucucagcccccuguuga

SEQ ID NO: 119975 - RNA, 20 nt, Artificial Sequence
  MKO10119975_B_Taf1c
  gRNA
cagcgcgaagaagcugcuuc

SEQ ID NO: 119976 - RNA, 20 nt, Artificial Sequence
  MKO10119976_B_Taf1c
  gRNA
ccuuugccaagaaccuacug

SEQ ID NO: 119977 - RNA, 20 nt, Artificial Sequence
  MKO10119977_B_Taf1c
  gRNA
acugguagcagugaccuccc

SEQ ID NO: 119978 - RNA, 20 nt, Artificial Sequence
  MKO10119978_B_Taf1d
  gRNA
acuuacaauggcucuucaau

SEQ ID NO: 119979 - RNA, 20 nt, Artificial Sequence
  MKO10119979_B_Taf1d
  gRNA
gugacucuucuauagaacca

SEQ ID NO: 119980 - RNA, 20 nt, Artificial Sequence
  MKO10119980_B_Taf1d
  gRNA
agaugaagcaacaaauccuc

SEQ ID NO: 119981 - RNA, 20 nt, Artificial Sequence
  MKO10119981_B_Taf1
  gRNA
aaggaccaagaugauauuac

SEQ ID NO: 119982 - RNA, 20 nt, Artificial Sequence
  MKO10119982_B_Taf1
  gRNA
uaccaccaguaauaucaucu

SEQ ID NO: 119983 - RNA, 20 nt, Artificial Sequence
  MKO10119983_B_Taf1
  gRNA
gcaagcuucccauugucugc

SEQ ID NO: 119984 - RNA, 20 nt, Artificial Sequence
  MKO10119984_B_Taf2
  gRNA
cuuccagcgaaaaucaguug

SEQ ID NO: 119985 - RNA, 20 nt, Artificial Sequence
  MKO10119985_B_Taf2
  gRNA
gagcucuggaaacaugucga

SEQ ID NO: 119986 - RNA, 20 nt, Artificial Sequence
  MKO10119986_B_Taf2
  gRNA
uguugauacagacgaccuga

SEQ ID NO: 119987 - RNA, 20 nt, Artificial Sequence
  MKO10119987_B_Taf3
  gRNA
gcgggcuuagccuccggggc

SEQ ID NO: 119988 - RNA, 20 nt, Artificial Sequence
  MKO10119988_B_Taf3
  gRNA
uggccgaacagaccccauuu

SEQ ID NO: 119989 - RNA, 20 nt, Artificial Sequence
  MKO10119989_B_Taf3
  gRNA
ccccaaguccaguuaucccc

SEQ ID NO: 119990 - RNA, 20 nt, Artificial Sequence
  MKO10119990_B_Taf4a
  gRNA
gccccagggacuguucguug

SEQ ID NO: 119991 - RNA, 20 nt, Artificial Sequence
  MKO10119991_B_Taf4a
  gRNA
caggaacaccuauuauugca

SEQ ID NO: 119992 - RNA, 20 nt, Artificial Sequence
  MKO10119992_B_Taf4a
  gRNA
ucuuaccguggcagcuguag

SEQ ID NO: 119993 - RNA, 20 nt, Artificial Sequence
  MKO10119993_B_Taf4b
  gRNA
uacuuguccugaggaaguac

SEQ ID NO: 119994 - RNA, 20 nt, Artificial Sequence
  MKO10119994_B_Taf4b
  gRNA
aguaaagaucuguacagugc

SEQ ID NO: 119995 - RNA, 20 nt, Artificial Sequence
  MKO10119995_B_Taf4b
  gRNA
uuaauaaaacuagcauguag

SEQ ID NO: 119996 - RNA, 20 nt, Artificial Sequence
  MKO10119996_B_Taf5l
  gRNA
uggggcugcagacaccgcau

SEQ ID NO: 119997 - RNA, 20 nt, Artificial Sequence
  MKO10119997_B_Taf5l
  gRNA
uguccugcuaccucaaacgc

SEQ ID NO: 119998 - RNA, 20 nt, Artificial Sequence
  MKO10119998_B_Taf5l
  gRNA
caccggugagaaagcuccuc

SEQ ID NO: 119999 - RNA, 20 nt, Artificial Sequence
  MKO10119999_B_Taf5
  gRNA
guugggauaacucugcucga

SEQ ID NO: 120000 - RNA, 20 nt, Artificial Sequence
  MKO10120000_B_Taf5
  gRNA
acuaccaaacgagugcgccu

SEQ ID NO: 120001 - RNA, 20 nt, Artificial Sequence
  MKO10120001_B_Taf5
  gRNA
ccaaugccccgccucaaaac

SEQ ID NO: 120002 - RNA, 20 nt, Artificial Sequence
  MKO10120002_B_Taf6l
  gRNA
ucuagagcugagugacgagg

SEQ ID NO: 120003 - RNA, 20 nt, Artificial Sequence
  MKO10120003_B_Taf6l
  gRNA
caccgucagcuuccuucguu

SEQ ID NO: 120004 - RNA, 20 nt, Artificial Sequence
  MKO10120004_B_Taf6l
  gRNA
ucucagguggagcagcgugg

SEQ ID NO: 120005 - RNA, 20 nt, Artificial Sequence
  MKO10120005_B_Taf6
  gRNA
aucccuuuccgguuugccuc

SEQ ID NO: 120006 - RNA, 20 nt, Artificial Sequence
  MKO10120006_B_Taf6
  gRNA
caaugcauagucaaugucac

SEQ ID NO: 120007 - RNA, 20 nt, Artificial Sequence
  MKO10120007_B_Taf6
  gRNA
ugcauugaaguuaaagaaug

SEQ ID NO: 120008 - RNA, 20 nt, Artificial Sequence
  MKO10120008_B_Taf7l
  gRNA
gaagaaccaguugucucuac

SEQ ID NO: 120009 - RNA, 20 nt, Artificial Sequence
  MKO10120009_B_Taf7l
  gRNA
ggagaaugaggcucaccuuc

SEQ ID NO: 120010 - RNA, 20 nt, Artificial Sequence
  MKO10120010_B_Taf7l
  gRNA
aggaacaagcuuaugcuguc

SEQ ID NO: 120011 - RNA, 20 nt, Artificial Sequence
  MKO10120011_B_Taf7
  gRNA
cagaagcugucaguacucgu

SEQ ID NO: 120012 - RNA, 20 nt, Artificial Sequence
  MKO10120012_B_Taf7
  gRNA
cacugcccuccucaccguag

SEQ ID NO: 120013 - RNA, 20 nt, Artificial Sequence
  MKO10120013_B_Taf7
  gRNA
gcccccagaauaugccgcua

SEQ ID NO: 120014 - RNA, 20 nt, Artificial Sequence
  MKO10120014_B_Taf8
  gRNA
ccgguucugcccugcaguga

SEQ ID NO: 120015 - RNA, 20 nt, Artificial Sequence
  MKO10120015_B_Taf8
  gRNA
ugucuccacagacgcuuucu

SEQ ID NO: 120016 - RNA, 20 nt, Artificial Sequence
  MKO10120016_B_Taf8
  gRNA
cucuaccugccuaugcaaaa

SEQ ID NO: 120017 - RNA, 20 nt, Artificial Sequence
  MKO10120017_B_Taf9b
  gRNA
guucuugauaggcgccaucu

SEQ ID NO: 120018 - RNA, 20 nt, Artificial Sequence
  MKO10120018_B_Taf9b
  gRNA
aggacuggucagcccgacac

SEQ ID NO: 120019 - RNA, 20 nt, Artificial Sequence
  MKO10120019_B_Taf9b
  gRNA
ggcagucuggguccugcaua

SEQ ID NO: 120020 - RNA, 20 nt, Artificial Sequence
  MKO10120020_B_Taf9
  gRNA
uuucagugcauuugcugacu

SEQ ID NO: 120021 - RNA, 20 nt, Artificial Sequence
  MKO10120021_B_Taf9
  gRNA
uaucauggagucuggcaaga

SEQ ID NO: 120022 - RNA, 20 nt, Artificial Sequence
  MKO10120022_B_Taf9
  gRNA
aaagacuuaagccuauaguu

SEQ ID NO: 120023 - RNA, 20 nt, Artificial Sequence
  MKO10120023_B_Tagap1
  gRNA
ucuccagcgucugcaccagc

SEQ ID NO: 120024 - RNA, 20 nt, Artificial Sequence
  MKO10120024_B_Tagap1
  gRNA
uuuaaaggcugaacucagag

SEQ ID NO: 120025 - RNA, 20 nt, Artificial Sequence
  MKO10120025_B_Tagap1
  gRNA
agaagaacaagaaaaaguag

SEQ ID NO: 120026 - RNA, 20 nt, Artificial Sequence
  MKO10120026_B_Tagap
  gRNA
cacaccuaccuggauggguc

SEQ ID NO: 120027 - RNA, 20 nt, Artificial Sequence
  MKO10120027_B_Tagap
  gRNA
cacucucacaugaugucagc

SEQ ID NO: 120028 - RNA, 20 nt, Artificial Sequence
  MKO10120028_B_Tagap
  gRNA
gacagcauuugccagcuaac

SEQ ID NO: 120029 - RNA, 20 nt, Artificial Sequence
  MKO10120029_B_Tagln2
  gRNA
gcagcggacacuaaugaacc

SEQ ID NO: 120030 - RNA, 20 nt, Artificial Sequence
  MKO10120030_B_Tagln2
  gRNA
gaacgugauuggguugcaga

SEQ ID NO: 120031 - RNA, 20 nt, Artificial Sequence
  MKO10120031_B_Tagln2
  gRNA
gccguaggaagguccccugu

SEQ ID NO: 120032 - RNA, 20 nt, Artificial Sequence
  MKO10120032_B_Tagln3
  gRNA
ugacgggguacgggaugccc

SEQ ID NO: 120033 - RNA, 20 nt, Artificial Sequence
  MKO10120033_B_Tagln3
  gRNA
cauagaccucggcagcuuuc

SEQ ID NO: 120034 - RNA, 20 nt, Artificial Sequence
  MKO10120034_B_Tagln3
  gRNA
gcuaccggggagagccaucc

SEQ ID NO: 120035 - RNA, 20 nt, Artificial Sequence
  MKO10120035_B_Tagln
  gRNA
aagcccaggcgcccacgauc

SEQ ID NO: 120036 - RNA, 20 nt, Artificial Sequence
  MKO10120036_B_Tagln
  gRNA
gcacgucauuggccuucaaa

SEQ ID NO: 120037 - RNA, 20 nt, Artificial Sequence
  MKO10120037_B_Tagln
  gRNA
ugagggaucgaagccaguga

SEQ ID NO: 120038 - RNA, 20 nt, Artificial Sequence
  MKO10120038_B_Tal1
  gRNA
ucugcugccgccaucguucc

SEQ ID NO: 120039 - RNA, 20 nt, Artificial Sequence
  MKO10120039_B_Tal1
  gRNA
gaggcccuccccauaugaga

SEQ ID NO: 120040 - RNA, 20 nt, Artificial Sequence
  MKO10120040_B_Tal1
  gRNA
ccucuucacccgguuguugu

SEQ ID NO: 120041 - RNA, 20 nt, Artificial Sequence
  MKO10120041_B_Tal2
  gRNA
aaugagguauaucaacuucu

SEQ ID NO: 120042 - RNA, 20 nt, Artificial Sequence
  MKO10120042_B_Tal2
  gRNA
ccaagccacggggcucccua

SEQ ID NO: 120043 - RNA, 20 nt, Artificial Sequence
  MKO10120043_B_Tal2
  gRNA
aaagacccgccugccagaug

SEQ ID NO: 120044 - RNA, 20 nt, Artificial Sequence
  MKO10120044_B_Taldo1
  gRNA
aucgagcuuuacaaagaagc

SEQ ID NO: 120045 - RNA, 20 nt, Artificial Sequence
  MKO10120045_B_Taldo1
  gRNA
acaccuugcaucaacuucug

SEQ ID NO: 120046 - RNA, 20 nt, Artificial Sequence
  MKO10120046_B_Taldo1
  gRNA
caccaacccaucccugaucc

SEQ ID NO: 120047 - RNA, 20 nt, Artificial Sequence
  MKO10120047_B_Tamm41
  gRNA
gaccuguucauagagauagc

SEQ ID NO: 120048 - RNA, 20 nt, Artificial Sequence
  MKO10120048_B_Tamm41
  gRNA
uauauagguuauuccaguuc

SEQ ID NO: 120049 - RNA, 20 nt, Artificial Sequence
  MKO10120049_B_Tamm41
  gRNA
ccuucccgucacaccugauc

SEQ ID NO: 120050 - RNA, 20 nt, Artificial Sequence
  MKO10120050_B_Tanc1
  gRNA
aagggcugaugccuugacuc

SEQ ID NO: 120051 - RNA, 20 nt, Artificial Sequence
  MKO10120051_B_Tanc1
  gRNA
acgauaaguguccucuguug

SEQ ID NO: 120052 - RNA, 20 nt, Artificial Sequence
  MKO10120052_B_Tanc1
  gRNA
uaucgugugagcuuggccaa

SEQ ID NO: 120053 - RNA, 20 nt, Artificial Sequence
  MKO10120053_B_Tanc2
  gRNA
agugguggaacagcauaguc

SEQ ID NO: 120054 - RNA, 20 nt, Artificial Sequence
  MKO10120054_B_Tanc2
  gRNA
agccccauagcuacaguccu

SEQ ID NO: 120055 - RNA, 20 nt, Artificial Sequence
  MKO10120055_B_Tanc2
  gRNA
gcugcauuuguacugacugg

SEQ ID NO: 120056 - RNA, 20 nt, Artificial Sequence
  MKO10120056_B_Tango2
  gRNA
cguccaaguuggcagacuuc

SEQ ID NO: 120057 - RNA, 20 nt, Artificial Sequence
  MKO10120057_B_Tango2
  gRNA
ucuauucacagcacgucaaa

SEQ ID NO: 120058 - RNA, 20 nt, Artificial Sequence
  MKO10120058_B_Tango2
  gRNA
gagccuauugucuugacacc

SEQ ID NO: 120059 - RNA, 20 nt, Artificial Sequence
  MKO10120059_B_Tango6
  gRNA
cugcaggguccuucucgacc

SEQ ID NO: 120060 - RNA, 20 nt, Artificial Sequence
  MKO10120060_B_Tango6
  gRNA
auugaaaucagcuacgaggc

SEQ ID NO: 120061 - RNA, 20 nt, Artificial Sequence
  MKO10120061_B_Tango6
  gRNA
caugugacagcgggcgcggc

SEQ ID NO: 120062 - RNA, 20 nt, Artificial Sequence
  MKO10120062_B_Tank
  gRNA
gugauuucagccugucaauu

SEQ ID NO: 120063 - RNA, 20 nt, Artificial Sequence
  MKO10120063_B_Tank
  gRNA
ugucuugcagauaacaguua

SEQ ID NO: 120064 - RNA, 20 nt, Artificial Sequence
  MKO10120064_B_Tank
  gRNA
ccuaguuucacuuuaucaug

SEQ ID NO: 120065 - RNA, 20 nt, Artificial Sequence
  MKO10120065_B_Taok1
  gRNA
auuuacgugaacacacagca

SEQ ID NO: 120066 - RNA, 20 nt, Artificial Sequence
  MKO10120066_B_Taok1
  gRNA
agaugugcguacuaaugaag

SEQ ID NO: 120067 - RNA, 20 nt, Artificial Sequence
  MKO10120067_B_Taok1
  gRNA
gaaauggcaggauauuauua

SEQ ID NO: 120068 - RNA, 20 nt, Artificial Sequence
  MKO10120068_B_Taok2
  gRNA
auccuaauaccauucaguac

SEQ ID NO: 120069 - RNA, 20 nt, Artificial Sequence
  MKO10120069_B_Taok2
  gRNA
gcuggugauggaguauugcc

SEQ ID NO: 120070 - RNA, 20 nt, Artificial Sequence
  MKO10120070_B_Taok2
  gRNA
cuggggccaucaugccagcu

SEQ ID NO: 120071 - RNA, 20 nt, Artificial Sequence
  MKO10120071_B_Taok3
  gRNA
gagaucgcugcuaucaccca

SEQ ID NO: 120072 - RNA, 20 nt, Artificial Sequence
  MKO10120072_B_Taok3
  gRNA
cuuaacagcgaccaccucgu

SEQ ID NO: 120073 - RNA, 20 nt, Artificial Sequence
  MKO10120073_B_Taok3
  gRNA
acuuucacucccugauucac

SEQ ID NO: 120074 - RNA, 20 nt, Artificial Sequence
  MKO10120074_B_Tap1
  gRNA
cuagcuucacccgcaacaua

SEQ ID NO: 120075 - RNA, 20 nt, Artificial Sequence
  MKO10120075_B_Tap1
  gRNA
gccguccuucgccaggagac

SEQ ID NO: 120076 - RNA, 20 nt, Artificial Sequence
  MKO10120076_B_Tap1
  gRNA
aacgugugcgaguccauuag

SEQ ID NO: 120077 - RNA, 20 nt, Artificial Sequence
  MKO10120077_B_Tap2
  gRNA
aaagcugcucucguauccgc

SEQ ID NO: 120078 - RNA, 20 nt, Artificial Sequence
  MKO10120078_B_Tap2
  gRNA
ugcacacauaccugauggcg

SEQ ID NO: 120079 - RNA, 20 nt, Artificial Sequence
  MKO10120079_B_Tap2
  gRNA
gcgcaccaccugccccgccu

SEQ ID NO: 120080 - RNA, 20 nt, Artificial Sequence
  MKO10120080_B_Tapbpl
  gRNA
auuuggcaaaacccucaugc

SEQ ID NO: 120081 - RNA, 20 nt, Artificial Sequence
  MKO10120081_B_Tapbpl
  gRNA
gcagucuaagaugauguccg

SEQ ID NO: 120082 - RNA, 20 nt, Artificial Sequence
  MKO10120082_B_Tapbpl
  gRNA
gccgccacuccacgccagug

SEQ ID NO: 120083 - RNA, 20 nt, Artificial Sequence
  MKO10120083_B_Tapbp
  gRNA
gccuucaggcgguaccccgc

SEQ ID NO: 120084 - RNA, 20 nt, Artificial Sequence
  MKO10120084_B_Tapbp
  gRNA
accauccgccaccauuccga

SEQ ID NO: 120085 - RNA, 20 nt, Artificial Sequence
  MKO10120085_B_Tapbp
  gRNA
cgccuacgcacccuccgccc

SEQ ID NO: 120086 - RNA, 20 nt, Artificial Sequence
  MKO10120086_B_Tapt1
  gRNA
uaugcgaauaccaagagaau

SEQ ID NO: 120087 - RNA, 20 nt, Artificial Sequence
  MKO10120087_B_Tapt1
  gRNA
agcgccagaaagacucuuaa

SEQ ID NO: 120088 - RNA, 20 nt, Artificial Sequence
  MKO10120088_B_Tapt1
  gRNA
acuuaccuuaagccauagca

SEQ ID NO: 120089 - RNA, 20 nt, Artificial Sequence
  MKO10120089_B_Tarbp2
  gRNA
gcacaccugcagagcaccga

SEQ ID NO: 120090 - RNA, 20 nt, Artificial Sequence
  MKO10120090_B_Tarbp2
  gRNA
uaccugguuaguacagcaga

SEQ ID NO: 120091 - RNA, 20 nt, Artificial Sequence
  MKO10120091_B_Tarbp2
  gRNA
aaggagcugguggugcaaaa

SEQ ID NO: 120092 - RNA, 20 nt, Artificial Sequence
  MKO10120092_B_Tardbp
  gRNA
guugugacauuacuuucacu

SEQ ID NO: 120093 - RNA, 20 nt, Artificial Sequence
  MKO10120093_B_Tardbp
  gRNA
auauaccuuaucaucugcaa

SEQ ID NO: 120094 - RNA, 20 nt, Artificial Sequence
  MKO10120094_B_Tardbp
  gRNA
ccccuggaaaacaacugagc

SEQ ID NO: 120095 - RNA, 20 nt, Artificial Sequence
  MKO10120095_B_Tarm1
  gRNA
cguaaaguuugcguuacuga

SEQ ID NO: 120096 - RNA, 20 nt, Artificial Sequence
  MKO10120096_B_Tarm1
  gRNA
ggugagguugcugucaguug

SEQ ID NO: 120097 - RNA, 20 nt, Artificial Sequence
  MKO10120097_B_Tarm1
  gRNA
gucgaggcagcaagaucuug

SEQ ID NO: 120098 - RNA, 20 nt, Artificial Sequence
  MKO10120098_B_Tars2
  gRNA
cuuuaagcuucaucugaucg

SEQ ID NO: 120099 - RNA, 20 nt, Artificial Sequence
  MKO10120099_B_Tars2
  gRNA
gaagugauaucuuaauagcc

SEQ ID NO: 120100 - RNA, 20 nt, Artificial Sequence
  MKO10120100_B_Tars2
  gRNA
aaauggagaacuuuacgauc

SEQ ID NO: 120101 - RNA, 20 nt, Artificial Sequence
  MKO10120101_B_Tarsl2
  gRNA
cagcgacuuaccucccggcc

SEQ ID NO: 120102 - RNA, 20 nt, Artificial Sequence
  MKO10120102_B_Tarsl2
  gRNA
cucccccaggaugugagcgc

SEQ ID NO: 120103 - RNA, 20 nt, Artificial Sequence
  MKO10120103_B_Tarsl2
  gRNA
gccuccauaguaaaguucca

SEQ ID NO: 120104 - RNA, 20 nt, Artificial Sequence
  MKO10120104_B_Tars
  gRNA
ugacaacaccguuguugcua

SEQ ID NO: 120105 - RNA, 20 nt, Artificial Sequence
  MKO10120105_B_Tars
  gRNA
agcagaacacgauucuaucc

SEQ ID NO: 120106 - RNA, 20 nt, Artificial Sequence
  MKO10120106_B_Tars
  gRNA
ucuucagguggaugccagcg

SEQ ID NO: 120107 - RNA, 20 nt, Artificial Sequence
  MKO10120107_B_Tas1r1
  gRNA
gccgcacuaugacuuccacc

SEQ ID NO: 120108 - RNA, 20 nt, Artificial Sequence
  MKO10120108_B_Tas1r1
  gRNA
guuauuaugacaucaucgcc

SEQ ID NO: 120109 - RNA, 20 nt, Artificial Sequence
  MKO10120109_B_Tas1r1
  gRNA
cuugcugggcgagcacccuc

SEQ ID NO: 120110 - RNA, 20 nt, Artificial Sequence
  MKO10120110_B_Tas1r2
  gRNA
cuggugagcgaugacgauua

SEQ ID NO: 120111 - RNA, 20 nt, Artificial Sequence
  MKO10120111_B_Tas1r2
  gRNA
cuuguucgucgaagaagagc

SEQ ID NO: 120112 - RNA, 20 nt, Artificial Sequence
  MKO10120112_B_Tas1r2
  gRNA
ccuacucccccaccgagacg

SEQ ID NO: 120113 - RNA, 20 nt, Artificial Sequence
  MKO10120113_B_Tas1r3
  gRNA
acuucccaauauugcccgug

SEQ ID NO: 120114 - RNA, 20 nt, Artificial Sequence
  MKO10120114_B_Tas1r3
  gRNA
acaguaccaaccccgugugc

SEQ ID NO: 120115 - RNA, 20 nt, Artificial Sequence
  MKO10120115_B_Tas1r3
  gRNA
uacaccuguauuacauacug

SEQ ID NO: 120116 - RNA, 20 nt, Artificial Sequence
  MKO10120116_B_Tas2r102
  gRNA
cauaguguugucaaacuucu

SEQ ID NO: 120117 - RNA, 20 nt, Artificial Sequence
  MKO10120117_B_Tas2r102
  gRNA
ugagcaaugaccuugcaaug

SEQ ID NO: 120118 - RNA, 20 nt, Artificial Sequence
  MKO10120118_B_Tas2r102
  gRNA
ucagaauagcuaacugcucc

SEQ ID NO: 120119 - RNA, 20 nt, Artificial Sequence
  MKO10120119_B_Tas2r103
  gRNA
auugauaacuauuauaaguc

SEQ ID NO: 120120 - RNA, 20 nt, Artificial Sequence
  MKO10120120_B_Tas2r103
  gRNA
ugaccaaucauuucaguguc

SEQ ID NO: 120121 - RNA, 20 nt, Artificial Sequence
  MKO10120121_B_Tas2r103
  gRNA
uguuacuuguacuacaguuc

SEQ ID NO: 120122 - RNA, 20 nt, Artificial Sequence
  MKO10120122_B_Tas2r104
  gRNA
agcaggcagaugcaauccau

SEQ ID NO: 120123 - RNA, 20 nt, Artificial Sequence
  MKO10120123_B_Tas2r104
  gRNA
aucuaaaguuauuauccaua

SEQ ID NO: 120124 - RNA, 20 nt, Artificial Sequence
  MKO10120124_B_Tas2r104
  gRNA
uaaguaacucacucuucucc

SEQ ID NO: 120125 - RNA, 20 nt, Artificial Sequence
  MKO10120125_B_Tas2r105
  gRNA
cccagcuucaacaguugcaa

SEQ ID NO: 120126 - RNA, 20 nt, Artificial Sequence
  MKO10120126_B_Tas2r105
  gRNA
cuauaaaauacaagacgaaa

SEQ ID NO: 120127 - RNA, 20 nt, Artificial Sequence
  MKO10120127_B_Tas2r105
  gRNA
ugguggcaaaccagacaguc

SEQ ID NO: 120128 - RNA, 20 nt, Artificial Sequence
  MKO10120128_B_Tas2r106
  gRNA
cuaugaaaugcaagauuaac

SEQ ID NO: 120129 - RNA, 20 nt, Artificial Sequence
  MKO10120129_B_Tas2r106
  gRNA
uaaagaagaauauaacuccc

SEQ ID NO: 120130 - RNA, 20 nt, Artificial Sequence
  MKO10120130_B_Tas2r106
  gRNA
uuaucaaucauacaaguaua

SEQ ID NO: 120131 - RNA, 20 nt, Artificial Sequence
  MKO10120131_B_Tas2r107
  gRNA
ccucacuagugacaacacaa

SEQ ID NO: 120132 - RNA, 20 nt, Artificial Sequence
  MKO10120132_B_Tas2r107
  gRNA
uaaccaaagugugaccaauc

SEQ ID NO: 120133 - RNA, 20 nt, Artificial Sequence
  MKO10120133_B_Tas2r107
  gRNA
uucucaaucacuuaaguguc

SEQ ID NO: 120134 - RNA, 20 nt, Artificial Sequence
  MKO10120134_B_Tas2r108
  gRNA
cuugacguuaguagccucuu

SEQ ID NO: 120135 - RNA, 20 nt, Artificial Sequence
  MKO10120135_B_Tas2r108
  gRNA
uagugauggccaagcugaac

SEQ ID NO: 120136 - RNA, 20 nt, Artificial Sequence
  MKO10120136_B_Tas2r108
  gRNA
agcaggguagcaauugaaua

SEQ ID NO: 120137 - RNA, 20 nt, Artificial Sequence
  MKO10120137_B_Tas2r109
  gRNA
cuacuagcaugaaccagagc

SEQ ID NO: 120138 - RNA, 20 nt, Artificial Sequence
  MKO10120138_B_Tas2r109
  gRNA
agucuaguaguaacuaaaua

SEQ ID NO: 120139 - RNA, 20 nt, Artificial Sequence
  MKO10120139_B_Tas2r109
  gRNA
uaauaaaauccucaccgcuu

SEQ ID NO: 120140 - RNA, 20 nt, Artificial Sequence
  MKO10120140_B_Tas2r110
  gRNA
cacauuaaagccuugcaaac

SEQ ID NO: 120141 - RNA, 20 nt, Artificial Sequence
  MKO10120141_B_Tas2r110
  gRNA
cauagcacuagugaauauca

SEQ ID NO: 120142 - RNA, 20 nt, Artificial Sequence
  MKO10120142_B_Tas2r110
  gRNA
cauacaugcuuagagauaac

SEQ ID NO: 120143 - RNA, 20 nt, Artificial Sequence
  MKO10120143_B_Tas2r113
  gRNA
uacccagcauuacacgaaac

SEQ ID NO: 120144 - RNA, 20 nt, Artificial Sequence
  MKO10120144_B_Tas2r113
  gRNA
aauaugcagcacaccgccaa

SEQ ID NO: 120145 - RNA, 20 nt, Artificial Sequence
  MKO10120145_B_Tas2r113
  gRNA
uuaccaguuucguguaaugc

SEQ ID NO: 120146 - RNA, 20 nt, Artificial Sequence
  MKO10120146_B_Tas2r114
  gRNA
augagcucaauuauguugac

SEQ ID NO: 120147 - RNA, 20 nt, Artificial Sequence
  MKO10120147_B_Tas2r114
  gRNA
agauaagcaagcacccuauc

SEQ ID NO: 120148 - RNA, 20 nt, Artificial Sequence
  MKO10120148_B_Tas2r114
  gRNA
cauugcacuuguaaacugua

SEQ ID NO: 120149 - RNA, 20 nt, Artificial Sequence
  MKO10120149_B_Tas2r115
  gRNA
uacaauggucuaugaaucca

SEQ ID NO: 120150 - RNA, 20 nt, Artificial Sequence
  MKO10120150_B_Tas2r115
  gRNA
gugcaagcgugagaaaaccu

SEQ ID NO: 120151 - RNA, 20 nt, Artificial Sequence
  MKO10120151_B_Tas2r115
  gRNA
acuugcuuucaguacugaag

SEQ ID NO: 120152 - RNA, 20 nt, Artificial Sequence
  MKO10120152_B_Tas2r116
  gRNA
cuaucagucauccauugucc

SEQ ID NO: 120153 - RNA, 20 nt, Artificial Sequence
  MKO10120153_B_Tas2r116
  gRNA
uaaccacagcagugcaauuc

SEQ ID NO: 120154 - RNA, 20 nt, Artificial Sequence
  MKO10120154_B_Tas2r116
  gRNA
ucuuagcauugcccagaauc

SEQ ID NO: 120155 - RNA, 20 nt, Artificial Sequence
  MKO10120155_B_Tas2r117
  gRNA
aaaugacugaaagugugcuc

SEQ ID NO: 120156 - RNA, 20 nt, Artificial Sequence
  MKO10120156_B_Tas2r117
  gRNA
auauucauuuguccacaugu

SEQ ID NO: 120157 - RNA, 20 nt, Artificial Sequence
  MKO10120157_B_Tas2r117
  gRNA
uagccaaccauuucagcauc

SEQ ID NO: 120158 - RNA, 20 nt, Artificial Sequence
  MKO10120158_B_Tas2r118
  gRNA
cuagggugacuaauuccauc

SEQ ID NO: 120159 - RNA, 20 nt, Artificial Sequence
  MKO10120159_B_Tas2r118
  gRNA
uauuccuuucuucguguucc

SEQ ID NO: 120160 - RNA, 20 nt, Artificial Sequence
  MKO10120160_B_Tas2r118
  gRNA
caucuuacucacagucucau

SEQ ID NO: 120161 - RNA, 20 nt, Artificial Sequence
  MKO10120161_B_Tas2r119
  gRNA
aauuaagacaaucgagugua

SEQ ID NO: 120162 - RNA, 20 nt, Artificial Sequence
  MKO10120162_B_Tas2r119
  gRNA
uaacgugugucucaccaaac

SEQ ID NO: 120163 - RNA, 20 nt, Artificial Sequence
  MKO10120163_B_Tas2r119
  gRNA
cugacgagggcaugucugcu

SEQ ID NO: 120164 - RNA, 20 nt, Artificial Sequence
  MKO10120164_B_Tas2r120
  gRNA
cugauaaacauuguaccauu

SEQ ID NO: 120165 - RNA, 20 nt, Artificial Sequence
  MKO10120165_B_Tas2r120
  gRNA
uccccagccaagugguaaaa

SEQ ID NO: 120166 - RNA, 20 nt, Artificial Sequence
  MKO10120166_B_Tas2r120
  gRNA
uauucuugagauguuuacuc

SEQ ID NO: 120167 - RNA, 20 nt, Artificial Sequence
  MKO10120167_B_Tas2r121
  gRNA
aauagccaguuucuccaaac

SEQ ID NO: 120168 - RNA, 20 nt, Artificial Sequence
  MKO10120168_B_Tas2r121
  gRNA
auuuaaggcaagccagucuu

SEQ ID NO: 120169 - RNA, 20 nt, Artificial Sequence
  MKO10120169_B_Tas2r121
  gRNA
ugcugauaaacugcauugau

SEQ ID NO: 120170 - RNA, 20 nt, Artificial Sequence
  MKO10120170_B_Tas2r122
  gRNA
ccuuaggaggaugaaacuac

SEQ ID NO: 120171 - RNA, 20 nt, Artificial Sequence
  MKO10120171_B_Tas2r122
  gRNA
ccagcuuucucaauacaugc

SEQ ID NO: 120172 - RNA, 20 nt, Artificial Sequence
  MKO10120172_B_Tas2r122
  gRNA
uagcaacauuaugcuuauug

SEQ ID NO: 120173 - RNA, 20 nt, Artificial Sequence
  MKO10120173_B_Tas2r123
  gRNA
uucucaauugcugcuuaugu

SEQ ID NO: 120174 - RNA, 20 nt, Artificial Sequence
  MKO10120174_B_Tas2r123
  gRNA
ccacucauuuguacugauuc

SEQ ID NO: 120175 - RNA, 20 nt, Artificial Sequence
  MKO10120175_B_Tas2r123
  gRNA
uaguaagccagaugcuaaaa

SEQ ID NO: 120176 - RNA, 20 nt, Artificial Sequence
  MKO10120176_B_Tas2r124
  gRNA
aagaucugccaguagcaauu

SEQ ID NO: 120177 - RNA, 20 nt, Artificial Sequence
  MKO10120177_B_Tas2r124
  gRNA
uacuaauugcagaguuuguu

SEQ ID NO: 120178 - RNA, 20 nt, Artificial Sequence
  MKO10120178_B_Tas2r124
  gRNA
cugccucauuacccaaagag

SEQ ID NO: 120179 - RNA, 20 nt, Artificial Sequence
  MKO10120179_B_Tas2r125
  gRNA
uuagaauaagcaauaacacc

SEQ ID NO: 120180 - RNA, 20 nt, Artificial Sequence
  MKO10120180_B_Tas2r125
  gRNA
ugucucuugccauacaauau

SEQ ID NO: 120181 - RNA, 20 nt, Artificial Sequence
  MKO10120181_B_Tas2r125
  gRNA
ugaacaugcauauugauauc

SEQ ID NO: 120182 - RNA, 20 nt, Artificial Sequence
  MKO10120182_B_Tas2r126
  gRNA
gcgugguaggcugcuccccu

SEQ ID NO: 120183 - RNA, 20 nt, Artificial Sequence
  MKO10120183_B_Tas2r126
  gRNA
aggacaccgcauaaagaacc

SEQ ID NO: 120184 - RNA, 20 nt, Artificial Sequence
  MKO10120184_B_Tas2r126
  gRNA
ggaaucuccacuucaaccac

SEQ ID NO: 120185 - RNA, 20 nt, Artificial Sequence
  MKO10120185_B_Tas2r129
  gRNA
ugguuugcaagacucugaug

SEQ ID NO: 120186 - RNA, 20 nt, Artificial Sequence
  MKO10120186_B_Tas2r129
  gRNA
cucacuccucaaaauuugca

SEQ ID NO: 120187 - RNA, 20 nt, Artificial Sequence
  MKO10120187_B_Tas2r129
  gRNA
gaaucaaauacucacagccu

SEQ ID NO: 120188 - RNA, 20 nt, Artificial Sequence
  MKO10120188_B_Tas2r130
  gRNA
uauccagacaccuacaacag

SEQ ID NO: 120189 - RNA, 20 nt, Artificial Sequence
  MKO10120189_B_Tas2r130
  gRNA
cagauacaacucaguguaac

SEQ ID NO: 120190 - RNA, 20 nt, Artificial Sequence
  MKO10120190_B_Tas2r130
  gRNA
cagacguuguguuaagacaa

SEQ ID NO: 120191 - RNA, 20 nt, Artificial Sequence
  MKO10120191_B_Tas2r131
  gRNA
aucuucgacagagagcaaug

SEQ ID NO: 120192 - RNA, 20 nt, Artificial Sequence
  MKO10120192_B_Tas2r131
  gRNA
uaacugaucaacuaucaaca

SEQ ID NO: 120193 - RNA, 20 nt, Artificial Sequence
  MKO10120193_B_Tas2r131
  gRNA
agaggaucagcucuugaagc

SEQ ID NO: 120194 - RNA, 20 nt, Artificial Sequence
  MKO10120194_B_Tas2r134
  gRNA
gugcuguaaucaugaguccu

SEQ ID NO: 120195 - RNA, 20 nt, Artificial Sequence
  MKO10120195_B_Tas2r134
  gRNA
gaauuucucggucagugccc

SEQ ID NO: 120196 - RNA, 20 nt, Artificial Sequence
  MKO10120196_B_Tas2r134
  gRNA
uuauggccaccgugcugggc

SEQ ID NO: 120197 - RNA, 20 nt, Artificial Sequence
  MKO10120197_B_Tas2r135
  gRNA
ugccagcaacacaccauauc

SEQ ID NO: 120198 - RNA, 20 nt, Artificial Sequence
  MKO10120198_B_Tas2r135
  gRNA
ucgauucugucuccaaugug

SEQ ID NO: 120199 - RNA, 20 nt, Artificial Sequence
  MKO10120199_B_Tas2r135
  gRNA
auucagguacuggauguggc

SEQ ID NO: 120200 - RNA, 20 nt, Artificial Sequence
  MKO10120200_B_Tas2r136
  gRNA
gacauucuuauaucuugcua

SEQ ID NO: 120201 - RNA, 20 nt, Artificial Sequence
  MKO10120201_B_Tas2r136
  gRNA
cugaaccauugccaacacaa

SEQ ID NO: 120202 - RNA, 20 nt, Artificial Sequence
  MKO10120202_B_Tas2r136
  gRNA
ugcuuguguugucucacaua

SEQ ID NO: 120203 - RNA, 20 nt, Artificial Sequence
  MKO10120203_B_Tas2r137
  gRNA
auacaucagacugaagcgac

SEQ ID NO: 120204 - RNA, 20 nt, Artificial Sequence
  MKO10120204_B_Tas2r137
  gRNA
ggccuaaauucuaauauguu

SEQ ID NO: 120205 - RNA, 20 nt, Artificial Sequence
  MKO10120205_B_Tas2r137
  gRNA
gcagcagaagguaggcaacc

SEQ ID NO: 120206 - RNA, 20 nt, Artificial Sequence
  MKO10120206_B_Tas2r138
  gRNA
ccauagagaccaugcuauuc

SEQ ID NO: 120207 - RNA, 20 nt, Artificial Sequence
  MKO10120207_B_Tas2r138
  gRNA
uaguccucaugugacucccc

SEQ ID NO: 120208 - RNA, 20 nt, Artificial Sequence
  MKO10120208_B_Tas2r138
  gRNA
acccagcuugcuacauggag

SEQ ID NO: 120209 - RNA, 20 nt, Artificial Sequence
  MKO10120209_B_Tas2r139
  gRNA
uuacuaauucagaacaaccc

SEQ ID NO: 120210 - RNA, 20 nt, Artificial Sequence
  MKO10120210_B_Tas2r139
  gRNA
aagcagaauccuaguaguua

SEQ ID NO: 120211 - RNA, 20 nt, Artificial Sequence
  MKO10120211_B_Tas2r139
  gRNA
cccacuugcaaugauaccua

SEQ ID NO: 120212 - RNA, 20 nt, Artificial Sequence
  MKO10120212_B_Tas2r140
  gRNA
cacuaacuggucuaaggacc

SEQ ID NO: 120213 - RNA, 20 nt, Artificial Sequence
  MKO10120213_B_Tas2r140
  gRNA
gaaaucauuauaggguguuu

SEQ ID NO: 120214 - RNA, 20 nt, Artificial Sequence
  MKO10120214_B_Tas2r140
  gRNA
cuaaaacguuuacaaacaag

SEQ ID NO: 120215 - RNA, 20 nt, Artificial Sequence
  MKO10120215_B_Tas2r143
  gRNA
uccuccacuugagccaaaag

SEQ ID NO: 120216 - RNA, 20 nt, Artificial Sequence
  MKO10120216_B_Tas2r143
  gRNA
ugagaacaugagcacgauaa

SEQ ID NO: 120217 - RNA, 20 nt, Artificial Sequence
  MKO10120217_B_Tas2r143
  gRNA
gaagccauucugcaacauag

SEQ ID NO: 120218 - RNA, 20 nt, Artificial Sequence
  MKO10120218_B_Tas2r144
  gRNA
ucucuacauuauuaaugcac

SEQ ID NO: 120219 - RNA, 20 nt, Artificial Sequence
  MKO10120219_B_Tas2r144
  gRNA
ucaagaucagaugcacugac

SEQ ID NO: 120220 - RNA, 20 nt, Artificial Sequence
  MKO10120220_B_Tas2r144
  gRNA
ccauaucuguagcaacagcc

SEQ ID NO: 120221 - RNA, 20 nt, Artificial Sequence
  MKO10120221_B_Tasp1
  gRNA
ugcugcuaaaguaacaguca

SEQ ID NO: 120222 - RNA, 20 nt, Artificial Sequence
  MKO10120222_B_Tasp1
  gRNA
augcaaacgagcuugucaga

SEQ ID NO: 120223 - RNA, 20 nt, Artificial Sequence
  MKO10120223_B_Tasp1
  gRNA
ugcugcucugguggaacuug

SEQ ID NO: 120224 - RNA, 20 nt, Artificial Sequence
  MKO10120224_B_Taudn1
  gRNA
cugacagauccuauguucag

SEQ ID NO: 120225 - RNA, 20 nt, Artificial Sequence
  MKO10120225_B_Taudn1
  gRNA
caguaaagaugcacugcagu

SEQ ID NO: 120226 - RNA, 20 nt, Artificial Sequence
  MKO10120226_B_Taudn1
  gRNA
cuauaaauuccucugaacau

SEQ ID NO: 120227 - RNA, 20 nt, Artificial Sequence
  MKO10120227_B_Taudn2
  gRNA
auggcugcuaguccaguagc

SEQ ID NO: 120228 - RNA, 20 nt, Artificial Sequence
  MKO10120228_B_Taudn2
  gRNA
ugcccuuagacagaucccgu

SEQ ID NO: 120229 - RNA, 20 nt, Artificial Sequence
  MKO10120229_B_Taudn2
  gRNA
accgaagugagugggaauuc

SEQ ID NO: 120230 - RNA, 20 nt, Artificial Sequence
  MKO10120230_B_Taudn3
  gRNA
guaggaucuggaugaugugu

SEQ ID NO: 120231 - RNA, 20 nt, Artificial Sequence
  MKO10120231_B_Taudn3
  gRNA
guggcaguugcugaacaugc

SEQ ID NO: 120232 - RNA, 20 nt, Artificial Sequence
  MKO10120232_B_Taudn3
  gRNA
ucacugccaucucuccgccu

SEQ ID NO: 120233 - RNA, 20 nt, Artificial Sequence
  MKO10120233_B_Tau
  gRNA
cgaaaaaacagcuugucucg

SEQ ID NO: 120234 - RNA, 20 nt, Artificial Sequence
  MKO10120234_B_Tau
  gRNA
aaaacccgggccucggaaug

SEQ ID NO: 120235 - RNA, 20 nt, Artificial Sequence
  MKO10120235_B_Tau
  gRNA
ugagcugugucuagccgugu

SEQ ID NO: 120236 - RNA, 20 nt, Artificial Sequence
  MKO10120236_B_Tax1bp1
  gRNA
uccuaugccugaacauuaug

SEQ ID NO: 120237 - RNA, 20 nt, Artificial Sequence
  MKO10120237_B_Tax1bp1
  gRNA
gauccuuccacauaauguuc

SEQ ID NO: 120238 - RNA, 20 nt, Artificial Sequence
  MKO10120238_B_Tax1bp1
  gRNA
gcucacaccgcccuuucucc

SEQ ID NO: 120239 - RNA, 20 nt, Artificial Sequence
  MKO10120239_B_Tax1bp3
  gRNA
gaaauucauaaguugcguca

SEQ ID NO: 120240 - RNA, 20 nt, Artificial Sequence
  MKO10120240_B_Tax1bp3
  gRNA
uuaaucuugggcuucaguau

SEQ ID NO: 120241 - RNA, 20 nt, Artificial Sequence
  MKO10120241_B_Tax1bp3
  gRNA
ugcagcccagcaauuucagc

SEQ ID NO: 120242 - RNA, 20 nt, Artificial Sequence
  MKO10120242_B_Taz
  gRNA
agcagcucaccucgacacac

SEQ ID NO: 120243 - RNA, 20 nt, Artificial Sequence
  MKO10120243_B_Taz
  gRNA
ccaccucaccgugcacaaca

SEQ ID NO: 120244 - RNA, 20 nt, Artificial Sequence
  MKO10120244_B_Taz
  gRNA
acggugauaagggggguggc

SEQ ID NO: 120245 - RNA, 20 nt, Artificial Sequence
  MKO10120245_B_Tbaua
  gRNA
acaccaaccucaucgggcuu

SEQ ID NO: 120246 - RNA, 20 nt, Artificial Sequence
  MKO10120246_B_Tbaua
  gRNA
ggauuucgagcugauccaug

SEQ ID NO: 120247 - RNA, 20 nt, Artificial Sequence
  MKO10120247_B_Tbaua
  gRNA
agcucgaaauccacaaugcc

SEQ ID NO: 120248 - RNA, 20 nt, Artificial Sequence
  MKO10120248_B_Tbc1d10a
  gRNA
caagcccguccgcgcagaga

SEQ ID NO: 120249 - RNA, 20 nt, Artificial Sequence
  MKO10120249_B_Tbc1d10a
  gRNA
ugauugagcgugaccugcac

SEQ ID NO: 120250 - RNA, 20 nt, Artificial Sequence
  MKO10120250_B_Tbc1d10a
  gRNA
cagcaaugggugccugcgcc

SEQ ID NO: 120251 - RNA, 20 nt, Artificial Sequence
  MKO10120251_B_Tbc1d10b
  gRNA
guggcucgaugugauugaga

SEQ ID NO: 120252 - RNA, 20 nt, Artificial Sequence
  MKO10120252_B_Tbc1d10b
  gRNA
gcaguaccugucuaauagca

SEQ ID NO: 120253 - RNA, 20 nt, Artificial Sequence
  MKO10120253_B_Tbc1d10b
  gRNA
cuuagguaaagcugcgcugc

SEQ ID NO: 120254 - RNA, 20 nt, Artificial Sequence
  MKO10120254_B_Tbc1d10c
  gRNA
ccacccauuucaucucucgc

SEQ ID NO: 120255 - RNA, 20 nt, Artificial Sequence
  MKO10120255_B_Tbc1d10c
  gRNA
ucaaggccuacacccuguac

SEQ ID NO: 120256 - RNA, 20 nt, Artificial Sequence
  MKO10120256_B_Tbc1d10c
  gRNA
uggccucguacccguguccc

SEQ ID NO: 120257 - RNA, 20 nt, Artificial Sequence
  MKO10120257_B_Tbc1d12
  gRNA
guggccgaagcuaaaaaacg

SEQ ID NO: 120258 - RNA, 20 nt, Artificial Sequence
  MKO10120258_B_Tbc1d12
  gRNA
ucaaugaaauacugcccaau

SEQ ID NO: 120259 - RNA, 20 nt, Artificial Sequence
  MKO10120259_B_Tbc1d12
  gRNA
acuuaccugcugaauaauuu

SEQ ID NO: 120260 - RNA, 20 nt, Artificial Sequence
  MKO10120260_B_Tbc1d13
  gRNA
caccgcaguccgcccucaca

SEQ ID NO: 120261 - RNA, 20 nt, Artificial Sequence
  MKO10120261_B_Tbc1d13
  gRNA
gcggacugcggugccucugc

SEQ ID NO: 120262 - RNA, 20 nt, Artificial Sequence
  MKO10120262_B_Tbc1d13
  gRNA
gaaggagcccuccauugugu

SEQ ID NO: 120263 - RNA, 20 nt, Artificial Sequence
  MKO10120263_B_Tbc1d14
  gRNA
augagcgccgugguggacag

SEQ ID NO: 120264 - RNA, 20 nt, Artificial Sequence
  MKO10120264_B_Tbc1d14
  gRNA
ccagcugcuuccuccgacgc

SEQ ID NO: 120265 - RNA, 20 nt, Artificial Sequence
  MKO10120265_B_Tbc1d14
  gRNA
agcuuaaagaagcccagcgu

SEQ ID NO: 120266 - RNA, 20 nt, Artificial Sequence
  MKO10120266_B_Tbc1d15
  gRNA
ccccgaugagcucuuuccuu

SEQ ID NO: 120267 - RNA, 20 nt, Artificial Sequence
  MKO10120267_B_Tbc1d15
  gRNA
guaggaugcugaaguaauag

SEQ ID NO: 120268 - RNA, 20 nt, Artificial Sequence
  MKO10120268_B_Tbc1d15
  gRNA
gaaucuaaugcaucauccaa

SEQ ID NO: 120269 - RNA, 20 nt, Artificial Sequence
  MKO10120269_B_Tbc1d16
  gRNA
cggcagcuugggccuucgga

SEQ ID NO: 120270 - RNA, 20 nt, Artificial Sequence
  MKO10120270_B_Tbc1d16
  gRNA
cuuaccugaagaagagccgc

SEQ ID NO: 120271 - RNA, 20 nt, Artificial Sequence
  MKO10120271_B_Tbc1d16
  gRNA
agugacgaggcuugcacgag

SEQ ID NO: 120272 - RNA, 20 nt, Artificial Sequence
  MKO10120272_B_Tbc1d17
  gRNA
uuccaccacucguaugacgc

SEQ ID NO: 120273 - RNA, 20 nt, Artificial Sequence
  MKO10120273_B_Tbc1d17
  gRNA
gugcugggcucaccccgacu

SEQ ID NO: 120274 - RNA, 20 nt, Artificial Sequence
  MKO10120274_B_Tbc1d17
  gRNA
ggauggacuugagcuccccc

SEQ ID NO: 120275 - RNA, 20 nt, Artificial Sequence
  MKO10120275_B_Tbc1d19
  gRNA
gcuuuccucauguacaccaa

SEQ ID NO: 120276 - RNA, 20 nt, Artificial Sequence
  MKO10120276_B_Tbc1d19
  gRNA
agaugcucagggggugcaga

SEQ ID NO: 120277 - RNA, 20 nt, Artificial Sequence
  MKO10120277_B_Tbc1d19
  gRNA
aucacucaaagaagauauua

SEQ ID NO: 120278 - RNA, 20 nt, Artificial Sequence
  MKO10120278_B_Tbc1d1
  gRNA
gccugcacaagcucugcgaa

SEQ ID NO: 120279 - RNA, 20 nt, Artificial Sequence
  MKO10120279_B_Tbc1d1
  gRNA
ugccgccacccgagcacucu

SEQ ID NO: 120280 - RNA, 20 nt, Artificial Sequence
  MKO10120280_B_Tbc1d1
  gRNA
gguagcugcggugcagcaga

SEQ ID NO: 120281 - RNA, 20 nt, Artificial Sequence
  MKO10120281_B_Tbc1d20
  gRNA
cgauaucauccuccucgucc

SEQ ID NO: 120282 - RNA, 20 nt, Artificial Sequence
  MKO10120282_B_Tbc1d20
  gRNA
ugggcucacuuggucaauga

SEQ ID NO: 120283 - RNA, 20 nt, Artificial Sequence
  MKO10120283_B_Tbc1d20
  gRNA
ugacguccagcagcacuugc

SEQ ID NO: 120284 - RNA, 20 nt, Artificial Sequence
  MKO10120284_B_Tbc1d21
  gRNA
accuagcguacgacauccag

SEQ ID NO: 120285 - RNA, 20 nt, Artificial Sequence
  MKO10120285_B_Tbc1d21
  gRNA
gcaaaugaagucucgugacu

SEQ ID NO: 120286 - RNA, 20 nt, Artificial Sequence
  MKO10120286_B_Tbc1d21
  gRNA
gagaaacccccccauugaca

SEQ ID NO: 120287 - RNA, 20 nt, Artificial Sequence
  MKO10120287_B_Tbc1d22a
  gRNA
ccacuccggugaaggccaag

SEQ ID NO: 120288 - RNA, 20 nt, Artificial Sequence
  MKO10120288_B_Tbc1d22a
  gRNA
agagacugggaccguugcag

SEQ ID NO: 120289 - RNA, 20 nt, Artificial Sequence
  MKO10120289_B_Tbc1d22a
  gRNA
gccucuggcugugauugcgc

SEQ ID NO: 120290 - RNA, 20 nt, Artificial Sequence
  MKO10120290_B_Tbc1d22b
  gRNA
gggaaguucgaccagugacc

SEQ ID NO: 120291 - RNA, 20 nt, Artificial Sequence
  MKO10120291_B_Tbc1d22b
  gRNA
ccaucaucccccuugucgcc

SEQ ID NO: 120292 - RNA, 20 nt, Artificial Sequence
  MKO10120292_B_Tbc1d22b
  gRNA
gggugcugagccccauacac

SEQ ID NO: 120293 - RNA, 20 nt, Artificial Sequence
  MKO10120293_B_Tbc1d23
  gRNA
ucaguagaugaauccagcuc

SEQ ID NO: 120294 - RNA, 20 nt, Artificial Sequence
  MKO10120294_B_Tbc1d23
  gRNA
aaggugauaguuuggcauca

SEQ ID NO: 120295 - RNA, 20 nt, Artificial Sequence
  MKO10120295_B_Tbc1d23
  gRNA
gaucacaaccuccugcuuca

SEQ ID NO: 120296 - RNA, 20 nt, Artificial Sequence
  MKO10120296_B_Tbc1d24
  gRNA
gcucaucaagaccacucaaa

SEQ ID NO: 120297 - RNA, 20 nt, Artificial Sequence
  MKO10120297_B_Tbc1d24
  gRNA
ucacgcugacaaucucugag

SEQ ID NO: 120298 - RNA, 20 nt, Artificial Sequence
  MKO10120298_B_Tbc1d24
  gRNA
ugggcucauguccuucacac

SEQ ID NO: 120299 - RNA, 20 nt, Artificial Sequence
  MKO10120299_B_Tbc1d25
  gRNA
ucagcuaccuggcucgagac

SEQ ID NO: 120300 - RNA, 20 nt, Artificial Sequence
  MKO10120300_B_Tbc1d25
  gRNA
gugcugcaacacguccagcg

SEQ ID NO: 120301 - RNA, 20 nt, Artificial Sequence
  MKO10120301_B_Tbc1d25
  gRNA
cgggauggcaaccaccuccg

SEQ ID NO: 120302 - RNA, 20 nt, Artificial Sequence
  MKO10120302_B_Tbc1d2b
  gRNA
aucgugagcucaugacuuac

SEQ ID NO: 120303 - RNA, 20 nt, Artificial Sequence
  MKO10120303_B_Tbc1d2b
  gRNA
agcaggacuuccccgacucc

SEQ ID NO: 120304 - RNA, 20 nt, Artificial Sequence
  MKO10120304_B_Tbc1d2b
  gRNA
ucaaugucaucauuccgucc

SEQ ID NO: 120305 - RNA, 20 nt, Artificial Sequence
  MKO10120305_B_Tbc1d2
  gRNA
acucguggaagacucgccuc

SEQ ID NO: 120306 - RNA, 20 nt, Artificial Sequence
  MKO10120306_B_Tbc1d2
  gRNA
ugaggcgagucuuccacgag

SEQ ID NO: 120307 - RNA, 20 nt, Artificial Sequence
  MKO10120307_B_Tbc1d2
  gRNA
uggcucccuagagcaagagg

SEQ ID NO: 120308 - RNA, 20 nt, Artificial Sequence
  MKO10120308_B_Tbc1d30
  gRNA
cuguggccagacugucaacg

SEQ ID NO: 120309 - RNA, 20 nt, Artificial Sequence
  MKO10120309_B_Tbc1d30
  gRNA
ugcacaguauagccaucgac

SEQ ID NO: 120310 - RNA, 20 nt, Artificial Sequence
  MKO10120310_B_Tbc1d30
  gRNA
uuagugguaugaugcucuca

SEQ ID NO: 120311 - RNA, 20 nt, Artificial Sequence
  MKO10120311_B_Tbc1d31
  gRNA
uauaagauguuagagcccuc

SEQ ID NO: 120312 - RNA, 20 nt, Artificial Sequence
  MKO10120312_B_Tbc1d31
  gRNA
ucaggcgauuccuucauugc

SEQ ID NO: 120313 - RNA, 20 nt, Artificial Sequence
  MKO10120313_B_Tbc1d31
  gRNA
aagacaacuccaucuucgcc

SEQ ID NO: 120314 - RNA, 20 nt, Artificial Sequence
  MKO10120314_B_Tbc1d32
  gRNA
augcacaucugaucagaauc

SEQ ID NO: 120315 - RNA, 20 nt, Artificial Sequence
  MKO10120315_B_Tbc1d32
  gRNA
acguccugagcugugagaac

SEQ ID NO: 120316 - RNA, 20 nt, Artificial Sequence
  MKO10120316_B_Tbc1d32
  gRNA
uuaaucuuaccucuuuaggu

SEQ ID NO: 120317 - RNA, 20 nt, Artificial Sequence
  MKO10120317_B_Tbc1d4
  gRNA
gcacaguuuaaucugcgucu

SEQ ID NO: 120318 - RNA, 20 nt, Artificial Sequence
  MKO10120318_B_Tbc1d4
  gRNA
cagcacgacugauuuagugu

SEQ ID NO: 120319 - RNA, 20 nt, Artificial Sequence
  MKO10120319_B_Tbc1d4
  gRNA
cuuuaucugucgggagucuc

SEQ ID NO: 120320 - RNA, 20 nt, Artificial Sequence
  MKO10120320_B_Tbc1d5
  gRNA
gaacgucccuucagugucua

SEQ ID NO: 120321 - RNA, 20 nt, Artificial Sequence
  MKO10120321_B_Tbc1d5
  gRNA
cuaggagaucuaagucaaaa

SEQ ID NO: 120322 - RNA, 20 nt, Artificial Sequence
  MKO10120322_B_Tbc1d5
  gRNA
guaagacagaaggggauuaa

SEQ ID NO: 120323 - RNA, 20 nt, Artificial Sequence
  MKO10120323_B_Tbc1d7
  gRNA
ggcaucccgcgaagcaccuu

SEQ ID NO: 120324 - RNA, 20 nt, Artificial Sequence
  MKO10120324_B_Tbc1d7
  gRNA
uuaacugcuucacgaagcau

SEQ ID NO: 120325 - RNA, 20 nt, Artificial Sequence
  MKO10120325_B_Tbc1d7
  gRNA
cuuugcgguaggccaucacc

SEQ ID NO: 120326 - RNA, 20 nt, Artificial Sequence
  MKO10120326_B_Tbc1d8b
  gRNA
guguacuugucaauugcaug

SEQ ID NO: 120327 - RNA, 20 nt, Artificial Sequence
  MKO10120327_B_Tbc1d8b
  gRNA
agcauucacguauguucuca

SEQ ID NO: 120328 - RNA, 20 nt, Artificial Sequence
  MKO10120328_B_Tbc1d8b
  gRNA
uaaugagacauaccuucuua

SEQ ID NO: 120329 - RNA, 20 nt, Artificial Sequence
  MKO10120329_B_Tbc1d8
  gRNA
cucccuuaaggucgccuugu

SEQ ID NO: 120330 - RNA, 20 nt, Artificial Sequence
  MKO10120330_B_Tbc1d8
  gRNA
cgugaccagcuucuccgccu

SEQ ID NO: 120331 - RNA, 20 nt, Artificial Sequence
  MKO10120331_B_Tbc1d8
  gRNA
ccggaucacuacacagaaua

SEQ ID NO: 120332 - RNA, 20 nt, Artificial Sequence
  MKO10120332_B_Tbc1d9b
  gRNA
uccaguagaccugcgagucc

SEQ ID NO: 120333 - RNA, 20 nt, Artificial Sequence
  MKO10120333_B_Tbc1d9b
  gRNA
ccuggccaugcgacaacugc

SEQ ID NO: 120334 - RNA, 20 nt, Artificial Sequence
  MKO10120334_B_Tbc1d9b
  gRNA
gucuggugcaggaugcggua

SEQ ID NO: 120335 - RNA, 20 nt, Artificial Sequence
  MKO10120335_B_Tbc1d9
  gRNA
cuuuccccagguaaccaucg

SEQ ID NO: 120336 - RNA, 20 nt, Artificial Sequence
  MKO10120336_B_Tbc1d9
  gRNA
uacugcuggccaacgcgcug

SEQ ID NO: 120337 - RNA, 20 nt, Artificial Sequence
  MKO10120337_B_Tbc1d9
  gRNA
ccacaucgaggguacccaca

SEQ ID NO: 120338 - RNA, 20 nt, Artificial Sequence
  MKO10120338_B_Tbca
  gRNA
augcagccucuaaccgacgc

SEQ ID NO: 120339 - RNA, 20 nt, Artificial Sequence
  MKO10120339_B_Tbca
  gRNA
ucaggaaagugaaaaagacu

SEQ ID NO: 120340 - RNA, 20 nt, Artificial Sequence
  MKO10120340_B_Tbca
  gRNA
agaaaagauugaaaaaauga

SEQ ID NO: 120341 - RNA, 20 nt, Artificial Sequence
  MKO10120341_B_Tbcb
  gRNA
guccgauaugaugagccguu

SEQ ID NO: 120342 - RNA, 20 nt, Artificial Sequence
  MKO10120342_B_Tbcb
  gRNA
cgggugcccgcaccucacaa

SEQ ID NO: 120343 - RNA, 20 nt, Artificial Sequence
  MKO10120343_B_Tbcb
  gRNA
acaugacagugccccugcga

SEQ ID NO: 120344 - RNA, 20 nt, Artificial Sequence
  MKO10120344_B_Tbccd1
  gRNA
aagccacuugcuacgugcag

SEQ ID NO: 120345 - RNA, 20 nt, Artificial Sequence
  MKO10120345_B_Tbccd1
  gRNA
uugcuacagugccuaacuau

SEQ ID NO: 120346 - RNA, 20 nt, Artificial Sequence
  MKO10120346_B_Tbccd1
  gRNA
uguauauccagcaguuaaac

SEQ ID NO: 120347 - RNA, 20 nt, Artificial Sequence
  MKO10120347_B_Tbcc
  gRNA
uucgcgccucugaagucgcu

SEQ ID NO: 120348 - RNA, 20 nt, Artificial Sequence
  MKO10120348_B_Tbcc
  gRNA
caagaagacgcgcgugucuu

SEQ ID NO: 120349 - RNA, 20 nt, Artificial Sequence
  MKO10120349_B_Tbcc
  gRNA
agucguucaggagcuuccgc

SEQ ID NO: 120350 - RNA, 20 nt, Artificial Sequence
  MKO10120350_B_Tbcd
  gRNA
ucagaacccuaaagaccaug

SEQ ID NO: 120351 - RNA, 20 nt, Artificial Sequence
  MKO10120351_B_Tbcd
  gRNA
ccgaauucugcaaauagcag

SEQ ID NO: 120352 - RNA, 20 nt, Artificial Sequence
  MKO10120352_B_Tbcd
  gRNA
agaaacacgaguacccacca

SEQ ID NO: 120353 - RNA, 20 nt, Artificial Sequence
  MKO10120353_B_Tbcel
  gRNA
caaucacuugaaugcaaucg

SEQ ID NO: 120354 - RNA, 20 nt, Artificial Sequence
  MKO10120354_B_Tbcel
  gRNA
gauuagggaacaaccuagcc

SEQ ID NO: 120355 - RNA, 20 nt, Artificial Sequence
  MKO10120355_B_Tbcel
  gRNA
aacagugcacaccauacugc

SEQ ID NO: 120356 - RNA, 20 nt, Artificial Sequence
  MKO10120356_B_Tbce
  gRNA
uaaaauacauaguaccuucg

SEQ ID NO: 120357 - RNA, 20 nt, Artificial Sequence
  MKO10120357_B_Tbce
  gRNA
ccaaaaacuuguugucaacu

SEQ ID NO: 120358 - RNA, 20 nt, Artificial Sequence
  MKO10120358_B_Tbce
  gRNA
accugagaucaagagccucc

SEQ ID NO: 120359 - RNA, 20 nt, Artificial Sequence
  MKO10120359_B_Tbck
  gRNA
cuuuaucacaugacagccca

SEQ ID NO: 120360 - RNA, 20 nt, Artificial Sequence
  MKO10120360_B_Tbck
  gRNA
aguucugugcauagcauaug

SEQ ID NO: 120361 - RNA, 20 nt, Artificial Sequence
  MKO10120361_B_Tbck
  gRNA
cccuagaaauauccacauau

SEQ ID NO: 120362 - RNA, 20 nt, Artificial Sequence
  MKO10120362_B_Tbk1
  gRNA
ucuaaacggcagcgaccccg

SEQ ID NO: 120363 - RNA, 20 nt, Artificial Sequence
  MKO10120363_B_Tbk1
  gRNA
cauaagcuuccuucgcccag

SEQ ID NO: 120364 - RNA, 20 nt, Artificial Sequence
  MKO10120364_B_Tbk1
  gRNA
ucucauugucuuacgagaug

SEQ ID NO: 120365 - RNA, 20 nt, Artificial Sequence
  MKO10120365_B_Tbkbp1
  gRNA
ucgcucacacuuacacucgu

SEQ ID NO: 120366 - RNA, 20 nt, Artificial Sequence
  MKO10120366_B_Tbkbp1
  gRNA
cgcacaguuucucguaagcc

SEQ ID NO: 120367 - RNA, 20 nt, Artificial Sequence
  MKO10120367_B_Tbkbp1
  gRNA
cccugguagagacucaucua

SEQ ID NO: 120368 - RNA, 20 nt, Artificial Sequence
  MKO10120368_B_Tbl1xr1
  gRNA
gaaaaaccuacccugaugcc

SEQ ID NO: 120369 - RNA, 20 nt, Artificial Sequence
  MKO10120369_B_Tbl1xr1
  gRNA
gcugccgccacuaaccagca

SEQ ID NO: 120370 - RNA, 20 nt, Artificial Sequence
  MKO10120370_B_Tbl1xr1
  gRNA
uauauggcucucuauaccaa

SEQ ID NO: 120371 - RNA, 20 nt, Artificial Sequence
  MKO10120371_B_Tbl1x
  gRNA
gaucuggagacuccacugcg

SEQ ID NO: 120372 - RNA, 20 nt, Artificial Sequence
  MKO10120372_B_Tbl1x
  gRNA
uaggauggcacgguauuuga

SEQ ID NO: 120373 - RNA, 20 nt, Artificial Sequence
  MKO10120373_B_Tbl1x
  gRNA
ccccguugcuguucucauua

SEQ ID NO: 120374 - RNA, 20 nt, Artificial Sequence
  MKO10120374_B_Tbl2
  gRNA
caguuaucuccccauguagc

SEQ ID NO: 120375 - RNA, 20 nt, Artificial Sequence
  MKO10120375_B_Tbl2
  gRNA
agcaaugccgauguugauga

SEQ ID NO: 120376 - RNA, 20 nt, Artificial Sequence
  MKO10120376_B_Tbl2
  gRNA
gugacacaacuguccucaua

SEQ ID NO: 120377 - RNA, 20 nt, Artificial Sequence
  MKO10120377_B_Tbl3
  gRNA
cacauccaggauguuaacuu

SEQ ID NO: 120378 - RNA, 20 nt, Artificial Sequence
  MKO10120378_B_Tbl3
  gRNA
acccaucauacuucaucauc

SEQ ID NO: 120379 - RNA, 20 nt, Artificial Sequence
  MKO10120379_B_Tbl3
  gRNA
cuuccuuuaggaggaccaag

SEQ ID NO: 120380 - RNA, 20 nt, Artificial Sequence
  MKO10120380_B_Tbpl1
  gRNA
agaacaauagaccucaugcc

SEQ ID NO: 120381 - RNA, 20 nt, Artificial Sequence
  MKO10120381_B_Tbpl1
  gRNA
aaccuaguuucugcagacua

SEQ ID NO: 120382 - RNA, 20 nt, Artificial Sequence
  MKO10120382_B_Tbpl1
  gRNA
ucaggaaaaauuauuugcac

SEQ ID NO: 120383 - RNA, 20 nt, Artificial Sequence
  MKO10120383_B_Tbpl2
  gRNA
aaacuccaaugccuuaccug

SEQ ID NO: 120384 - RNA, 20 nt, Artificial Sequence
  MKO10120384_B_Tbpl2
  gRNA
gguuugcugcaguaauaaug

SEQ ID NO: 120385 - RNA, 20 nt, Artificial Sequence
  MKO10120385_B_Tbpl2
  gRNA
augccaaugaacccuguucc

SEQ ID NO: 120386 - RNA, 20 nt, Artificial Sequence
  MKO10120386_B_Tbp
  gRNA
cugaccacugcaccguugcc

SEQ ID NO: 120387 - RNA, 20 nt, Artificial Sequence
  MKO10120387_B_Tbp
  gRNA
auuucuugcacgaagugcaa

SEQ ID NO: 120388 - RNA, 20 nt, Artificial Sequence
  MKO10120388_B_Tbp
  gRNA
gugaugugaaguucccuaua

SEQ ID NO: 120389 - RNA, 20 nt, Artificial Sequence
  MKO10120389_B_Tbr1
  gRNA
aauccggaugcauauagacc

SEQ ID NO: 120390 - RNA, 20 nt, Artificial Sequence
  MKO10120390_B_Tbr1
  gRNA
aaagcggacaccaaugugca

SEQ ID NO: 120391 - RNA, 20 nt, Artificial Sequence
  MKO10120391_B_Tbr1
  gRNA
gaucauaaccccuuugcaaa

SEQ ID NO: 120392 - RNA, 20 nt, Artificial Sequence
  MKO10120392_B_Tbrg1
  gRNA
uagaucaucaccaaccgacc

SEQ ID NO: 120393 - RNA, 20 nt, Artificial Sequence
  MKO10120393_B_Tbrg1
  gRNA
ugaugaaauugcucgucuug

SEQ ID NO: 120394 - RNA, 20 nt, Artificial Sequence
  MKO10120394_B_Tbrg1
  gRNA
accauaaggcaggggcaaac

SEQ ID NO: 120395 - RNA, 20 nt, Artificial Sequence
  MKO10120395_B_Tbrg4
  gRNA
uucauucccagcaugacgcc

SEQ ID NO: 120396 - RNA, 20 nt, Artificial Sequence
  MKO10120396_B_Tbrg4
  gRNA
gcgcagcgggccaccucucc

SEQ ID NO: 120397 - RNA, 20 nt, Artificial Sequence
  MKO10120397_B_Tbrg4
  gRNA
gcaacacucgcaggaacugc

SEQ ID NO: 120398 - RNA, 20 nt, Artificial Sequence
  MKO10120398_B_Tbx10
  gRNA
gcacccuuggcuggcgaguc

SEQ ID NO: 120399 - RNA, 20 nt, Artificial Sequence
  MKO10120399_B_Tbx10
  gRNA
gcucauggacuuuaucccgu

SEQ ID NO: 120400 - RNA, 20 nt, Artificial Sequence
  MKO10120400_B_Tbx10
  gRNA
gaggauguucccaacguucc

SEQ ID NO: 120401 - RNA, 20 nt, Artificial Sequence
  MKO10120401_B_Tbx15
  gRNA
ucgaggcugguauuuaugca

SEQ ID NO: 120402 - RNA, 20 nt, Artificial Sequence
  MKO10120402_B_Tbx15
  gRNA
auguaaacccuuggaggcac

SEQ ID NO: 120403 - RNA, 20 nt, Artificial Sequence
  MKO10120403_B_Tbx15
  gRNA
gcuauauaguauugcugaug

SEQ ID NO: 120404 - RNA, 20 nt, Artificial Sequence
  MKO10120404_B_Tbx18
  gRNA
cgguggacaacaagagauac

SEQ ID NO: 120405 - RNA, 20 nt, Artificial Sequence
  MKO10120405_B_Tbx18
  gRNA
gaucaucuccgcaaucuuua

SEQ ID NO: 120406 - RNA, 20 nt, Artificial Sequence
  MKO10120406_B_Tbx18
  gRNA
caugucauccguaaagauug

SEQ ID NO: 120407 - RNA, 20 nt, Artificial Sequence
  MKO10120407_B_Tbx19
  gRNA
uguuggaggcgcccaucgaa

SEQ ID NO: 120408 - RNA, 20 nt, Artificial Sequence
  MKO10120408_B_Tbx19
  gRNA
agcaguucaugaccauucga

SEQ ID NO: 120409 - RNA, 20 nt, Artificial Sequence
  MKO10120409_B_Tbx19
  gRNA
cucuuucagaaaccaccuca

SEQ ID NO: 120410 - RNA, 20 nt, Artificial Sequence
  MKO10120410_B_Tbx1
  gRNA
cuuccgggauugcgacccgg

SEQ ID NO: 120411 - RNA, 20 nt, Artificial Sequence
  MKO10120411_B_Tbx1
  gRNA
auccacugugcgcccuuagc

SEQ ID NO: 120412 - RNA, 20 nt, Artificial Sequence
  MKO10120412_B_Tbx1
  gRNA
ccgauuccauguugucuaug

SEQ ID NO: 120413 - RNA, 20 nt, Artificial Sequence
  MKO10120413_B_Tbx20
  gRNA
gauaccgcuaugccuaccac

SEQ ID NO: 120414 - RNA, 20 nt, Artificial Sequence
  MKO10120414_B_Tbx20
  gRNA
agacucgucagcucacccag

SEQ ID NO: 120415 - RNA, 20 nt, Artificial Sequence
  MKO10120415_B_Tbx20
  gRNA
ucgccaguaaagggggaguc

SEQ ID NO: 120416 - RNA, 20 nt, Artificial Sequence
  MKO10120416_B_Tbx21
  gRNA
cauccagugggcuccggugu

SEQ ID NO: 120417 - RNA, 20 nt, Artificial Sequence
  MKO10120417_B_Tbx21
  gRNA
cuuacgacucaaaguucucc

SEQ ID NO: 120418 - RNA, 20 nt, Artificial Sequence
  MKO10120418_B_Tbx21
  gRNA
uggagcccacaagccauuac

SEQ ID NO: 120419 - RNA, 20 nt, Artificial Sequence
  MKO10120419_B_Tbx22
  gRNA
guccggguggacauagaauc

SEQ ID NO: 120420 - RNA, 20 nt, Artificial Sequence
  MKO10120420_B_Tbx22
  gRNA
ucccagauucuauguccacc

SEQ ID NO: 120421 - RNA, 20 nt, Artificial Sequence
  MKO10120421_B_Tbx22
  gRNA
ucaucucagugccaaugucg

SEQ ID NO: 120422 - RNA, 20 nt, Artificial Sequence
  MKO10120422_B_Tbx2
  gRNA
gggacacugggaacggccgu

SEQ ID NO: 120423 - RNA, 20 nt, Artificial Sequence
  MKO10120423_B_Tbx2
  gRNA
gcacgauguggaaucgcggc

SEQ ID NO: 120424 - RNA, 20 nt, Artificial Sequence
  MKO10120424_B_Tbx2
  gRNA
auaaguuucacaacucccgc

SEQ ID NO: 120425 - RNA, 20 nt, Artificial Sequence
  MKO10120425_B_Tbx3
  gRNA
gccggacuucgccaugagcg

SEQ ID NO: 120426 - RNA, 20 nt, Artificial Sequence
  MKO10120426_B_Tbx3
  gRNA
uaucguuggcucugacgaug

SEQ ID NO: 120427 - RNA, 20 nt, Artificial Sequence
  MKO10120427_B_Tbx3
  gRNA
acggcgaugaauucuguuuc

SEQ ID NO: 120428 - RNA, 20 nt, Artificial Sequence
  MKO10120428_B_Tbx4
  gRNA
ggucacugucaucgcugccc

SEQ ID NO: 120429 - RNA, 20 nt, Artificial Sequence
  MKO10120429_B_Tbx4
  gRNA
ggcucacuggaugcggcagu

SEQ ID NO: 120430 - RNA, 20 nt, Artificial Sequence
  MKO10120430_B_Tbx4
  gRNA
gucgaugagaaguauguacu

SEQ ID NO: 120431 - RNA, 20 nt, Artificial Sequence
  MKO10120431_B_Tbx5
  gRNA
gacuucguaccagaaucaca

SEQ ID NO: 120432 - RNA, 20 nt, Artificial Sequence
  MKO10120432_B_Tbx5
  gRNA
aacgaaguauauucuucuca

SEQ ID NO: 120433 - RNA, 20 nt, Artificial Sequence
  MKO10120433_B_Tbx5
  gRNA
gagaagaauauacuucguuu

SEQ ID NO: 120434 - RNA, 20 nt, Artificial Sequence
  MKO10120434_B_Tbx6
  gRNA
ggccacucacccuaggguuc

SEQ ID NO: 120435 - RNA, 20 nt, Artificial Sequence
  MKO10120435_B_Tbx6
  gRNA
aagcgagugaagggccucug

SEQ ID NO: 120436 - RNA, 20 nt, Artificial Sequence
  MKO10120436_B_Tbx6
  gRNA
agauuuggauacuucuaaac

SEQ ID NO: 120437 - RNA, 20 nt, Artificial Sequence
  MKO10120437_B_Tbxa2r
  gRNA
cugggcuggaggccggcgca

SEQ ID NO: 120438 - RNA, 20 nt, Artificial Sequence
  MKO10120438_B_Tbxa2r
  gRNA
ccgggucuaccacacgcgcg

SEQ ID NO: 120439 - RNA, 20 nt, Artificial Sequence
  MKO10120439_B_Tbxa2r
  gRNA
gucgcaacacgcugccuugu

SEQ ID NO: 120440 - RNA, 20 nt, Artificial Sequence
  MKO10120440_B_Tbxas1
  gRNA
uccccuccuagguacuaucu

SEQ ID NO: 120441 - RNA, 20 nt, Artificial Sequence
  MKO10120441_B_Tbxas1
  gRNA
aacaccugcuugaucauguc

SEQ ID NO: 120442 - RNA, 20 nt, Artificial Sequence
  MKO10120442_B_Tbxas1
  gRNA
caugucagcuuucucaagac

SEQ ID NO: 120443 - RNA, 20 nt, Artificial Sequence
  MKO10120443_B_Tc2n
  gRNA
ucuucauuacagccaacuug

SEQ ID NO: 120444 - RNA, 20 nt, Artificial Sequence
  MKO10120444_B_Tc2n
  gRNA
aaguguugauacauauagca

SEQ ID NO: 120445 - RNA, 20 nt, Artificial Sequence
  MKO10120445_B_Tc2n
  gRNA
aguaaacuuccugguuccuc

SEQ ID NO: 120446 - RNA, 20 nt, Artificial Sequence
  MKO10120446_B_Tcaim
  gRNA
ucucugauagguucggccug

SEQ ID NO: 120447 - RNA, 20 nt, Artificial Sequence
  MKO10120447_B_Tcaim
  gRNA
aacguaccgguaguacugau

SEQ ID NO: 120448 - RNA, 20 nt, Artificial Sequence
  MKO10120448_B_Tcaim
  gRNA
uuugggucuagguccugguu

SEQ ID NO: 120449 - RNA, 20 nt, Artificial Sequence
  MKO10120449_B_Tcam1
  gRNA
gaucccugaagccgaagagu

SEQ ID NO: 120450 - RNA, 20 nt, Artificial Sequence
  MKO10120450_B_Tcam1
  gRNA
ucauccacggccacccauuc

SEQ ID NO: 120451 - RNA, 20 nt, Artificial Sequence
  MKO10120451_B_Tcam1
  gRNA
aacucuaccagggccucauu

SEQ ID NO: 120452 - RNA, 20 nt, Artificial Sequence
  MKO10120452_B_Tcap
  gRNA
aggaacgcagggaagccuuc

SEQ ID NO: 120453 - RNA, 20 nt, Artificial Sequence
  MKO10120453_B_Tcap
  gRNA
uugugaucucagccacgucc

SEQ ID NO: 120454 - RNA, 20 nt, Artificial Sequence
  MKO10120454_B_Tcap
  gRNA
caccuuggugggcgugaaga

SEQ ID NO: 120455 - RNA, 20 nt, Artificial Sequence
  MKO10120455_B_Tcea1
  gRNA
cacauaccuguagcaauucu

SEQ ID NO: 120456 - RNA, 20 nt, Artificial Sequence
  MKO10120456_B_Tcea1
  gRNA
auucugugcgauuaaaaugu

SEQ ID NO: 120457 - RNA, 20 nt, Artificial Sequence
  MKO10120457_B_Tcea1
  gRNA
uaccuuucuucucuugcuuc

SEQ ID NO: 120458 - RNA, 20 nt, Artificial Sequence
  MKO10120458_B_Tcea2
  gRNA
uggggaaauguagugauccu

SEQ ID NO: 120459 - RNA, 20 nt, Artificial Sequence
  MKO10120459_B_Tcea2
  gRNA
uggagcaagugcaauguaau

SEQ ID NO: 120460 - RNA, 20 nt, Artificial Sequence
  MKO10120460_B_Tcea2
  gRNA
uauuacauugcacuugcucc

SEQ ID NO: 120461 - RNA, 20 nt, Artificial Sequence
  MKO10120461_B_Tcea3
  gRNA
uuccauuaccuuuccagcga

SEQ ID NO: 120462 - RNA, 20 nt, Artificial Sequence
  MKO10120462_B_Tcea3
  gRNA
gccucacagaccaccaggau

SEQ ID NO: 120463 - RNA, 20 nt, Artificial Sequence
  MKO10120463_B_Tcea3
  gRNA
ggagagacucuguagacucc

SEQ ID NO: 120464 - RNA, 20 nt, Artificial Sequence
  MKO10120464_B_Tceal1
  gRNA
agcucgggcaggagcucuuc

SEQ ID NO: 120465 - RNA, 20 nt, Artificial Sequence
  MKO10120465_B_Tceal1
  gRNA
cuccucggaggacugcuccu

SEQ ID NO: 120466 - RNA, 20 nt, Artificial Sequence
  MKO10120466_B_Tceal1
  gRNA
cuuguguuugcccaccccgc

SEQ ID NO: 120467 - RNA, 20 nt, Artificial Sequence
  MKO10120467_B_Tceal3
  gRNA
ggacaggcauguaagcagug

SEQ ID NO: 120468 - RNA, 20 nt, Artificial Sequence
  MKO10120468_B_Tceal3
  gRNA
agaugaagaaaagucagacg

SEQ ID NO: 120469 - RNA, 20 nt, Artificial Sequence
  MKO10120469_B_Tceal3
  gRNA
cucggggagucaggggggug

SEQ ID NO: 120470 - RNA, 20 nt, Artificial Sequence
  MKO10120470_B_Tceal5
  gRNA
ugaagacaagucagaugcag

SEQ ID NO: 120471 - RNA, 20 nt, Artificial Sequence
  MKO10120471_B_Tceal5
  gRNA
cggcggaggcaggggccaga

SEQ ID NO: 120472 - RNA, 20 nt, Artificial Sequence
  MKO10120472_B_Tceal5
  gRNA
agacgaaggaaguacagaag

SEQ ID NO: 120473 - RNA, 20 nt, Artificial Sequence
  MKO10120473_B_Tceal6
  gRNA
agaugaagaaaagucagaug

SEQ ID NO: 120474 - RNA, 20 nt, Artificial Sequence
  MKO10120474_B_Tceal6
  gRNA
cucgggaagaguuaaggaag

SEQ ID NO: 120475 - RNA, 20 nt, Artificial Sequence
  MKO10120475_B_Tceal6
  gRNA
ggccaaaggcauuaaaggua

SEQ ID NO: 120476 - RNA, 20 nt, Artificial Sequence
  MKO10120476_B_Tceal7
  gRNA
ggccacugcuuuaaaaggga

SEQ ID NO: 120477 - RNA, 20 nt, Artificial Sequence
  MKO10120477_B_Tceal7
  gRNA
uggaaggcaauuucagacag

SEQ ID NO: 120478 - RNA, 20 nt, Artificial Sequence
  MKO10120478_B_Tceal7
  gRNA
ccucuuugccucacugcccu

SEQ ID NO: 120479 - RNA, 20 nt, Artificial Sequence
  MKO10120479_B_Tceal8
  gRNA
aaccccgaagaagugauaag

SEQ ID NO: 120480 - RNA, 20 nt, Artificial Sequence
  MKO10120480_B_Tceal8
  gRNA
acaaguucguguugaugcau

SEQ ID NO: 120481 - RNA, 20 nt, Artificial Sequence
  MKO10120481_B_Tceal8
  gRNA
aagucuugugacgagaacga

SEQ ID NO: 120482 - RNA, 20 nt, Artificial Sequence
  MKO10120482_B_Tceanc2
  gRNA
gucuguacaaacgugccgac

SEQ ID NO: 120483 - RNA, 20 nt, Artificial Sequence
  MKO10120483_B_Tceanc2
  gRNA
caccuucaacgacucaaucg

SEQ ID NO: 120484 - RNA, 20 nt, Artificial Sequence
  MKO10120484_B_Tceanc2
  gRNA
guguugagauccacaaggau

SEQ ID NO: 120485 - RNA, 20 nt, Artificial Sequence
  MKO10120485_B_Tceanc
  gRNA
uuugaauucugcacccaacu

SEQ ID NO: 120486 - RNA, 20 nt, Artificial Sequence
  MKO10120486_B_Tceanc
  gRNA
ugaaaguagcacugcucaaa

SEQ ID NO: 120487 - RNA, 20 nt, Artificial Sequence
  MKO10120487_B_Tceanc
  gRNA
acaagaaccaaaucauugcc

SEQ ID NO: 120488 - RNA, 20 nt, Artificial Sequence
  MKO10120488_B_Tceb1
  gRNA
agcaguuccagugcaauuuc

SEQ ID NO: 120489 - RNA, 20 nt, Artificial Sequence
  MKO10120489_B_Tceb1
  gRNA
gugaaauuaauaucuucuga

SEQ ID NO: 120490 - RNA, 20 nt, Artificial Sequence
  MKO10120490_B_Tceb1
  gRNA
aauuucacauacauagcauc

SEQ ID NO: 120491 - RNA, 20 nt, Artificial Sequence
  MKO10120491_B_Tceb2
  gRNA
aagcucuggagggcuggaaa

SEQ ID NO: 120492 - RNA, 20 nt, Artificial Sequence
  MKO10120492_B_Tceb2
  gRNA
gaugaccagcuccuugauga

SEQ ID NO: 120493 - RNA, 20 nt, Artificial Sequence
  MKO10120493_B_Tceb2
  gRNA
uccagaugugaugaagccac

SEQ ID NO: 120494 - RNA, 20 nt, Artificial Sequence
  MKO10120494_B_Tceb3
  gRNA
uuucggaagcaugagcaagu

SEQ ID NO: 120495 - RNA, 20 nt, Artificial Sequence
  MKO10120495_B_Tceb3
  gRNA
uccuuucagccaaagcgaaa

SEQ ID NO: 120496 - RNA, 20 nt, Artificial Sequence
  MKO10120496_B_Tceb3
  gRNA
cuggaaccagcuucuuccac

SEQ ID NO: 120497 - RNA, 20 nt, Artificial Sequence
  MKO10120497_B_Tcerg1l
  gRNA
uuagcagcucaacccauacc

SEQ ID NO: 120498 - RNA, 20 nt, Artificial Sequence
  MKO10120498_B_Tcerg1l
  gRNA
uaagaggaugccuaauuaca

SEQ ID NO: 120499 - RNA, 20 nt, Artificial Sequence
  MKO10120499_B_Tcerg1l
  gRNA
cccccaucagaauccccuuc

SEQ ID NO: 120500 - RNA, 20 nt, Artificial Sequence
  MKO10120500_B_Tcerg1
  gRNA
gccggcugagguaccgagug

SEQ ID NO: 120501 - RNA, 20 nt, Artificial Sequence
  MKO10120501_B_Tcerg1
  gRNA
augccuccggggacugcucc

SEQ ID NO: 120502 - RNA, 20 nt, Artificial Sequence
  MKO10120502_B_Tcerg1
  gRNA
ccggguaugauguucccacc

SEQ ID NO: 120503 - RNA, 20 nt, Artificial Sequence
  MKO10120503_B_Tcf12
  gRNA
ucuuuagguauggaugagcg

SEQ ID NO: 120504 - RNA, 20 nt, Artificial Sequence
  MKO10120504_B_Tcf12
  gRNA
gaaaacgagaccaacaacac

SEQ ID NO: 120505 - RNA, 20 nt, Artificial Sequence
  MKO10120505_B_Tcf12
  gRNA
acuuacucuagaugaaucau

SEQ ID NO: 120506 - RNA, 20 nt, Artificial Sequence
  MKO10120506_B_Tcf15
  gRNA
gggauccagguucaucgccg

SEQ ID NO: 120507 - RNA, 20 nt, Artificial Sequence
  MKO10120507_B_Tcf15
  gRNA
cuucgcagcagccgaacgac

SEQ ID NO: 120508 - RNA, 20 nt, Artificial Sequence
  MKO10120508_B_Tcf15
  gRNA
gcgcagcagcgcgaacgcca

SEQ ID NO: 120509 - RNA, 20 nt, Artificial Sequence
  MKO10120509_B_Tcf19
  gRNA
uugcgcuuccccaugcugag

SEQ ID NO: 120510 - RNA, 20 nt, Artificial Sequence
  MKO10120510_B_Tcf19
  gRNA
ggcccugcagcccaaucgau

SEQ ID NO: 120511 - RNA, 20 nt, Artificial Sequence
  MKO10120511_B_Tcf19
  gRNA
ugacccuccagucguccccu

SEQ ID NO: 120512 - RNA, 20 nt, Artificial Sequence
  MKO10120512_B_Tcf20
  gRNA
uacccaugugccauugacgc

SEQ ID NO: 120513 - RNA, 20 nt, Artificial Sequence
  MKO10120513_B_Tcf20
  gRNA
ucagcacagagcaguccgag

SEQ ID NO: 120514 - RNA, 20 nt, Artificial Sequence
  MKO10120514_B_Tcf20
  gRNA
uugcagaacaagaccgcaaa

SEQ ID NO: 120515 - RNA, 20 nt, Artificial Sequence
  MKO10120515_B_Tcf21
  gRNA
ugguuugccggccaccauaa

SEQ ID NO: 120516 - RNA, 20 nt, Artificial Sequence
  MKO10120516_B_Tcf21
  gRNA
gccaacgacaaguacgagaa

SEQ ID NO: 120517 - RNA, 20 nt, Artificial Sequence
  MKO10120517_B_Tcf21
  gRNA
accguucucguacuugucgu

SEQ ID NO: 120518 - RNA, 20 nt, Artificial Sequence
  MKO10120518_B_Tcf23
  gRNA
ugcauagagacgagaucgca

SEQ ID NO: 120519 - RNA, 20 nt, Artificial Sequence
  MKO10120519_B_Tcf23
  gRNA
gccuagaagccaccgugccu

SEQ ID NO: 120520 - RNA, 20 nt, Artificial Sequence
  MKO10120520_B_Tcf23
  gRNA
ugauagcggcaugucacagg

SEQ ID NO: 120521 - RNA, 20 nt, Artificial Sequence
  MKO10120521_B_Tcf24
  gRNA
cuauucgcacagacaugauc

SEQ ID NO: 120522 - RNA, 20 nt, Artificial Sequence
  MKO10120522_B_Tcf24
  gRNA
cugggcgccuugcgaggcga

SEQ ID NO: 120523 - RNA, 20 nt, Artificial Sequence
  MKO10120523_B_Tcf24
  gRNA
accggggucuccgggcgcgu

SEQ ID NO: 120524 - RNA, 20 nt, Artificial Sequence
  MKO10120524_B_Tcf25
  gRNA
caggaagcacguccuauaug

SEQ ID NO: 120525 - RNA, 20 nt, Artificial Sequence
  MKO10120525_B_Tcf25
  gRNA
gaggaugaccuugugguaaa

SEQ ID NO: 120526 - RNA, 20 nt, Artificial Sequence
  MKO10120526_B_Tcf25
  gRNA
uuccauuagucuaaugcaag

SEQ ID NO: 120527 - RNA, 20 nt, Artificial Sequence
  MKO10120527_B_Tcf3
  gRNA
ucuuacccggcuagggucaa

SEQ ID NO: 120528 - RNA, 20 nt, Artificial Sequence
  MKO10120528_B_Tcf3
  gRNA
cucccccagacauacagcga

SEQ ID NO: 120529 - RNA, 20 nt, Artificial Sequence
  MKO10120529_B_Tcf3
  gRNA
cuggaggaccgacccagcuc

SEQ ID NO: 120530 - RNA, 20 nt, Artificial Sequence
  MKO10120530_B_Tcf4
  gRNA
gaggccauccaagcccgucc

SEQ ID NO: 120531 - RNA, 20 nt, Artificial Sequence
  MKO10120531_B_Tcf4
  gRNA
cagcucuuuguccgucccua

SEQ ID NO: 120532 - RNA, 20 nt, Artificial Sequence
  MKO10120532_B_Tcf4
  gRNA
caagaucccugcuagucaug

SEQ ID NO: 120533 - RNA, 20 nt, Artificial Sequence
  MKO10120533_B_Tcf7l1
  gRNA
gccgagcagcgacagcgcuu

SEQ ID NO: 120534 - RNA, 20 nt, Artificial Sequence
  MKO10120534_B_Tcf7l1
  gRNA
ccuuaaaaaaagcgccaucc

SEQ ID NO: 120535 - RNA, 20 nt, Artificial Sequence
  MKO10120535_B_Tcf7l1
  gRNA
cuuacggugcgcgcuccacc

SEQ ID NO: 120536 - RNA, 20 nt, Artificial Sequence
  MKO10120536_B_Tcf7l2
  gRNA
ucagcucgucguuagcgccu

SEQ ID NO: 120537 - RNA, 20 nt, Artificial Sequence
  MKO10120537_B_Tcf7l2
  gRNA
uuuaaggggccaccguaucc

SEQ ID NO: 120538 - RNA, 20 nt, Artificial Sequence
  MKO10120538_B_Tcf7l2
  gRNA
ccuccgggaaggcggaaaga

SEQ ID NO: 120539 - RNA, 20 nt, Artificial Sequence
  MKO10120539_B_Tcf7
  gRNA
gaaagcugggggacgccaug

SEQ ID NO: 120540 - RNA, 20 nt, Artificial Sequence
  MKO10120540_B_Tcf7
  gRNA
acacuuaccagcucacagua

SEQ ID NO: 120541 - RNA, 20 nt, Artificial Sequence
  MKO10120541_B_Tcf7
  gRNA
acucacagguuucuaucaua

SEQ ID NO: 120542 - RNA, 20 nt, Artificial Sequence
  MKO10120542_B_Tcfl5
  gRNA
cagguuuggauuaaaguggg

SEQ ID NO: 120543 - RNA, 20 nt, Artificial Sequence
  MKO10120543_B_Tcfl5
  gRNA
acuuuaauccaaaccugcuc

SEQ ID NO: 120544 - RNA, 20 nt, Artificial Sequence
  MKO10120544_B_Tcfl5
  gRNA
ugccagccuugcacagacgc

SEQ ID NO: 120545 - RNA, 20 nt, Artificial Sequence
  MKO10120545_B_Tchhl1
  gRNA
gaccggcuuguccugaaucc

SEQ ID NO: 120546 - RNA, 20 nt, Artificial Sequence
  MKO10120546_B_Tchhl1
  gRNA
cugugcgggucaguguugcc

SEQ ID NO: 120547 - RNA, 20 nt, Artificial Sequence
  MKO10120547_B_Tchhl1
  gRNA
gauaguuuaguaucauccau

SEQ ID NO: 120548 - RNA, 20 nt, Artificial Sequence
  MKO10120548_B_Tchh
  gRNA
uaugcaucacaaaguuguga

SEQ ID NO: 120549 - RNA, 20 nt, Artificial Sequence
  MKO10120549_B_Tchh
  gRNA
gcgcgaccgucagauccuag

SEQ ID NO: 120550 - RNA, 20 nt, Artificial Sequence
  MKO10120550_B_Tchh
  gRNA
uguuccucgcguuccucgcg

SEQ ID NO: 120551 - RNA, 20 nt, Artificial Sequence
  MKO10120551_B_Tchp
  gRNA
cucgacucucauccucgccu

SEQ ID NO: 120552 - RNA, 20 nt, Artificial Sequence
  MKO10120552_B_Tchp
  gRNA
aaggcuccgcgagcagcacc

SEQ ID NO: 120553 - RNA, 20 nt, Artificial Sequence
  MKO10120553_B_Tchp
  gRNA
cuaccauugugagaagauga

SEQ ID NO: 120554 - RNA, 20 nt, Artificial Sequence
  MKO10120554_B_Tcirg1
  gRNA
ccgagaccugcugcgcaucc

SEQ ID NO: 120555 - RNA, 20 nt, Artificial Sequence
  MKO10120555_B_Tcirg1
  gRNA
gaauguggcccccgggugcc

SEQ ID NO: 120556 - RNA, 20 nt, Artificial Sequence
  MKO10120556_B_Tcirg1
  gRNA
cgcggcaagcucuccacagc

SEQ ID NO: 120557 - RNA, 20 nt, Artificial Sequence
  MKO10120557_B_Tcl1b1
  gRNA
gucacccuaacaccagcauc

SEQ ID NO: 120558 - RNA, 20 nt, Artificial Sequence
  MKO10120558_B_Tcl1b1
  gRNA
cucauagaugcccagucuaa

SEQ ID NO: 120559 - RNA, 20 nt, Artificial Sequence
  MKO10120559_B_Tcl1b1
  gRNA
agagcaacugauccugaugc

SEQ ID NO: 120560 - RNA, 20 nt, Artificial Sequence
  MKO10120560_B_Tcl1b2
  gRNA
aaacucaccuuguugcaaua

SEQ ID NO: 120561 - RNA, 20 nt, Artificial Sequence
  MKO10120561_B_Tcl1b2
  gRNA
gucaccuuuacuccagcauc

SEQ ID NO: 120562 - RNA, 20 nt, Artificial Sequence
  MKO10120562_B_Tcl1b2
  gRNA
agugcaacugauccugaugc

SEQ ID NO: 120563 - RNA, 20 nt, Artificial Sequence
  MKO10120563_B_Tcl1b3
  gRNA
gcauaugaccacaauccccc

SEQ ID NO: 120564 - RNA, 20 nt, Artificial Sequence
  MKO10120564_B_Tcl1b3
  gRNA
gcgaggugggaauggcaucc

SEQ ID NO: 120565 - RNA, 20 nt, Artificial Sequence
  MKO10120565_B_Tcl1b3
  gRNA
aguaggcuccugggggauug

SEQ ID NO: 120566 - RNA, 20 nt, Artificial Sequence
  MKO10120566_B_Tcl1b4
  gRNA
acaguggguagcugcaaaag

SEQ ID NO: 120567 - RNA, 20 nt, Artificial Sequence
  MKO10120567_B_Tcl1b4
  gRNA
acuaggcuccuggaagagug

SEQ ID NO: 120568 - RNA, 20 nt, Artificial Sequence
  MKO10120568_B_Tcl1b4
  gRNA
ccacaaguggacaguuacac

SEQ ID NO: 120569 - RNA, 20 nt, Artificial Sequence
  MKO10120569_B_Tcl1b5
  gRNA
ccuccuggucucuguuagcc

SEQ ID NO: 120570 - RNA, 20 nt, Artificial Sequence
  MKO10120570_B_Tcl1b5
  gRNA
cugugucuguugauccccag

SEQ ID NO: 120571 - RNA, 20 nt, Artificial Sequence
  MKO10120571_B_Tcl1b5
  gRNA
uguucccguguauguguucc

SEQ ID NO: 120572 - RNA, 20 nt, Artificial Sequence
  MKO10120572_B_Tcl1
  gRNA
gggucuggguuauucaucgu

SEQ ID NO: 120573 - RNA, 20 nt, Artificial Sequence
  MKO10120573_B_Tcl1
  gRNA
ccgcccucaguuuagagacg

SEQ ID NO: 120574 - RNA, 20 nt, Artificial Sequence
  MKO10120574_B_Tcl1
  gRNA
cuuacgagcugccuuuaaug

SEQ ID NO: 120575 - RNA, 20 nt, Artificial Sequence
  MKO10120575_B_Tcn2
  gRNA
aauaccgcaggaggcacugc

SEQ ID NO: 120576 - RNA, 20 nt, Artificial Sequence
  MKO10120576_B_Tcn2
  gRNA
ucgcaggccaacgaagacgc

SEQ ID NO: 120577 - RNA, 20 nt, Artificial Sequence
  MKO10120577_B_Tcn2
  gRNA
ucugagaccacgaaucacca

SEQ ID NO: 120578 - RNA, 20 nt, Artificial Sequence
  MKO10120578_B_Tcof1
  gRNA
gcugcgguugcagaauugac

SEQ ID NO: 120579 - RNA, 20 nt, Artificial Sequence
  MKO10120579_B_Tcof1
  gRNA
gacucagcccgucacccuuc

SEQ ID NO: 120580 - RNA, 20 nt, Artificial Sequence
  MKO10120580_B_Tcof1
  gRNA
aagaggaggcagcaaccgaa

SEQ ID NO: 120581 - RNA, 20 nt, Artificial Sequence
  MKO10120581_B_Tcp10a
  gRNA
agaguguugcuugcucuugc

SEQ ID NO: 120582 - RNA, 20 nt, Artificial Sequence
  MKO10120582_B_Tcp10a
  gRNA
cagaagcagaucugugaccu

SEQ ID NO: 120583 - RNA, 20 nt, Artificial Sequence
  MKO10120583_B_Tcp10a
  gRNA
gccaguguacauaaagauag

SEQ ID NO: 120584 - RNA, 20 nt, Artificial Sequence
  MKO10120584_B_Tcp10b
  gRNA
agcaagagcaagcaacacuc

SEQ ID NO: 120585 - RNA, 20 nt, Artificial Sequence
  MKO10120585_B_Tcp10b
  gRNA
cagccagugacucugugucc

SEQ ID NO: 120586 - RNA, 20 nt, Artificial Sequence
  MKO10120586_B_Tcp10b
  gRNA
aaauuucugcaaagaagcuu

SEQ ID NO: 120587 - RNA, 20 nt, Artificial Sequence
  MKO10120587_B_Tcp10c
  gRNA
gccaguguacauaaagauag

SEQ ID NO: 120588 - RNA, 20 nt, Artificial Sequence
  MKO10120588_B_Tcp10c
  gRNA
guggccauugugcuucuguu

SEQ ID NO: 120589 - RNA, 20 nt, Artificial Sequence
  MKO10120589_B_Tcp10c
  gRNA
auuccgagaggacaaccuca

SEQ ID NO: 120590 - RNA, 20 nt, Artificial Sequence
  MKO10120590_B_Tcp11l1
  gRNA
agcagucagucgaguaugag

SEQ ID NO: 120591 - RNA, 20 nt, Artificial Sequence
  MKO10120591_B_Tcp11l1
  gRNA
aaugcuacugauggcgaagu

SEQ ID NO: 120592 - RNA, 20 nt, Artificial Sequence
  MKO10120592_B_Tcp11l1
  gRNA
uugggggcucuucacuuaac

SEQ ID NO: 120593 - RNA, 20 nt, Artificial Sequence
  MKO10120593_B_Tcp11l2
  gRNA
uagacaaaucuuccgugucu

SEQ ID NO: 120594 - RNA, 20 nt, Artificial Sequence
  MKO10120594_B_Tcp11l2
  gRNA
caucgaccucauuagacagc

SEQ ID NO: 120595 - RNA, 20 nt, Artificial Sequence
  MKO10120595_B_Tcp11l2
  gRNA
gaaagcuaccaccaacaucg

SEQ ID NO: 120596 - RNA, 20 nt, Artificial Sequence
  MKO10120596_B_Tcp11
  gRNA
cuccagcagcaagccgaccg

SEQ ID NO: 120597 - RNA, 20 nt, Artificial Sequence
  MKO10120597_B_Tcp11
  gRNA
acaccaugcccagcgacuuc

SEQ ID NO: 120598 - RNA, 20 nt, Artificial Sequence
  MKO10120598_B_Tcp11
  gRNA
cagaugcucccagaagucgc

SEQ ID NO: 120599 - RNA, 20 nt, Artificial Sequence
  MKO10120599_B_Tcp1
  gRNA
ucaacagguaaucauugcag

SEQ ID NO: 120600 - RNA, 20 nt, Artificial Sequence
  MKO10120600_B_Tcp1
  gRNA
guucgucuguguuaauaauc

SEQ ID NO: 120601 - RNA, 20 nt, Artificial Sequence
  MKO10120601_B_Tcp1
  gRNA
cauccaacaucaguuauuag

SEQ ID NO: 120602 - RNA, 20 nt, Artificial Sequence
  MKO10120602_B_Tcstv1
  gRNA
aauuagaacaccuuguacuc

SEQ ID NO: 120603 - RNA, 20 nt, Artificial Sequence
  MKO10120603_B_Tcstv1
  gRNA
gccuuucucacuucuucuua

SEQ ID NO: 120604 - RNA, 20 nt, Artificial Sequence
  MKO10120604_B_Tcstv1
  gRNA
ucaaucuucgguaggaucuc

SEQ ID NO: 120605 - RNA, 20 nt, Artificial Sequence
  MKO10120605_B_Tcstv3
  gRNA
cucccugagcaagcuuagug

SEQ ID NO: 120606 - RNA, 20 nt, Artificial Sequence
  MKO10120606_B_Tcstv3
  gRNA
aacccucacuaagcuugcuc

SEQ ID NO: 120607 - RNA, 20 nt, Artificial Sequence
  MKO10120607_B_Tcstv3
  gRNA
gaaacaaagugucucagaau

SEQ ID NO: 120608 - RNA, 20 nt, Artificial Sequence
  MKO10120608_B_Tcua
  gRNA
cucaaaacgcacagagaaua

SEQ ID NO: 120609 - RNA, 20 nt, Artificial Sequence
  MKO10120609_B_Tcua
  gRNA
cagaauggauccacaccuga

SEQ ID NO: 120610 - RNA, 20 nt, Artificial Sequence
  MKO10120610_B_Tcua
  gRNA
uguguucccguagaaccccc

SEQ ID NO: 120611 - RNA, 20 nt, Artificial Sequence
  MKO10120611_B_Tcue1
  gRNA
cacggaccccaacgugaucc

SEQ ID NO: 120612 - RNA, 20 nt, Artificial Sequence
  MKO10120612_B_Tcue1
  gRNA
ccaagcaaucgcccacgccc

SEQ ID NO: 120613 - RNA, 20 nt, Artificial Sequence
  MKO10120613_B_Tcue1
  gRNA
ccuccgccucaacuguaucg

SEQ ID NO: 120614 - RNA, 20 nt, Artificial Sequence
  MKO10120614_B_Tcue2
  gRNA
gagauagcagcuacugugau

SEQ ID NO: 120615 - RNA, 20 nt, Artificial Sequence
  MKO10120615_B_Tcue2
  gRNA
aagccuccgaguggccuucu

SEQ ID NO: 120616 - RNA, 20 nt, Artificial Sequence
  MKO10120616_B_Tcue2
  gRNA
uaauuuaggggaucccgaga

SEQ ID NO: 120617 - RNA, 20 nt, Artificial Sequence
  MKO10120617_B_Tcue3
  gRNA
gaugacucaauugcugaugu

SEQ ID NO: 120618 - RNA, 20 nt, Artificial Sequence
  MKO10120618_B_Tcue3
  gRNA
cccucauuugucacuugaau

SEQ ID NO: 120619 - RNA, 20 nt, Artificial Sequence
  MKO10120619_B_Tcue3
  gRNA
guauaaugaauuuauaacga

SEQ ID NO: 120620 - RNA, 20 nt, Artificial Sequence
  MKO10120620_B_Tcuex1d1
  gRNA
ggugcugaaagcuuacguca

SEQ ID NO: 120621 - RNA, 20 nt, Artificial Sequence
  MKO10120621_B_Tcuex1d1
  gRNA
cuaauugucaucguuuacau

SEQ ID NO: 120622 - RNA, 20 nt, Artificial Sequence
  MKO10120622_B_Tcuex1d1
  gRNA
ucccaccaaaccuuuccccg

SEQ ID NO: 120623 - RNA, 20 nt, Artificial Sequence
  MKO10120623_B_Tcuex1d2
  gRNA
augauuaaagauaagcuaaa

SEQ ID NO: 120624 - RNA, 20 nt, Artificial Sequence
  MKO10120624_B_Tcuex1d2
  gRNA
gcauggcugcucgcuguuuc

SEQ ID NO: 120625 - RNA, 20 nt, Artificial Sequence
  MKO10120625_B_Tcuex1d2
  gRNA
augguggugcaaguggugau

SEQ ID NO: 120626 - RNA, 20 nt, Artificial Sequence
  MKO10120626_B_Tcuex1d4
  gRNA
auugaugagacccgaccuau

SEQ ID NO: 120627 - RNA, 20 nt, Artificial Sequence
  MKO10120627_B_Tcuex1d4
  gRNA
agggauggucgucgaccucc

SEQ ID NO: 120628 - RNA, 20 nt, Artificial Sequence
  MKO10120628_B_Tcuex1d4
  gRNA
cguugcacacgaguuuguag

SEQ ID NO: 120629 - RNA, 20 nt, Artificial Sequence
  MKO10120629_B_Tcun1
  gRNA
cccacagcccacuaaauacg

SEQ ID NO: 120630 - RNA, 20 nt, Artificial Sequence
  MKO10120630_B_Tcun1
  gRNA
caguugacaucacacugugc

SEQ ID NO: 120631 - RNA, 20 nt, Artificial Sequence
  MKO10120631_B_Tcun1
  gRNA
gcacacagagaugacgugag

SEQ ID NO: 120632 - RNA, 20 nt, Artificial Sequence
  MKO10120632_B_Tcun2
  gRNA
cccugagguccgagcgaccc

SEQ ID NO: 120633 - RNA, 20 nt, Artificial Sequence
  MKO10120633_B_Tcun2
  gRNA
gaaugaggcugucucgucug

SEQ ID NO: 120634 - RNA, 20 nt, Artificial Sequence
  MKO10120634_B_Tcun2
  gRNA
cauccucgcugccuccgacc

SEQ ID NO: 120635 - RNA, 20 nt, Artificial Sequence
  MKO10120635_B_Tcun3
  gRNA
acaaaacugugucguuccac

SEQ ID NO: 120636 - RNA, 20 nt, Artificial Sequence
  MKO10120636_B_Tcun3
  gRNA
cucacccuauagaauaguac

SEQ ID NO: 120637 - RNA, 20 nt, Artificial Sequence
  MKO10120637_B_Tcun3
  gRNA
ugugccgagagcaacccugc

SEQ ID NO: 120638 - RNA, 20 nt, Artificial Sequence
  MKO10120638_B_Tdgf1
  gRNA
uuuccaguuugugccuuccg

SEQ ID NO: 120639 - RNA, 20 nt, Artificial Sequence
  MKO10120639_B_Tdgf1
  gRNA
ccaucagagauaacagcauu

SEQ ID NO: 120640 - RNA, 20 nt, Artificial Sequence
  MKO10120640_B_Tdgf1
  gRNA
aauaaaacuugcugucugaa

SEQ ID NO: 120641 - RNA, 20 nt, Artificial Sequence
  MKO10120641_B_Tdg
  gRNA
agggaagugucuguucaugu

SEQ ID NO: 120642 - RNA, 20 nt, Artificial Sequence
  MKO10120642_B_Tdg
  gRNA
uuucagaagcuccaaagaga

SEQ ID NO: 120643 - RNA, 20 nt, Artificial Sequence
  MKO10120643_B_Tdg
  gRNA
cacuuacagaagugauuucc

SEQ ID NO: 120644 - RNA, 20 nt, Artificial Sequence
  MKO10120644_B_Tdh
  gRNA
cagugcccugcugagugccg

SEQ ID NO: 120645 - RNA, 20 nt, Artificial Sequence
  MKO10120645_B_Tdh
  gRNA
accaguuauauucacaucuc

SEQ ID NO: 120646 - RNA, 20 nt, Artificial Sequence
  MKO10120646_B_Tdh
  gRNA
ccuagggggucuuggccagc

SEQ ID NO: 120647 - RNA, 20 nt, Artificial Sequence
  MKO10120647_B_Tdo2
  gRNA
gaaccgagaacugcuguacc

SEQ ID NO: 120648 - RNA, 20 nt, Artificial Sequence
  MKO10120648_B_Tdo2
  gRNA
cuauucaucauaacucauca

SEQ ID NO: 120649 - RNA, 20 nt, Artificial Sequence
  MKO10120649_B_Tdo2
  gRNA
guucgugaaaucuuccaaaa

SEQ ID NO: 120650 - RNA, 20 nt, Artificial Sequence
  MKO10120650_B_Tdp1
  gRNA
aacccgauccugcuugugca

SEQ ID NO: 120651 - RNA, 20 nt, Artificial Sequence
  MKO10120651_B_Tdp1
  gRNA
gcaaaguuggauauugcauu

SEQ ID NO: 120652 - RNA, 20 nt, Artificial Sequence
  MKO10120652_B_Tdp1
  gRNA
gagacaagugucccaaacag

SEQ ID NO: 120653 - RNA, 20 nt, Artificial Sequence
  MKO10120653_B_Tdp2
  gRNA
aauuagguauaguccagaug

SEQ ID NO: 120654 - RNA, 20 nt, Artificial Sequence
  MKO10120654_B_Tdp2
  gRNA
guucucuggcagcucgaagu

SEQ ID NO: 120655 - RNA, 20 nt, Artificial Sequence
  MKO10120655_B_Tdp2
  gRNA
ucccacguccuucaaguccg

SEQ ID NO: 120656 - RNA, 20 nt, Artificial Sequence
  MKO10120656_B_Tdpoz1
  gRNA
auucagguuaugaaucuuaa

SEQ ID NO: 120657 - RNA, 20 nt, Artificial Sequence
  MKO10120657_B_Tdpoz1
  gRNA
caauaucgacuuccacucug

SEQ ID NO: 120658 - RNA, 20 nt, Artificial Sequence
  MKO10120658_B_Tdpoz1
  gRNA
gccaucugcagaucccaguu

SEQ ID NO: 120659 - RNA, 20 nt, Artificial Sequence
  MKO10120659_B_Tdpoz2
  gRNA
gucaucauucaaacgccuua

SEQ ID NO: 120660 - RNA, 20 nt, Artificial Sequence
  MKO10120660_B_Tdpoz2
  gRNA
ccucugcaggaacgucucug

SEQ ID NO: 120661 - RNA, 20 nt, Artificial Sequence
  MKO10120661_B_Tdpoz2
  gRNA
uuccuuaacacugaucugug

SEQ ID NO: 120662 - RNA, 20 nt, Artificial Sequence
  MKO10120662_B_Tdpoz3
  gRNA
uucaaaaaguuucuccuucg

SEQ ID NO: 120663 - RNA, 20 nt, Artificial Sequence
  MKO10120663_B_Tdpoz3
  gRNA
uucuccuuucccauaugaau

SEQ ID NO: 120664 - RNA, 20 nt, Artificial Sequence
  MKO10120664_B_Tdpoz3
  gRNA
gugcagcagucuucacagag

SEQ ID NO: 120665 - RNA, 20 nt, Artificial Sequence
  MKO10120665_B_Tdpoz4
  gRNA
ggacuugauggucaugugug

SEQ ID NO: 120666 - RNA, 20 nt, Artificial Sequence
  MKO10120666_B_Tdpoz4
  gRNA
cauuauaguuuaugcuucug

SEQ ID NO: 120667 - RNA, 20 nt, Artificial Sequence
  MKO10120667_B_Tdpoz4
  gRNA
ggagucacauccccgcuugg

SEQ ID NO: 120668 - RNA, 20 nt, Artificial Sequence
  MKO10120668_B_Tdpoz5
  gRNA
ggauucaaaaaguucauccu

SEQ ID NO: 120669 - RNA, 20 nt, Artificial Sequence
  MKO10120669_B_Tdpoz5
  gRNA
cuccauuucauguucaaaca

SEQ ID NO: 120670 - RNA, 20 nt, Artificial Sequence
  MKO10120670_B_Tdpoz5
  gRNA
uccucaucucucauccacgu

SEQ ID NO: 120671 - RNA, 20 nt, Artificial Sequence
  MKO10120671_B_Tdrd12
  gRNA
cucuucugcagaccauuacc

SEQ ID NO: 120672 - RNA, 20 nt, Artificial Sequence
  MKO10120672_B_Tdrd12
  gRNA
uuauuacagauugaagaucc

SEQ ID NO: 120673 - RNA, 20 nt, Artificial Sequence
  MKO10120673_B_Tdrd12
  gRNA
gcuguuauagaagucauuca

SEQ ID NO: 120674 - RNA, 20 nt, Artificial Sequence
  MKO10120674_B_Tdrd1
  gRNA
agugcugaccuuugcuguac

SEQ ID NO: 120675 - RNA, 20 nt, Artificial Sequence
  MKO10120675_B_Tdrd1
  gRNA
aaccucacucuucacuucaa

SEQ ID NO: 120676 - RNA, 20 nt, Artificial Sequence
  MKO10120676_B_Tdrd1
  gRNA
ccagugucaccauuaagucu

SEQ ID NO: 120677 - RNA, 20 nt, Artificial Sequence
  MKO10120677_B_Tdrd3
  gRNA
caacgcggcgccggacaccu

SEQ ID NO: 120678 - RNA, 20 nt, Artificial Sequence
  MKO10120678_B_Tdrd3
  gRNA
aaccuacauugagagcaauc

SEQ ID NO: 120679 - RNA, 20 nt, Artificial Sequence
  MKO10120679_B_Tdrd3
  gRNA
cuuuccaccguugaugucac

SEQ ID NO: 120680 - RNA, 20 nt, Artificial Sequence
  MKO10120680_B_Tdrd5
  gRNA
gucgugucuaaguuuccaca

SEQ ID NO: 120681 - RNA, 20 nt, Artificial Sequence
  MKO10120681_B_Tdrd5
  gRNA
agguccaaucugugcaauca

SEQ ID NO: 120682 - RNA, 20 nt, Artificial Sequence
  MKO10120682_B_Tdrd5
  gRNA
cgccaugcucaguacuuguu

SEQ ID NO: 120683 - RNA, 20 nt, Artificial Sequence
  MKO10120683_B_Tdrd6
  gRNA
auucucgaacuagccgaaga

SEQ ID NO: 120684 - RNA, 20 nt, Artificial Sequence
  MKO10120684_B_Tdrd6
  gRNA
acgcggguuaccuuuggugg

SEQ ID NO: 120685 - RNA, 20 nt, Artificial Sequence
  MKO10120685_B_Tdrd6
  gRNA
caguaagccccgagaauguc

SEQ ID NO: 120686 - RNA, 20 nt, Artificial Sequence
  MKO10120686_B_Tdrd7
  gRNA
augcucgcgugccucugcac

SEQ ID NO: 120687 - RNA, 20 nt, Artificial Sequence
  MKO10120687_B_Tdrd7
  gRNA
gccugcccuacggaagucaa

SEQ ID NO: 120688 - RNA, 20 nt, Artificial Sequence
  MKO10120688_B_Tdrd7
  gRNA
cucagcuuguggcucgucag

SEQ ID NO: 120689 - RNA, 20 nt, Artificial Sequence
  MKO10120689_B_Tdrd9
  gRNA
aaccugcguaccugguccac

SEQ ID NO: 120690 - RNA, 20 nt, Artificial Sequence
  MKO10120690_B_Tdrd9
  gRNA
ucuucuuuacaccgauuuau

SEQ ID NO: 120691 - RNA, 20 nt, Artificial Sequence
  MKO10120691_B_Tdrd9
  gRNA
cacgcacaucuucauugacg

SEQ ID NO: 120692 - RNA, 20 nt, Artificial Sequence
  MKO10120692_B_Tdrkh
  gRNA
cuggaaguuccucuccgcaa

SEQ ID NO: 120693 - RNA, 20 nt, Artificial Sequence
  MKO10120693_B_Tdrkh
  gRNA
gagcgagugcugcuuaucag

SEQ ID NO: 120694 - RNA, 20 nt, Artificial Sequence
  MKO10120694_B_Tdrkh
  gRNA
ggaacuuccagggguguagc

SEQ ID NO: 120695 - RNA, 20 nt, Artificial Sequence
  MKO10120695_B_Tdrp
  gRNA
ccuccggucagcgggaaagc

SEQ ID NO: 120696 - RNA, 20 nt, Artificial Sequence
  MKO10120696_B_Tdrp
  gRNA
uccagaucuccuaaguccaa

SEQ ID NO: 120697 - RNA, 20 nt, Artificial Sequence
  MKO10120697_B_Tdrp
  gRNA
cugacucacccuuuggacuu

SEQ ID NO: 120698 - RNA, 20 nt, Artificial Sequence
  MKO10120698_B_Tead1
  gRNA
cguccugaguuugauguauc

SEQ ID NO: 120699 - RNA, 20 nt, Artificial Sequence
  MKO10120699_B_Tead1
  gRNA
gcaggugucuagucacauuc

SEQ ID NO: 120700 - RNA, 20 nt, Artificial Sequence
  MKO10120700_B_Tead1
  gRNA
gucaucagcccagaucgucu

SEQ ID NO: 120701 - RNA, 20 nt, Artificial Sequence
  MKO10120701_B_Tead2
  gRNA
gaugagcugugccgaagaca

SEQ ID NO: 120702 - RNA, 20 nt, Artificial Sequence
  MKO10120702_B_Tead2
  gRNA
cagagcucccugaccagaac

SEQ ID NO: 120703 - RNA, 20 nt, Artificial Sequence
  MKO10120703_B_Tead2
  gRNA
ccaggucuccagccauauuc

SEQ ID NO: 120704 - RNA, 20 nt, Artificial Sequence
  MKO10120704_B_Tead3
  gRNA
uccgagcuagaaccuguaug

SEQ ID NO: 120705 - RNA, 20 nt, Artificial Sequence
  MKO10120705_B_Tead3
  gRNA
uccuucacaggcuaugaacc

SEQ ID NO: 120706 - RNA, 20 nt, Artificial Sequence
  MKO10120706_B_Tead3
  gRNA
caguccucagcuugauguag

SEQ ID NO: 120707 - RNA, 20 nt, Artificial Sequence
  MKO10120707_B_Tead4
  gRNA
ucgcacgccauaucaagcuc

SEQ ID NO: 120708 - RNA, 20 nt, Artificial Sequence
  MKO10120708_B_Tead4
  gRNA
gaagacgcgcacaaggaagc

SEQ ID NO: 120709 - RNA, 20 nt, Artificial Sequence
  MKO10120709_B_Tead4
  gRNA
acucacucgugggauguucc

SEQ ID NO: 120710 - RNA, 20 nt, Artificial Sequence
  MKO10120710_B_Tecpr1
  gRNA
uucaccuaccccuuucucgg

SEQ ID NO: 120711 - RNA, 20 nt, Artificial Sequence
  MKO10120711_B_Tecpr1
  gRNA
accuuauaugggccacccuc

SEQ ID NO: 120712 - RNA, 20 nt, Artificial Sequence
  MKO10120712_B_Tecpr1
  gRNA
gguauaggcgauacaaaucc

SEQ ID NO: 120713 - RNA, 20 nt, Artificial Sequence
  MKO10120713_B_Tecpr2
  gRNA
agacgaggguagagcucaaa

SEQ ID NO: 120714 - RNA, 20 nt, Artificial Sequence
  MKO10120714_B_Tecpr2
  gRNA
guaguccagcugcacaaugg

SEQ ID NO: 120715 - RNA, 20 nt, Artificial Sequence
  MKO10120715_B_Tecpr2
  gRNA
caagaccagcaucacagcgc

SEQ ID NO: 120716 - RNA, 20 nt, Artificial Sequence
  MKO10120716_B_Tecrl
  gRNA
uagauggccccggcacccug

SEQ ID NO: 120717 - RNA, 20 nt, Artificial Sequence
  MKO10120717_B_Tecrl
  gRNA
gugauguagucccucaaaua

SEQ ID NO: 120718 - RNA, 20 nt, Artificial Sequence
  MKO10120718_B_Tecrl
  gRNA
agcuccucaaguaaaaaaga

SEQ ID NO: 120719 - RNA, 20 nt, Artificial Sequence
  MKO10120719_B_Tecr
  gRNA
ucuucuuugagguggagauu

SEQ ID NO: 120720 - RNA, 20 nt, Artificial Sequence
  MKO10120720_B_Tecr
  gRNA
ucaccgucacccagcugauc

SEQ ID NO: 120721 - RNA, 20 nt, Artificial Sequence
  MKO10120721_B_Tecr
  gRNA
accucggggcccagaucagc

SEQ ID NO: 120722 - RNA, 20 nt, Artificial Sequence
  MKO10120722_B_Tecua
  gRNA
cgucggauaccagcacagcc

SEQ ID NO: 120723 - RNA, 20 nt, Artificial Sequence
  MKO10120723_B_Tecua
  gRNA
agggacuuacauagacggug

SEQ ID NO: 120724 - RNA, 20 nt, Artificial Sequence
  MKO10120724_B_Tecua
  gRNA
acuuuaaaugcccagcgucc

SEQ ID NO: 120725 - RNA, 20 nt, Artificial Sequence
  MKO10120725_B_Tecub
  gRNA
cacgaucacugugcugucgu

SEQ ID NO: 120726 - RNA, 20 nt, Artificial Sequence
  MKO10120726_B_Tecub
  gRNA
ccuaagaacaaguccuacug

SEQ ID NO: 120727 - RNA, 20 nt, Artificial Sequence
  MKO10120727_B_Tecub
  gRNA
uguuacaacgggguccauga

SEQ ID NO: 120728 - RNA, 20 nt, Artificial Sequence
  MKO10120728_B_Tec
  gRNA
acccucauaguagcucaaca

SEQ ID NO: 120729 - RNA, 20 nt, Artificial Sequence
  MKO10120729_B_Tec
  gRNA
uuaaauaccauccuaaauuc

SEQ ID NO: 120730 - RNA, 20 nt, Artificial Sequence
  MKO10120730_B_Tec
  gRNA
ugggugaagaaguuaaaaga

SEQ ID NO: 120731 - RNA, 20 nt, Artificial Sequence
  MKO10120731_B_Teddm1
  gRNA
cacguagacacccaggaccg

SEQ ID NO: 120732 - RNA, 20 nt, Artificial Sequence
  MKO10120732_B_Teddm1
  gRNA
ggcccauuuccccuuauucu

SEQ ID NO: 120733 - RNA, 20 nt, Artificial Sequence
  MKO10120733_B_Teddm1
  gRNA
cuguggaaaauagcccaugc

SEQ ID NO: 120734 - RNA, 20 nt, Artificial Sequence
  MKO10120734_B_Tefm
  gRNA
cugagaaaguucaucaagcc

SEQ ID NO: 120735 - RNA, 20 nt, Artificial Sequence
  MKO10120735_B_Tefm
  gRNA
aaaggagcccgggaauccau

SEQ ID NO: 120736 - RNA, 20 nt, Artificial Sequence
  MKO10120736_B_Tefm
  gRNA
cccuaccuccggccuugaug

SEQ ID NO: 120737 - RNA, 20 nt, Artificial Sequence
  MKO10120737_B_Tef
  gRNA
cccccgcgcgagacgcgccu

SEQ ID NO: 120738 - RNA, 20 nt, Artificial Sequence
  MKO10120738_B_Tef
  gRNA
agguuacaagggcccguacu

SEQ ID NO: 120739 - RNA, 20 nt, Artificial Sequence
  MKO10120739_B_Tef
  gRNA
cauccagguccauguacucg

SEQ ID NO: 120740 - RNA, 20 nt, Artificial Sequence
  MKO10120740_B_Tekt1
  gRNA
uaagcagguucaugacuccg

SEQ ID NO: 120741 - RNA, 20 nt, Artificial Sequence
  MKO10120741_B_Tekt1
  gRNA
gcuuacguacaagacccgcc

SEQ ID NO: 120742 - RNA, 20 nt, Artificial Sequence
  MKO10120742_B_Tekt1
  gRNA
acguaagcaggucauccguc

SEQ ID NO: 120743 - RNA, 20 nt, Artificial Sequence
  MKO10120743_B_Tekt2
  gRNA
uuacucgauucaacaagaac

SEQ ID NO: 120744 - RNA, 20 nt, Artificial Sequence
  MKO10120744_B_Tekt2
  gRNA
ugaaagcguccauagaguug

SEQ ID NO: 120745 - RNA, 20 nt, Artificial Sequence
  MKO10120745_B_Tekt2
  gRNA
guugcugccgaauuuccugc

SEQ ID NO: 120746 - RNA, 20 nt, Artificial Sequence
  MKO10120746_B_Tekt3
  gRNA
cgucagcuacuuccggggcg

SEQ ID NO: 120747 - RNA, 20 nt, Artificial Sequence
  MKO10120747_B_Tekt3
  gRNA
uaccgccaguaguucuuucu

SEQ ID NO: 120748 - RNA, 20 nt, Artificial Sequence
  MKO10120748_B_Tekt3
  gRNA
cgauucccauucucuucucg

SEQ ID NO: 120749 - RNA, 20 nt, Artificial Sequence
  MKO10120749_B_Tekt4
  gRNA
cucauugguguagcgggagc

SEQ ID NO: 120750 - RNA, 20 nt, Artificial Sequence
  MKO10120750_B_Tekt4
  gRNA
cgagucugggccacacgcag

SEQ ID NO: 120751 - RNA, 20 nt, Artificial Sequence
  MKO10120751_B_Tekt4
  gRNA
gacccaccguaucuggucca

SEQ ID NO: 120752 - RNA, 20 nt, Artificial Sequence
  MKO10120752_B_Tekt5
  gRNA
ugucuucaauaucccgcucu

SEQ ID NO: 120753 - RNA, 20 nt, Artificial Sequence
  MKO10120753_B_Tekt5
  gRNA
acguggagaaaaaccuuauc

SEQ ID NO: 120754 - RNA, 20 nt, Artificial Sequence
  MKO10120754_B_Tekt5
  gRNA
cccuggagugucuguacaau

SEQ ID NO: 120755 - RNA, 20 nt, Artificial Sequence
  MKO10120755_B_Tek
  gRNA
aucuuggugcugguucauua

SEQ ID NO: 120756 - RNA, 20 nt, Artificial Sequence
  MKO10120756_B_Tek
  gRNA
accaugaagaugcgucaaca

SEQ ID NO: 120757 - RNA, 20 nt, Artificial Sequence
  MKO10120757_B_Tek
  gRNA
cauuugcccuccuggguuua

SEQ ID NO: 120758 - RNA, 20 nt, Artificial Sequence
  MKO10120758_B_Telo2
  gRNA
acugggucagguugucccgc

SEQ ID NO: 120759 - RNA, 20 nt, Artificial Sequence
  MKO10120759_B_Telo2
  gRNA
gacgcugcucagcaagguug

SEQ ID NO: 120760 - RNA, 20 nt, Artificial Sequence
  MKO10120760_B_Telo2
  gRNA
gucuguggcagcgggugugc

SEQ ID NO: 120761 - RNA, 20 nt, Artificial Sequence
  MKO10120761_B_Ten1
  gRNA
acugcuugucugcaccaacu

SEQ ID NO: 120762 - RNA, 20 nt, Artificial Sequence
  MKO10120762_B_Ten1
  gRNA
ccuuacccuccauucgcucc

SEQ ID NO: 120763 - RNA, 20 nt, Artificial Sequence
  MKO10120763_B_Ten1
  gRNA
ucccagugacagccuuaguc

SEQ ID NO: 120764 - RNA, 20 nt, Artificial Sequence
  MKO10120764_B_Tenc1
  gRNA
ucuuccggaaaaccuucucc

SEQ ID NO: 120765 - RNA, 20 nt, Artificial Sequence
  MKO10120765_B_Tenc1
  gRNA
ucucucucuagucugcaagg

SEQ ID NO: 120766 - RNA, 20 nt, Artificial Sequence
  MKO10120766_B_Tenc1
  gRNA
ccaggugacuucauccuguc

SEQ ID NO: 120767 - RNA, 20 nt, Artificial Sequence
  MKO10120767_B_Tenm1
  gRNA
aaagggcuuaccaauuacau

SEQ ID NO: 120768 - RNA, 20 nt, Artificial Sequence
  MKO10120768_B_Tenm1
  gRNA
uuguuacuagccuauguaau

SEQ ID NO: 120769 - RNA, 20 nt, Artificial Sequence
  MKO10120769_B_Tenm1
  gRNA
cuuccguucaugaucagugu

SEQ ID NO: 120770 - RNA, 20 nt, Artificial Sequence
  MKO10120770_B_Tenm2
  gRNA
uuccagacgacgucuugaaa

SEQ ID NO: 120771 - RNA, 20 nt, Artificial Sequence
  MKO10120771_B_Tenm2
  gRNA
ugguguauaaacggucccug

SEQ ID NO: 120772 - RNA, 20 nt, Artificial Sequence
  MKO10120772_B_Tenm2
  gRNA
gagcccuccccacaccgaag

SEQ ID NO: 120773 - RNA, 20 nt, Artificial Sequence
  MKO10120773_B_Tenm3
  gRNA
aacacuguaucguuaccuuc

SEQ ID NO: 120774 - RNA, 20 nt, Artificial Sequence
  MKO10120774_B_Tenm3
  gRNA
acccgaguccguccagcugc

SEQ ID NO: 120775 - RNA, 20 nt, Artificial Sequence
  MKO10120775_B_Tenm3
  gRNA
gacgacgccacuguucagua

SEQ ID NO: 120776 - RNA, 20 nt, Artificial Sequence
  MKO10120776_B_Tenm4
  gRNA
ugcgcccugaccgugugcuc

SEQ ID NO: 120777 - RNA, 20 nt, Artificial Sequence
  MKO10120777_B_Tenm4
  gRNA
cgucacuguaagccccauca

SEQ ID NO: 120778 - RNA, 20 nt, Artificial Sequence
  MKO10120778_B_Tenm4
  gRNA
cucagcgccucccgccauga

SEQ ID NO: 120779 - RNA, 20 nt, Artificial Sequence
  MKO10120779_B_Tep1
  gRNA
uggcuggcgggaccgccucu

SEQ ID NO: 120780 - RNA, 20 nt, Artificial Sequence
  MKO10120780_B_Tep1
  gRNA
ggaaccggaguucauccuua

SEQ ID NO: 120781 - RNA, 20 nt, Artificial Sequence
  MKO10120781_B_Tep1
  gRNA
aauaccuuaaggaugaacuc

SEQ ID NO: 120782 - RNA, 20 nt, Artificial Sequence
  MKO10120782_B_Tepp
  gRNA
gucacuuacagcgagucgaa

SEQ ID NO: 120783 - RNA, 20 nt, Artificial Sequence
  MKO10120783_B_Tepp
  gRNA
gcuucuguccguagcggucc

SEQ ID NO: 120784 - RNA, 20 nt, Artificial Sequence
  MKO10120784_B_Tepp
  gRNA
cuuucccuacccgccaguuc

SEQ ID NO: 120785 - RNA, 20 nt, Artificial Sequence
  MKO10120785_B_Terf1
  gRNA
ugcagcuauagcugaagugu

SEQ ID NO: 120786 - RNA, 20 nt, Artificial Sequence
  MKO10120786_B_Terf1
  gRNA
auaauuaccguguaaaauuc

SEQ ID NO: 120787 - RNA, 20 nt, Artificial Sequence
  MKO10120787_B_Terf1
  gRNA
uaaggcuguagcuguuugua

SEQ ID NO: 120788 - RNA, 20 nt, Artificial Sequence
  MKO10120788_B_Terf2ip
  gRNA
uccggaguucggagaagccg

SEQ ID NO: 120789 - RNA, 20 nt, Artificial Sequence
  MKO10120789_B_Terf2ip
  gRNA
accacggcuucuccgaacuc

SEQ ID NO: 120790 - RNA, 20 nt, Artificial Sequence
  MKO10120790_B_Terf2ip
  gRNA
ugacgacacgaaaaaugcac

SEQ ID NO: 120791 - RNA, 20 nt, Artificial Sequence
  MKO10120791_B_Terf2
  gRNA
acugcauaacccgcagcaac

SEQ ID NO: 120792 - RNA, 20 nt, Artificial Sequence
  MKO10120792_B_Terf2
  gRNA
gagcucagccuccauaucaa

SEQ ID NO: 120793 - RNA, 20 nt, Artificial Sequence
  MKO10120793_B_Terf2
  gRNA
ggaaucagcuaucaaugugc

SEQ ID NO: 120794 - RNA, 20 nt, Artificial Sequence
  MKO10120794_B_Tert
  gRNA
cccguagccgcacucucuca

SEQ ID NO: 120795 - RNA, 20 nt, Artificial Sequence
  MKO10120795_B_Tert
  gRNA
cauacgugguacagcugcuu

SEQ ID NO: 120796 - RNA, 20 nt, Artificial Sequence
  MKO10120796_B_Tert
  gRNA
ugaagagagucuugagacgc

SEQ ID NO: 120797 - RNA, 20 nt, Artificial Sequence
  MKO10120797_B_Tescl
  gRNA
cagguuccgguugucgaaga

SEQ ID NO: 120798 - RNA, 20 nt, Artificial Sequence
  MKO10120798_B_Tescl
  gRNA
cggucacuggcauaagaccg

SEQ ID NO: 120799 - RNA, 20 nt, Artificial Sequence
  MKO10120799_B_Tescl
  gRNA
ugaacaagugcgacuucagc

SEQ ID NO: 120800 - RNA, 20 nt, Artificial Sequence
  MKO10120800_B_Tesc
  gRNA
cgucuuaccgaauggugggc

SEQ ID NO: 120801 - RNA, 20 nt, Artificial Sequence
  MKO10120801_B_Tesc
  gRNA
cagugacggccgcaucaccc

SEQ ID NO: 120802 - RNA, 20 nt, Artificial Sequence
  MKO10120802_B_Tesc
  gRNA
uccgaugcagcugcucuauc

SEQ ID NO: 120803 - RNA, 20 nt, Artificial Sequence
  MKO10120803_B_Tesk1
  gRNA
ccaugacuugucccgacugu

SEQ ID NO: 120804 - RNA, 20 nt, Artificial Sequence
  MKO10120804_B_Tesk1
  gRNA
gcagcugcacgcgcuuacag

SEQ ID NO: 120805 - RNA, 20 nt, Artificial Sequence
  MKO10120805_B_Tesk1
  gRNA
uaagcgcgugcagcugcccu

SEQ ID NO: 120806 - RNA, 20 nt, Artificial Sequence
  MKO10120806_B_Tesk2
  gRNA
acaguugcaugcacuuacag

SEQ ID NO: 120807 - RNA, 20 nt, Artificial Sequence
  MKO10120807_B_Tesk2
  gRNA
uaggugcgacacagagcuuc

SEQ ID NO: 120808 - RNA, 20 nt, Artificial Sequence
  MKO10120808_B_Tesk2
  gRNA
aacccauuaccugaggaugu

SEQ ID NO: 120809 - RNA, 20 nt, Artificial Sequence
  MKO10120809_B_Tespa1
  gRNA
uugguaggauauucuagcca

SEQ ID NO: 120810 - RNA, 20 nt, Artificial Sequence
  MKO10120810_B_Tespa1
  gRNA
uucauacuuaccuagagaag

SEQ ID NO: 120811 - RNA, 20 nt, Artificial Sequence
  MKO10120811_B_Tespa1
  gRNA
gccacauuacugucuaccaa

SEQ ID NO: 120812 - RNA, 20 nt, Artificial Sequence
  MKO10120812_B_Tes
  gRNA
ugcaaacacaccaugaacga

SEQ ID NO: 120813 - RNA, 20 nt, Artificial Sequence
  MKO10120813_B_Tes
  gRNA
acagcucccggcucaugacc

SEQ ID NO: 120814 - RNA, 20 nt, Artificial Sequence
  MKO10120814_B_Tes
  gRNA
agccggccaucuaugcugaa

SEQ ID NO: 120815 - RNA, 20 nt, Artificial Sequence
  MKO10120815_B_Tet1
  gRNA
gauuaaucacaucaacgccg

SEQ ID NO: 120816 - RNA, 20 nt, Artificial Sequence
  MKO10120816_B_Tet1
  gRNA
cccauauuauacacaccuug

SEQ ID NO: 120817 - RNA, 20 nt, Artificial Sequence
  MKO10120817_B_Tet1
  gRNA
gccccaagguguguauaaua

SEQ ID NO: 120818 - RNA, 20 nt, Artificial Sequence
  MKO10120818_B_Tet2
  gRNA
gcuccuuauuauacccaucu

SEQ ID NO: 120819 - RNA, 20 nt, Artificial Sequence
  MKO10120819_B_Tet2
  gRNA
ccauguagccuaaauuuccu

SEQ ID NO: 120820 - RNA, 20 nt, Artificial Sequence
  MKO10120820_B_Tet2
  gRNA
acauggagcugagccaaaag

SEQ ID NO: 120821 - RNA, 20 nt, Artificial Sequence
  MKO10120821_B_Tet3
  gRNA
ucaucuacacgggcaaggag

SEQ ID NO: 120822 - RNA, 20 nt, Artificial Sequence
  MKO10120822_B_Tet3
  gRNA
aggcccauauuacacucacc

SEQ ID NO: 120823 - RNA, 20 nt, Artificial Sequence
  MKO10120823_B_Tet3
  gRNA
aguauggcaacccuaccagc

SEQ ID NO: 120824 - RNA, 20 nt, Artificial Sequence
  MKO10120824_B_Tex101
  gRNA
gguccaaaauaccuacugcc

SEQ ID NO: 120825 - RNA, 20 nt, Artificial Sequence
  MKO10120825_B_Tex101
  gRNA
auccaguauacugcaccucc

SEQ ID NO: 120826 - RNA, 20 nt, Artificial Sequence
  MKO10120826_B_Tex101
  gRNA
guggcggguuccugacaugu

SEQ ID NO: 120827 - RNA, 20 nt, Artificial Sequence
  MKO10120827_B_Tex10
  gRNA
acuugcugcauaaccugcag

SEQ ID NO: 120828 - RNA, 20 nt, Artificial Sequence
  MKO10120828_B_Tex10
  gRNA
gguugagcgagagccucugc

SEQ ID NO: 120829 - RNA, 20 nt, Artificial Sequence
  MKO10120829_B_Tex10
  gRNA
ucaaucuagugccaccuuua

SEQ ID NO: 120830 - RNA, 20 nt, Artificial Sequence
  MKO10120830_B_Tex11
  gRNA
augaauuaccaguuaugauc

SEQ ID NO: 120831 - RNA, 20 nt, Artificial Sequence
  MKO10120831_B_Tex11
  gRNA
uaguaacugcccaguuccac

SEQ ID NO: 120832 - RNA, 20 nt, Artificial Sequence
  MKO10120832_B_Tex11
  gRNA
agaaguaaaagucaguaaug

SEQ ID NO: 120833 - RNA, 20 nt, Artificial Sequence
  MKO10120833_B_Tex12
  gRNA
ccgacucuagaaacugcaag

SEQ ID NO: 120834 - RNA, 20 nt, Artificial Sequence
  MKO10120834_B_Tex12
  gRNA
ccucuugcaguuucuagagu

SEQ ID NO: 120835 - RNA, 20 nt, Artificial Sequence
  MKO10120835_B_Tex12
  gRNA
gcucuggagaaggauuugag

SEQ ID NO: 120836 - RNA, 20 nt, Artificial Sequence
  MKO10120836_B_Tex13a
  gRNA
auuagaucucagacccaaga

SEQ ID NO: 120837 - RNA, 20 nt, Artificial Sequence
  MKO10120837_B_Tex13a
  gRNA
gugagcgaagcgcacaccca

SEQ ID NO: 120838 - RNA, 20 nt, Artificial Sequence
  MKO10120838_B_Tex13a
  gRNA
aacccacuaccaagauccuc

SEQ ID NO: 120839 - RNA, 20 nt, Artificial Sequence
  MKO10120839_B_Tex13
  gRNA
agaguugugcgagacuacag

SEQ ID NO: 120840 - RNA, 20 nt, Artificial Sequence
  MKO10120840_B_Tex13
  gRNA
gcacucugcgccccugcaac

SEQ ID NO: 120841 - RNA, 20 nt, Artificial Sequence
  MKO10120841_B_Tex13
  gRNA
cucagccaucaugaauugcg

SEQ ID NO: 120842 - RNA, 20 nt, Artificial Sequence
  MKO10120842_B_Tex14
  gRNA
gggcugccgaugagucgcug

SEQ ID NO: 120843 - RNA, 20 nt, Artificial Sequence
  MKO10120843_B_Tex14
  gRNA
ccugcgacuccaugaugaga

SEQ ID NO: 120844 - RNA, 20 nt, Artificial Sequence
  MKO10120844_B_Tex14
  gRNA
gagugcucccgucaaagcag

SEQ ID NO: 120845 - RNA, 20 nt, Artificial Sequence
  MKO10120845_B_Tex15
  gRNA
gauggaaaauacccguuucc

SEQ ID NO: 120846 - RNA, 20 nt, Artificial Sequence
  MKO10120846_B_Tex15
  gRNA
aacagaauccguuucuacga

SEQ ID NO: 120847 - RNA, 20 nt, Artificial Sequence
  MKO10120847_B_Tex15
  gRNA
uagguuaccaugaaagaugu

SEQ ID NO: 120848 - RNA, 20 nt, Artificial Sequence
  MKO10120848_B_Tex16
  gRNA
ugcuaugcugaaacguuuga

SEQ ID NO: 120849 - RNA, 20 nt, Artificial Sequence
  MKO10120849_B_Tex16
  gRNA
uugcagcucagacuccaaac

SEQ ID NO: 120850 - RNA, 20 nt, Artificial Sequence
  MKO10120850_B_Tex16
  gRNA
aagcuuaggaggcaggauaa

SEQ ID NO: 120851 - RNA, 20 nt, Artificial Sequence
  MKO10120851_B_Tex19.1
  gRNA
agggaugagcuggugcgagc

SEQ ID NO: 120852 - RNA, 20 nt, Artificial Sequence
  MKO10120852_B_Tex19.1
  gRNA
gcccaacuucuuuccgaaaa

SEQ ID NO: 120853 - RNA, 20 nt, Artificial Sequence
  MKO10120853_B_Tex19.1
  gRNA
cucuggcauguuaaugugcc

SEQ ID NO: 120854 - RNA, 20 nt, Artificial Sequence
  MKO10120854_B_Tex19.2
  gRNA
ugagaacccguguccagcgc

SEQ ID NO: 120855 - RNA, 20 nt, Artificial Sequence
  MKO10120855_B_Tex19.2
  gRNA
gggcucaacuccaacaauac

SEQ ID NO: 120856 - RNA, 20 nt, Artificial Sequence
  MKO10120856_B_Tex19.2
  gRNA
ccucgucguuaagaacaugc

SEQ ID NO: 120857 - RNA, 20 nt, Artificial Sequence
  MKO10120857_B_Tex21
  gRNA
cgguccuuucagauucauau

SEQ ID NO: 120858 - RNA, 20 nt, Artificial Sequence
  MKO10120858_B_Tex21
  gRNA
agaaaagcuaacgucugagu

SEQ ID NO: 120859 - RNA, 20 nt, Artificial Sequence
  MKO10120859_B_Tex21
  gRNA
auauuaucuguagcuccugc

SEQ ID NO: 120860 - RNA, 20 nt, Artificial Sequence
  MKO10120860_B_Tex22
  gRNA
gccacuguagcgucuuccuc

SEQ ID NO: 120861 - RNA, 20 nt, Artificial Sequence
  MKO10120861_B_Tex22
  gRNA
gcuggccuugcagcguaugc

SEQ ID NO: 120862 - RNA, 20 nt, Artificial Sequence
  MKO10120862_B_Tex22
  gRNA
ccucuccugcauacgcugca

SEQ ID NO: 120863 - RNA, 20 nt, Artificial Sequence
  MKO10120863_B_Tex24
  gRNA
uaaaguacaucgcccaucuc

SEQ ID NO: 120864 - RNA, 20 nt, Artificial Sequence
  MKO10120864_B_Tex24
  gRNA
cuccuguagugcuuacaguu

SEQ ID NO: 120865 - RNA, 20 nt, Artificial Sequence
  MKO10120865_B_Tex24
  gRNA
ugaccgaguccucuguccug

SEQ ID NO: 120866 - RNA, 20 nt, Artificial Sequence
  MKO10120866_B_Tex261
  gRNA
ccgcaaaaaacugaaaugcc

SEQ ID NO: 120867 - RNA, 20 nt, Artificial Sequence
  MKO10120867_B_Tex261
  gRNA
cauccccacagggcuagugg

SEQ ID NO: 120868 - RNA, 20 nt, Artificial Sequence
  MKO10120868_B_Tex261
  gRNA
uuccucaccgccuggcugca

SEQ ID NO: 120869 - RNA, 20 nt, Artificial Sequence
  MKO10120869_B_Tex264
  gRNA
guucagucgggguucuccca

SEQ ID NO: 120870 - RNA, 20 nt, Artificial Sequence
  MKO10120870_B_Tex264
  gRNA
ggcaaccguggcugggacga

SEQ ID NO: 120871 - RNA, 20 nt, Artificial Sequence
  MKO10120871_B_Tex264
  gRNA
gcugugugcucacccucgcc

SEQ ID NO: 120872 - RNA, 20 nt, Artificial Sequence
  MKO10120872_B_Tex26
  gRNA
caggucuacgaagucccucu

SEQ ID NO: 120873 - RNA, 20 nt, Artificial Sequence
  MKO10120873_B_Tex26
  gRNA
uaucgaaauucaguguccag

SEQ ID NO: 120874 - RNA, 20 nt, Artificial Sequence
  MKO10120874_B_Tex26
  gRNA
aguaccacgaugaguauacc

SEQ ID NO: 120875 - RNA, 20 nt, Artificial Sequence
  MKO10120875_B_Tex28
  gRNA
ucuacagcaagcuacccaac

SEQ ID NO: 120876 - RNA, 20 nt, Artificial Sequence
  MKO10120876_B_Tex28
  gRNA
ugaucacuugcagagauacc

SEQ ID NO: 120877 - RNA, 20 nt, Artificial Sequence
  MKO10120877_B_Tex28
  gRNA
uugccaccucaaacagcauc

SEQ ID NO: 120878 - RNA, 20 nt, Artificial Sequence
  MKO10120878_B_Tex29
  gRNA
ggagguucucgaauggguuc

SEQ ID NO: 120879 - RNA, 20 nt, Artificial Sequence
  MKO10120879_B_Tex29
  gRNA
gagacuccugcagcgcuccc

SEQ ID NO: 120880 - RNA, 20 nt, Artificial Sequence
  MKO10120880_B_Tex29
  gRNA
auuucaaccugugaguccuc

SEQ ID NO: 120881 - RNA, 20 nt, Artificial Sequence
  MKO10120881_B_Tex2
  gRNA
gugguucaggcgguucaucc

SEQ ID NO: 120882 - RNA, 20 nt, Artificial Sequence
  MKO10120882_B_Tex2
  gRNA
cuagacuucguccccucuug

SEQ ID NO: 120883 - RNA, 20 nt, Artificial Sequence
  MKO10120883_B_Tex2
  gRNA
cucauuguagcuugcccucc

SEQ ID NO: 120884 - RNA, 20 nt, Artificial Sequence
  MKO10120884_B_Tex30
  gRNA
gagcccgacacaaacaguac

SEQ ID NO: 120885 - RNA, 20 nt, Artificial Sequence
  MKO10120885_B_Tex30
  gRNA
ugccugagauuuacuugcaa

SEQ ID NO: 120886 - RNA, 20 nt, Artificial Sequence
  MKO10120886_B_Tex30
  gRNA
uagaauuaccugaagaccuc

SEQ ID NO: 120887 - RNA, 20 nt, Artificial Sequence
  MKO10120887_B_Tex33
  gRNA
uccuuucaacuacuuggccu

SEQ ID NO: 120888 - RNA, 20 nt, Artificial Sequence
  MKO10120888_B_Tex33
  gRNA
caucaggcucgacaggccau

SEQ ID NO: 120889 - RNA, 20 nt, Artificial Sequence
  MKO10120889_B_Tex33
  gRNA
caugaacuugcagaaagcgc

SEQ ID NO: 120890 - RNA, 20 nt, Artificial Sequence
  MKO10120890_B_Tex35
  gRNA
gaagggcuacucaucagaaa

SEQ ID NO: 120891 - RNA, 20 nt, Artificial Sequence
  MKO10120891_B_Tex35
  gRNA
ucauuagauaaaggauauaa

SEQ ID NO: 120892 - RNA, 20 nt, Artificial Sequence
  MKO10120892_B_Tex35
  gRNA
cgauaaacuuuaugaguuug

SEQ ID NO: 120893 - RNA, 20 nt, Artificial Sequence
  MKO10120893_B_Tex36
  gRNA
aacccgucuuugaauaauga

SEQ ID NO: 120894 - RNA, 20 nt, Artificial Sequence
  MKO10120894_B_Tex36
  gRNA
cuacguaccuaagaaagcug

SEQ ID NO: 120895 - RNA, 20 nt, Artificial Sequence
  MKO10120895_B_Tex36
  gRNA
cuuccgucauuauucaaaga

SEQ ID NO: 120896 - RNA, 20 nt, Artificial Sequence
  MKO10120896_B_Tex37
  gRNA
aguccaccauguaugagcuu

SEQ ID NO: 120897 - RNA, 20 nt, Artificial Sequence
  MKO10120897_B_Tex37
  gRNA
guccuuggccauggcacgug

SEQ ID NO: 120898 - RNA, 20 nt, Artificial Sequence
  MKO10120898_B_Tex37
  gRNA
uucuagagucacgccacaag

SEQ ID NO: 120899 - RNA, 20 nt, Artificial Sequence
  MKO10120899_B_Tex38
  gRNA
ugcugucaccaagaccgagc

SEQ ID NO: 120900 - RNA, 20 nt, Artificial Sequence
  MKO10120900_B_Tex38
  gRNA
gggaauggggagucaguccg

SEQ ID NO: 120901 - RNA, 20 nt, Artificial Sequence
  MKO10120901_B_Tex38
  gRNA
ccuacagcccacuguuguac

SEQ ID NO: 120902 - RNA, 20 nt, Artificial Sequence
  MKO10120902_B_Tex40
  gRNA
ucgaagggaucaggaagcgc

SEQ ID NO: 120903 - RNA, 20 nt, Artificial Sequence
  MKO10120903_B_Tex40
  gRNA
aaucacuaauauucagccua

SEQ ID NO: 120904 - RNA, 20 nt, Artificial Sequence
  MKO10120904_B_Tex40
  gRNA
guucugcugcucuguccagu

SEQ ID NO: 120905 - RNA, 20 nt, Artificial Sequence
  MKO10120905_B_Tex9
  gRNA
acuaacuacaucaugcaaag

SEQ ID NO: 120906 - RNA, 20 nt, Artificial Sequence
  MKO10120906_B_Tex9
  gRNA
agcagcaagaagugcgagcc

SEQ ID NO: 120907 - RNA, 20 nt, Artificial Sequence
  MKO10120907_B_Tex9
  gRNA
uaggcguuuaaaugaagaau

SEQ ID NO: 120908 - RNA, 20 nt, Artificial Sequence
  MKO10120908_B_Tfam
  gRNA
uaugaacucauagguuucuu

SEQ ID NO: 120909 - RNA, 20 nt, Artificial Sequence
  MKO10120909_B_Tfam
  gRNA
gcuaacuccaagucagcuga

SEQ ID NO: 120910 - RNA, 20 nt, Artificial Sequence
  MKO10120910_B_Tfam
  gRNA
agaugcaaaacuuucagaau

SEQ ID NO: 120911 - RNA, 20 nt, Artificial Sequence
  MKO10120911_B_Tfap2a
  gRNA
agcgacgcguuaagacacuc

SEQ ID NO: 120912 - RNA, 20 nt, Artificial Sequence
  MKO10120912_B_Tfap2a
  gRNA
uacccuccucacgucacuag

SEQ ID NO: 120913 - RNA, 20 nt, Artificial Sequence
  MKO10120913_B_Tfap2a
  gRNA
uaccuuccacuagugacgug

SEQ ID NO: 120914 - RNA, 20 nt, Artificial Sequence
  MKO10120914_B_Tfap2b
  gRNA
accuucugaggacgccgccc

SEQ ID NO: 120915 - RNA, 20 nt, Artificial Sequence
  MKO10120915_B_Tfap2b
  gRNA
ugcagagccaaaucgaaaaa

SEQ ID NO: 120916 - RNA, 20 nt, Artificial Sequence
  MKO10120916_B_Tfap2b
  gRNA
gacugagcaaaauaccucgc

SEQ ID NO: 120917 - RNA, 20 nt, Artificial Sequence
  MKO10120917_B_Tfap2c
  gRNA
gaccuuccacgagagacgug

SEQ ID NO: 120918 - RNA, 20 nt, Artificial Sequence
  MKO10120918_B_Tfap2c
  gRNA
aguuacuuuguacuucgacg

SEQ ID NO: 120919 - RNA, 20 nt, Artificial Sequence
  MKO10120919_B_Tfap2c
  gRNA
gaaugacagucugaucgugu

SEQ ID NO: 120920 - RNA, 20 nt, Artificial Sequence
  MKO10120920_B_Tfap2d
  gRNA
cucuucugaucacccccccu

SEQ ID NO: 120921 - RNA, 20 nt, Artificial Sequence
  MKO10120921_B_Tfap2d
  gRNA
gugccucaaugcuucacuuc

SEQ ID NO: 120922 - RNA, 20 nt, Artificial Sequence
  MKO10120922_B_Tfap2d
  gRNA
ugacuaucgcugagguaaag

SEQ ID NO: 120923 - RNA, 20 nt, Artificial Sequence
  MKO10120923_B_Tfap2e
  gRNA
uugcaggcgauagaugaccc

SEQ ID NO: 120924 - RNA, 20 nt, Artificial Sequence
  MKO10120924_B_Tfap2e
  gRNA
gcugccuuccgacgaccagc

SEQ ID NO: 120925 - RNA, 20 nt, Artificial Sequence
  MKO10120925_B_Tfap2e
  gRNA
accuucggaggacacccccc

SEQ ID NO: 120926 - RNA, 20 nt, Artificial Sequence
  MKO10120926_B_Tfap4
  gRNA
gcauuggcucacccgacauc

SEQ ID NO: 120927 - RNA, 20 nt, Artificial Sequence
  MKO10120927_B_Tfap4
  gRNA
ccugcaggugcgcucccucg

SEQ ID NO: 120928 - RNA, 20 nt, Artificial Sequence
  MKO10120928_B_Tfap4
  gRNA
ccccgcucaccuggguccgu

SEQ ID NO: 120929 - RNA, 20 nt, Artificial Sequence
  MKO10120929_B_Tfb1m
  gRNA
caacuccacugauuaucaag

SEQ ID NO: 120930 - RNA, 20 nt, Artificial Sequence
  MKO10120930_B_Tfb1m
  gRNA
gcacagucgccuuuccauua

SEQ ID NO: 120931 - RNA, 20 nt, Artificial Sequence
  MKO10120931_B_Tfb1m
  gRNA
gcacaucuccaugaacaauu

SEQ ID NO: 120932 - RNA, 20 nt, Artificial Sequence
  MKO10120932_B_Tfb2m
  gRNA
ccagguccuggaauccugac

SEQ ID NO: 120933 - RNA, 20 nt, Artificial Sequence
  MKO10120933_B_Tfb2m
  gRNA
gguguuccuauaaaaguauu

SEQ ID NO: 120934 - RNA, 20 nt, Artificial Sequence
  MKO10120934_B_Tfb2m
  gRNA
auaucuguauauagauucgc

SEQ ID NO: 120935 - RNA, 20 nt, Artificial Sequence
  MKO10120935_B_Tfcp2l1
  gRNA
ggcaagcgggccccauucuc

SEQ ID NO: 120936 - RNA, 20 nt, Artificial Sequence
  MKO10120936_B_Tfcp2l1
  gRNA
accgccaacccuccaacugu

SEQ ID NO: 120937 - RNA, 20 nt, Artificial Sequence
  MKO10120937_B_Tfcp2l1
  gRNA
cauauuucguguucagaucu

SEQ ID NO: 120938 - RNA, 20 nt, Artificial Sequence
  MKO10120938_B_Tfcp2
  gRNA
gaccuugauugagguacguc

SEQ ID NO: 120939 - RNA, 20 nt, Artificial Sequence
  MKO10120939_B_Tfcp2
  gRNA
uccagaacucaacggcaagc

SEQ ID NO: 120940 - RNA, 20 nt, Artificial Sequence
  MKO10120940_B_Tfcp2
  gRNA
accagcuugccguugaguuc

SEQ ID NO: 120941 - RNA, 20 nt, Artificial Sequence
  MKO10120941_B_Tfdp1
  gRNA
uugcugugugauauugacau

SEQ ID NO: 120942 - RNA, 20 nt, Artificial Sequence
  MKO10120942_B_Tfdp1
  gRNA
ugucaauaucacacagcaag

SEQ ID NO: 120943 - RNA, 20 nt, Artificial Sequence
  MKO10120943_B_Tfdp1
  gRNA
cuuucccaggacuaagauuc

SEQ ID NO: 120944 - RNA, 20 nt, Artificial Sequence
  MKO10120944_B_Tfdp2
  gRNA
uuugucgauuucucuguacc

SEQ ID NO: 120945 - RNA, 20 nt, Artificial Sequence
  MKO10120945_B_Tfdp2
  gRNA
ccugccuaccaauucugcuc

SEQ ID NO: 120946 - RNA, 20 nt, Artificial Sequence
  MKO10120946_B_Tfdp2
  gRNA
cauuccugagcagaauuggu

SEQ ID NO: 120947 - RNA, 20 nt, Artificial Sequence
  MKO10120947_B_Tfe3
  gRNA
cucgauaucagcaacaaucc

SEQ ID NO: 120948 - RNA, 20 nt, Artificial Sequence
  MKO10120948_B_Tfe3
  gRNA
gacgacgcagagaguguagc

SEQ ID NO: 120949 - RNA, 20 nt, Artificial Sequence
  MKO10120949_B_Tfe3
  gRNA
accaccugcagcaagcucgc

SEQ ID NO: 120950 - RNA, 20 nt, Artificial Sequence
  MKO10120950_B_Tfeb
  gRNA
acguguccagcccgcacccc

SEQ ID NO: 120951 - RNA, 20 nt, Artificial Sequence
  MKO10120951_B_Tfeb
  gRNA
ggucaccgcuguacacguuc

SEQ ID NO: 120952 - RNA, 20 nt, Artificial Sequence
  MKO10120952_B_Tfeb
  gRNA
uggacacguacuguccaccu

SEQ ID NO: 120953 - RNA, 20 nt, Artificial Sequence
  MKO10120953_B_Tfec
  gRNA
ggcauuucuucagcuaaugc

SEQ ID NO: 120954 - RNA, 20 nt, Artificial Sequence
  MKO10120954_B_Tfec
  gRNA
aaguauucuacccaugagaa

SEQ ID NO: 120955 - RNA, 20 nt, Artificial Sequence
  MKO10120955_B_Tfec
  gRNA
acucacggaucauuagacuu

SEQ ID NO: 120956 - RNA, 20 nt, Artificial Sequence
  MKO10120956_B_Tff1
  gRNA
acagaucaccuugugcucca

SEQ ID NO: 120957 - RNA, 20 nt, Artificial Sequence
  MKO10120957_B_Tff1
  gRNA
uuagaagaaugucccuucua

SEQ ID NO: 120958 - RNA, 20 nt, Artificial Sequence
  MKO10120958_B_Tff1
  gRNA
cccguggugcuuccacccca

SEQ ID NO: 120959 - RNA, 20 nt, Artificial Sequence
  MKO10120959_B_Tff2
  gRNA
gugucagcucgcaagaauug

SEQ ID NO: 120960 - RNA, 20 nt, Artificial Sequence
  MKO10120960_B_Tff2
  gRNA
gccagcaggggggcaccucg

SEQ ID NO: 120961 - RNA, 20 nt, Artificial Sequence
  MKO10120961_B_Tff2
  gRNA
cagcccccugucggugcucc

SEQ ID NO: 120962 - RNA, 20 nt, Artificial Sequence
  MKO10120962_B_Tff3
  gRNA
acacugcuccgaugugacag

SEQ ID NO: 120963 - RNA, 20 nt, Artificial Sequence
  MKO10120963_B_Tff3
  gRNA
guaaucugcagcuaucccag

SEQ ID NO: 120964 - RNA, 20 nt, Artificial Sequence
  MKO10120964_B_Tff3
  gRNA
gacagcuccaagccaaugua

SEQ ID NO: 120965 - RNA, 20 nt, Artificial Sequence
  MKO10120965_B_Tfg
  gRNA
aaauaaagugaaucgcuuau

SEQ ID NO: 120966 - RNA, 20 nt, Artificial Sequence
  MKO10120966_B_Tfg
  gRNA
aaaaacgucaugucagcauu

SEQ ID NO: 120967 - RNA, 20 nt, Artificial Sequence
  MKO10120967_B_Tfg
  gRNA
ucuacuacacugaauugcaa

SEQ ID NO: 120968 - RNA, 20 nt, Artificial Sequence
  MKO10120968_B_Tfip11
  gRNA
gggaaguccuccugcuuaac

SEQ ID NO: 120969 - RNA, 20 nt, Artificial Sequence
  MKO10120969_B_Tfip11
  gRNA
acagucuuguaagaguacuu

SEQ ID NO: 120970 - RNA, 20 nt, Artificial Sequence
  MKO10120970_B_Tfip11
  gRNA
cuacgucccugggcguggcc

SEQ ID NO: 120971 - RNA, 20 nt, Artificial Sequence
  MKO10120971_B_Tfpi2
  gRNA
aagugccgcagauucaacua

SEQ ID NO: 120972 - RNA, 20 nt, Artificial Sequence
  MKO10120972_B_Tfpi2
  gRNA
uuuagcucugaucgacaaac

SEQ ID NO: 120973 - RNA, 20 nt, Artificial Sequence
  MKO10120973_B_Tfpi2
  gRNA
ugccaccgugccugcguuaa

SEQ ID NO: 120974 - RNA, 20 nt, Artificial Sequence
  MKO10120974_B_Tfpi
  gRNA
uuaccuuguagauucugagc

SEQ ID NO: 120975 - RNA, 20 nt, Artificial Sequence
  MKO10120975_B_Tfpi
  gRNA
uuaugagaagacagcuguga

SEQ ID NO: 120976 - RNA, 20 nt, Artificial Sequence
  MKO10120976_B_Tfpi
  gRNA
ugaagaaagaauaugccuuu

SEQ ID NO: 120977 - RNA, 20 nt, Artificial Sequence
  MKO10120977_B_Tfpt
  gRNA
gucaaugaagcccccacccg

SEQ ID NO: 120978 - RNA, 20 nt, Artificial Sequence
  MKO10120978_B_Tfpt
  gRNA
aaugguaccugcgcuccugc

SEQ ID NO: 120979 - RNA, 20 nt, Artificial Sequence
  MKO10120979_B_Tfpt
  gRNA
uagccaguucaccauugugu

SEQ ID NO: 120980 - RNA, 20 nt, Artificial Sequence
  MKO10120980_B_Tfr2
  gRNA
guggacugacacgcacuacg

SEQ ID NO: 120981 - RNA, 20 nt, Artificial Sequence
  MKO10120981_B_Tfr2
  gRNA
ccggccggaccacguuguac

SEQ ID NO: 120982 - RNA, 20 nt, Artificial Sequence
  MKO10120982_B_Tfr2
  gRNA
ucgaaaggcugcccccuauc

SEQ ID NO: 120983 - RNA, 20 nt, Artificial Sequence
  MKO10120983_B_Tfrc
  gRNA
cuccaucuacuugccgagca

SEQ ID NO: 120984 - RNA, 20 nt, Artificial Sequence
  MKO10120984_B_Tfrc
  gRNA
guuaccauuugacugcacua

SEQ ID NO: 120985 - RNA, 20 nt, Artificial Sequence
  MKO10120985_B_Tfrc
  gRNA
cuacaucaucucgcuuauau

SEQ ID NO: 120986 - RNA, 20 nt, Artificial Sequence
  MKO10120986_B_Tgds
  gRNA
gcaaaacuacaaguuuauac

SEQ ID NO: 120987 - RNA, 20 nt, Artificial Sequence
  MKO10120987_B_Tgds
  gRNA
uaugaucguaaaucuagaca

SEQ ID NO: 120988 - RNA, 20 nt, Artificial Sequence
  MKO10120988_B_Tgds
  gRNA
cugugcaagcuugaagaauc

SEQ ID NO: 120989 - RNA, 20 nt, Artificial Sequence
  MKO10120989_B_Tgfa
  gRNA
gcuucucaugucugcagacg

SEQ ID NO: 120990 - RNA, 20 nt, Artificial Sequence
  MKO10120990_B_Tgfa
  gRNA
ugccccagcagacucacccg

SEQ ID NO: 120991 - RNA, 20 nt, Artificial Sequence
  MKO10120991_B_Tgfa
  gRNA
gaagcaagccaucacugccc

SEQ ID NO: 120992 - RNA, 20 nt, Artificial Sequence
  MKO10120992_B_Tgfb1i1
  gRNA
uucagccaccuccgccacuc

SEQ ID NO: 120993 - RNA, 20 nt, Artificial Sequence
  MKO10120993_B_Tgfb1i1
  gRNA
uagaugauccuuguccccag

SEQ ID NO: 120994 - RNA, 20 nt, Artificial Sequence
  MKO10120994_B_Tgfb1i1
  gRNA
gugagcucuugucuucagau

SEQ ID NO: 120995 - RNA, 20 nt, Artificial Sequence
  MKO10120995_B_Tgfb1
  gRNA
cagggaucagccccaaacgu

SEQ ID NO: 120996 - RNA, 20 nt, Artificial Sequence
  MKO10120996_B_Tgfb1
  gRNA
uugacgucacuggaguugua

SEQ ID NO: 120997 - RNA, 20 nt, Artificial Sequence
  MKO10120997_B_Tgfb1
  gRNA
uccggugccgugagcugugc

SEQ ID NO: 120998 - RNA, 20 nt, Artificial Sequence
  MKO10120998_B_Tgfb2
  gRNA
guaauuauuagacggcacga

SEQ ID NO: 120999 - RNA, 20 nt, Artificial Sequence
  MKO10120999_B_Tgfb2
  gRNA
gcagcggauugaacuguauc

SEQ ID NO: 121000 - RNA, 20 nt, Artificial Sequence
  MKO10121000_B_Tgfb2
  gRNA
cgacgugacagacgcugugc

SEQ ID NO: 121001 - RNA, 20 nt, Artificial Sequence
  MKO10121001_B_Tgfb3
  gRNA
gaugauccccccacaccgac

SEQ ID NO: 121002 - RNA, 20 nt, Artificial Sequence
  MKO10121002_B_Tgfb3
  gRNA
gguugggcacccgcaagacc

SEQ ID NO: 121003 - RNA, 20 nt, Artificial Sequence
  MKO10121003_B_Tgfb3
  gRNA
gaacuggccgucugccccaa

SEQ ID NO: 121004 - RNA, 20 nt, Artificial Sequence
  MKO10121004_B_Tgfbi
  gRNA
acuugccgcagaucuuccuc

SEQ ID NO: 121005 - RNA, 20 nt, Artificial Sequence
  MKO10121005_B_Tgfbi
  gRNA
aucaguuaugagugcugucc

SEQ ID NO: 121006 - RNA, 20 nt, Artificial Sequence
  MKO10121006_B_Tgfbi
  gRNA
cucauugcuaggagcaaaga

SEQ ID NO: 121007 - RNA, 20 nt, Artificial Sequence
  MKO10121007_B_Tgfbr1
  gRNA
cauacaaauggccugucucg

SEQ ID NO: 121008 - RNA, 20 nt, Artificial Sequence
  MKO10121008_B_Tgfbr1
  gRNA
uugaccuaauuccucgagac

SEQ ID NO: 121009 - RNA, 20 nt, Artificial Sequence
  MKO10121009_B_Tgfbr1
  gRNA
guuacgccaugaaaauaucc

SEQ ID NO: 121010 - RNA, 20 nt, Artificial Sequence
  MKO10121010_B_Tgfbr2
  gRNA
acggccacgcagacuucaug

SEQ ID NO: 121011 - RNA, 20 nt, Artificial Sequence
  MKO10121011_B_Tgfbr2
  gRNA
ugcuggcgaugcgcguccac

SEQ ID NO: 121012 - RNA, 20 nt, Artificial Sequence
  MKO10121012_B_Tgfbr2
  gRNA
ggccgcugcauaucguccug

SEQ ID NO: 121013 - RNA, 20 nt, Artificial Sequence
  MKO10121013_B_Tgfbr3
  gRNA
uucccucccacguguaacau

SEQ ID NO: 121014 - RNA, 20 nt, Artificial Sequence
  MKO10121014_B_Tgfbr3
  gRNA
cuuguggugagugugcacgg

SEQ ID NO: 121015 - RNA, 20 nt, Artificial Sequence
  MKO10121015_B_Tgfbr3
  gRNA
cugucuucacaugccacacc

SEQ ID NO: 121016 - RNA, 20 nt, Artificial Sequence
  MKO10121016_B_Tgfbrap1
  gRNA
gaaugaaauccgcagcacag

SEQ ID NO: 121017 - RNA, 20 nt, Artificial Sequence
  MKO10121017_B_Tgfbrap1
  gRNA
agcccggaggaacauuccaa

SEQ ID NO: 121018 - RNA, 20 nt, Artificial Sequence
  MKO10121018_B_Tgfbrap1
  gRNA
gauguaaacuccuuuacuug

SEQ ID NO: 121019 - RNA, 20 nt, Artificial Sequence
  MKO10121019_B_Tgif1
  gRNA
caguucacgauuucccgccg

SEQ ID NO: 121020 - RNA, 20 nt, Artificial Sequence
  MKO10121020_B_Tgif1
  gRNA
uccgccagcgcguagaggga

SEQ ID NO: 121021 - RNA, 20 nt, Artificial Sequence
  MKO10121021_B_Tgif1
  gRNA
uccuuaccuguaguguggac

SEQ ID NO: 121022 - RNA, 20 nt, Artificial Sequence
  MKO10121022_B_Tgif2lx1
  gRNA
ccuucgugacucaagcugua

SEQ ID NO: 121023 - RNA, 20 nt, Artificial Sequence
  MKO10121023_B_Tgif2lx1
  gRNA
agauuucaaucacugagccu

SEQ ID NO: 121024 - RNA, 20 nt, Artificial Sequence
  MKO10121024_B_Tgif2lx1
  gRNA
uguaacgaauuucccagcga

SEQ ID NO: 121025 - RNA, 20 nt, Artificial Sequence
  MKO10121025_B_Tgif2lx2
  gRNA
cgaagagaaagugccauauc

SEQ ID NO: 121026 - RNA, 20 nt, Artificial Sequence
  MKO10121026_B_Tgif2lx2
  gRNA
uguaacgaauuucccagcga

SEQ ID NO: 121027 - RNA, 20 nt, Artificial Sequence
  MKO10121027_B_Tgif2lx2
  gRNA
agauuucaaucacugagccu

SEQ ID NO: 121028 - RNA, 20 nt, Artificial Sequence
  MKO10121028_B_Tgif2
  gRNA
aucaugucggacagcgaucu

SEQ ID NO: 121029 - RNA, 20 nt, Artificial Sequence
  MKO10121029_B_Tgif2
  gRNA
caacgccuaccccucagagc

SEQ ID NO: 121030 - RNA, 20 nt, Artificial Sequence
  MKO10121030_B_Tgif2
  gRNA
ccucugauguggcucucccc

SEQ ID NO: 121031 - RNA, 20 nt, Artificial Sequence
  MKO10121031_B_Tgm1
  gRNA
acgaaccuggaacuaugguc

SEQ ID NO: 121032 - RNA, 20 nt, Artificial Sequence
  MKO10121032_B_Tgm1
  gRNA
auggcaucccccuccgaucc

SEQ ID NO: 121033 - RNA, 20 nt, Artificial Sequence
  MKO10121033_B_Tgm1
  gRNA
gaugagcugauugugcgccg

SEQ ID NO: 121034 - RNA, 20 nt, Artificial Sequence
  MKO10121034_B_Tgm2
  gRNA
agucccgacuacgguucuuc

SEQ ID NO: 121035 - RNA, 20 nt, Artificial Sequence
  MKO10121035_B_Tgm2
  gRNA
aguuccugaagaaccguagu

SEQ ID NO: 121036 - RNA, 20 nt, Artificial Sequence
  MKO10121036_B_Tgm2
  gRNA
agaugaagcccuguugcgua

SEQ ID NO: 121037 - RNA, 20 nt, Artificial Sequence
  MKO10121037_B_Tgm3
  gRNA
uuauaaugcucuucaacccg

SEQ ID NO: 121038 - RNA, 20 nt, Artificial Sequence
  MKO10121038_B_Tgm3
  gRNA
gugggcagcacaaaucgaau

SEQ ID NO: 121039 - RNA, 20 nt, Artificial Sequence
  MKO10121039_B_Tgm3
  gRNA
cugcgagccacaucagucac

SEQ ID NO: 121040 - RNA, 20 nt, Artificial Sequence
  MKO10121040_B_Tgm4
  gRNA
agaccaagaagcucgugcug

SEQ ID NO: 121041 - RNA, 20 nt, Artificial Sequence
  MKO10121041_B_Tgm4
  gRNA
cagugcugcugacgccguag

SEQ ID NO: 121042 - RNA, 20 nt, Artificial Sequence
  MKO10121042_B_Tgm4
  gRNA
agggugaacgaguauaaagc

SEQ ID NO: 121043 - RNA, 20 nt, Artificial Sequence
  MKO10121043_B_Tgm5
  gRNA
gaguauguugugaacgauua

SEQ ID NO: 121044 - RNA, 20 nt, Artificial Sequence
  MKO10121044_B_Tgm5
  gRNA
agccccgauucuuaaaguac

SEQ ID NO: 121045 - RNA, 20 nt, Artificial Sequence
  MKO10121045_B_Tgm5
  gRNA
gaauaucauagauaucugcu

SEQ ID NO: 121046 - RNA, 20 nt, Artificial Sequence
  MKO10121046_B_Tgm6
  gRNA
acuaggacuucgguccagaa

SEQ ID NO: 121047 - RNA, 20 nt, Artificial Sequence
  MKO10121047_B_Tgm6
  gRNA
gacuggcagcauucgaaaaa

SEQ ID NO: 121048 - RNA, 20 nt, Artificial Sequence
  MKO10121048_B_Tgm6
  gRNA
gugucaggcccucuucccgc

SEQ ID NO: 121049 - RNA, 20 nt, Artificial Sequence
  MKO10121049_B_Tgm7
  gRNA
acgcugccguuccauuccag

SEQ ID NO: 121050 - RNA, 20 nt, Artificial Sequence
  MKO10121050_B_Tgm7
  gRNA
gugcagggugguaagcgcca

SEQ ID NO: 121051 - RNA, 20 nt, Artificial Sequence
  MKO10121051_B_Tgm7
  gRNA
gaguauaucaugagugacua

SEQ ID NO: 121052 - RNA, 20 nt, Artificial Sequence
  MKO10121052_B_Tgoln1
  gRNA
cuaccaacguuugaaccuaa

SEQ ID NO: 121053 - RNA, 20 nt, Artificial Sequence
  MKO10121053_B_Tgoln1
  gRNA
agacugcaggaugcgguucc

SEQ ID NO: 121054 - RNA, 20 nt, Artificial Sequence
  MKO10121054_B_Tgoln1
  gRNA
uuaccuuuagguucaaacgu

SEQ ID NO: 121055 - RNA, 20 nt, Artificial Sequence
  MKO10121055_B_Tgoln2
  gRNA
cuaccaacguuugaaccuaa

SEQ ID NO: 121056 - RNA, 20 nt, Artificial Sequence
  MKO10121056_B_Tgoln2
  gRNA
gcuaguuguacuagcauaaa

SEQ ID NO: 121057 - RNA, 20 nt, Artificial Sequence
  MKO10121057_B_Tgoln2
  gRNA
agggcggaagcgcagacugc

SEQ ID NO: 121058 - RNA, 20 nt, Artificial Sequence
  MKO10121058_B_Tgs1
  gRNA
gaaucaaggucacuuucauu

SEQ ID NO: 121059 - RNA, 20 nt, Artificial Sequence
  MKO10121059_B_Tgs1
  gRNA
ugaaagugaccuugauucug

SEQ ID NO: 121060 - RNA, 20 nt, Artificial Sequence
  MKO10121060_B_Tgs1
  gRNA
cauguccaucagccccauua

SEQ ID NO: 121061 - RNA, 20 nt, Artificial Sequence
  MKO10121061_B_Tgup1
  gRNA
aucucucuuguaguuaaugg

SEQ ID NO: 121062 - RNA, 20 nt, Artificial Sequence
  MKO10121062_B_Tgup1
  gRNA
uaagccuaagaguuucaaua

SEQ ID NO: 121063 - RNA, 20 nt, Artificial Sequence
  MKO10121063_B_Tgup1
  gRNA
ggaaguccucaagaauauua

SEQ ID NO: 121064 - RNA, 20 nt, Artificial Sequence
  MKO10121064_B_Tgup2
  gRNA
aucucucuuguaguuaaugg

SEQ ID NO: 121065 - RNA, 20 nt, Artificial Sequence
  MKO10121065_B_Tgup2
  gRNA
uaagccuaagaguuucaaua

SEQ ID NO: 121066 - RNA, 20 nt, Artificial Sequence
  MKO10121066_B_Tgup2
  gRNA
ggaaguccucaagaauauua

SEQ ID NO: 121067 - RNA, 20 nt, Artificial Sequence
  MKO10121067_B_Tg
  gRNA
acuccccaucugcagugcac

SEQ ID NO: 121068 - RNA, 20 nt, Artificial Sequence
  MKO10121068_B_Tg
  gRNA
ggaguggcugugcaucuacc

SEQ ID NO: 121069 - RNA, 20 nt, Artificial Sequence
  MKO10121069_B_Tg
  gRNA
agcaagauugaccaucauuu

SEQ ID NO: 121070 - RNA, 20 nt, Artificial Sequence
  MKO10121070_B_Tha1
  gRNA
uugcuccgugggcgugggcc

SEQ ID NO: 121071 - RNA, 20 nt, Artificial Sequence
  MKO10121071_B_Tha1
  gRNA
ucaaccgagcuccauccaug

SEQ ID NO: 121072 - RNA, 20 nt, Artificial Sequence
  MKO10121072_B_Tha1
  gRNA
ccaccuccacgucuaugagc

SEQ ID NO: 121073 - RNA, 20 nt, Artificial Sequence
  MKO10121073_B_Thada
  gRNA
cugcauggagaacuuuaacc

SEQ ID NO: 121074 - RNA, 20 nt, Artificial Sequence
  MKO10121074_B_Thada
  gRNA
gaaccccuugaagaaaguuu

SEQ ID NO: 121075 - RNA, 20 nt, Artificial Sequence
  MKO10121075_B_Thada
  gRNA
accugcagguagagcaagug

SEQ ID NO: 121076 - RNA, 20 nt, Artificial Sequence
  MKO10121076_B_Thap11
  gRNA
cacccaguugcagccgaacc

SEQ ID NO: 121077 - RNA, 20 nt, Artificial Sequence
  MKO10121077_B_Thap11
  gRNA
ucuugcggccgcccugaaag

SEQ ID NO: 121078 - RNA, 20 nt, Artificial Sequence
  MKO10121078_B_Thap11
  gRNA
ggugggaacgcgcaccgugu

SEQ ID NO: 121079 - RNA, 20 nt, Artificial Sequence
  MKO10121079_B_Thap1
  gRNA
uaggaucacguagccccucu

SEQ ID NO: 121080 - RNA, 20 nt, Artificial Sequence
  MKO10121080_B_Thap1
  gRNA
ucaccccggacugcuuuaag

SEQ ID NO: 121081 - RNA, 20 nt, Artificial Sequence
  MKO10121081_B_Thap1
  gRNA
cagaaaaccgacagguuauc

SEQ ID NO: 121082 - RNA, 20 nt, Artificial Sequence
  MKO10121082_B_Thap2
  gRNA
uaagcucuucacaaagcacg

SEQ ID NO: 121083 - RNA, 20 nt, Artificial Sequence
  MKO10121083_B_Thap2
  gRNA
gagaacgcagagcaacucga

SEQ ID NO: 121084 - RNA, 20 nt, Artificial Sequence
  MKO10121084_B_Thap2
  gRNA
uuguacccauauaaagucuc

SEQ ID NO: 121085 - RNA, 20 nt, Artificial Sequence
  MKO10121085_B_Thap3
  gRNA
guucugaaaagcgaacaccg

SEQ ID NO: 121086 - RNA, 20 nt, Artificial Sequence
  MKO10121086_B_Thap3
  gRNA
cuuaccagaucgagaagcaa

SEQ ID NO: 121087 - RNA, 20 nt, Artificial Sequence
  MKO10121087_B_Thap3
  gRNA
agccgggaccucgggccaga

SEQ ID NO: 121088 - RNA, 20 nt, Artificial Sequence
  MKO10121088_B_Thap4
  gRNA
acuuacgagaaguugagcau

SEQ ID NO: 121089 - RNA, 20 nt, Artificial Sequence
  MKO10121089_B_Thap4
  gRNA
cuuugccaaggagccccaug

SEQ ID NO: 121090 - RNA, 20 nt, Artificial Sequence
  MKO10121090_B_Thap4
  gRNA
acugacaaaggccacuuugu

SEQ ID NO: 121091 - RNA, 20 nt, Artificial Sequence
  MKO10121091_B_Thap7
  gRNA
ccgcgacacugcuccgccgc

SEQ ID NO: 121092 - RNA, 20 nt, Artificial Sequence
  MKO10121092_B_Thap7
  gRNA
ccgcugcucccgccgcuugc

SEQ ID NO: 121093 - RNA, 20 nt, Artificial Sequence
  MKO10121093_B_Thap7
  gRNA
gcgucgaacagccaagacca

SEQ ID NO: 121094 - RNA, 20 nt, Artificial Sequence
  MKO10121094_B_Thbd
  gRNA
ggugaauacucgcgauccug

SEQ ID NO: 121095 - RNA, 20 nt, Artificial Sequence
  MKO10121095_B_Thbd
  gRNA
ucgcgaguauucaccgucag

SEQ ID NO: 121096 - RNA, 20 nt, Artificial Sequence
  MKO10121096_B_Thbd
  gRNA
ugugacgacccggugcaucu

SEQ ID NO: 121097 - RNA, 20 nt, Artificial Sequence
  MKO10121097_B_Thbs1
  gRNA
caccaucgugaccacucugc

SEQ ID NO: 121098 - RNA, 20 nt, Artificial Sequence
  MKO10121098_B_Thbs1
  gRNA
acuccucguuguucuuguac

SEQ ID NO: 121099 - RNA, 20 nt, Artificial Sequence
  MKO10121099_B_Thbs1
  gRNA
aguccaguacaagaacaacg

SEQ ID NO: 121100 - RNA, 20 nt, Artificial Sequence
  MKO10121100_B_Thbs2
  gRNA
ucacaucaccacagaucucg

SEQ ID NO: 121101 - RNA, 20 nt, Artificial Sequence
  MKO10121101_B_Thbs2
  gRNA
uuguaccacaugcaccugca

SEQ ID NO: 121102 - RNA, 20 nt, Artificial Sequence
  MKO10121102_B_Thbs2
  gRNA
acucaccuugcaggugcaug

SEQ ID NO: 121103 - RNA, 20 nt, Artificial Sequence
  MKO10121103_B_Thbs3
  gRNA
ggaaucgaugaaaauuauuc

SEQ ID NO: 121104 - RNA, 20 nt, Artificial Sequence
  MKO10121104_B_Thbs3
  gRNA
cuuggaauggacauucacuc

SEQ ID NO: 121105 - RNA, 20 nt, Artificial Sequence
  MKO10121105_B_Thbs3
  gRNA
uagaauggauugcagugcgc

SEQ ID NO: 121106 - RNA, 20 nt, Artificial Sequence
  MKO10121106_B_Thbs4
  gRNA
agacuuuaaucgacaguucu

SEQ ID NO: 121107 - RNA, 20 nt, Artificial Sequence
  MKO10121107_B_Thbs4
  gRNA
uucuaccguccuccagccag

SEQ ID NO: 121108 - RNA, 20 nt, Artificial Sequence
  MKO10121108_B_Thbs4
  gRNA
ggugcggggcucgcuguucc

SEQ ID NO: 121109 - RNA, 20 nt, Artificial Sequence
  MKO10121109_B_Theg
  gRNA
gaaccuaccagggaccguga

SEQ ID NO: 121110 - RNA, 20 nt, Artificial Sequence
  MKO10121110_B_Theg
  gRNA
uugaagaggaccauccagau

SEQ ID NO: 121111 - RNA, 20 nt, Artificial Sequence
  MKO10121111_B_Theg
  gRNA
gcucccggagaccuccaauc

SEQ ID NO: 121112 - RNA, 20 nt, Artificial Sequence
  MKO10121112_B_Them4
  gRNA
uagcccuuccucgaaacuuc

SEQ ID NO: 121113 - RNA, 20 nt, Artificial Sequence
  MKO10121113_B_Them4
  gRNA
cuuacccagguacuccuugc

SEQ ID NO: 121114 - RNA, 20 nt, Artificial Sequence
  MKO10121114_B_Them4
  gRNA
guugugacuagauuuguuca

SEQ ID NO: 121115 - RNA, 20 nt, Artificial Sequence
  MKO10121115_B_Them5
  gRNA
cuuuaccagguccauacaac

SEQ ID NO: 121116 - RNA, 20 nt, Artificial Sequence
  MKO10121116_B_Them5
  gRNA
gauuucuuuaccggaggacu

SEQ ID NO: 121117 - RNA, 20 nt, Artificial Sequence
  MKO10121117_B_Them5
  gRNA
accgucuaugccaaguccuc

SEQ ID NO: 121118 - RNA, 20 nt, Artificial Sequence
  MKO10121118_B_Them6
  gRNA
ugccagaagacuugaaacau

SEQ ID NO: 121119 - RNA, 20 nt, Artificial Sequence
  MKO10121119_B_Them6
  gRNA
gcgccuguuugagccguucg

SEQ ID NO: 121120 - RNA, 20 nt, Artificial Sequence
  MKO10121120_B_Them6
  gRNA
aagugcuguacuacucgauc

SEQ ID NO: 121121 - RNA, 20 nt, Artificial Sequence
  MKO10121121_B_Themis2
  gRNA
ccgcuaugcgcgcugcgucc

SEQ ID NO: 121122 - RNA, 20 nt, Artificial Sequence
  MKO10121122_B_Themis2
  gRNA
agcgcgcauagcggauccca

SEQ ID NO: 121123 - RNA, 20 nt, Artificial Sequence
  MKO10121123_B_Themis2
  gRNA
gguuccgucuacgagcucuu

SEQ ID NO: 121124 - RNA, 20 nt, Artificial Sequence
  MKO10121124_B_Themis3
  gRNA
aguucugcucugacgaaaac

SEQ ID NO: 121125 - RNA, 20 nt, Artificial Sequence
  MKO10121125_B_Themis3
  gRNA
uggaguagaaccugucgucc

SEQ ID NO: 121126 - RNA, 20 nt, Artificial Sequence
  MKO10121126_B_Themis3
  gRNA
aagcaucuuccaccucacga

SEQ ID NO: 121127 - RNA, 20 nt, Artificial Sequence
  MKO10121127_B_Themis
  gRNA
gaaauuugugagggcgcuau

SEQ ID NO: 121128 - RNA, 20 nt, Artificial Sequence
  MKO10121128_B_Themis
  gRNA
aucacaagaaccguuaauau

SEQ ID NO: 121129 - RNA, 20 nt, Artificial Sequence
  MKO10121129_B_Themis
  gRNA
uguagucacaguggugcuug

SEQ ID NO: 121130 - RNA, 20 nt, Artificial Sequence
  MKO10121130_B_Thg1l
  gRNA
acgacucucccaucaaaucc

SEQ ID NO: 121131 - RNA, 20 nt, Artificial Sequence
  MKO10121131_B_Thg1l
  gRNA
cugguguuaguccagacugc

SEQ ID NO: 121132 - RNA, 20 nt, Artificial Sequence
  MKO10121132_B_Thg1l
  gRNA
acaaugagccacacauguac

SEQ ID NO: 121133 - RNA, 20 nt, Artificial Sequence
  MKO10121133_B_Thnsl1
  gRNA
uuaugaagucagucaaaacg

SEQ ID NO: 121134 - RNA, 20 nt, Artificial Sequence
  MKO10121134_B_Thnsl1
  gRNA
ugcauugcccccuccucacg

SEQ ID NO: 121135 - RNA, 20 nt, Artificial Sequence
  MKO10121135_B_Thnsl1
  gRNA
guuugccccugcuaucaugc

SEQ ID NO: 121136 - RNA, 20 nt, Artificial Sequence
  MKO10121136_B_Thnsl2
  gRNA
accgcaacgacaucauucac

SEQ ID NO: 121137 - RNA, 20 nt, Artificial Sequence
  MKO10121137_B_Thnsl2
  gRNA
uccugugaaugaugucguug

SEQ ID NO: 121138 - RNA, 20 nt, Artificial Sequence
  MKO10121138_B_Thnsl2
  gRNA
cagauuccgccacagaaaug

SEQ ID NO: 121139 - RNA, 20 nt, Artificial Sequence
  MKO10121139_B_Thoc1
  gRNA
acaucucccaauagcacaaa

SEQ ID NO: 121140 - RNA, 20 nt, Artificial Sequence
  MKO10121140_B_Thoc1
  gRNA
guccacaccauuugugcuau

SEQ ID NO: 121141 - RNA, 20 nt, Artificial Sequence
  MKO10121141_B_Thoc1
  gRNA
acugccuucagucaguuacc

SEQ ID NO: 121142 - RNA, 20 nt, Artificial Sequence
  MKO10121142_B_Thoc2
  gRNA
cucuguaggucgaacuguca

SEQ ID NO: 121143 - RNA, 20 nt, Artificial Sequence
  MKO10121143_B_Thoc2
  gRNA
uuaaauucccuuuaaugaca

SEQ ID NO: 121144 - RNA, 20 nt, Artificial Sequence
  MKO10121144_B_Thoc2
  gRNA
uugucauaccaugucauuaa

SEQ ID NO: 121145 - RNA, 20 nt, Artificial Sequence
  MKO10121145_B_Thoc3
  gRNA
cgacgggcagaccaucgcug

SEQ ID NO: 121146 - RNA, 20 nt, Artificial Sequence
  MKO10121146_B_Thoc3
  gRNA
caagacacaccgcuccaaag

SEQ ID NO: 121147 - RNA, 20 nt, Artificial Sequence
  MKO10121147_B_Thoc3
  gRNA
ugcuugggugccaacaaagc

SEQ ID NO: 121148 - RNA, 20 nt, Artificial Sequence
  MKO10121148_B_Thoc5
  gRNA
guuguacaaauacacuugcc

SEQ ID NO: 121149 - RNA, 20 nt, Artificial Sequence
  MKO10121149_B_Thoc5
  gRNA
ucaacucuaccucguggguc

SEQ ID NO: 121150 - RNA, 20 nt, Artificial Sequence
  MKO10121150_B_Thoc5
  gRNA
gaaguugaccugcgggaccc

SEQ ID NO: 121151 - RNA, 20 nt, Artificial Sequence
  MKO10121151_B_Thoc6
  gRNA
gaucgacaccuacucagugc

SEQ ID NO: 121152 - RNA, 20 nt, Artificial Sequence
  MKO10121152_B_Thoc6
  gRNA
agcugccagaaacuucccgc

SEQ ID NO: 121153 - RNA, 20 nt, Artificial Sequence
  MKO10121153_B_Thoc6
  gRNA
gucugcugccuuaaguucag

SEQ ID NO: 121154 - RNA, 20 nt, Artificial Sequence
  MKO10121154_B_Thoc7
  gRNA
cgucuucugauugauggaga

SEQ ID NO: 121155 - RNA, 20 nt, Artificial Sequence
  MKO10121155_B_Thoc7
  gRNA
ugcccauugaaaauucacac

SEQ ID NO: 121156 - RNA, 20 nt, Artificial Sequence
  MKO10121156_B_Thoc7
  gRNA
ucuuucagaauaugacgcuu

SEQ ID NO: 121157 - RNA, 20 nt, Artificial Sequence
  MKO10121157_B_Thop1
  gRNA
ccagcuugaugagccgcucc

SEQ ID NO: 121158 - RNA, 20 nt, Artificial Sequence
  MKO10121158_B_Thop1
  gRNA
acguguaccagagggucgug

SEQ ID NO: 121159 - RNA, 20 nt, Artificial Sequence
  MKO10121159_B_Thop1
  gRNA
gccugaagcagcucgcuacc

SEQ ID NO: 121160 - RNA, 20 nt, Artificial Sequence
  MKO10121160_B_Thpo
  gRNA
ccaccuccuucacagccgac

SEQ ID NO: 121161 - RNA, 20 nt, Artificial Sequence
  MKO10121161_B_Thpo
  gRNA
aggggcagugucccuucuac

SEQ ID NO: 121162 - RNA, 20 nt, Artificial Sequence
  MKO10121162_B_Thpo
  gRNA
gcaggguccgucugacacag

SEQ ID NO: 121163 - RNA, 20 nt, Artificial Sequence
  MKO10121163_B_Thrap3
  gRNA
uuucagaccuagugguuuau

SEQ ID NO: 121164 - RNA, 20 nt, Artificial Sequence
  MKO10121164_B_Thrap3
  gRNA
uucuuaacagagcaucacuu

SEQ ID NO: 121165 - RNA, 20 nt, Artificial Sequence
  MKO10121165_B_Thrap3
  gRNA
gugcccacuuucacuccucu

SEQ ID NO: 121166 - RNA, 20 nt, Artificial Sequence
  MKO10121166_B_Thra
  gRNA
aggguauaucccuaguuacc

SEQ ID NO: 121167 - RNA, 20 nt, Artificial Sequence
  MKO10121167_B_Thra
  gRNA
gugucaucgacaagaucacc

SEQ ID NO: 121168 - RNA, 20 nt, Artificial Sequence
  MKO10121168_B_Thra
  gRNA
ugcagugccaggucaccaga

SEQ ID NO: 121169 - RNA, 20 nt, Artificial Sequence
  MKO10121169_B_Thrb
  gRNA
cuccucuauaagcuuccgcu

SEQ ID NO: 121170 - RNA, 20 nt, Artificial Sequence
  MKO10121170_B_Thrb
  gRNA
ccacguggccaccaaugccc

SEQ ID NO: 121171 - RNA, 20 nt, Artificial Sequence
  MKO10121171_B_Thrb
  gRNA
auuucuuaaagcgacauucc

SEQ ID NO: 121172 - RNA, 20 nt, Artificial Sequence
  MKO10121172_B_Thrsp
  gRNA
gcguuucguuagcacuugca

SEQ ID NO: 121173 - RNA, 20 nt, Artificial Sequence
  MKO10121173_B_Thrsp
  gRNA
ggaggugacgcggaaauacc

SEQ ID NO: 121174 - RNA, 20 nt, Artificial Sequence
  MKO10121174_B_Thrsp
  gRNA
ccguccuggaccgagccccc

SEQ ID NO: 121175 - RNA, 20 nt, Artificial Sequence
  MKO10121175_B_Thsd1
  gRNA
aguccucuccuccgggcguu

SEQ ID NO: 121176 - RNA, 20 nt, Artificial Sequence
  MKO10121176_B_Thsd1
  gRNA
ucggacagcauccccgcacg

SEQ ID NO: 121177 - RNA, 20 nt, Artificial Sequence
  MKO10121177_B_Thsd1
  gRNA
agcccguguagcaccacgug

SEQ ID NO: 121178 - RNA, 20 nt, Artificial Sequence
  MKO10121178_B_Thsd4
  gRNA
auucugacgugaauaccuca

SEQ ID NO: 121179 - RNA, 20 nt, Artificial Sequence
  MKO10121179_B_Thsd4
  gRNA
ugaacacucccgacaccacc

SEQ ID NO: 121180 - RNA, 20 nt, Artificial Sequence
  MKO10121180_B_Thsd4
  gRNA
cuacaacccggugguagccc

SEQ ID NO: 121181 - RNA, 20 nt, Artificial Sequence
  MKO10121181_B_Thsd7a
  gRNA
ggcgaaaccucacauucaau

SEQ ID NO: 121182 - RNA, 20 nt, Artificial Sequence
  MKO10121182_B_Thsd7a
  gRNA
guccuuacucgagugccugu

SEQ ID NO: 121183 - RNA, 20 nt, Artificial Sequence
  MKO10121183_B_Thsd7a
  gRNA
uccuuguccaauugaaugug

SEQ ID NO: 121184 - RNA, 20 nt, Artificial Sequence
  MKO10121184_B_Thsd7b
  gRNA
uugcaaugucccuugcucga

SEQ ID NO: 121185 - RNA, 20 nt, Artificial Sequence
  MKO10121185_B_Thsd7b
  gRNA
uguuccaagaccugccguuc

SEQ ID NO: 121186 - RNA, 20 nt, Artificial Sequence
  MKO10121186_B_Thsd7b
  gRNA
gauccacuuuggcaugagac

SEQ ID NO: 121187 - RNA, 20 nt, Artificial Sequence
  MKO10121187_B_Thtpa
  gRNA
ccagaggccugaagcgcugu

SEQ ID NO: 121188 - RNA, 20 nt, Artificial Sequence
  MKO10121188_B_Thtpa
  gRNA
cacaucggaagcugcgauug

SEQ ID NO: 121189 - RNA, 20 nt, Artificial Sequence
  MKO10121189_B_Thtpa
  gRNA
aucaccgucaguagcaugcu

SEQ ID NO: 121190 - RNA, 20 nt, Artificial Sequence
  MKO10121190_B_Thumpd1
  gRNA
ccgagcuccucgauacucuc

SEQ ID NO: 121191 - RNA, 20 nt, Artificial Sequence
  MKO10121191_B_Thumpd1
  gRNA
auaugaugcacuaauuucuc

SEQ ID NO: 121192 - RNA, 20 nt, Artificial Sequence
  MKO10121192_B_Thumpd1
  gRNA
cuacgaaugcugcccaucuc

SEQ ID NO: 121193 - RNA, 20 nt, Artificial Sequence
  MKO10121193_B_Thumpd2
  gRNA
gaugaccuuucugacauucc

SEQ ID NO: 121194 - RNA, 20 nt, Artificial Sequence
  MKO10121194_B_Thumpd2
  gRNA
auauucauuaccucuauauu

SEQ ID NO: 121195 - RNA, 20 nt, Artificial Sequence
  MKO10121195_B_Thumpd2
  gRNA
gagcagaggaauccccacca

SEQ ID NO: 121196 - RNA, 20 nt, Artificial Sequence
  MKO10121196_B_Thumpd3
  gRNA
agaguugaccuaagaguugu

SEQ ID NO: 121197 - RNA, 20 nt, Artificial Sequence
  MKO10121197_B_Thumpd3
  gRNA
acuauuacaucaguaggcuu

SEQ ID NO: 121198 - RNA, 20 nt, Artificial Sequence
  MKO10121198_B_Thumpd3
  gRNA
aacaggggcaauaccaauag

SEQ ID NO: 121199 - RNA, 20 nt, Artificial Sequence
  MKO10121199_B_Thy1
  gRNA
acagacaagcuggucaagug

SEQ ID NO: 121200 - RNA, 20 nt, Artificial Sequence
  MKO10121200_B_Thy1
  gRNA
ugcugguucagaacacaucc

SEQ ID NO: 121201 - RNA, 20 nt, Artificial Sequence
  MKO10121201_B_Thy1
  gRNA
gagcaggagagcgacgcuga

SEQ ID NO: 121202 - RNA, 20 nt, Artificial Sequence
  MKO10121202_B_Thyn1
  gRNA
gcaagaauuuaagcaacuac

SEQ ID NO: 121203 - RNA, 20 nt, Artificial Sequence
  MKO10121203_B_Thyn1
  gRNA
agcccaagcagacagcuugc

SEQ ID NO: 121204 - RNA, 20 nt, Artificial Sequence
  MKO10121204_B_Thyn1
  gRNA
aucccagcaagcugucugcu

SEQ ID NO: 121205 - RNA, 20 nt, Artificial Sequence
  MKO10121205_B_Th
  gRNA
acaagcucaccggauggucc

SEQ ID NO: 121206 - RNA, 20 nt, Artificial Sequence
  MKO10121206_B_Th
  gRNA
acacccgacgcacagaacug

SEQ ID NO: 121207 - RNA, 20 nt, Artificial Sequence
  MKO10121207_B_Th
  gRNA
cagggucaaacuuggugacc

SEQ ID NO: 121208 - RNA, 20 nt, Artificial Sequence
  MKO10121208_B_Tia1
  gRNA
cuugggcaucucguccucca

SEQ ID NO: 121209 - RNA, 20 nt, Artificial Sequence
  MKO10121209_B_Tia1
  gRNA
caugaaugggcggaagauaa

SEQ ID NO: 121210 - RNA, 20 nt, Artificial Sequence
  MKO10121210_B_Tia1
  gRNA
aaccccuagcagucaaaaga

SEQ ID NO: 121211 - RNA, 20 nt, Artificial Sequence
  MKO10121211_B_Tial1
  gRNA
uuuaggaggucaaaguaaac

SEQ ID NO: 121212 - RNA, 20 nt, Artificial Sequence
  MKO10121212_B_Tial1
  gRNA
cuucaguuauucagucagau

SEQ ID NO: 121213 - RNA, 20 nt, Artificial Sequence
  MKO10121213_B_Tial1
  gRNA
aagcuguaaaaugauaacag

SEQ ID NO: 121214 - RNA, 20 nt, Artificial Sequence
  MKO10121214_B_Tiam1
  gRNA
aguaagacuggucccugacu

SEQ ID NO: 121215 - RNA, 20 nt, Artificial Sequence
  MKO10121215_B_Tiam1
  gRNA
ggcaaccacacgacagcugu

SEQ ID NO: 121216 - RNA, 20 nt, Artificial Sequence
  MKO10121216_B_Tiam1
  gRNA
gacuugaaacuccaccauuu

SEQ ID NO: 121217 - RNA, 20 nt, Artificial Sequence
  MKO10121217_B_Tiam2
  gRNA
cccuguuuaagauccggcaa

SEQ ID NO: 121218 - RNA, 20 nt, Artificial Sequence
  MKO10121218_B_Tiam2
  gRNA
ugcgagagcucgaaaugagc

SEQ ID NO: 121219 - RNA, 20 nt, Artificial Sequence
  MKO10121219_B_Tiam2
  gRNA
caaugguaccugauucucga

SEQ ID NO: 121220 - RNA, 20 nt, Artificial Sequence
  MKO10121220_B_Ticam1
  gRNA
aucugaacugcaccgauccc

SEQ ID NO: 121221 - RNA, 20 nt, Artificial Sequence
  MKO10121221_B_Ticam1
  gRNA
ucuggaacgcuaauuucgug

SEQ ID NO: 121222 - RNA, 20 nt, Artificial Sequence
  MKO10121222_B_Ticam1
  gRNA
cgugaaccccgagugaucga

SEQ ID NO: 121223 - RNA, 20 nt, Artificial Sequence
  MKO10121223_B_Ticam2
  gRNA
acaacuccgucauacccaug

SEQ ID NO: 121224 - RNA, 20 nt, Artificial Sequence
  MKO10121224_B_Ticam2
  gRNA
uuugcagaaucuagacgaug

SEQ ID NO: 121225 - RNA, 20 nt, Artificial Sequence
  MKO10121225_B_Ticam2
  gRNA
cuccacaaaaccacgcaagc

SEQ ID NO: 121226 - RNA, 20 nt, Artificial Sequence
  MKO10121226_B_Ticrr
  gRNA
uuugaagacccugcgucuuc

SEQ ID NO: 121227 - RNA, 20 nt, Artificial Sequence
  MKO10121227_B_Ticrr
  gRNA
caagucugaaguagcaccac

SEQ ID NO: 121228 - RNA, 20 nt, Artificial Sequence
  MKO10121228_B_Ticrr
  gRNA
cccuggcuuuaguaaauccc

SEQ ID NO: 121229 - RNA, 20 nt, Artificial Sequence
  MKO10121229_B_Tie1
  gRNA
gaagacgccuaccaaauccg

SEQ ID NO: 121230 - RNA, 20 nt, Artificial Sequence
  MKO10121230_B_Tie1
  gRNA
gggcaauccuugacacaucc

SEQ ID NO: 121231 - RNA, 20 nt, Artificial Sequence
  MKO10121231_B_Tie1
  gRNA
ggcgaauguguguguccccc

SEQ ID NO: 121232 - RNA, 20 nt, Artificial Sequence
  MKO10121232_B_Tifab
  gRNA
agcugcaacaugacgccagc

SEQ ID NO: 121233 - RNA, 20 nt, Artificial Sequence
  MKO10121233_B_Tifab
  gRNA
gagccuguaccacccuacac

SEQ ID NO: 121234 - RNA, 20 nt, Artificial Sequence
  MKO10121234_B_Tifab
  gRNA
aaggcgaccgggcccugugu

SEQ ID NO: 121235 - RNA, 20 nt, Artificial Sequence
  MKO10121235_B_Tifa
  gRNA
caugugccaguauacguuuc

SEQ ID NO: 121236 - RNA, 20 nt, Artificial Sequence
  MKO10121236_B_Tifa
  gRNA
caggaugguaaauggucauc

SEQ ID NO: 121237 - RNA, 20 nt, Artificial Sequence
  MKO10121237_B_Tifa
  gRNA
ugccuuacaaguguaugcuc

SEQ ID NO: 121238 - RNA, 20 nt, Artificial Sequence
  MKO10121238_B_Tigd2
  gRNA
caugaagucgucaacguaug

SEQ ID NO: 121239 - RNA, 20 nt, Artificial Sequence
  MKO10121239_B_Tigd2
  gRNA
acuagguuuaagcagcgcca

SEQ ID NO: 121240 - RNA, 20 nt, Artificial Sequence
  MKO10121240_B_Tigd2
  gRNA
uagguucuucuucgaugcau

SEQ ID NO: 121241 - RNA, 20 nt, Artificial Sequence
  MKO10121241_B_Tigd3
  gRNA
ucgaugaggcucuacugugc

SEQ ID NO: 121242 - RNA, 20 nt, Artificial Sequence
  MKO10121242_B_Tigd3
  gRNA
aguacccuuguuguaucgcg

SEQ ID NO: 121243 - RNA, 20 nt, Artificial Sequence
  MKO10121243_B_Tigd3
  gRNA
cacgcuuccgcuuccgcucg

SEQ ID NO: 121244 - RNA, 20 nt, Artificial Sequence
  MKO10121244_B_Tigd4
  gRNA
agcugagagcgcguccuucu

SEQ ID NO: 121245 - RNA, 20 nt, Artificial Sequence
  MKO10121245_B_Tigd4
  gRNA
cauagaggaauacgcugccc

SEQ ID NO: 121246 - RNA, 20 nt, Artificial Sequence
  MKO10121246_B_Tigd4
  gRNA
ucugccgucaccauccaaga

SEQ ID NO: 121247 - RNA, 20 nt, Artificial Sequence
  MKO10121247_B_Tigd5
  gRNA
gcucgcgggguacauggcgu

SEQ ID NO: 121248 - RNA, 20 nt, Artificial Sequence
  MKO10121248_B_Tigd5
  gRNA
ucgaccgcgccgucuacucg

SEQ ID NO: 121249 - RNA, 20 nt, Artificial Sequence
  MKO10121249_B_Tigd5
  gRNA
ggcgcaguucucguaccuga

SEQ ID NO: 121250 - RNA, 20 nt, Artificial Sequence
  MKO10121250_B_Tigit
  gRNA
caggcugccuuccucgcuac

SEQ ID NO: 121251 - RNA, 20 nt, Artificial Sequence
  MKO10121251_B_Tigit
  gRNA
uuccuccaagcggggcaguc

SEQ ID NO: 121252 - RNA, 20 nt, Artificial Sequence
  MKO10121252_B_Tigit
  gRNA
caguuccagacugccccgcu

SEQ ID NO: 121253 - RNA, 20 nt, Artificial Sequence
  MKO10121253_B_Timd2
  gRNA
auaguuaccugcaggaguag

SEQ ID NO: 121254 - RNA, 20 nt, Artificial Sequence
  MKO10121254_B_Timd2
  gRNA
accucagcuguagucugauc

SEQ ID NO: 121255 - RNA, 20 nt, Artificial Sequence
  MKO10121255_B_Timd2
  gRNA
ugacauccucagaugacccu

SEQ ID NO: 121256 - RNA, 20 nt, Artificial Sequence
  MKO10121256_B_Timd4
  gRNA
cauaagggguggugguuggc

SEQ ID NO: 121257 - RNA, 20 nt, Artificial Sequence
  MKO10121257_B_Timd4
  gRNA
acaauccucaccuguaguga

SEQ ID NO: 121258 - RNA, 20 nt, Artificial Sequence
  MKO10121258_B_Timd4
  gRNA
caugcuucuuugagagugau

SEQ ID NO: 121259 - RNA, 20 nt, Artificial Sequence
  MKO10121259_B_Timeless
  gRNA
cuuguaugaauugcuacagc

SEQ ID NO: 121260 - RNA, 20 nt, Artificial Sequence
  MKO10121260_B_Timeless
  gRNA
ucaccucuuuguaggcuugc

SEQ ID NO: 121261 - RNA, 20 nt, Artificial Sequence
  MKO10121261_B_Timeless
  gRNA
cagcuguagcaauucauaca

SEQ ID NO: 121262 - RNA, 20 nt, Artificial Sequence
  MKO10121262_B_Timm10b
  gRNA
ucaguugcgagacuuccugu

SEQ ID NO: 121263 - RNA, 20 nt, Artificial Sequence
  MKO10121263_B_Timm10b
  gRNA
cgugcaccucaugcccgccc

SEQ ID NO: 121264 - RNA, 20 nt, Artificial Sequence
  MKO10121264_B_Timm10b
  gRNA
ccauucuaaccaccgccuca

SEQ ID NO: 121265 - RNA, 20 nt, Artificial Sequence
  MKO10121265_B_Timm10
  gRNA
uccgcucagagcccagcagc

SEQ ID NO: 121266 - RNA, 20 nt, Artificial Sequence
  MKO10121266_B_Timm10
  gRNA
gugcgugccuccccacuaca

SEQ ID NO: 121267 - RNA, 20 nt, Artificial Sequence
  MKO10121267_B_Timm10
  gRNA
guugacagagcugucaaugc

SEQ ID NO: 121268 - RNA, 20 nt, Artificial Sequence
  MKO10121268_B_Timm13
  gRNA
ccgcugcagucgagaguugu

SEQ ID NO: 121269 - RNA, 20 nt, Artificial Sequence
  MKO10121269_B_Timm13
  gRNA
gcuggacccgggggccauua

SEQ ID NO: 121270 - RNA, 20 nt, Artificial Sequence
  MKO10121270_B_Timm13
  gRNA
caccugcuccgaguuaucca

SEQ ID NO: 121271 - RNA, 20 nt, Artificial Sequence
  MKO10121271_B_Timm17a
  gRNA
ucccucuuaccucccaacug

SEQ ID NO: 121272 - RNA, 20 nt, Artificial Sequence
  MKO10121272_B_Timm17a
  gRNA
uaauagcugucaaacuuccu

SEQ ID NO: 121273 - RNA, 20 nt, Artificial Sequence
  MKO10121273_B_Timm17a
  gRNA
aaacagguagcuuugcaguu

SEQ ID NO: 121274 - RNA, 20 nt, Artificial Sequence
  MKO10121274_B_Timm17b
  gRNA
agucaacgcuccacugcuga

SEQ ID NO: 121275 - RNA, 20 nt, Artificial Sequence
  MKO10121275_B_Timm17b
  gRNA
aucagcaguggagcguugac

SEQ ID NO: 121276 - RNA, 20 nt, Artificial Sequence
  MKO10121276_B_Timm17b
  gRNA
uucuccagggaauucgacac

SEQ ID NO: 121277 - RNA, 20 nt, Artificial Sequence
  MKO10121277_B_Timm21
  gRNA
uguaccguuccuugcuuccc

SEQ ID NO: 121278 - RNA, 20 nt, Artificial Sequence
  MKO10121278_B_Timm21
  gRNA
cucuuugcagugagagaagc

SEQ ID NO: 121279 - RNA, 20 nt, Artificial Sequence
  MKO10121279_B_Timm21
  gRNA
uccagcccuaauaucauaua

SEQ ID NO: 121280 - RNA, 20 nt, Artificial Sequence
  MKO10121280_B_Timm22
  gRNA
ugcaucacuggcggagccau

SEQ ID NO: 121281 - RNA, 20 nt, Artificial Sequence
  MKO10121281_B_Timm22
  gRNA
ccggggccauagguugugga

SEQ ID NO: 121282 - RNA, 20 nt, Artificial Sequence
  MKO10121282_B_Timm22
  gRNA
agcugaacccccggccuugg

SEQ ID NO: 121283 - RNA, 20 nt, Artificial Sequence
  MKO10121283_B_Timm23
  gRNA
uagacuuacuguacauuucu

SEQ ID NO: 121284 - RNA, 20 nt, Artificial Sequence
  MKO10121284_B_Timm23
  gRNA
ccugucuccuuauuuaaaug

SEQ ID NO: 121285 - RNA, 20 nt, Artificial Sequence
  MKO10121285_B_Timm23
  gRNA
ugucaugcaacauccuccaa

SEQ ID NO: 121286 - RNA, 20 nt, Artificial Sequence
  MKO10121286_B_Timm44
  gRNA
agaagagucggaugcucucc

SEQ ID NO: 121287 - RNA, 20 nt, Artificial Sequence
  MKO10121287_B_Timm44
  gRNA
cacugacuccgcugacugcu

SEQ ID NO: 121288 - RNA, 20 nt, Artificial Sequence
  MKO10121288_B_Timm44
  gRNA
uccagccacaaccuacccca

SEQ ID NO: 121289 - RNA, 20 nt, Artificial Sequence
  MKO10121289_B_Timm50
  gRNA
cgcaacugcugaaccagaau

SEQ ID NO: 121290 - RNA, 20 nt, Artificial Sequence
  MKO10121290_B_Timm50
  gRNA
ccuggcaggaaacaacccug

SEQ ID NO: 121291 - RNA, 20 nt, Artificial Sequence
  MKO10121291_B_Timm50
  gRNA
auuccugaugaauucgacag

SEQ ID NO: 121292 - RNA, 20 nt, Artificial Sequence
  MKO10121292_B_Timm8a1
  gRNA
aaugcugagaucagucagaa

SEQ ID NO: 121293 - RNA, 20 nt, Artificial Sequence
  MKO10121293_B_Timm8a1
  gRNA
ucaguugcagcauuucaucg

SEQ ID NO: 121294 - RNA, 20 nt, Artificial Sequence
  MKO10121294_B_Timm8a1
  gRNA
ucgaugaaaugcugcaacug

SEQ ID NO: 121295 - RNA, 20 nt, Artificial Sequence
  MKO10121295_B_Timm8a2
  gRNA
accacaugacagagcucugc

SEQ ID NO: 121296 - RNA, 20 nt, Artificial Sequence
  MKO10121296_B_Timm8a2
  gRNA
aagaucccaggcuggucccc

SEQ ID NO: 121297 - RNA, 20 nt, Artificial Sequence
  MKO10121297_B_Timm8a2
  gRNA
ccaguucaucuugaaucgac

SEQ ID NO: 121298 - RNA, 20 nt, Artificial Sequence
  MKO10121298_B_Timm8b
  gRNA
cgggagucuagccgacuucc

SEQ ID NO: 121299 - RNA, 20 nt, Artificial Sequence
  MKO10121299_B_Timm8b
  gRNA
gaaggcgcaauucacugcgc

SEQ ID NO: 121300 - RNA, 20 nt, Artificial Sequence
  MKO10121300_B_Timm8b
  gRNA
uucguccgcuucaccaagcu

SEQ ID NO: 121301 - RNA, 20 nt, Artificial Sequence
  MKO10121301_B_Timm9
  gRNA
gugauauuccugaaaucuca

SEQ ID NO: 121302 - RNA, 20 nt, Artificial Sequence
  MKO10121302_B_Timm9
  gRNA
gaauauggcugcacagauac

SEQ ID NO: 121303 - RNA, 20 nt, Artificial Sequence
  MKO10121303_B_Timm9
  gRNA
uaaguuuauuguagguuccc

SEQ ID NO: 121304 - RNA, 20 nt, Artificial Sequence
  MKO10121304_B_Timmdc1
  gRNA
agaauaaacuuagguguucg

SEQ ID NO: 121305 - RNA, 20 nt, Artificial Sequence
  MKO10121305_B_Timmdc1
  gRNA
ucauaaccgauuugaugcug

SEQ ID NO: 121306 - RNA, 20 nt, Artificial Sequence
  MKO10121306_B_Timmdc1
  gRNA
aucauuggcugggcauaugg

SEQ ID NO: 121307 - RNA, 20 nt, Artificial Sequence
  MKO10121307_B_Timp1
  gRNA
uuuaucuaucccuugcaaac

SEQ ID NO: 121308 - RNA, 20 nt, Artificial Sequence
  MKO10121308_B_Timp1
  gRNA
ugggaaaugccgcagauauc

SEQ ID NO: 121309 - RNA, 20 nt, Artificial Sequence
  MKO10121309_B_Timp1
  gRNA
ugugcaaauuuccguuccuu

SEQ ID NO: 121310 - RNA, 20 nt, Artificial Sequence
  MKO10121310_B_Timp2
  gRNA
gugaugcuaagcguguccca

SEQ ID NO: 121311 - RNA, 20 nt, Artificial Sequence
  MKO10121311_B_Timp2
  gRNA
guugccauagaugucauucc

SEQ ID NO: 121312 - RNA, 20 nt, Artificial Sequence
  MKO10121312_B_Timp2
  gRNA
gaccccgcacacugcugaag

SEQ ID NO: 121313 - RNA, 20 nt, Artificial Sequence
  MKO10121313_B_Timp3
  gRNA
uaguguuuggacugauagcc

SEQ ID NO: 121314 - RNA, 20 nt, Artificial Sequence
  MKO10121314_B_Timp3
  gRNA
ccucaauuaccgcuaccacc

SEQ ID NO: 121315 - RNA, 20 nt, Artificial Sequence
  MKO10121315_B_Timp3
  gRNA
ccaaacacuacgccugcauc

SEQ ID NO: 121316 - RNA, 20 nt, Artificial Sequence
  MKO10121316_B_Timp4
  gRNA
cugacacucaaaaacugauc

SEQ ID NO: 121317 - RNA, 20 nt, Artificial Sequence
  MKO10121317_B_Timp4
  gRNA
ugugcaacuacauugagccc

SEQ ID NO: 121318 - RNA, 20 nt, Artificial Sequence
  MKO10121318_B_Timp4
  gRNA
ggccaaaauauccagugaga

SEQ ID NO: 121319 - RNA, 20 nt, Artificial Sequence
  MKO10121319_B_Tinagl1
  gRNA
gguagcgaaugcccucaucc

SEQ ID NO: 121320 - RNA, 20 nt, Artificial Sequence
  MKO10121320_B_Tinagl1
  gRNA
gcacaauugcccugguccaa

SEQ ID NO: 121321 - RNA, 20 nt, Artificial Sequence
  MKO10121321_B_Tinagl1
  gRNA
augauuaaagccaucaaccg

SEQ ID NO: 121322 - RNA, 20 nt, Artificial Sequence
  MKO10121322_B_Tinag
  gRNA
uuaauugaccacaucaauaa

SEQ ID NO: 121323 - RNA, 20 nt, Artificial Sequence
  MKO10121323_B_Tinag
  gRNA
uuaaagaaaacugcaacucc

SEQ ID NO: 121324 - RNA, 20 nt, Artificial Sequence
  MKO10121324_B_Tinag
  gRNA
aaaaaaacugugcugcaucc

SEQ ID NO: 121325 - RNA, 20 nt, Artificial Sequence
  MKO10121325_B_Tinf2
  gRNA
accccauguccauaccauac

SEQ ID NO: 121326 - RNA, 20 nt, Artificial Sequence
  MKO10121326_B_Tinf2
  gRNA
gcuugugaagcaccugucag

SEQ ID NO: 121327 - RNA, 20 nt, Artificial Sequence
  MKO10121327_B_Tinf2
  gRNA
agugaugcuucagggcauuc

SEQ ID NO: 121328 - RNA, 20 nt, Artificial Sequence
  MKO10121328_B_Tiparp
  gRNA
uucuuucagaccccgagagu

SEQ ID NO: 121329 - RNA, 20 nt, Artificial Sequence
  MKO10121329_B_Tiparp
  gRNA
acacugccaggguugaccgg

SEQ ID NO: 121330 - RNA, 20 nt, Artificial Sequence
  MKO10121330_B_Tiparp
  gRNA
uuggcugaaguuacuccauc

SEQ ID NO: 121331 - RNA, 20 nt, Artificial Sequence
  MKO10121331_B_Tipin
  gRNA
gaaaacgcuaaucagacaca

SEQ ID NO: 121332 - RNA, 20 nt, Artificial Sequence
  MKO10121332_B_Tipin
  gRNA
auugacagagucgaaaaccu

SEQ ID NO: 121333 - RNA, 20 nt, Artificial Sequence
  MKO10121333_B_Tipin
  gRNA
cuuaucaaacacaugccuua

SEQ ID NO: 121334 - RNA, 20 nt, Artificial Sequence
  MKO10121334_B_Tiprl
  gRNA
gagaugugugaacaacuauc

SEQ ID NO: 121335 - RNA, 20 nt, Artificial Sequence
  MKO10121335_B_Tiprl
  gRNA
aaguuauuaaaccauaugac

SEQ ID NO: 121336 - RNA, 20 nt, Artificial Sequence
  MKO10121336_B_Tiprl
  gRNA
accuauacaacagauuauaa

SEQ ID NO: 121337 - RNA, 20 nt, Artificial Sequence
  MKO10121337_B_Tirap
  gRNA
aagccucgagacaagauagc

SEQ ID NO: 121338 - RNA, 20 nt, Artificial Sequence
  MKO10121338_B_Tirap
  gRNA
uuccggcggauaggcggcuc

SEQ ID NO: 121339 - RNA, 20 nt, Artificial Sequence
  MKO10121339_B_Tirap
  gRNA
guauaacagccuccuugacu

SEQ ID NO: 121340 - RNA, 20 nt, Artificial Sequence
  MKO10121340_B_Tjap1
  gRNA
ccagcggaccaaccaggaac

SEQ ID NO: 121341 - RNA, 20 nt, Artificial Sequence
  MKO10121341_B_Tjap1
  gRNA
agucccugacugacgcagag

SEQ ID NO: 121342 - RNA, 20 nt, Artificial Sequence
  MKO10121342_B_Tjap1
  gRNA
ccuggcauccaguagcuugu

SEQ ID NO: 121343 - RNA, 20 nt, Artificial Sequence
  MKO10121343_B_Tjp1
  gRNA
agcacacagugacgcuucac

SEQ ID NO: 121344 - RNA, 20 nt, Artificial Sequence
  MKO10121344_B_Tjp1
  gRNA
cuccguuaaccauugcaacu

SEQ ID NO: 121345 - RNA, 20 nt, Artificial Sequence
  MKO10121345_B_Tjp1
  gRNA
uacuguagcuguccuucagc

SEQ ID NO: 121346 - RNA, 20 nt, Artificial Sequence
  MKO10121346_B_Tjp2
  gRNA
cgaauggagcacaucuucca

SEQ ID NO: 121347 - RNA, 20 nt, Artificial Sequence
  MKO10121347_B_Tjp2
  gRNA
gaauuaugucccccucauga

SEQ ID NO: 121348 - RNA, 20 nt, Artificial Sequence
  MKO10121348_B_Tjp2
  gRNA
cguuugccguucagcagcuu

SEQ ID NO: 121349 - RNA, 20 nt, Artificial Sequence
  MKO10121349_B_Tjp3
  gRNA
cagauccgccacccgaacuc

SEQ ID NO: 121350 - RNA, 20 nt, Artificial Sequence
  MKO10121350_B_Tjp3
  gRNA
gaccggggaccacaucguca

SEQ ID NO: 121351 - RNA, 20 nt, Artificial Sequence
  MKO10121351_B_Tjp3
  gRNA
acuuacaacguuggcuguuu

SEQ ID NO: 121352 - RNA, 20 nt, Artificial Sequence
  MKO10121352_B_Tk1
  gRNA
gacaguaauuguggcagcgc

SEQ ID NO: 121353 - RNA, 20 nt, Artificial Sequence
  MKO10121353_B_Tk1
  gRNA
uccuuggguguggccgucau

SEQ ID NO: 121354 - RNA, 20 nt, Artificial Sequence
  MKO10121354_B_Tk1
  gRNA
uucucuucuaggugauucuc

SEQ ID NO: 121355 - RNA, 20 nt, Artificial Sequence
  MKO10121355_B_Tk2
  gRNA
uguccauggccauaacccuc

SEQ ID NO: 121356 - RNA, 20 nt, Artificial Sequence
  MKO10121356_B_Tk2
  gRNA
uaccucgacgucuguuguau

SEQ ID NO: 121357 - RNA, 20 nt, Artificial Sequence
  MKO10121357_B_Tk2
  gRNA
acauuucuccacuugagcac

SEQ ID NO: 121358 - RNA, 20 nt, Artificial Sequence
  MKO10121358_B_Tktl1
  gRNA
aucuuugaugugaaccgcau

SEQ ID NO: 121359 - RNA, 20 nt, Artificial Sequence
  MKO10121359_B_Tktl1
  gRNA
gccaguauaugccaucccac

SEQ ID NO: 121360 - RNA, 20 nt, Artificial Sequence
  MKO10121360_B_Tktl1
  gRNA
ccugugccauguauucucac

SEQ ID NO: 121361 - RNA, 20 nt, Artificial Sequence
  MKO10121361_B_Tktl2
  gRNA
aguugacgaacgacuauguc

SEQ ID NO: 121362 - RNA, 20 nt, Artificial Sequence
  MKO10121362_B_Tktl2
  gRNA
ugccacacuacagcacgacg

SEQ ID NO: 121363 - RNA, 20 nt, Artificial Sequence
  MKO10121363_B_Tktl2
  gRNA
agcaauaguucguccucgug

SEQ ID NO: 121364 - RNA, 20 nt, Artificial Sequence
  MKO10121364_B_Tkt
  gRNA
aggucuccgagggcuccguc

SEQ ID NO: 121365 - RNA, 20 nt, Artificial Sequence
  MKO10121365_B_Tkt
  gRNA
ugaucgauuugugcucucua

SEQ ID NO: 121366 - RNA, 20 nt, Artificial Sequence
  MKO10121366_B_Tkt
  gRNA
gaaacaagccuucaccgaug

SEQ ID NO: 121367 - RNA, 20 nt, Artificial Sequence
  MKO10121367_B_Tlcd1
  gRNA
auacuuuauccacgacacag

SEQ ID NO: 121368 - RNA, 20 nt, Artificial Sequence
  MKO10121368_B_Tlcd1
  gRNA
ucugcccugaacgugcaccc

SEQ ID NO: 121369 - RNA, 20 nt, Artificial Sequence
  MKO10121369_B_Tlcd1
  gRNA
gcaagcaaacucgagcuucu

SEQ ID NO: 121370 - RNA, 20 nt, Artificial Sequence
  MKO10121370_B_Tlcd2
  gRNA
cuuccguagaugcaaacaga

SEQ ID NO: 121371 - RNA, 20 nt, Artificial Sequence
  MKO10121371_B_Tlcd2
  gRNA
agacacgugagccuguugcc

SEQ ID NO: 121372 - RNA, 20 nt, Artificial Sequence
  MKO10121372_B_Tlcd2
  gRNA
cccaggccugggccaauguc

SEQ ID NO: 121373 - RNA, 20 nt, Artificial Sequence
  MKO10121373_B_Tldc1
  gRNA
auccuuugauccguccacgc

SEQ ID NO: 121374 - RNA, 20 nt, Artificial Sequence
  MKO10121374_B_Tldc1
  gRNA
ggugcccccugacaguaugc

SEQ ID NO: 121375 - RNA, 20 nt, Artificial Sequence
  MKO10121375_B_Tldc1
  gRNA
guagcccgugugcaggugcg

SEQ ID NO: 121376 - RNA, 20 nt, Artificial Sequence
  MKO10121376_B_Tldc2
  gRNA
gucuggucuucugcacauca

SEQ ID NO: 121377 - RNA, 20 nt, Artificial Sequence
  MKO10121377_B_Tldc2
  gRNA
uggcuagcuucuguaagcug

SEQ ID NO: 121378 - RNA, 20 nt, Artificial Sequence
  MKO10121378_B_Tldc2
  gRNA
cguagaagccuuugcugagu

SEQ ID NO: 121379 - RNA, 20 nt, Artificial Sequence
  MKO10121379_B_Tle1
  gRNA
acaaaugguguucaaucucu

SEQ ID NO: 121380 - RNA, 20 nt, Artificial Sequence
  MKO10121380_B_Tle1
  gRNA
agucaucccauuucugucuc

SEQ ID NO: 121381 - RNA, 20 nt, Artificial Sequence
  MKO10121381_B_Tle1
  gRNA
caguauuaugaaaugucaua

SEQ ID NO: 121382 - RNA, 20 nt, Artificial Sequence
  MKO10121382_B_Tle2
  gRNA
gcuucucacauucuagcuug

SEQ ID NO: 121383 - RNA, 20 nt, Artificial Sequence
  MKO10121383_B_Tle2
  gRNA
uccaguacugagaacuugaa

SEQ ID NO: 121384 - RNA, 20 nt, Artificial Sequence
  MKO10121384_B_Tle2
  gRNA
caacauugagaugcauaaac

SEQ ID NO: 121385 - RNA, 20 nt, Artificial Sequence
  MKO10121385_B_Tle3
  gRNA
cauuucaauauucaagccau

SEQ ID NO: 121386 - RNA, 20 nt, Artificial Sequence
  MKO10121386_B_Tle3
  gRNA
gaugcagcgccauuauguga

SEQ ID NO: 121387 - RNA, 20 nt, Artificial Sequence
  MKO10121387_B_Tle3
  gRNA
accugugauacugagcuugc

SEQ ID NO: 121388 - RNA, 20 nt, Artificial Sequence
  MKO10121388_B_Tle4
  gRNA
caauuucagaauccugugau

SEQ ID NO: 121389 - RNA, 20 nt, Artificial Sequence
  MKO10121389_B_Tle4
  gRNA
acuaaaugcuaucugugcac

SEQ ID NO: 121390 - RNA, 20 nt, Artificial Sequence
  MKO10121390_B_Tle4
  gRNA
gaacauagaaaugcacaagc

SEQ ID NO: 121391 - RNA, 20 nt, Artificial Sequence
  MKO10121391_B_Tle6
  gRNA
guccaucgugaaccagcuuc

SEQ ID NO: 121392 - RNA, 20 nt, Artificial Sequence
  MKO10121392_B_Tle6
  gRNA
cccucucaccagagucacuc

SEQ ID NO: 121393 - RNA, 20 nt, Artificial Sequence
  MKO10121393_B_Tle6
  gRNA
cagcgucgucucugaaauga

SEQ ID NO: 121394 - RNA, 20 nt, Artificial Sequence
  MKO10121394_B_Tlk1
  gRNA
aauggaugagcuucacaguc

SEQ ID NO: 121395 - RNA, 20 nt, Artificial Sequence
  MKO10121395_B_Tlk1
  gRNA
ucuaagugacaaagaaucag

SEQ ID NO: 121396 - RNA, 20 nt, Artificial Sequence
  MKO10121396_B_Tlk1
  gRNA
gaaaguucuaaucacaguuu

SEQ ID NO: 121397 - RNA, 20 nt, Artificial Sequence
  MKO10121397_B_Tlk2
  gRNA
uaaaauuagugauuacuuug

SEQ ID NO: 121398 - RNA, 20 nt, Artificial Sequence
  MKO10121398_B_Tlk2
  gRNA
accccacgcugcacagacuc

SEQ ID NO: 121399 - RNA, 20 nt, Artificial Sequence
  MKO10121399_B_Tlk2
  gRNA
uacaccaacuccagugaacc

SEQ ID NO: 121400 - RNA, 20 nt, Artificial Sequence
  MKO10121400_B_Tll1
  gRNA
uagagugccccucgcuucuu

SEQ ID NO: 121401 - RNA, 20 nt, Artificial Sequence
  MKO10121401_B_Tll1
  gRNA
ucucucagugaacgucacac

SEQ ID NO: 121402 - RNA, 20 nt, Artificial Sequence
  MKO10121402_B_Tll1
  gRNA
ccauauccuuuccguucuug

SEQ ID NO: 121403 - RNA, 20 nt, Artificial Sequence
  MKO10121403_B_Tll2
  gRNA
acagagcggauuuggccugg

SEQ ID NO: 121404 - RNA, 20 nt, Artificial Sequence
  MKO10121404_B_Tll2
  gRNA
uacuugccagugucaugucc

SEQ ID NO: 121405 - RNA, 20 nt, Artificial Sequence
  MKO10121405_B_Tll2
  gRNA
accacauuucugccuaaccc

SEQ ID NO: 121406 - RNA, 20 nt, Artificial Sequence
  MKO10121406_B_Tln1
  gRNA
cagaaagagcccaaagucgu

SEQ ID NO: 121407 - RNA, 20 nt, Artificial Sequence
  MKO10121407_B_Tln1
  gRNA
gcugaaccuucucuaugugc

SEQ ID NO: 121408 - RNA, 20 nt, Artificial Sequence
  MKO10121408_B_Tln1
  gRNA
ggucucgggaauccacauuc

SEQ ID NO: 121409 - RNA, 20 nt, Artificial Sequence
  MKO10121409_B_Tln2
  gRNA
cacuggauuacuacauguug

SEQ ID NO: 121410 - RNA, 20 nt, Artificial Sequence
  MKO10121410_B_Tln2
  gRNA
aaagggauuuggcuagaagc

SEQ ID NO: 121411 - RNA, 20 nt, Artificial Sequence
  MKO10121411_B_Tln2
  gRNA
caggcacacuaaaaaaagau

SEQ ID NO: 121412 - RNA, 20 nt, Artificial Sequence
  MKO10121412_B_Tlr11
  gRNA
cagcagagcagccaccauug

SEQ ID NO: 121413 - RNA, 20 nt, Artificial Sequence
  MKO10121413_B_Tlr11
  gRNA
uaccauccaauauuagggaa

SEQ ID NO: 121414 - RNA, 20 nt, Artificial Sequence
  MKO10121414_B_Tlr11
  gRNA
cugcgucgccucaccuugcg

SEQ ID NO: 121415 - RNA, 20 nt, Artificial Sequence
  MKO10121415_B_Tlr12
  gRNA
ggccuaaccaagcuuccacc

SEQ ID NO: 121416 - RNA, 20 nt, Artificial Sequence
  MKO10121416_B_Tlr12
  gRNA
gcuccuccagcugcaccgaa

SEQ ID NO: 121417 - RNA, 20 nt, Artificial Sequence
  MKO10121417_B_Tlr12
  gRNA
acgccagcuucagcucccgu

SEQ ID NO: 121418 - RNA, 20 nt, Artificial Sequence
  MKO10121418_B_Tlr13
  gRNA
cacucacuuccagcuggacc

SEQ ID NO: 121419 - RNA, 20 nt, Artificial Sequence
  MKO10121419_B_Tlr13
  gRNA
gcucgcaucagaaaugcguu

SEQ ID NO: 121420 - RNA, 20 nt, Artificial Sequence
  MKO10121420_B_Tlr13
  gRNA
gugguuacugacuacgcaca

SEQ ID NO: 121421 - RNA, 20 nt, Artificial Sequence
  MKO10121421_B_Tlr1
  gRNA
cgcuguaccuuagagaauuc

SEQ ID NO: 121422 - RNA, 20 nt, Artificial Sequence
  MKO10121422_B_Tlr1
  gRNA
augggggaaucccaugcgcc

SEQ ID NO: 121423 - RNA, 20 nt, Artificial Sequence
  MKO10121423_B_Tlr1
  gRNA
ucaaaacucucaugucacga

SEQ ID NO: 121424 - RNA, 20 nt, Artificial Sequence
  MKO10121424_B_Tlr2
  gRNA
cuuugacgagaacaacgacg

SEQ ID NO: 121425 - RNA, 20 nt, Artificial Sequence
  MKO10121425_B_Tlr2
  gRNA
caccuacgagcaagaucaac

SEQ ID NO: 121426 - RNA, 20 nt, Artificial Sequence
  MKO10121426_B_Tlr2
  gRNA
gcucacuacgucugacuccg

SEQ ID NO: 121427 - RNA, 20 nt, Artificial Sequence
  MKO10121427_B_Tlr3
  gRNA
caauucuucuuuacgaaagu

SEQ ID NO: 121428 - RNA, 20 nt, Artificial Sequence
  MKO10121428_B_Tlr3
  gRNA
caugcacucuguuugcgaag

SEQ ID NO: 121429 - RNA, 20 nt, Artificial Sequence
  MKO10121429_B_Tlr3
  gRNA
acauuagaucgaguucuguc

SEQ ID NO: 121430 - RNA, 20 nt, Artificial Sequence
  MKO10121430_B_Tlr4
  gRNA
aagcuugaaucccugcauag

SEQ ID NO: 121431 - RNA, 20 nt, Artificial Sequence
  MKO10121431_B_Tlr4
  gRNA
ccaugaucagaguccuagcc

SEQ ID NO: 121432 - RNA, 20 nt, Artificial Sequence
  MKO10121432_B_Tlr4
  gRNA
ccacugaaguucugaaaaau

SEQ ID NO: 121433 - RNA, 20 nt, Artificial Sequence
  MKO10121433_B_Tlr5
  gRNA
cccacgcaccacacuucagc

SEQ ID NO: 121434 - RNA, 20 nt, Artificial Sequence
  MKO10121434_B_Tlr5
  gRNA
agcaaaauuuacgucgcuua

SEQ ID NO: 121435 - RNA, 20 nt, Artificial Sequence
  MKO10121435_B_Tlr5
  gRNA
uuaacgaccugguugcauua

SEQ ID NO: 121436 - RNA, 20 nt, Artificial Sequence
  MKO10121436_B_Tlr6
  gRNA
ugcugcaaaguuccgacaac

SEQ ID NO: 121437 - RNA, 20 nt, Artificial Sequence
  MKO10121437_B_Tlr6
  gRNA
cgauaacugagagaaucgac

SEQ ID NO: 121438 - RNA, 20 nt, Artificial Sequence
  MKO10121438_B_Tlr6
  gRNA
accgauugugugagacaucc

SEQ ID NO: 121439 - RNA, 20 nt, Artificial Sequence
  MKO10121439_B_Tlr7
  gRNA
uccgauacgaugaauaugca

SEQ ID NO: 121440 - RNA, 20 nt, Artificial Sequence
  MKO10121440_B_Tlr7
  gRNA
aaguaccgcaacucucucaa

SEQ ID NO: 121441 - RNA, 20 nt, Artificial Sequence
  MKO10121441_B_Tlr7
  gRNA
uucagcaugugcccccaaca

SEQ ID NO: 121442 - RNA, 20 nt, Artificial Sequence
  MKO10121442_B_Tlr8
  gRNA
agaucucacgacuuguguau

SEQ ID NO: 121443 - RNA, 20 nt, Artificial Sequence
  MKO10121443_B_Tlr8
  gRNA
ccaucacuaguauugccuaa

SEQ ID NO: 121444 - RNA, 20 nt, Artificial Sequence
  MKO10121444_B_Tlr8
  gRNA
ccgaagacgauuucgccaag

SEQ ID NO: 121445 - RNA, 20 nt, Artificial Sequence
  MKO10121445_B_Tlr9
  gRNA
guccuucaauuaccgcaaga

SEQ ID NO: 121446 - RNA, 20 nt, Artificial Sequence
  MKO10121446_B_Tlr9
  gRNA
ccgagcccuacgcuuguguc

SEQ ID NO: 121447 - RNA, 20 nt, Artificial Sequence
  MKO10121447_B_Tlr9
  gRNA
cucccuucgaguacuugaug

SEQ ID NO: 121448 - RNA, 20 nt, Artificial Sequence
  MKO10121448_B_Tlx1
  gRNA
gccguaagcgccagugcccc

SEQ ID NO: 121449 - RNA, 20 nt, Artificial Sequence
  MKO10121449_B_Tlx1
  gRNA
gccgggggcacuggcgcuua

SEQ ID NO: 121450 - RNA, 20 nt, Artificial Sequence
  MKO10121450_B_Tlx1
  gRNA
agucgucagaccacggcugc

SEQ ID NO: 121451 - RNA, 20 nt, Artificial Sequence
  MKO10121451_B_Tlx2
  gRNA
cucgcccaggcgccagaccg

SEQ ID NO: 121452 - RNA, 20 nt, Artificial Sequence
  MKO10121452_B_Tlx2
  gRNA
aaaacgccgcacuuucuccg

SEQ ID NO: 121453 - RNA, 20 nt, Artificial Sequence
  MKO10121453_B_Tlx2
  gRNA
cacggcgggggccgcacccg

SEQ ID NO: 121454 - RNA, 20 nt, Artificial Sequence
  MKO10121454_B_Tlx3
  gRNA
ucacgcccuucaccgugacc

SEQ ID NO: 121455 - RNA, 20 nt, Artificial Sequence
  MKO10121455_B_Tlx3
  gRNA
cgggcuggauggaaucguug

SEQ ID NO: 121456 - RNA, 20 nt, Artificial Sequence
  MKO10121456_B_Tlx3
  gRNA
guugcagcuguagcaugagc

SEQ ID NO: 121457 - RNA, 20 nt, Artificial Sequence
  MKO10121457_B_Tm2d1
  gRNA
agcacccaaaauaacuugua

SEQ ID NO: 121458 - RNA, 20 nt, Artificial Sequence
  MKO10121458_B_Tm2d1
  gRNA
uuucauucuuauuucaaugc

SEQ ID NO: 121459 - RNA, 20 nt, Artificial Sequence
  MKO10121459_B_Tm2d1
  gRNA
guguaguuuguacaauuaac

SEQ ID NO: 121460 - RNA, 20 nt, Artificial Sequence
  MKO10121460_B_Tm2d2
  gRNA
ggucgacuccgaagcauccc

SEQ ID NO: 121461 - RNA, 20 nt, Artificial Sequence
  MKO10121461_B_Tm2d2
  gRNA
cggagucgaccgcuucugcc

SEQ ID NO: 121462 - RNA, 20 nt, Artificial Sequence
  MKO10121462_B_Tm2d2
  gRNA
gcuugguuaugguugucuca

SEQ ID NO: 121463 - RNA, 20 nt, Artificial Sequence
  MKO10121463_B_Tm2d3
  gRNA
ggaaaagcagcacgcgggac

SEQ ID NO: 121464 - RNA, 20 nt, Artificial Sequence
  MKO10121464_B_Tm2d3
  gRNA
cuacaaguggucgacagccc

SEQ ID NO: 121465 - RNA, 20 nt, Artificial Sequence
  MKO10121465_B_Tm2d3
  gRNA
cucccgacagaauguagcac

SEQ ID NO: 121466 - RNA, 20 nt, Artificial Sequence
  MKO10121466_B_Tm4sf19
  gRNA
ucgcgcuccucuuuccuaac

SEQ ID NO: 121467 - RNA, 20 nt, Artificial Sequence
  MKO10121467_B_Tm4sf19
  gRNA
ccuuuaaagaucuacacaac

SEQ ID NO: 121468 - RNA, 20 nt, Artificial Sequence
  MKO10121468_B_Tm4sf19
  gRNA
accuugcuuaccugcaggca

SEQ ID NO: 121469 - RNA, 20 nt, Artificial Sequence
  MKO10121469_B_Tm4sf1
  gRNA
ccaaagugcagcgaugccca

SEQ ID NO: 121470 - RNA, 20 nt, Artificial Sequence
  MKO10121470_B_Tm4sf1
  gRNA
cugccagcguuuguguucau

SEQ ID NO: 121471 - RNA, 20 nt, Artificial Sequence
  MKO10121471_B_Tm4sf1
  gRNA
agguguaguuccauacucca

SEQ ID NO: 121472 - RNA, 20 nt, Artificial Sequence
  MKO10121472_B_Tm4sf20
  gRNA
gcuccaggauuccaacaagc

SEQ ID NO: 121473 - RNA, 20 nt, Artificial Sequence
  MKO10121473_B_Tm4sf20
  gRNA
uguguggcgucucucagcga

SEQ ID NO: 121474 - RNA, 20 nt, Artificial Sequence
  MKO10121474_B_Tm4sf20
  gRNA
uugcauguugguaucacucc

SEQ ID NO: 121475 - RNA, 20 nt, Artificial Sequence
  MKO10121475_B_Tm4sf4
  gRNA
gugcaaagagccccgugaug

SEQ ID NO: 121476 - RNA, 20 nt, Artificial Sequence
  MKO10121476_B_Tm4sf4
  gRNA
cgcagcagucguuguucugc

SEQ ID NO: 121477 - RNA, 20 nt, Artificial Sequence
  MKO10121477_B_Tm4sf4
  gRNA
cugcagaacaacgacugcug

SEQ ID NO: 121478 - RNA, 20 nt, Artificial Sequence
  MKO10121478_B_Tm4sf5
  gRNA
gauggcgccaagcaccccaa

SEQ ID NO: 121479 - RNA, 20 nt, Artificial Sequence
  MKO10121479_B_Tm4sf5
  gRNA
gcccagcucccgccacugac

SEQ ID NO: 121480 - RNA, 20 nt, Artificial Sequence
  MKO10121480_B_Tm4sf5
  gRNA
ugcugcggugcagguugcug

SEQ ID NO: 121481 - RNA, 20 nt, Artificial Sequence
  MKO10121481_B_Tm6sf1
  gRNA
ccaccaucacuagguacauc

SEQ ID NO: 121482 - RNA, 20 nt, Artificial Sequence
  MKO10121482_B_Tm6sf1
  gRNA
cuugcuccaagccuaugaua

SEQ ID NO: 121483 - RNA, 20 nt, Artificial Sequence
  MKO10121483_B_Tm6sf1
  gRNA
aguguggugaaccuuaucau

SEQ ID NO: 121484 - RNA, 20 nt, Artificial Sequence
  MKO10121484_B_Tm6sf2
  gRNA
accuacgacccucucuaugc

SEQ ID NO: 121485 - RNA, 20 nt, Artificial Sequence
  MKO10121485_B_Tm6sf2
  gRNA
cuucauggauuucuacacca

SEQ ID NO: 121486 - RNA, 20 nt, Artificial Sequence
  MKO10121486_B_Tm6sf2
  gRNA
cccuaccuacgcacagcaca

SEQ ID NO: 121487 - RNA, 20 nt, Artificial Sequence
  MKO10121487_B_Tm7sf2
  gRNA
cuauuugcugccugcacgca

SEQ ID NO: 121488 - RNA, 20 nt, Artificial Sequence
  MKO10121488_B_Tm7sf2
  gRNA
cuaccaaagccuucgcauag

SEQ ID NO: 121489 - RNA, 20 nt, Artificial Sequence
  MKO10121489_B_Tm7sf2
  gRNA
agaucacacaccuugcgugc

SEQ ID NO: 121490 - RNA, 20 nt, Artificial Sequence
  MKO10121490_B_Tm7sf3
  gRNA
acucuccuucccagcacguc

SEQ ID NO: 121491 - RNA, 20 nt, Artificial Sequence
  MKO10121491_B_Tm7sf3
  gRNA
caccaagccuguccaaagcg

SEQ ID NO: 121492 - RNA, 20 nt, Artificial Sequence
  MKO10121492_B_Tm7sf3
  gRNA
uuccaugcagaucccauucc

SEQ ID NO: 121493 - RNA, 20 nt, Artificial Sequence
  MKO10121493_B_Tm9sf1
  gRNA
cagagcucgucucuucgucu

SEQ ID NO: 121494 - RNA, 20 nt, Artificial Sequence
  MKO10121494_B_Tm9sf1
  gRNA
ccccugacauguuagagcgc

SEQ ID NO: 121495 - RNA, 20 nt, Artificial Sequence
  MKO10121495_B_Tm9sf1
  gRNA
uggcgauccgugcugagcgu

SEQ ID NO: 121496 - RNA, 20 nt, Artificial Sequence
  MKO10121496_B_Tm9sf2
  gRNA
uuucguacaaacgagcuuac

SEQ ID NO: 121497 - RNA, 20 nt, Artificial Sequence
  MKO10121497_B_Tm9sf2
  gRNA
acuuacgcuguauauucaua

SEQ ID NO: 121498 - RNA, 20 nt, Artificial Sequence
  MKO10121498_B_Tm9sf2
  gRNA
cagauuccaccgaaucaagc

SEQ ID NO: 121499 - RNA, 20 nt, Artificial Sequence
  MKO10121499_B_Tm9sf3
  gRNA
accuacccuaugcugaaaaa

SEQ ID NO: 121500 - RNA, 20 nt, Artificial Sequence
  MKO10121500_B_Tm9sf3
  gRNA
ggaguugaauuagaauuuag

SEQ ID NO: 121501 - RNA, 20 nt, Artificial Sequence
  MKO10121501_B_Tm9sf3
  gRNA
uaccuuuaaauuuaaugucc

SEQ ID NO: 121502 - RNA, 20 nt, Artificial Sequence
  MKO10121502_B_Tm9sf4
  gRNA
gauugucaacaccccuuucc

SEQ ID NO: 121503 - RNA, 20 nt, Artificial Sequence
  MKO10121503_B_Tm9sf4
  gRNA
gcccaucaagauaaccuaca

SEQ ID NO: 121504 - RNA, 20 nt, Artificial Sequence
  MKO10121504_B_Tm9sf4
  gRNA
aaacgacccaguagagauca

SEQ ID NO: 121505 - RNA, 20 nt, Artificial Sequence
  MKO10121505_B_Tma16
  gRNA
uuaccuuucaacuaauucac

SEQ ID NO: 121506 - RNA, 20 nt, Artificial Sequence
  MKO10121506_B_Tma16
  gRNA
uucaagauugaagacugaga

SEQ ID NO: 121507 - RNA, 20 nt, Artificial Sequence
  MKO10121507_B_Tma16
  gRNA
gucucacaaacaagacaaga

SEQ ID NO: 121508 - RNA, 20 nt, Artificial Sequence
  MKO10121508_B_Tma7
  gRNA
acucgaagagcuaaaagcca

SEQ ID NO: 121509 - RNA, 20 nt, Artificial Sequence
  MKO10121509_B_Tma7
  gRNA
cuggaggcgccaugucgggc

SEQ ID NO: 121510 - RNA, 20 nt, Artificial Sequence
  MKO10121510_B_Tma7
  gRNA
ccugaaacagcccaagaagc

SEQ ID NO: 121511 - RNA, 20 nt, Artificial Sequence
  MKO10121511_B_Tmbim1
  gRNA
caaauacgugaggaacaaug

SEQ ID NO: 121512 - RNA, 20 nt, Artificial Sequence
  MKO10121512_B_Tmbim1
  gRNA
uguccagcugcucaucacug

SEQ ID NO: 121513 - RNA, 20 nt, Artificial Sequence
  MKO10121513_B_Tmbim1
  gRNA
ccaacacucaccuggguccc

SEQ ID NO: 121514 - RNA, 20 nt, Artificial Sequence
  MKO10121514_B_Tmbim4
  gRNA
gggcagaggucacuguaguc

SEQ ID NO: 121515 - RNA, 20 nt, Artificial Sequence
  MKO10121515_B_Tmbim4
  gRNA
caaaugcaaagaguagauag

SEQ ID NO: 121516 - RNA, 20 nt, Artificial Sequence
  MKO10121516_B_Tmbim4
  gRNA
cagagcaaacaccacaauua

SEQ ID NO: 121517 - RNA, 20 nt, Artificial Sequence
  MKO10121517_B_Tmbim6
  gRNA
agcuccggcgccgggcauac

SEQ ID NO: 121518 - RNA, 20 nt, Artificial Sequence
  MKO10121518_B_Tmbim6
  gRNA
ccgugcccaugaaggccgug

SEQ ID NO: 121519 - RNA, 20 nt, Artificial Sequence
  MKO10121519_B_Tmbim6
  gRNA
agcaggggccuauguccaug

SEQ ID NO: 121520 - RNA, 20 nt, Artificial Sequence
  MKO10121520_B_Tmbim7
  gRNA
gaauguaguuugcgggcacu

SEQ ID NO: 121521 - RNA, 20 nt, Artificial Sequence
  MKO10121521_B_Tmbim7
  gRNA
guucauacagcagccauuaa

SEQ ID NO: 121522 - RNA, 20 nt, Artificial Sequence
  MKO10121522_B_Tmbim7
  gRNA
auagcgaaccuguaagaaag

SEQ ID NO: 121523 - RNA, 20 nt, Artificial Sequence
  MKO10121523_B_Tmc1
  gRNA
cuacugucaaauguaaaccu

SEQ ID NO: 121524 - RNA, 20 nt, Artificial Sequence
  MKO10121524_B_Tmc1
  gRNA
aaauuugugagugagaauga

SEQ ID NO: 121525 - RNA, 20 nt, Artificial Sequence
  MKO10121525_B_Tmc1
  gRNA
auuuaagaugaugauggcca

SEQ ID NO: 121526 - RNA, 20 nt, Artificial Sequence
  MKO10121526_B_Tmc2
  gRNA
agaagcucaucacuaccgug

SEQ ID NO: 121527 - RNA, 20 nt, Artificial Sequence
  MKO10121527_B_Tmc2
  gRNA
ucaagacucaauguauuccc

SEQ ID NO: 121528 - RNA, 20 nt, Artificial Sequence
  MKO10121528_B_Tmc2
  gRNA
cagggaagcccaagccuuug

SEQ ID NO: 121529 - RNA, 20 nt, Artificial Sequence
  MKO10121529_B_Tmc3
  gRNA
caaauauccgcugcagaccc

SEQ ID NO: 121530 - RNA, 20 nt, Artificial Sequence
  MKO10121530_B_Tmc3
  gRNA
uaaucccaaauagccaccuc

SEQ ID NO: 121531 - RNA, 20 nt, Artificial Sequence
  MKO10121531_B_Tmc3
  gRNA
ggcagaaacugcgggcacug

SEQ ID NO: 121532 - RNA, 20 nt, Artificial Sequence
  MKO10121532_B_Tmc4
  gRNA
acuugcugugcauccuacga

SEQ ID NO: 121533 - RNA, 20 nt, Artificial Sequence
  MKO10121533_B_Tmc4
  gRNA
gcgaccaggccaugagugug

SEQ ID NO: 121534 - RNA, 20 nt, Artificial Sequence
  MKO10121534_B_Tmc4
  gRNA
ggaaagcugucggguccagu

SEQ ID NO: 121535 - RNA, 20 nt, Artificial Sequence
  MKO10121535_B_Tmc5
  gRNA
cuccaaccuagacuuaccgc

SEQ ID NO: 121536 - RNA, 20 nt, Artificial Sequence
  MKO10121536_B_Tmc5
  gRNA
gauucugucucuaguuguca

SEQ ID NO: 121537 - RNA, 20 nt, Artificial Sequence
  MKO10121537_B_Tmc5
  gRNA
caacugcugugcucaguguc

SEQ ID NO: 121538 - RNA, 20 nt, Artificial Sequence
  MKO10121538_B_Tmc6
  gRNA
gauuuccaaggucgcagccg

SEQ ID NO: 121539 - RNA, 20 nt, Artificial Sequence
  MKO10121539_B_Tmc6
  gRNA
ccucgaugucccggagacca

SEQ ID NO: 121540 - RNA, 20 nt, Artificial Sequence
  MKO10121540_B_Tmc6
  gRNA
aauacuacaaccgcacagug

SEQ ID NO: 121541 - RNA, 20 nt, Artificial Sequence
  MKO10121541_B_Tmc7
  gRNA
ugcugcuguaccguuuccac

SEQ ID NO: 121542 - RNA, 20 nt, Artificial Sequence
  MKO10121542_B_Tmc7
  gRNA
gaugagcacaaaagugcugu

SEQ ID NO: 121543 - RNA, 20 nt, Artificial Sequence
  MKO10121543_B_Tmc7
  gRNA
uacaucauagaccugcuguc

SEQ ID NO: 121544 - RNA, 20 nt, Artificial Sequence
  MKO10121544_B_Tmc8
  gRNA
gcagagcaacggcuggcccg

SEQ ID NO: 121545 - RNA, 20 nt, Artificial Sequence
  MKO10121545_B_Tmc8
  gRNA
uggcagacaagcgcuucauc

SEQ ID NO: 121546 - RNA, 20 nt, Artificial Sequence
  MKO10121546_B_Tmc8
  gRNA
cccguuaaaauauuccaaag

SEQ ID NO: 121547 - RNA, 20 nt, Artificial Sequence
  MKO10121547_B_Tmcc1
  gRNA
aaaauguuagaucgagcguu

SEQ ID NO: 121548 - RNA, 20 nt, Artificial Sequence
  MKO10121548_B_Tmcc1
  gRNA
uuaccaccgaaagcuccgug

SEQ ID NO: 121549 - RNA, 20 nt, Artificial Sequence
  MKO10121549_B_Tmcc1
  gRNA
cuuucuuagaugugagcgac

SEQ ID NO: 121550 - RNA, 20 nt, Artificial Sequence
  MKO10121550_B_Tmcc2
  gRNA
accggacccccagcgaacua

SEQ ID NO: 121551 - RNA, 20 nt, Artificial Sequence
  MKO10121551_B_Tmcc2
  gRNA
uccggaggcgcgucuucaug

SEQ ID NO: 121552 - RNA, 20 nt, Artificial Sequence
  MKO10121552_B_Tmcc2
  gRNA
caguccucaccugcuucgua

SEQ ID NO: 121553 - RNA, 20 nt, Artificial Sequence
  MKO10121553_B_Tmcc3
  gRNA
aucccccucggcguauguuc

SEQ ID NO: 121554 - RNA, 20 nt, Artificial Sequence
  MKO10121554_B_Tmcc3
  gRNA
gugagcgccgugucgcugcc

SEQ ID NO: 121555 - RNA, 20 nt, Artificial Sequence
  MKO10121555_B_Tmcc3
  gRNA
gaugucccuugagcgcucau

SEQ ID NO: 121556 - RNA, 20 nt, Artificial Sequence
  MKO10121556_B_Tmco1
  gRNA
caacaauagagaccugucaa

SEQ ID NO: 121557 - RNA, 20 nt, Artificial Sequence
  MKO10121557_B_Tmco1
  gRNA
auuugucuguccuguaaacc

SEQ ID NO: 121558 - RNA, 20 nt, Artificial Sequence
  MKO10121558_B_Tmco1
  gRNA
cgacaacagaagaagaagau

SEQ ID NO: 121559 - RNA, 20 nt, Artificial Sequence
  MKO10121559_B_Tmco2
  gRNA
ugcgccucagccaacaaacu

SEQ ID NO: 121560 - RNA, 20 nt, Artificial Sequence
  MKO10121560_B_Tmco2
  gRNA
gagcagucccgcuucgaagc

SEQ ID NO: 121561 - RNA, 20 nt, Artificial Sequence
  MKO10121561_B_Tmco2
  gRNA
ucucuugcagacccaacgac

SEQ ID NO: 121562 - RNA, 20 nt, Artificial Sequence
  MKO10121562_B_Tmco3
  gRNA
auaggucugccuacgauguu

SEQ ID NO: 121563 - RNA, 20 nt, Artificial Sequence
  MKO10121563_B_Tmco3
  gRNA
cgcagaccaccacuucauaa

SEQ ID NO: 121564 - RNA, 20 nt, Artificial Sequence
  MKO10121564_B_Tmco3
  gRNA
uauaauuuguggcgugcuuc

SEQ ID NO: 121565 - RNA, 20 nt, Artificial Sequence
  MKO10121565_B_Tmco4
  gRNA
gggaggucacaugacaaacg

SEQ ID NO: 121566 - RNA, 20 nt, Artificial Sequence
  MKO10121566_B_Tmco4
  gRNA
cgucacaaauucugugcaga

SEQ ID NO: 121567 - RNA, 20 nt, Artificial Sequence
  MKO10121567_B_Tmco4
  gRNA
uugaaggacacuaugaugcc

SEQ ID NO: 121568 - RNA, 20 nt, Artificial Sequence
  MKO10121568_B_Tmco5b
  gRNA
ccugaacucagaccuugaaa

SEQ ID NO: 121569 - RNA, 20 nt, Artificial Sequence
  MKO10121569_B_Tmco5b
  gRNA
gacccuaagcaagaauguga

SEQ ID NO: 121570 - RNA, 20 nt, Artificial Sequence
  MKO10121570_B_Tmco5b
  gRNA
agaaagaagaaucuauacaa

SEQ ID NO: 121571 - RNA, 20 nt, Artificial Sequence
  MKO10121571_B_Tmco5
  gRNA
gaacaugagaucacccagac

SEQ ID NO: 121572 - RNA, 20 nt, Artificial Sequence
  MKO10121572_B_Tmco5
  gRNA
ucccacuccucgucuucugc

SEQ ID NO: 121573 - RNA, 20 nt, Artificial Sequence
  MKO10121573_B_Tmco5
  gRNA
aacaaccccagaagagucca

SEQ ID NO: 121574 - RNA, 20 nt, Artificial Sequence
  MKO10121574_B_Tmco6
  gRNA
agccgccucaagcugcaaca

SEQ ID NO: 121575 - RNA, 20 nt, Artificial Sequence
  MKO10121575_B_Tmco6
  gRNA
gaagacgccccggaagaagu

SEQ ID NO: 121576 - RNA, 20 nt, Artificial Sequence
  MKO10121576_B_Tmco6
  gRNA
uguugcagcuugaggcggcu

SEQ ID NO: 121577 - RNA, 20 nt, Artificial Sequence
  MKO10121577_B_Tmed10
  gRNA
ucauuacucuaucaacuucu

SEQ ID NO: 121578 - RNA, 20 nt, Artificial Sequence
  MKO10121578_B_Tmed10
  gRNA
gaggagaugagggacacuaa

SEQ ID NO: 121579 - RNA, 20 nt, Artificial Sequence
  MKO10121579_B_Tmed10
  gRNA
aaacaugucauagucuuccg

SEQ ID NO: 121580 - RNA, 20 nt, Artificial Sequence
  MKO10121580_B_Tmed11
  gRNA
gucacaaacauuccuaagcc

SEQ ID NO: 121581 - RNA, 20 nt, Artificial Sequence
  MKO10121581_B_Tmed11
  gRNA
uccuugugcaccauauaacu

SEQ ID NO: 121582 - RNA, 20 nt, Artificial Sequence
  MKO10121582_B_Tmed11
  gRNA
gacuuccuugaaucugcucc

SEQ ID NO: 121583 - RNA, 20 nt, Artificial Sequence
  MKO10121583_B_Tmed1
  gRNA
accagaaguugacccgcucc

SEQ ID NO: 121584 - RNA, 20 nt, Artificial Sequence
  MKO10121584_B_Tmed1
  gRNA
gagcccucagggugugcugu

SEQ ID NO: 121585 - RNA, 20 nt, Artificial Sequence
  MKO10121585_B_Tmed1
  gRNA
gcuggacguggacuucaccu

SEQ ID NO: 121586 - RNA, 20 nt, Artificial Sequence
  MKO10121586_B_Tmed2
  gRNA
aucacaggaccagauaauaa

SEQ ID NO: 121587 - RNA, 20 nt, Artificial Sequence
  MKO10121587_B_Tmed2
  gRNA
uggcucuguguauucucucc

SEQ ID NO: 121588 - RNA, 20 nt, Artificial Sequence
  MKO10121588_B_Tmed2
  gRNA
agaagaaaugauuaaugagc

SEQ ID NO: 121589 - RNA, 20 nt, Artificial Sequence
  MKO10121589_B_Tmed3
  gRNA
gcagggcgugaaguucucuc

SEQ ID NO: 121590 - RNA, 20 nt, Artificial Sequence
  MKO10121590_B_Tmed3
  gRNA
augaagcgugcggagccucg

SEQ ID NO: 121591 - RNA, 20 nt, Artificial Sequence
  MKO10121591_B_Tmed3
  gRNA
ccaggggcaacgucaucuac

SEQ ID NO: 121592 - RNA, 20 nt, Artificial Sequence
  MKO10121592_B_Tmed4
  gRNA
uggggguuuaccuugccguc

SEQ ID NO: 121593 - RNA, 20 nt, Artificial Sequence
  MKO10121593_B_Tmed4
  gRNA
gaggauaacggucugggcga

SEQ ID NO: 121594 - RNA, 20 nt, Artificial Sequence
  MKO10121594_B_Tmed4
  gRNA
uccagcgaagagagccauuc

SEQ ID NO: 121595 - RNA, 20 nt, Artificial Sequence
  MKO10121595_B_Tmed5
  gRNA
ugugguuaacuugaugguca

SEQ ID NO: 121596 - RNA, 20 nt, Artificial Sequence
  MKO10121596_B_Tmed5
  gRNA
uauuacuaauacagaugucc

SEQ ID NO: 121597 - RNA, 20 nt, Artificial Sequence
  MKO10121597_B_Tmed5
  gRNA
cucuaaguagaguuuguaug

SEQ ID NO: 121598 - RNA, 20 nt, Artificial Sequence
  MKO10121598_B_Tmed6
  gRNA
gcaccucguagcugaaguag

SEQ ID NO: 121599 - RNA, 20 nt, Artificial Sequence
  MKO10121599_B_Tmed6
  gRNA
agucuucuaugaggggcccg

SEQ ID NO: 121600 - RNA, 20 nt, Artificial Sequence
  MKO10121600_B_Tmed6
  gRNA
acccugcgggguaugugccg

SEQ ID NO: 121601 - RNA, 20 nt, Artificial Sequence
  MKO10121601_B_Tmed7
  gRNA
agccgccgcucggagccggc

SEQ ID NO: 121602 - RNA, 20 nt, Artificial Sequence
  MKO10121602_B_Tmed7
  gRNA
gggcagcucgaaggugaucu

SEQ ID NO: 121603 - RNA, 20 nt, Artificial Sequence
  MKO10121603_B_Tmed7
  gRNA
aaacuuguacgucccauuuc

SEQ ID NO: 121604 - RNA, 20 nt, Artificial Sequence
  MKO10121604_B_Tmed8
  gRNA
acagccgucugguagugaag

SEQ ID NO: 121605 - RNA, 20 nt, Artificial Sequence
  MKO10121605_B_Tmed8
  gRNA
ccaagcuccacagcgaccug

SEQ ID NO: 121606 - RNA, 20 nt, Artificial Sequence
  MKO10121606_B_Tmed8
  gRNA
caccaacgucagcucuccac

SEQ ID NO: 121607 - RNA, 20 nt, Artificial Sequence
  MKO10121607_B_Tmed9
  gRNA
aucuauaggucauccuggcc

SEQ ID NO: 121608 - RNA, 20 nt, Artificial Sequence
  MKO10121608_B_Tmed9
  gRNA
ggccagcuuaccuuguccuc

SEQ ID NO: 121609 - RNA, 20 nt, Artificial Sequence
  MKO10121609_B_Tmed9
  gRNA
guuugucauacagcugcguc

SEQ ID NO: 121610 - RNA, 20 nt, Artificial Sequence
  MKO10121610_B_Tmeff1
  gRNA
guacaaggccgagugugacg

SEQ ID NO: 121611 - RNA, 20 nt, Artificial Sequence
  MKO10121611_B_Tmeff1
  gRNA
guacuugcacgguccacacu

SEQ ID NO: 121612 - RNA, 20 nt, Artificial Sequence
  MKO10121612_B_Tmeff1
  gRNA
uccccguuugacccacagac

SEQ ID NO: 121613 - RNA, 20 nt, Artificial Sequence
  MKO10121613_B_Tmeff2
  gRNA
gccucagguagcacucauuc

SEQ ID NO: 121614 - RNA, 20 nt, Artificial Sequence
  MKO10121614_B_Tmeff2
  gRNA
cccacaguccaugaaggcuc

SEQ ID NO: 121615 - RNA, 20 nt, Artificial Sequence
  MKO10121615_B_Tmeff2
  gRNA
accugugacauuugccaguu

SEQ ID NO: 121616 - RNA, 20 nt, Artificial Sequence
  MKO10121616_B_Tmem100
  gRNA
ggggaugaugcagcgguagc

SEQ ID NO: 121617 - RNA, 20 nt, Artificial Sequence
  MKO10121617_B_Tmem100
  gRNA
cugcaucauccccuuugccg

SEQ ID NO: 121618 - RNA, 20 nt, Artificial Sequence
  MKO10121618_B_Tmem100
  gRNA
cacgggacccuuggucagcg

SEQ ID NO: 121619 - RNA, 20 nt, Artificial Sequence
  MKO10121619_B_Tmem101
  gRNA
gcuauguccacuacggggac

SEQ ID NO: 121620 - RNA, 20 nt, Artificial Sequence
  MKO10121620_B_Tmem101
  gRNA
ccaacgccgcuucacuccga

SEQ ID NO: 121621 - RNA, 20 nt, Artificial Sequence
  MKO10121621_B_Tmem101
  gRNA
ugcucacgcgcugccccuuu

SEQ ID NO: 121622 - RNA, 20 nt, Artificial Sequence
  MKO10121622_B_Tmem102
  gRNA
gaagcauggcuuccaccguc

SEQ ID NO: 121623 - RNA, 20 nt, Artificial Sequence
  MKO10121623_B_Tmem102
  gRNA
ugcucuacugggcgugcgag

SEQ ID NO: 121624 - RNA, 20 nt, Artificial Sequence
  MKO10121624_B_Tmem102
  gRNA
guucaugcagcucgucacgc

SEQ ID NO: 121625 - RNA, 20 nt, Artificial Sequence
  MKO10121625_B_Tmem104
  gRNA
ugugacaaccaccuuugcga

SEQ ID NO: 121626 - RNA, 20 nt, Artificial Sequence
  MKO10121626_B_Tmem104
  gRNA
cugcccucucguaguugucu

SEQ ID NO: 121627 - RNA, 20 nt, Artificial Sequence
  MKO10121627_B_Tmem104
  gRNA
cagccaaugcccagcuccgc

SEQ ID NO: 121628 - RNA, 20 nt, Artificial Sequence
  MKO10121628_B_Tmem106a
  gRNA
ucaucccuuauggagaccaa

SEQ ID NO: 121629 - RNA, 20 nt, Artificial Sequence
  MKO10121629_B_Tmem106a
  gRNA
agcagccuccgccugcacau

SEQ ID NO: 121630 - RNA, 20 nt, Artificial Sequence
  MKO10121630_B_Tmem106a
  gRNA
guuaccugcucacuggccaa

SEQ ID NO: 121631 - RNA, 20 nt, Artificial Sequence
  MKO10121631_B_Tmem106b
  gRNA
uucagcgucguagcugacau

SEQ ID NO: 121632 - RNA, 20 nt, Artificial Sequence
  MKO10121632_B_Tmem106b
  gRNA
cuuaccugcuucauaucaag

SEQ ID NO: 121633 - RNA, 20 nt, Artificial Sequence
  MKO10121633_B_Tmem106b
  gRNA
ugauuccauauagugaucag

SEQ ID NO: 121634 - RNA, 20 nt, Artificial Sequence
  MKO10121634_B_Tmem106c
  gRNA
uucaucuuaccgugacauca

SEQ ID NO: 121635 - RNA, 20 nt, Artificial Sequence
  MKO10121635_B_Tmem106c
  gRNA
ugaucccccacagugaccag

SEQ ID NO: 121636 - RNA, 20 nt, Artificial Sequence
  MKO10121636_B_Tmem106c
  gRNA
ccuuacuacacauaggaaga

SEQ ID NO: 121637 - RNA, 20 nt, Artificial Sequence
  MKO10121637_B_Tmem107
  gRNA
agccgcgcucugucucaccc

SEQ ID NO: 121638 - RNA, 20 nt, Artificial Sequence
  MKO10121638_B_Tmem107
  gRNA
ugguugucaucacguuguuc

SEQ ID NO: 121639 - RNA, 20 nt, Artificial Sequence
  MKO10121639_B_Tmem107
  gRNA
ucgccaggaaagcaacaucc

SEQ ID NO: 121640 - RNA, 20 nt, Artificial Sequence
  MKO10121640_B_Tmem108
  gRNA
ggacuacuucaacagacacg

SEQ ID NO: 121641 - RNA, 20 nt, Artificial Sequence
  MKO10121641_B_Tmem108
  gRNA
cgacuaucgagacacuggga

SEQ ID NO: 121642 - RNA, 20 nt, Artificial Sequence
  MKO10121642_B_Tmem108
  gRNA
ucaugcagcacacugucaac

SEQ ID NO: 121643 - RNA, 20 nt, Artificial Sequence
  MKO10121643_B_Tmem109
  gRNA
gcuacucaccauccagcccc

SEQ ID NO: 121644 - RNA, 20 nt, Artificial Sequence
  MKO10121644_B_Tmem109
  gRNA
acugggcagcaaucccagac

SEQ ID NO: 121645 - RNA, 20 nt, Artificial Sequence
  MKO10121645_B_Tmem109
  gRNA
ggacgaggaaaagggccacg

SEQ ID NO: 121646 - RNA, 20 nt, Artificial Sequence
  MKO10121646_B_Tmem110
  gRNA
agaucaugaucacgauguag

SEQ ID NO: 121647 - RNA, 20 nt, Artificial Sequence
  MKO10121647_B_Tmem110
  gRNA
caugaucuuugaaaaguccg

SEQ ID NO: 121648 - RNA, 20 nt, Artificial Sequence
  MKO10121648_B_Tmem110
  gRNA
gacacuuccaaacaagccau

SEQ ID NO: 121649 - RNA, 20 nt, Artificial Sequence
  MKO10121649_B_Tmem115
  gRNA
gaagaagcuuccacgccccc

SEQ ID NO: 121650 - RNA, 20 nt, Artificial Sequence
  MKO10121650_B_Tmem115
  gRNA
cuucugcgcuccgcaucuug

SEQ ID NO: 121651 - RNA, 20 nt, Artificial Sequence
  MKO10121651_B_Tmem115
  gRNA
cuguucacuauucguaucca

SEQ ID NO: 121652 - RNA, 20 nt, Artificial Sequence
  MKO10121652_B_Tmem116
  gRNA
gcgagugcguuucuucccag

SEQ ID NO: 121653 - RNA, 20 nt, Artificial Sequence
  MKO10121653_B_Tmem116
  gRNA
auucauugacauugcccaaa

SEQ ID NO: 121654 - RNA, 20 nt, Artificial Sequence
  MKO10121654_B_Tmem116
  gRNA
ugugcugcagacagauguau

SEQ ID NO: 121655 - RNA, 20 nt, Artificial Sequence
  MKO10121655_B_Tmem117
  gRNA
ggaaauccgcaagagcuuuc

SEQ ID NO: 121656 - RNA, 20 nt, Artificial Sequence
  MKO10121656_B_Tmem117
  gRNA
auauuucaggccaguugcuc

SEQ ID NO: 121657 - RNA, 20 nt, Artificial Sequence
  MKO10121657_B_Tmem117
  gRNA
uuucaugaaacuagcugcug

SEQ ID NO: 121658 - RNA, 20 nt, Artificial Sequence
  MKO10121658_B_Tmem119
  gRNA
uccccgagccugccgccgcc

SEQ ID NO: 121659 - RNA, 20 nt, Artificial Sequence
  MKO10121659_B_Tmem119
  gRNA
caucacgcgccagaagcaca

SEQ ID NO: 121660 - RNA, 20 nt, Artificial Sequence
  MKO10121660_B_Tmem119
  gRNA
gggcucuagcuggagaccgg

SEQ ID NO: 121661 - RNA, 20 nt, Artificial Sequence
  MKO10121661_B_Tmem11
  gRNA
cagacgccuccuuccccacg

SEQ ID NO: 121662 - RNA, 20 nt, Artificial Sequence
  MKO10121662_B_Tmem11
  gRNA
uacucacauuccaacacuca

SEQ ID NO: 121663 - RNA, 20 nt, Artificial Sequence
  MKO10121663_B_Tmem11
  gRNA
gugcugucucgucuccaauu

SEQ ID NO: 121664 - RNA, 20 nt, Artificial Sequence
  MKO10121664_B_Tmem120a
  gRNA
acccucaccuggaguugagc

SEQ ID NO: 121665 - RNA, 20 nt, Artificial Sequence
  MKO10121665_B_Tmem120a
  gRNA
cgugacacuucugagcaagc

SEQ ID NO: 121666 - RNA, 20 nt, Artificial Sequence
  MKO10121666_B_Tmem120a
  gRNA
ccucuagcuugaggcgauac

SEQ ID NO: 121667 - RNA, 20 nt, Artificial Sequence
  MKO10121667_B_Tmem120b
  gRNA
cgugacccuccucagcaauc

SEQ ID NO: 121668 - RNA, 20 nt, Artificial Sequence
  MKO10121668_B_Tmem120b
  gRNA
aggugcugcacagcgucugc

SEQ ID NO: 121669 - RNA, 20 nt, Artificial Sequence
  MKO10121669_B_Tmem120b
  gRNA
ucauggcagguuugcuuaca

SEQ ID NO: 121670 - RNA, 20 nt, Artificial Sequence
  MKO10121670_B_Tmem121
  gRNA
gcgcaccuuccgaaagcgcg

SEQ ID NO: 121671 - RNA, 20 nt, Artificial Sequence
  MKO10121671_B_Tmem121
  gRNA
ccacgugugccugaccacgc

SEQ ID NO: 121672 - RNA, 20 nt, Artificial Sequence
  MKO10121672_B_Tmem121
  gRNA
cucugggagccgccacgcac

SEQ ID NO: 121673 - RNA, 20 nt, Artificial Sequence
  MKO10121673_B_Tmem123
  gRNA
uauaccaccaacaaagcugc

SEQ ID NO: 121674 - RNA, 20 nt, Artificial Sequence
  MKO10121674_B_Tmem123
  gRNA
uuuaccuguuauguuaauau

SEQ ID NO: 121675 - RNA, 20 nt, Artificial Sequence
  MKO10121675_B_Tmem123
  gRNA
accuccaauauuaacauaac

SEQ ID NO: 121676 - RNA, 20 nt, Artificial Sequence
  MKO10121676_B_Tmem125
  gRNA
uccuccaccagcagccgauc

SEQ ID NO: 121677 - RNA, 20 nt, Artificial Sequence
  MKO10121677_B_Tmem125
  gRNA
agaugcuacuguuaucaccg

SEQ ID NO: 121678 - RNA, 20 nt, Artificial Sequence
  MKO10121678_B_Tmem125
  gRNA
uggagguggucucaugacgc

SEQ ID NO: 121679 - RNA, 20 nt, Artificial Sequence
  MKO10121679_B_Tmem126a
  gRNA
uaaacuuacaagacuuuggu

SEQ ID NO: 121680 - RNA, 20 nt, Artificial Sequence
  MKO10121680_B_Tmem126a
  gRNA
gaaauagacuguuugcuauu

SEQ ID NO: 121681 - RNA, 20 nt, Artificial Sequence
  MKO10121681_B_Tmem126a
  gRNA
acuguguuugcauccuaucu

SEQ ID NO: 121682 - RNA, 20 nt, Artificial Sequence
  MKO10121682_B_Tmem126b
  gRNA
guaacagaugcuuugcaauc

SEQ ID NO: 121683 - RNA, 20 nt, Artificial Sequence
  MKO10121683_B_Tmem126b
  gRNA
ggagucuuugguuaaucauc

SEQ ID NO: 121684 - RNA, 20 nt, Artificial Sequence
  MKO10121684_B_Tmem126b
  gRNA
ggaacaaguaguaguuuguc

SEQ ID NO: 121685 - RNA, 20 nt, Artificial Sequence
  MKO10121685_B_Tmem127
  gRNA
cggcuggcauuaggguguau

SEQ ID NO: 121686 - RNA, 20 nt, Artificial Sequence
  MKO10121686_B_Tmem127
  gRNA
cgacgaguaaucuucagagc

SEQ ID NO: 121687 - RNA, 20 nt, Artificial Sequence
  MKO10121687_B_Tmem127
  gRNA
cccggcagcccggcaccucc

SEQ ID NO: 121688 - RNA, 20 nt, Artificial Sequence
  MKO10121688_B_Tmem128
  gRNA
cacaacugcaacuuucauug

SEQ ID NO: 121689 - RNA, 20 nt, Artificial Sequence
  MKO10121689_B_Tmem128
  gRNA
gugauguucaucucacuccu

SEQ ID NO: 121690 - RNA, 20 nt, Artificial Sequence
  MKO10121690_B_Tmem128
  gRNA
caucauauucuucaauccca

SEQ ID NO: 121691 - RNA, 20 nt, Artificial Sequence
  MKO10121691_B_Tmem129
  gRNA
gcagcuucuuacuauacgug

SEQ ID NO: 121692 - RNA, 20 nt, Artificial Sequence
  MKO10121692_B_Tmem129
  gRNA
gaccuucacguuggccuacc

SEQ ID NO: 121693 - RNA, 20 nt, Artificial Sequence
  MKO10121693_B_Tmem129
  gRNA
cugcacuucggauuggggcg

SEQ ID NO: 121694 - RNA, 20 nt, Artificial Sequence
  MKO10121694_B_Tmem130
  gRNA
gcggacuugaagaagucgcu

SEQ ID NO: 121695 - RNA, 20 nt, Artificial Sequence
  MKO10121695_B_Tmem130
  gRNA
gaguaguuguaauacaccac

SEQ ID NO: 121696 - RNA, 20 nt, Artificial Sequence
  MKO10121696_B_Tmem130
  gRNA
uguaggaguucggccaagac

SEQ ID NO: 121697 - RNA, 20 nt, Artificial Sequence
  MKO10121697_B_Tmem131
  gRNA
gaaguccugcgcuuugacga

SEQ ID NO: 121698 - RNA, 20 nt, Artificial Sequence
  MKO10121698_B_Tmem131
  gRNA
gccaguuggaaugccaaaaa

SEQ ID NO: 121699 - RNA, 20 nt, Artificial Sequence
  MKO10121699_B_Tmem131
  gRNA
ucgguucauaucaacagaaa

SEQ ID NO: 121700 - RNA, 20 nt, Artificial Sequence
  MKO10121700_B_Tmem132a
  gRNA
aaacagcccgcacaucccaa

SEQ ID NO: 121701 - RNA, 20 nt, Artificial Sequence
  MKO10121701_B_Tmem132a
  gRNA
cuccagcguguaggccaguu

SEQ ID NO: 121702 - RNA, 20 nt, Artificial Sequence
  MKO10121702_B_Tmem132a
  gRNA
ccaccgagccugccgcuucc

SEQ ID NO: 121703 - RNA, 20 nt, Artificial Sequence
  MKO10121703_B_Tmem132b
  gRNA
ggugacccucgaugacaaug

SEQ ID NO: 121704 - RNA, 20 nt, Artificial Sequence
  MKO10121704_B_Tmem132b
  gRNA
cugccgauccuuucccgagc

SEQ ID NO: 121705 - RNA, 20 nt, Artificial Sequence
  MKO10121705_B_Tmem132b
  gRNA
caucagccagacgaccuuug

SEQ ID NO: 121706 - RNA, 20 nt, Artificial Sequence
  MKO10121706_B_Tmem132c
  gRNA
acucaccuauuucgugcccc

SEQ ID NO: 121707 - RNA, 20 nt, Artificial Sequence
  MKO10121707_B_Tmem132c
  gRNA
cuccgacacagcaauguccg

SEQ ID NO: 121708 - RNA, 20 nt, Artificial Sequence
  MKO10121708_B_Tmem132c
  gRNA
ccgugcagaccagcgagccu

SEQ ID NO: 121709 - RNA, 20 nt, Artificial Sequence
  MKO10121709_B_Tmem132d
  gRNA
acguggcagguugaauaccc

SEQ ID NO: 121710 - RNA, 20 nt, Artificial Sequence
  MKO10121710_B_Tmem132d
  gRNA
agucaugaagauugauaucg

SEQ ID NO: 121711 - RNA, 20 nt, Artificial Sequence
  MKO10121711_B_Tmem132d
  gRNA
uuucuucugacaaacgauga

SEQ ID NO: 121712 - RNA, 20 nt, Artificial Sequence
  MKO10121712_B_Tmem132e
  gRNA
augcugccgaugcgcagcag

SEQ ID NO: 121713 - RNA, 20 nt, Artificial Sequence
  MKO10121713_B_Tmem132e
  gRNA
uuaggcaccaagucucgaag

SEQ ID NO: 121714 - RNA, 20 nt, Artificial Sequence
  MKO10121714_B_Tmem132e
  gRNA
ccacaugauccuccgcuuca

SEQ ID NO: 121715 - RNA, 20 nt, Artificial Sequence
  MKO10121715_B_Tmem134
  gRNA
cguucaccugguagcguagc

SEQ ID NO: 121716 - RNA, 20 nt, Artificial Sequence
  MKO10121716_B_Tmem134
  gRNA
ugucuguccgcagcucgcag

SEQ ID NO: 121717 - RNA, 20 nt, Artificial Sequence
  MKO10121717_B_Tmem134
  gRNA
cuggugcugacucccccauc

SEQ ID NO: 121718 - RNA, 20 nt, Artificial Sequence
  MKO10121718_B_Tmem135
  gRNA
aauacuccagcuugcgcuuc

SEQ ID NO: 121719 - RNA, 20 nt, Artificial Sequence
  MKO10121719_B_Tmem135
  gRNA
ugcucugccagccucauaug

SEQ ID NO: 121720 - RNA, 20 nt, Artificial Sequence
  MKO10121720_B_Tmem135
  gRNA
aaauucuacucauggacucc

SEQ ID NO: 121721 - RNA, 20 nt, Artificial Sequence
  MKO10121721_B_Tmem136
  gRNA
uaccuaccuggguggguaaa

SEQ ID NO: 121722 - RNA, 20 nt, Artificial Sequence
  MKO10121722_B_Tmem136
  gRNA
ugcaucuauuuccaguccga

SEQ ID NO: 121723 - RNA, 20 nt, Artificial Sequence
  MKO10121723_B_Tmem136
  gRNA
cccccgugaaacugugauag

SEQ ID NO: 121724 - RNA, 20 nt, Artificial Sequence
  MKO10121724_B_Tmem138
  gRNA
aggaguucaugcaaguccga

SEQ ID NO: 121725 - RNA, 20 nt, Artificial Sequence
  MKO10121725_B_Tmem138
  gRNA
cauucggaguagcucugaga

SEQ ID NO: 121726 - RNA, 20 nt, Artificial Sequence
  MKO10121726_B_Tmem138
  gRNA
ucagcaucucccuacauguc

SEQ ID NO: 121727 - RNA, 20 nt, Artificial Sequence
  MKO10121727_B_Tmem139
  gRNA
acuuagggguccacgaguug

SEQ ID NO: 121728 - RNA, 20 nt, Artificial Sequence
  MKO10121728_B_Tmem139
  gRNA
cuaagucgaagaauucuucc

SEQ ID NO: 121729 - RNA, 20 nt, Artificial Sequence
  MKO10121729_B_Tmem139
  gRNA
gauauuaugauacugcugua

SEQ ID NO: 121730 - RNA, 20 nt, Artificial Sequence
  MKO10121730_B_Tmem140
  gRNA
acagaauggaggaugccgcc

SEQ ID NO: 121731 - RNA, 20 nt, Artificial Sequence
  MKO10121731_B_Tmem140
  gRNA
gugguuguuccgccacagcc

SEQ ID NO: 121732 - RNA, 20 nt, Artificial Sequence
  MKO10121732_B_Tmem140
  gRNA
auguuacaacuuucccgagc

SEQ ID NO: 121733 - RNA, 20 nt, Artificial Sequence
  MKO10121733_B_Tmem141
  gRNA
gcaggcacuggugcgacuuu

SEQ ID NO: 121734 - RNA, 20 nt, Artificial Sequence
  MKO10121734_B_Tmem141
  gRNA
gucagaaaugcagcaaucuc

SEQ ID NO: 121735 - RNA, 20 nt, Artificial Sequence
  MKO10121735_B_Tmem141
  gRNA
uccucuuaaugaacaucagc

SEQ ID NO: 121736 - RNA, 20 nt, Artificial Sequence
  MKO10121736_B_Tmem143
  gRNA
caagguccgacuaugguccc

SEQ ID NO: 121737 - RNA, 20 nt, Artificial Sequence
  MKO10121737_B_Tmem143
  gRNA
cuuucugaagaagccacgcu

SEQ ID NO: 121738 - RNA, 20 nt, Artificial Sequence
  MKO10121738_B_Tmem143
  gRNA
uccaaagcugcucucuccgc

SEQ ID NO: 121739 - RNA, 20 nt, Artificial Sequence
  MKO10121739_B_Tmem144
  gRNA
cagccgccaagcaucgcaaa

SEQ ID NO: 121740 - RNA, 20 nt, Artificial Sequence
  MKO10121740_B_Tmem144
  gRNA
uguuaaaugauccccagauu

SEQ ID NO: 121741 - RNA, 20 nt, Artificial Sequence
  MKO10121741_B_Tmem144
  gRNA
uccgagcugccuggguuauu

SEQ ID NO: 121742 - RNA, 20 nt, Artificial Sequence
  MKO10121742_B_Tmem145
  gRNA
uggccugaucaccgacuccu

SEQ ID NO: 121743 - RNA, 20 nt, Artificial Sequence
  MKO10121743_B_Tmem145
  gRNA
uccguucugugcgugaaaga

SEQ ID NO: 121744 - RNA, 20 nt, Artificial Sequence
  MKO10121744_B_Tmem145
  gRNA
uauaucgcacucagcaagug

SEQ ID NO: 121745 - RNA, 20 nt, Artificial Sequence
  MKO10121745_B_Tmem147
  gRNA
cccgaggcauugaauuugac

SEQ ID NO: 121746 - RNA, 20 nt, Artificial Sequence
  MKO10121746_B_Tmem147
  gRNA
cugcugaacucauuaugucc

SEQ ID NO: 121747 - RNA, 20 nt, Artificial Sequence
  MKO10121747_B_Tmem147
  gRNA
acugcauaccagacugaugu

SEQ ID NO: 121748 - RNA, 20 nt, Artificial Sequence
  MKO10121748_B_Tmem14a
  gRNA
ggaguuccaucucugauugc

SEQ ID NO: 121749 - RNA, 20 nt, Artificial Sequence
  MKO10121749_B_Tmem14a
  gRNA
uaaugggugugagauuuaag

SEQ ID NO: 121750 - RNA, 20 nt, Artificial Sequence
  MKO10121750_B_Tmem14a
  gRNA
uccuuaccaauggaccugau

SEQ ID NO: 121751 - RNA, 20 nt, Artificial Sequence
  MKO10121751_B_Tmem14c
  gRNA
cccagguagugugccguccc

SEQ ID NO: 121752 - RNA, 20 nt, Artificial Sequence
  MKO10121752_B_Tmem14c
  gRNA
gcuccugcgauuaacccugc

SEQ ID NO: 121753 - RNA, 20 nt, Artificial Sequence
  MKO10121753_B_Tmem14c
  gRNA
auuauuggcuaugccaaagc

SEQ ID NO: 121754 - RNA, 20 nt, Artificial Sequence
  MKO10121754_B_Tmem150a
  gRNA
cguaccgaaggaggcagaug

SEQ ID NO: 121755 - RNA, 20 nt, Artificial Sequence
  MKO10121755_B_Tmem150a
  gRNA
gcuccauaccaguucuccac

SEQ ID NO: 121756 - RNA, 20 nt, Artificial Sequence
  MKO10121756_B_Tmem150a
  gRNA
cagcacccauguugccaaug

SEQ ID NO: 121757 - RNA, 20 nt, Artificial Sequence
  MKO10121757_B_Tmem150b
  gRNA
uuagagcagcuccuauauug

SEQ ID NO: 121758 - RNA, 20 nt, Artificial Sequence
  MKO10121758_B_Tmem150b
  gRNA
gccauaacaaccugauaaaa

SEQ ID NO: 121759 - RNA, 20 nt, Artificial Sequence
  MKO10121759_B_Tmem150b
  gRNA
gcccacagaaauaagaugac

SEQ ID NO: 121760 - RNA, 20 nt, Artificial Sequence
  MKO10121760_B_Tmem150c
  gRNA
cgaagcaugcuccauacauc

SEQ ID NO: 121761 - RNA, 20 nt, Artificial Sequence
  MKO10121761_B_Tmem150c
  gRNA
guucagucaaguaaugaaca

SEQ ID NO: 121762 - RNA, 20 nt, Artificial Sequence
  MKO10121762_B_Tmem150c
  gRNA
ugacugaacacacagcucgc

SEQ ID NO: 121763 - RNA, 20 nt, Artificial Sequence
  MKO10121763_B_Tmem151a
  gRNA
gcgagagaguggugguccgc

SEQ ID NO: 121764 - RNA, 20 nt, Artificial Sequence
  MKO10121764_B_Tmem151a
  gRNA
ugcgacuguccgcccucuca

SEQ ID NO: 121765 - RNA, 20 nt, Artificial Sequence
  MKO10121765_B_Tmem151a
  gRNA
aggccucguaccucacgcag

SEQ ID NO: 121766 - RNA, 20 nt, Artificial Sequence
  MKO10121766_B_Tmem151b
  gRNA
cgacagacgcgucugcuccg

SEQ ID NO: 121767 - RNA, 20 nt, Artificial Sequence
  MKO10121767_B_Tmem151b
  gRNA
gcccucguccgccgaugcca

SEQ ID NO: 121768 - RNA, 20 nt, Artificial Sequence
  MKO10121768_B_Tmem151b
  gRNA
cucuacgccauguccccccc

SEQ ID NO: 121769 - RNA, 20 nt, Artificial Sequence
  MKO10121769_B_Tmem154
  gRNA
cuuugagauccuuggcuaga

SEQ ID NO: 121770 - RNA, 20 nt, Artificial Sequence
  MKO10121770_B_Tmem154
  gRNA
caucucuauuuccauaacag

SEQ ID NO: 121771 - RNA, 20 nt, Artificial Sequence
  MKO10121771_B_Tmem154
  gRNA
ucucuuucagaugaacuugg

SEQ ID NO: 121772 - RNA, 20 nt, Artificial Sequence
  MKO10121772_B_Tmem158
  gRNA
ugcaaggccgggcgcauccg

SEQ ID NO: 121773 - RNA, 20 nt, Artificial Sequence
  MKO10121773_B_Tmem158
  gRNA
gcaagaccugcgccugugcg

SEQ ID NO: 121774 - RNA, 20 nt, Artificial Sequence
  MKO10121774_B_Tmem158
  gRNA
cucuucucuaccaacgcgca

SEQ ID NO: 121775 - RNA, 20 nt, Artificial Sequence
  MKO10121775_B_Tmem159
  gRNA
ucucaugggggccauauuau

SEQ ID NO: 121776 - RNA, 20 nt, Artificial Sequence
  MKO10121776_B_Tmem159
  gRNA
ugccaacgucgacugucagc

SEQ ID NO: 121777 - RNA, 20 nt, Artificial Sequence
  MKO10121777_B_Tmem159
  gRNA
uccccgacaaggcaagugac

SEQ ID NO: 121778 - RNA, 20 nt, Artificial Sequence
  MKO10121778_B_Tmem160
  gRNA
cgcugccagacccaccgcau

SEQ ID NO: 121779 - RNA, 20 nt, Artificial Sequence
  MKO10121779_B_Tmem160
  gRNA
cgaaauggacuucugucauc

SEQ ID NO: 121780 - RNA, 20 nt, Artificial Sequence
  MKO10121780_B_Tmem160
  gRNA
gaaggagaugaccccaaugc

SEQ ID NO: 121781 - RNA, 20 nt, Artificial Sequence
  MKO10121781_B_Tmem161a
  gRNA
aggaacuucgggcgcuguca

SEQ ID NO: 121782 - RNA, 20 nt, Artificial Sequence
  MKO10121782_B_Tmem161a
  gRNA
gcagagcagccagcgugcga

SEQ ID NO: 121783 - RNA, 20 nt, Artificial Sequence
  MKO10121783_B_Tmem161a
  gRNA
cacacuguuccuucgcacgc

SEQ ID NO: 121784 - RNA, 20 nt, Artificial Sequence
  MKO10121784_B_Tmem161b
  gRNA
ccgugaaguccaccagccac

SEQ ID NO: 121785 - RNA, 20 nt, Artificial Sequence
  MKO10121785_B_Tmem161b
  gRNA
cauugucuauuuaguaacug

SEQ ID NO: 121786 - RNA, 20 nt, Artificial Sequence
  MKO10121786_B_Tmem161b
  gRNA
guccacuucuguaacagacu

SEQ ID NO: 121787 - RNA, 20 nt, Artificial Sequence
  MKO10121787_B_Tmem163
  gRNA
ggugacaauaauggacagcc

SEQ ID NO: 121788 - RNA, 20 nt, Artificial Sequence
  MKO10121788_B_Tmem163
  gRNA
cagggagcagccuaguugag

SEQ ID NO: 121789 - RNA, 20 nt, Artificial Sequence
  MKO10121789_B_Tmem163
  gRNA
ccauccaugaccucucaacu

SEQ ID NO: 121790 - RNA, 20 nt, Artificial Sequence
  MKO10121790_B_Tmem164
  gRNA
uuaccaggccgaggaucugc

SEQ ID NO: 121791 - RNA, 20 nt, Artificial Sequence
  MKO10121791_B_Tmem164
  gRNA
ccagcaugcuaugcucuacg

SEQ ID NO: 121792 - RNA, 20 nt, Artificial Sequence
  MKO10121792_B_Tmem164
  gRNA
ccacguagagcauagcaugc

SEQ ID NO: 121793 - RNA, 20 nt, Artificial Sequence
  MKO10121793_B_Tmem165
  gRNA
caaaagaucucuguccgaac

SEQ ID NO: 121794 - RNA, 20 nt, Artificial Sequence
  MKO10121794_B_Tmem165
  gRNA
cauuuaagaguuugguucgu

SEQ ID NO: 121795 - RNA, 20 nt, Artificial Sequence
  MKO10121795_B_Tmem165
  gRNA
augccacaacagucaucccc

SEQ ID NO: 121796 - RNA, 20 nt, Artificial Sequence
  MKO10121796_B_Tmem167b
  gRNA
ugcaauugccugcauuguaa

SEQ ID NO: 121797 - RNA, 20 nt, Artificial Sequence
  MKO10121797_B_Tmem167b
  gRNA
uugcaacagcagcaugcagc

SEQ ID NO: 121798 - RNA, 20 nt, Artificial Sequence
  MKO10121798_B_Tmem167b
  gRNA
cuuugugacaguguacuccu

SEQ ID NO: 121799 - RNA, 20 nt, Artificial Sequence
  MKO10121799_B_Tmem167
  gRNA
uccaaagcuacuguaugaag

SEQ ID NO: 121800 - RNA, 20 nt, Artificial Sequence
  MKO10121800_B_Tmem167
  gRNA
cgccauaugcuguauaguga

SEQ ID NO: 121801 - RNA, 20 nt, Artificial Sequence
  MKO10121801_B_Tmem167
  gRNA
auccuggacagaaauaaaac

SEQ ID NO: 121802 - RNA, 20 nt, Artificial Sequence
  MKO10121802_B_Tmem168
  gRNA
uuaguaaaguaggccgaugg

SEQ ID NO: 121803 - RNA, 20 nt, Artificial Sequence
  MKO10121803_B_Tmem168
  gRNA
gcuuccgccagaacauguac

SEQ ID NO: 121804 - RNA, 20 nt, Artificial Sequence
  MKO10121804_B_Tmem168
  gRNA
ugcuuagggggaaccucugu

SEQ ID NO: 121805 - RNA, 20 nt, Artificial Sequence
  MKO10121805_B_Tmem169
  gRNA
ccgucuucucauuaucugac

SEQ ID NO: 121806 - RNA, 20 nt, Artificial Sequence
  MKO10121806_B_Tmem169
  gRNA
agcucgccaccacgcugccc

SEQ ID NO: 121807 - RNA, 20 nt, Artificial Sequence
  MKO10121807_B_Tmem169
  gRNA
cugguccgccccgaccuggc

SEQ ID NO: 121808 - RNA, 20 nt, Artificial Sequence
  MKO10121808_B_Tmem170b
  gRNA
ccggcaucuacagaguggcu

SEQ ID NO: 121809 - RNA, 20 nt, Artificial Sequence
  MKO10121809_B_Tmem170b
  gRNA
ucagcacgccugcagcaccg

SEQ ID NO: 121810 - RNA, 20 nt, Artificial Sequence
  MKO10121810_B_Tmem170b
  gRNA
cauggccccgcuggaagccc

SEQ ID NO: 121811 - RNA, 20 nt, Artificial Sequence
  MKO10121811_B_Tmem170
  gRNA
agggucccguugcccacccg

SEQ ID NO: 121812 - RNA, 20 nt, Artificial Sequence
  MKO10121812_B_Tmem170
  gRNA
acaugaaccuaccauauuug

SEQ ID NO: 121813 - RNA, 20 nt, Artificial Sequence
  MKO10121813_B_Tmem170
  gRNA
acccucagacaccacaaaua

SEQ ID NO: 121814 - RNA, 20 nt, Artificial Sequence
  MKO10121814_B_Tmem171
  gRNA
gcugucgcucccguagaugc

SEQ ID NO: 121815 - RNA, 20 nt, Artificial Sequence
  MKO10121815_B_Tmem171
  gRNA
uccaguguaugaucucuccg

SEQ ID NO: 121816 - RNA, 20 nt, Artificial Sequence
  MKO10121816_B_Tmem171
  gRNA
aggcuguuagccccagggga

SEQ ID NO: 121817 - RNA, 20 nt, Artificial Sequence
  MKO10121817_B_Tmem173
  gRNA
guacccaauguaguaugacc

SEQ ID NO: 121818 - RNA, 20 nt, Artificial Sequence
  MKO10121818_B_Tmem173
  gRNA
gcaugcuuagggacuuauag

SEQ ID NO: 121819 - RNA, 20 nt, Artificial Sequence
  MKO10121819_B_Tmem173
  gRNA
uguuggggucaacuacacuc

SEQ ID NO: 121820 - RNA, 20 nt, Artificial Sequence
  MKO10121820_B_Tmem174
  gRNA
uuucucuccuccaccguaug

SEQ ID NO: 121821 - RNA, 20 nt, Artificial Sequence
  MKO10121821_B_Tmem174
  gRNA
ccggacucggaccagacuuc

SEQ ID NO: 121822 - RNA, 20 nt, Artificial Sequence
  MKO10121822_B_Tmem174
  gRNA
gcacagcaguaaucgcccag

SEQ ID NO: 121823 - RNA, 20 nt, Artificial Sequence
  MKO10121823_B_Tmem175
  gRNA
uuuagauuguuccagguugu

SEQ ID NO: 121824 - RNA, 20 nt, Artificial Sequence
  MKO10121824_B_Tmem175
  gRNA
cacagagaucucaccagaac

SEQ ID NO: 121825 - RNA, 20 nt, Artificial Sequence
  MKO10121825_B_Tmem175
  gRNA
guucuggugagaucucugug

SEQ ID NO: 121826 - RNA, 20 nt, Artificial Sequence
  MKO10121826_B_Tmem176a
  gRNA
gcucuaccuaggcccugaug

SEQ ID NO: 121827 - RNA, 20 nt, Artificial Sequence
  MKO10121827_B_Tmem176a
  gRNA
ccccuucuggacugggaucg

SEQ ID NO: 121828 - RNA, 20 nt, Artificial Sequence
  MKO10121828_B_Tmem176a
  gRNA
gagccuccaagcuaugcucu

SEQ ID NO: 121829 - RNA, 20 nt, Artificial Sequence
  MKO10121829_B_Tmem176b
  gRNA
guacuauuguccaugagaag

SEQ ID NO: 121830 - RNA, 20 nt, Artificial Sequence
  MKO10121830_B_Tmem176b
  gRNA
ugcuuucuggucggggucug

SEQ ID NO: 121831 - RNA, 20 nt, Artificial Sequence
  MKO10121831_B_Tmem176b
  gRNA
cuaagucuccgaaguaugua

SEQ ID NO: 121832 - RNA, 20 nt, Artificial Sequence
  MKO10121832_B_Tmem177
  gRNA
cuuagcccuacgcagucuuu

SEQ ID NO: 121833 - RNA, 20 nt, Artificial Sequence
  MKO10121833_B_Tmem177
  gRNA
ugaaaagugaaggcgguaaa

SEQ ID NO: 121834 - RNA, 20 nt, Artificial Sequence
  MKO10121834_B_Tmem177
  gRNA
cuggauucucagaagcggcc

SEQ ID NO: 121835 - RNA, 20 nt, Artificial Sequence
  MKO10121835_B_Tmem178b
  gRNA
gaugguccauguucugugca

SEQ ID NO: 121836 - RNA, 20 nt, Artificial Sequence
  MKO10121836_B_Tmem178b
  gRNA
aggggacuuacccuuguauu

SEQ ID NO: 121837 - RNA, 20 nt, Artificial Sequence
  MKO10121837_B_Tmem178b
  gRNA
aaaagauggagggguuucuu

SEQ ID NO: 121838 - RNA, 20 nt, Artificial Sequence
  MKO10121838_B_Tmem178
  gRNA
guccggccacgugcuggguc

SEQ ID NO: 121839 - RNA, 20 nt, Artificial Sequence
  MKO10121839_B_Tmem178
  gRNA
ggacuccuauuccucaugac

SEQ ID NO: 121840 - RNA, 20 nt, Artificial Sequence
  MKO10121840_B_Tmem178
  gRNA
uguaaauuagcuucgggacc

SEQ ID NO: 121841 - RNA, 20 nt, Artificial Sequence
  MKO10121841_B_Tmem179b
  gRNA
uaacugucccuuguauggug

SEQ ID NO: 121842 - RNA, 20 nt, Artificial Sequence
  MKO10121842_B_Tmem179b
  gRNA
uaaacuugcacugcauggcc

SEQ ID NO: 121843 - RNA, 20 nt, Artificial Sequence
  MKO10121843_B_Tmem179b
  gRNA
guauucuucaggagugagac

SEQ ID NO: 121844 - RNA, 20 nt, Artificial Sequence
  MKO10121844_B_Tmem179
  gRNA
ccaucaguuugcuaucgccc

SEQ ID NO: 121845 - RNA, 20 nt, Artificial Sequence
  MKO10121845_B_Tmem179
  gRNA
gcccacacucacgauggugc

SEQ ID NO: 121846 - RNA, 20 nt, Artificial Sequence
  MKO10121846_B_Tmem179
  gRNA
ucagcuccaaguccguuucc

SEQ ID NO: 121847 - RNA, 20 nt, Artificial Sequence
  MKO10121847_B_Tmem17
  gRNA
ucgcuucaaucaagguuaug

SEQ ID NO: 121848 - RNA, 20 nt, Artificial Sequence
  MKO10121848_B_Tmem17
  gRNA
gguggaaacgggcugccagc

SEQ ID NO: 121849 - RNA, 20 nt, Artificial Sequence
  MKO10121849_B_Tmem17
  gRNA
aagacagcugaucaaagucc

SEQ ID NO: 121850 - RNA, 20 nt, Artificial Sequence
  MKO10121850_B_Tmem180
  gRNA
uuugguggcgugccaguugc

SEQ ID NO: 121851 - RNA, 20 nt, Artificial Sequence
  MKO10121851_B_Tmem180
  gRNA
gaucacugagccagccgaag

SEQ ID NO: 121852 - RNA, 20 nt, Artificial Sequence
  MKO10121852_B_Tmem180
  gRNA
gcacuacucacccaacagga

SEQ ID NO: 121853 - RNA, 20 nt, Artificial Sequence
  MKO10121853_B_Tmem181a
  gRNA
cuauugagugaauaauuagc

SEQ ID NO: 121854 - RNA, 20 nt, Artificial Sequence
  MKO10121854_B_Tmem181a
  gRNA
uucacucaauaguagcaaaa

SEQ ID NO: 121855 - RNA, 20 nt, Artificial Sequence
  MKO10121855_B_Tmem181a
  gRNA
ccacauauaaccaacaacua

SEQ ID NO: 121856 - RNA, 20 nt, Artificial Sequence
  MKO10121856_B_Tmem182
  gRNA
ugacauacaguaucaccacc

SEQ ID NO: 121857 - RNA, 20 nt, Artificial Sequence
  MKO10121857_B_Tmem182
  gRNA
uucuaguuuaccguggcuuc

SEQ ID NO: 121858 - RNA, 20 nt, Artificial Sequence
  MKO10121858_B_Tmem182
  gRNA
ggaggcucauacauugccuc

SEQ ID NO: 121859 - RNA, 20 nt, Artificial Sequence
  MKO10121859_B_Tmem183a
  gRNA
accuuccugcugaauagcgu

SEQ ID NO: 121860 - RNA, 20 nt, Artificial Sequence
  MKO10121860_B_Tmem183a
  gRNA
cuaugccaacucggauccgg

SEQ ID NO: 121861 - RNA, 20 nt, Artificial Sequence
  MKO10121861_B_Tmem183a
  gRNA
gcggcugcgaccagaaucca

SEQ ID NO: 121862 - RNA, 20 nt, Artificial Sequence
  MKO10121862_B_Tmem184a
  gRNA
gcguuucaggcguguuugua

SEQ ID NO: 121863 - RNA, 20 nt, Artificial Sequence
  MKO10121863_B_Tmem184a
  gRNA
guucuuacgcuucugcaaac

SEQ ID NO: 121864 - RNA, 20 nt, Artificial Sequence
  MKO10121864_B_Tmem184a
  gRNA
cgcucucgccccccagauau

SEQ ID NO: 121865 - RNA, 20 nt, Artificial Sequence
  MKO10121865_B_Tmem184b
  gRNA
gcacgugccguacauacagc

SEQ ID NO: 121866 - RNA, 20 nt, Artificial Sequence
  MKO10121866_B_Tmem184b
  gRNA
acaccuguuuacagaaccgc

SEQ ID NO: 121867 - RNA, 20 nt, Artificial Sequence
  MKO10121867_B_Tmem184b
  gRNA
gguacucauagcacaagcuc

SEQ ID NO: 121868 - RNA, 20 nt, Artificial Sequence
  MKO10121868_B_Tmem184c
  gRNA
uaaccauacccgugucauug

SEQ ID NO: 121869 - RNA, 20 nt, Artificial Sequence
  MKO10121869_B_Tmem184c
  gRNA
cuacucuuucguugcaagcu

SEQ ID NO: 121870 - RNA, 20 nt, Artificial Sequence
  MKO10121870_B_Tmem184c
  gRNA
uuuccauaggauccuaugga

SEQ ID NO: 121871 - RNA, 20 nt, Artificial Sequence
  MKO10121871_B_Tmem185b
  gRNA
cgccgcguugcgugcggagu

SEQ ID NO: 121872 - RNA, 20 nt, Artificial Sequence
  MKO10121872_B_Tmem185b
  gRNA
uugagauacuagucugcgac

SEQ ID NO: 121873 - RNA, 20 nt, Artificial Sequence
  MKO10121873_B_Tmem185b
  gRNA
auccgacuccgcacgcaacg

SEQ ID NO: 121874 - RNA, 20 nt, Artificial Sequence
  MKO10121874_B_Tmem186
  gRNA
ugcccgacucguucacauac

SEQ ID NO: 121875 - RNA, 20 nt, Artificial Sequence
  MKO10121875_B_Tmem186
  gRNA
uuccgagccauccgagcaau

SEQ ID NO: 121876 - RNA, 20 nt, Artificial Sequence
  MKO10121876_B_Tmem186
  gRNA
cucggaaccgguagauugua

SEQ ID NO: 121877 - RNA, 20 nt, Artificial Sequence
  MKO10121877_B_Tmem189
  gRNA
ugcccaccuaggccuucauc

SEQ ID NO: 121878 - RNA, 20 nt, Artificial Sequence
  MKO10121878_B_Tmem189
  gRNA
gcgccacgugguggaugcga

SEQ ID NO: 121879 - RNA, 20 nt, Artificial Sequence
  MKO10121879_B_Tmem189
  gRNA
acaccaucgcauccaccacg

SEQ ID NO: 121880 - RNA, 20 nt, Artificial Sequence
  MKO10121880_B_Tmem18
  gRNA
cuucaacgccaugcucauug

SEQ ID NO: 121881 - RNA, 20 nt, Artificial Sequence
  MKO10121881_B_Tmem18
  gRNA
aguaccaguacuuugacucc

SEQ ID NO: 121882 - RNA, 20 nt, Artificial Sequence
  MKO10121882_B_Tmem18
  gRNA
cuguagcuuauaccucugug

SEQ ID NO: 121883 - RNA, 20 nt, Artificial Sequence
  MKO10121883_B_Tmem190
  gRNA
agcaccgcaggcguaggcag

SEQ ID NO: 121884 - RNA, 20 nt, Artificial Sequence
  MKO10121884_B_Tmem190
  gRNA
caggaagaguaggcugccac

SEQ ID NO: 121885 - RNA, 20 nt, Artificial Sequence
  MKO10121885_B_Tmem190
  gRNA
cacagaugcgaauggaaucc

SEQ ID NO: 121886 - RNA, 20 nt, Artificial Sequence
  MKO10121886_B_Tmem191c
  gRNA
guucgcaggagcaacacaau

SEQ ID NO: 121887 - RNA, 20 nt, Artificial Sequence
  MKO10121887_B_Tmem191c
  gRNA
gcagcuaagucaacagcgag

SEQ ID NO: 121888 - RNA, 20 nt, Artificial Sequence
  MKO10121888_B_Tmem191c
  gRNA
cucugccugcaugcugaauu

SEQ ID NO: 121889 - RNA, 20 nt, Artificial Sequence
  MKO10121889_B_Tmem192
  gRNA
agcaauacugccucagagac

SEQ ID NO: 121890 - RNA, 20 nt, Artificial Sequence
  MKO10121890_B_Tmem192
  gRNA
cuuggauauccuacaaagua

SEQ ID NO: 121891 - RNA, 20 nt, Artificial Sequence
  MKO10121891_B_Tmem192
  gRNA
uuauuucagugaagauuagg

SEQ ID NO: 121892 - RNA, 20 nt, Artificial Sequence
  MKO10121892_B_Tmem194b
  gRNA
ccggaagaguaauagaaaac

SEQ ID NO: 121893 - RNA, 20 nt, Artificial Sequence
  MKO10121893_B_Tmem194b
  gRNA
auauauguggucaacugugc

SEQ ID NO: 121894 - RNA, 20 nt, Artificial Sequence
  MKO10121894_B_Tmem194b
  gRNA
aggucuuugcauacaagaaa

SEQ ID NO: 121895 - RNA, 20 nt, Artificial Sequence
  MKO10121895_B_Tmem194
  gRNA
gaaugacaccuauguuaacg

SEQ ID NO: 121896 - RNA, 20 nt, Artificial Sequence
  MKO10121896_B_Tmem194
  gRNA
agcuagagcaguuuaguauc

SEQ ID NO: 121897 - RNA, 20 nt, Artificial Sequence
  MKO10121897_B_Tmem194
  gRNA
gccuaaagcugauguaaaug

SEQ ID NO: 121898 - RNA, 20 nt, Artificial Sequence
  MKO10121898_B_Tmem196
  gRNA
cuuccauuaaacaucaguug

SEQ ID NO: 121899 - RNA, 20 nt, Artificial Sequence
  MKO10121899_B_Tmem196
  gRNA
cauccuccuuugcucauagc

SEQ ID NO: 121900 - RNA, 20 nt, Artificial Sequence
  MKO10121900_B_Tmem196
  gRNA
cugugcgccaaaaaaaaguc

SEQ ID NO: 121901 - RNA, 20 nt, Artificial Sequence
  MKO10121901_B_Tmem198b
  gRNA
gcucauacucucgaagacuc

SEQ ID NO: 121902 - RNA, 20 nt, Artificial Sequence
  MKO10121902_B_Tmem198b
  gRNA
accagcuuacccccaauauc

SEQ ID NO: 121903 - RNA, 20 nt, Artificial Sequence
  MKO10121903_B_Tmem198b
  gRNA
gagucuucgagaguaugagc

SEQ ID NO: 121904 - RNA, 20 nt, Artificial Sequence
  MKO10121904_B_Tmem198
  gRNA
acuuagccugaugggcgucc

SEQ ID NO: 121905 - RNA, 20 nt, Artificial Sequence
  MKO10121905_B_Tmem198
  gRNA
aucuccauugaagcguuuga

SEQ ID NO: 121906 - RNA, 20 nt, Artificial Sequence
  MKO10121906_B_Tmem198
  gRNA
cugacccugcuuauagacgc

SEQ ID NO: 121907 - RNA, 20 nt, Artificial Sequence
  MKO10121907_B_Tmem199
  gRNA
gccuuugucugcacuuaccu

SEQ ID NO: 121908 - RNA, 20 nt, Artificial Sequence
  MKO10121908_B_Tmem199
  gRNA
aguagaugucacugccuucu

SEQ ID NO: 121909 - RNA, 20 nt, Artificial Sequence
  MKO10121909_B_Tmem199
  gRNA
uccuagguaagugcagacaa

SEQ ID NO: 121910 - RNA, 20 nt, Artificial Sequence
  MKO10121910_B_Tmem19
  gRNA
acuuucggccuguuucuccg

SEQ ID NO: 121911 - RNA, 20 nt, Artificial Sequence
  MKO10121911_B_Tmem19
  gRNA
cggcgccauuacagaacacc

SEQ ID NO: 121912 - RNA, 20 nt, Artificial Sequence
  MKO10121912_B_Tmem19
  gRNA
uuugucucucuuggcugcgc

SEQ ID NO: 121913 - RNA, 20 nt, Artificial Sequence
  MKO10121913_B_Tmem200a
  gRNA
ugcuguugcuccgauccaac

SEQ ID NO: 121914 - RNA, 20 nt, Artificial Sequence
  MKO10121914_B_Tmem200a
  gRNA
ccgaaccacuugggucucau

SEQ ID NO: 121915 - RNA, 20 nt, Artificial Sequence
  MKO10121915_B_Tmem200a
  gRNA
ggaugacgacacaaucgauu

SEQ ID NO: 121916 - RNA, 20 nt, Artificial Sequence
  MKO10121916_B_Tmem200b
  gRNA
cgagggccgcguuucgcgcc

SEQ ID NO: 121917 - RNA, 20 nt, Artificial Sequence
  MKO10121917_B_Tmem200b
  gRNA
acgaccgcgcgaugacggcc

SEQ ID NO: 121918 - RNA, 20 nt, Artificial Sequence
  MKO10121918_B_Tmem200b
  gRNA
gcugcggcugcguucgccgu

SEQ ID NO: 121919 - RNA, 20 nt, Artificial Sequence
  MKO10121919_B_Tmem200c
  gRNA
gaagaagcccaccgacgugg

SEQ ID NO: 121920 - RNA, 20 nt, Artificial Sequence
  MKO10121920_B_Tmem200c
  gRNA
gacgguggagcccgauaguc

SEQ ID NO: 121921 - RNA, 20 nt, Artificial Sequence
  MKO10121921_B_Tmem200c
  gRNA
aggacucgccccgcguccgg

SEQ ID NO: 121922 - RNA, 20 nt, Artificial Sequence
  MKO10121922_B_Tmem201
  gRNA
cgcugcucaccacgugguuc

SEQ ID NO: 121923 - RNA, 20 nt, Artificial Sequence
  MKO10121923_B_Tmem201
  gRNA
ccuaugggaaucgcaacugu

SEQ ID NO: 121924 - RNA, 20 nt, Artificial Sequence
  MKO10121924_B_Tmem201
  gRNA
ugcuuucacaccacgggagg

SEQ ID NO: 121925 - RNA, 20 nt, Artificial Sequence
  MKO10121925_B_Tmem202
  gRNA
uccgcgcugacacccucauc

SEQ ID NO: 121926 - RNA, 20 nt, Artificial Sequence
  MKO10121926_B_Tmem202
  gRNA
cggaucuauggcagaagucc

SEQ ID NO: 121927 - RNA, 20 nt, Artificial Sequence
  MKO10121927_B_Tmem202
  gRNA
auucaaccugcgccagaaac

SEQ ID NO: 121928 - RNA, 20 nt, Artificial Sequence
  MKO10121928_B_Tmem203
  gRNA
cacucgcagugccaacagua

SEQ ID NO: 121929 - RNA, 20 nt, Artificial Sequence
  MKO10121929_B_Tmem203
  gRNA
gcgaguggauggcuugacuc

SEQ ID NO: 121930 - RNA, 20 nt, Artificial Sequence
  MKO10121930_B_Tmem203
  gRNA
gggcacaaagacguuccacc

SEQ ID NO: 121931 - RNA, 20 nt, Artificial Sequence
  MKO10121931_B_Tmem204
  gRNA
agaugagcauugcagccgcc

SEQ ID NO: 121932 - RNA, 20 nt, Artificial Sequence
  MKO10121932_B_Tmem204
  gRNA
gugccaugcaguccucccuc

SEQ ID NO: 121933 - RNA, 20 nt, Artificial Sequence
  MKO10121933_B_Tmem204
  gRNA
gucagaucaccuucauccuu

SEQ ID NO: 121934 - RNA, 20 nt, Artificial Sequence
  MKO10121934_B_Tmem205
  gRNA
agccucccgcggcacacauu

SEQ ID NO: 121935 - RNA, 20 nt, Artificial Sequence
  MKO10121935_B_Tmem205
  gRNA
gauuaaagucauccacuugc

SEQ ID NO: 121936 - RNA, 20 nt, Artificial Sequence
  MKO10121936_B_Tmem205
  gRNA
agggucccuaccugagauaa

SEQ ID NO: 121937 - RNA, 20 nt, Artificial Sequence
  MKO10121937_B_Tmem206
  gRNA
ccgugauggucugguagacc

SEQ ID NO: 121938 - RNA, 20 nt, Artificial Sequence
  MKO10121938_B_Tmem206
  gRNA
ggugguugagaacucggagc

SEQ ID NO: 121939 - RNA, 20 nt, Artificial Sequence
  MKO10121939_B_Tmem206
  gRNA
ugcaguuccugucucccggc

SEQ ID NO: 121940 - RNA, 20 nt, Artificial Sequence
  MKO10121940_B_Tmem207
  gRNA
uaccagauauaccagccauc

SEQ ID NO: 121941 - RNA, 20 nt, Artificial Sequence
  MKO10121941_B_Tmem207
  gRNA
uguguuucagcgagugcucu

SEQ ID NO: 121942 - RNA, 20 nt, Artificial Sequence
  MKO10121942_B_Tmem207
  gRNA
agaaaagcacuacuccacaa

SEQ ID NO: 121943 - RNA, 20 nt, Artificial Sequence
  MKO10121943_B_Tmem208
  gRNA
ucaguaggaucacauccuua

SEQ ID NO: 121944 - RNA, 20 nt, Artificial Sequence
  MKO10121944_B_Tmem208
  gRNA
cccacguaccagaagccaga

SEQ ID NO: 121945 - RNA, 20 nt, Artificial Sequence
  MKO10121945_B_Tmem208
  gRNA
caucuacugccuuguaaccu

SEQ ID NO: 121946 - RNA, 20 nt, Artificial Sequence
  MKO10121946_B_Tmem209
  gRNA
gacgacaggccuugcaguug

SEQ ID NO: 121947 - RNA, 20 nt, Artificial Sequence
  MKO10121947_B_Tmem209
  gRNA
uaccagacuuguuggugcua

SEQ ID NO: 121948 - RNA, 20 nt, Artificial Sequence
  MKO10121948_B_Tmem209
  gRNA
gggacuccuaaauguaucca

SEQ ID NO: 121949 - RNA, 20 nt, Artificial Sequence
  MKO10121949_B_Tmem210
  gRNA
cguauccaugaugccguccu

SEQ ID NO: 121950 - RNA, 20 nt, Artificial Sequence
  MKO10121950_B_Tmem210
  gRNA
ccccucagugacacgugccc

SEQ ID NO: 121951 - RNA, 20 nt, Artificial Sequence
  MKO10121951_B_Tmem210
  gRNA
gacagacauaucaggccaag

SEQ ID NO: 121952 - RNA, 20 nt, Artificial Sequence
  MKO10121952_B_Tmem211
  gRNA
aaccagcagaccuacaagca

SEQ ID NO: 121953 - RNA, 20 nt, Artificial Sequence
  MKO10121953_B_Tmem211
  gRNA
guagguaaagauaccauaag

SEQ ID NO: 121954 - RNA, 20 nt, Artificial Sequence
  MKO10121954_B_Tmem211
  gRNA
ucagccucaucucccccgcc

SEQ ID NO: 121955 - RNA, 20 nt, Artificial Sequence
  MKO10121955_B_Tmem212
  gRNA
uaccaaagccccguuccaga

SEQ ID NO: 121956 - RNA, 20 nt, Artificial Sequence
  MKO10121956_B_Tmem212
  gRNA
uuguauuuaccaagugucuc

SEQ ID NO: 121957 - RNA, 20 nt, Artificial Sequence
  MKO10121957_B_Tmem212
  gRNA
caaauuuauuguggauucuc

SEQ ID NO: 121958 - RNA, 20 nt, Artificial Sequence
  MKO10121958_B_Tmem213
  gRNA
ugcagcaacauggcccaguc

SEQ ID NO: 121959 - RNA, 20 nt, Artificial Sequence
  MKO10121959_B_Tmem213
  gRNA
acuuacuggcacacugcucc

SEQ ID NO: 121960 - RNA, 20 nt, Artificial Sequence
  MKO10121960_B_Tmem213
  gRNA
ggucuggguggugugcacuc

SEQ ID NO: 121961 - RNA, 20 nt, Artificial Sequence
  MKO10121961_B_Tmem214
  gRNA
gagcuuguaguugagauagc

SEQ ID NO: 121962 - RNA, 20 nt, Artificial Sequence
  MKO10121962_B_Tmem214
  gRNA
ccgcuuucagugcguccucc

SEQ ID NO: 121963 - RNA, 20 nt, Artificial Sequence
  MKO10121963_B_Tmem214
  gRNA
acaagcacucuuuaugagcg

SEQ ID NO: 121964 - RNA, 20 nt, Artificial Sequence
  MKO10121964_B_Tmem215
  gRNA
agcaaacgaugauacugucc

SEQ ID NO: 121965 - RNA, 20 nt, Artificial Sequence
  MKO10121965_B_Tmem215
  gRNA
ucgccgccauugcucuggcc

SEQ ID NO: 121966 - RNA, 20 nt, Artificial Sequence
  MKO10121966_B_Tmem215
  gRNA
guagcaacaguaucugucau

SEQ ID NO: 121967 - RNA, 20 nt, Artificial Sequence
  MKO10121967_B_Tmem216
  gRNA
uaggaagccaucauagcgga

SEQ ID NO: 121968 - RNA, 20 nt, Artificial Sequence
  MKO10121968_B_Tmem216
  gRNA
ucaaggccacacuaaugcca

SEQ ID NO: 121969 - RNA, 20 nt, Artificial Sequence
  MKO10121969_B_Tmem216
  gRNA
gcugcuugagaugcucacgc

SEQ ID NO: 121970 - RNA, 20 nt, Artificial Sequence
  MKO10121970_B_Tmem217
  gRNA
auaaucuuugauuuccgccg

SEQ ID NO: 121971 - RNA, 20 nt, Artificial Sequence
  MKO10121971_B_Tmem217
  gRNA
cccuggucagagccaugcga

SEQ ID NO: 121972 - RNA, 20 nt, Artificial Sequence
  MKO10121972_B_Tmem217
  gRNA
cagggccacacugaacucgu

SEQ ID NO: 121973 - RNA, 20 nt, Artificial Sequence
  MKO10121973_B_Tmem218
  gRNA
guccccuaggauggcuggca

SEQ ID NO: 121974 - RNA, 20 nt, Artificial Sequence
  MKO10121974_B_Tmem218
  gRNA
gacauagcggccgaugaaaa

SEQ ID NO: 121975 - RNA, 20 nt, Artificial Sequence
  MKO10121975_B_Tmem218
  gRNA
gcuucuuacucaucauuugc

SEQ ID NO: 121976 - RNA, 20 nt, Artificial Sequence
  MKO10121976_B_Tmem219
  gRNA
gcuacggaggccaguugugu

SEQ ID NO: 121977 - RNA, 20 nt, Artificial Sequence
  MKO10121977_B_Tmem219
  gRNA
acuuacugaaguaaggagcu

SEQ ID NO: 121978 - RNA, 20 nt, Artificial Sequence
  MKO10121978_B_Tmem219
  gRNA
aguccuuccugacgccacuc

SEQ ID NO: 121979 - RNA, 20 nt, Artificial Sequence
  MKO10121979_B_Tmem220
  gRNA
acaagcaggguaagcacugc

SEQ ID NO: 121980 - RNA, 20 nt, Artificial Sequence
  MKO10121980_B_Tmem220
  gRNA
ggagcucuuacugucaugcc

SEQ ID NO: 121981 - RNA, 20 nt, Artificial Sequence
  MKO10121981_B_Tmem220
  gRNA
gcagugcuuacccugcuugu

SEQ ID NO: 121982 - RNA, 20 nt, Artificial Sequence
  MKO10121982_B_Tmem221
  gRNA
ccugcugcuguucgagaucg

SEQ ID NO: 121983 - RNA, 20 nt, Artificial Sequence
  MKO10121983_B_Tmem221
  gRNA
gcgcuuggccuguucugcug

SEQ ID NO: 121984 - RNA, 20 nt, Artificial Sequence
  MKO10121984_B_Tmem221
  gRNA
cacacuaccugcuaaguaga

SEQ ID NO: 121985 - RNA, 20 nt, Artificial Sequence
  MKO10121985_B_Tmem222
  gRNA
ugacaacugccacucccacg

SEQ ID NO: 121986 - RNA, 20 nt, Artificial Sequence
  MKO10121986_B_Tmem222
  gRNA
uuacuuggcaggcuuuccga

SEQ ID NO: 121987 - RNA, 20 nt, Artificial Sequence
  MKO10121987_B_Tmem222
  gRNA
ugcuguuguuguaacgcauc

SEQ ID NO: 121988 - RNA, 20 nt, Artificial Sequence
  MKO10121988_B_Tmem223
  gRNA
ccggcgcuucuacuuccuuu

SEQ ID NO: 121989 - RNA, 20 nt, Artificial Sequence
  MKO10121989_B_Tmem223
  gRNA
ggcuccgaaccggagcuacc

SEQ ID NO: 121990 - RNA, 20 nt, Artificial Sequence
  MKO10121990_B_Tmem223
  gRNA
gacccgcacaaaacagucca

SEQ ID NO: 121991 - RNA, 20 nt, Artificial Sequence
  MKO10121991_B_Tmem225
  gRNA
ucguuaauuacaagaccaag

SEQ ID NO: 121992 - RNA, 20 nt, Artificial Sequence
  MKO10121992_B_Tmem225
  gRNA
uucugaccuucgggccaaaa

SEQ ID NO: 121993 - RNA, 20 nt, Artificial Sequence
  MKO10121993_B_Tmem225
  gRNA
uccuacuaucaacagaagua

SEQ ID NO: 121994 - RNA, 20 nt, Artificial Sequence
  MKO10121994_B_Tmem229a
  gRNA
uacgugcucgcgcucuacca

SEQ ID NO: 121995 - RNA, 20 nt, Artificial Sequence
  MKO10121995_B_Tmem229a
  gRNA
cgugcaucccguagaaguag

SEQ ID NO: 121996 - RNA, 20 nt, Artificial Sequence
  MKO10121996_B_Tmem229a
  gRNA
cuaggcugagccguagcgcc

SEQ ID NO: 121997 - RNA, 20 nt, Artificial Sequence
  MKO10121997_B_Tmem229b
  gRNA
accaacgagacagcgcuguc

SEQ ID NO: 121998 - RNA, 20 nt, Artificial Sequence
  MKO10121998_B_Tmem229b
  gRNA
gccaguucaacgccuguccc

SEQ ID NO: 121999 - RNA, 20 nt, Artificial Sequence
  MKO10121999_B_Tmem229b
  gRNA
cccugacagcgcugucucgu

SEQ ID NO: 122000 - RNA, 20 nt, Artificial Sequence
  MKO10122000_B_Tmem230
  gRNA
cccuccuaagaucccuuaua

SEQ ID NO: 122001 - RNA, 20 nt, Artificial Sequence
  MKO10122001_B_Tmem230
  gRNA
gccguuccuguccucaucau

SEQ ID NO: 122002 - RNA, 20 nt, Artificial Sequence
  MKO10122002_B_Tmem230
  gRNA
gaaggcuagucaucaaaguc

SEQ ID NO: 122003 - RNA, 20 nt, Artificial Sequence
  MKO10122003_B_Tmem231
  gRNA
ccccagguguccgugaucaa

SEQ ID NO: 122004 - RNA, 20 nt, Artificial Sequence
  MKO10122004_B_Tmem231
  gRNA
ucaggauuagcugcacaccg

SEQ ID NO: 122005 - RNA, 20 nt, Artificial Sequence
  MKO10122005_B_Tmem231
  gRNA
aagcagccacugagcuaccg

SEQ ID NO: 122006 - RNA, 20 nt, Artificial Sequence
  MKO10122006_B_Tmem232
  gRNA
aucuaucuggcucagugcaa

SEQ ID NO: 122007 - RNA, 20 nt, Artificial Sequence
  MKO10122007_B_Tmem232
  gRNA
agaccugacgaugagucucc

SEQ ID NO: 122008 - RNA, 20 nt, Artificial Sequence
  MKO10122008_B_Tmem232
  gRNA
aauacucuaccguauaaaua

SEQ ID NO: 122009 - RNA, 20 nt, Artificial Sequence
  MKO10122009_B_Tmem233
  gRNA
caucaucggcgucuccugug

SEQ ID NO: 122010 - RNA, 20 nt, Artificial Sequence
  MKO10122010_B_Tmem233
  gRNA
uacugagacaugggcgaagu

SEQ ID NO: 122011 - RNA, 20 nt, Artificial Sequence
  MKO10122011_B_Tmem233
  gRNA
ugggcagaaacacgagauaa

SEQ ID NO: 122012 - RNA, 20 nt, Artificial Sequence
  MKO10122012_B_Tmem234
  gRNA
aacaaucaguguaaagacga

SEQ ID NO: 122013 - RNA, 20 nt, Artificial Sequence
  MKO10122013_B_Tmem234
  gRNA
caccgagcuugugaugcaca

SEQ ID NO: 122014 - RNA, 20 nt, Artificial Sequence
  MKO10122014_B_Tmem234
  gRNA
ucccaccaauaucuucucca

SEQ ID NO: 122015 - RNA, 20 nt, Artificial Sequence
  MKO10122015_B_Tmem235
  gRNA
agacccaaccacauacgaug

SEQ ID NO: 122016 - RNA, 20 nt, Artificial Sequence
  MKO10122016_B_Tmem235
  gRNA
cuuacucagcuucgcgcugc

SEQ ID NO: 122017 - RNA, 20 nt, Artificial Sequence
  MKO10122017_B_Tmem235
  gRNA
cgccagcguccgccaccucc

SEQ ID NO: 122018 - RNA, 20 nt, Artificial Sequence
  MKO10122018_B_Tmem236
  gRNA
cuuugcuaggcgaccuguuc

SEQ ID NO: 122019 - RNA, 20 nt, Artificial Sequence
  MKO10122019_B_Tmem236
  gRNA
uucagacuuuguucgcugau

SEQ ID NO: 122020 - RNA, 20 nt, Artificial Sequence
  MKO10122020_B_Tmem236
  gRNA
aucagcgaacaaagucugaa

SEQ ID NO: 122021 - RNA, 20 nt, Artificial Sequence
  MKO10122021_B_Tmem237
  gRNA
uccgguagcuaccgcuucuu

SEQ ID NO: 122022 - RNA, 20 nt, Artificial Sequence
  MKO10122022_B_Tmem237
  gRNA
gagcacucccaccugugcca

SEQ ID NO: 122023 - RNA, 20 nt, Artificial Sequence
  MKO10122023_B_Tmem237
  gRNA
agcauggccuuccgaagaag

SEQ ID NO: 122024 - RNA, 20 nt, Artificial Sequence
  MKO10122024_B_Tmem238
  gRNA
gugcggcucgcaggcguccg

SEQ ID NO: 122025 - RNA, 20 nt, Artificial Sequence
  MKO10122025_B_Tmem238
  gRNA
accggcugugguccggggac

SEQ ID NO: 122026 - RNA, 20 nt, Artificial Sequence
  MKO10122026_B_Tmem238
  gRNA
cgccaggcgggcaaucgccg

SEQ ID NO: 122027 - RNA, 20 nt, Artificial Sequence
  MKO10122027_B_Tmem239
  gRNA
ccccacagcauccgcuguag

SEQ ID NO: 122028 - RNA, 20 nt, Artificial Sequence
  MKO10122028_B_Tmem239
  gRNA
cgugaugcagcagccacgag

SEQ ID NO: 122029 - RNA, 20 nt, Artificial Sequence
  MKO10122029_B_Tmem239
  gRNA
ggauaucaucggggcuggcg

SEQ ID NO: 122030 - RNA, 20 nt, Artificial Sequence
  MKO10122030_B_Tmem240
  gRNA
acgugcaccauguuccccgu

SEQ ID NO: 122031 - RNA, 20 nt, Artificial Sequence
  MKO10122031_B_Tmem240
  gRNA
ccaggccaucgcgugcuuga

SEQ ID NO: 122032 - RNA, 20 nt, Artificial Sequence
  MKO10122032_B_Tmem240
  gRNA
cgaagggccuguguggccgc

SEQ ID NO: 122033 - RNA, 20 nt, Artificial Sequence
  MKO10122033_B_Tmem241
  gRNA
cguucaucugucagcucucc

SEQ ID NO: 122034 - RNA, 20 nt, Artificial Sequence
  MKO10122034_B_Tmem241
  gRNA
uccagguggcagacauucau

SEQ ID NO: 122035 - RNA, 20 nt, Artificial Sequence
  MKO10122035_B_Tmem241
  gRNA
uggagcuccacagcagucca

SEQ ID NO: 122036 - RNA, 20 nt, Artificial Sequence
  MKO10122036_B_Tmem242
  gRNA
acuuacgcugugaacuccua

SEQ ID NO: 122037 - RNA, 20 nt, Artificial Sequence
  MKO10122037_B_Tmem242
  gRNA
uccagcuagcauucccgcug

SEQ ID NO: 122038 - RNA, 20 nt, Artificial Sequence
  MKO10122038_B_Tmem242
  gRNA
auuccagggcacuauggcca

SEQ ID NO: 122039 - RNA, 20 nt, Artificial Sequence
  MKO10122039_B_Tmem243
  gRNA
auccaggccgcuggucccgu

SEQ ID NO: 122040 - RNA, 20 nt, Artificial Sequence
  MKO10122040_B_Tmem243
  gRNA
gguacuuacuagaaucaaca

SEQ ID NO: 122041 - RNA, 20 nt, Artificial Sequence
  MKO10122041_B_Tmem243
  gRNA
aaacuuguacuuccaugaug

SEQ ID NO: 122042 - RNA, 20 nt, Artificial Sequence
  MKO10122042_B_Tmem245
  gRNA
ucuacuucgugucucuugug

SEQ ID NO: 122043 - RNA, 20 nt, Artificial Sequence
  MKO10122043_B_Tmem245
  gRNA
gcuggacucauacccaguga

SEQ ID NO: 122044 - RNA, 20 nt, Artificial Sequence
  MKO10122044_B_Tmem245
  gRNA
ccgagaugggaacauuucuc

SEQ ID NO: 122045 - RNA, 20 nt, Artificial Sequence
  MKO10122045_B_Tmem246
  gRNA
cgcacugcugcagaagccga

SEQ ID NO: 122046 - RNA, 20 nt, Artificial Sequence
  MKO10122046_B_Tmem246
  gRNA
agccgggguacaacacugag

SEQ ID NO: 122047 - RNA, 20 nt, Artificial Sequence
  MKO10122047_B_Tmem246
  gRNA
gcucucuaaguacgucccug

SEQ ID NO: 122048 - RNA, 20 nt, Artificial Sequence
  MKO10122048_B_Tmem247
  gRNA
ccacaucaucuacguugcca

SEQ ID NO: 122049 - RNA, 20 nt, Artificial Sequence
  MKO10122049_B_Tmem247
  gRNA
cacaaucccuauccucauaa

SEQ ID NO: 122050 - RNA, 20 nt, Artificial Sequence
  MKO10122050_B_Tmem247
  gRNA
gagaaagaagaccgucuccu

SEQ ID NO: 122051 - RNA, 20 nt, Artificial Sequence
  MKO10122051_B_Tmem248
  gRNA
agacgaucuggccugcccga

SEQ ID NO: 122052 - RNA, 20 nt, Artificial Sequence
  MKO10122052_B_Tmem248
  gRNA
ucguuaucaccaucacgaaa

SEQ ID NO: 122053 - RNA, 20 nt, Artificial Sequence
  MKO10122053_B_Tmem248
  gRNA
auugcucugccgcaguuugc

SEQ ID NO: 122054 - RNA, 20 nt, Artificial Sequence
  MKO10122054_B_Tmem251
  gRNA
ucacucaguucugaacaguc

SEQ ID NO: 122055 - RNA, 20 nt, Artificial Sequence
  MKO10122055_B_Tmem251
  gRNA
aguuaucugcaaucgucauc

SEQ ID NO: 122056 - RNA, 20 nt, Artificial Sequence
  MKO10122056_B_Tmem251
  gRNA
caauccaucccauccgcuga

SEQ ID NO: 122057 - RNA, 20 nt, Artificial Sequence
  MKO10122057_B_Tmem252
  gRNA
ucagcauccugugccuucgc

SEQ ID NO: 122058 - RNA, 20 nt, Artificial Sequence
  MKO10122058_B_Tmem252
  gRNA
cagacagcaccucgcuuucc

SEQ ID NO: 122059 - RNA, 20 nt, Artificial Sequence
  MKO10122059_B_Tmem252
  gRNA
ugccccuggccacuguagac

SEQ ID NO: 122060 - RNA, 20 nt, Artificial Sequence
  MKO10122060_B_Tmem253
  gRNA
uagcuauugccagccacacu

SEQ ID NO: 122061 - RNA, 20 nt, Artificial Sequence
  MKO10122061_B_Tmem253
  gRNA
gugggucuuaccgaggcucc

SEQ ID NO: 122062 - RNA, 20 nt, Artificial Sequence
  MKO10122062_B_Tmem253
  gRNA
uccgaagagcaccuugcauc

SEQ ID NO: 122063 - RNA, 20 nt, Artificial Sequence
  MKO10122063_B_Tmem254a
  gRNA
gcuuuccuuacccauuccuu

SEQ ID NO: 122064 - RNA, 20 nt, Artificial Sequence
  MKO10122064_B_Tmem254a
  gRNA
guuucagguauuggcuugcu

SEQ ID NO: 122065 - RNA, 20 nt, Artificial Sequence
  MKO10122065_B_Tmem254a
  gRNA
gacuuacuugcauaaaacca

SEQ ID NO: 122066 - RNA, 20 nt, Artificial Sequence
  MKO10122066_B_Tmem254b
  gRNA
gcuuuccuuacccauuccuu

SEQ ID NO: 122067 - RNA, 20 nt, Artificial Sequence
  MKO10122067_B_Tmem254b
  gRNA
guuucagguauuggcuugcu

SEQ ID NO: 122068 - RNA, 20 nt, Artificial Sequence
  MKO10122068_B_Tmem254b
  gRNA
gacuuacuugcauaaaacca

SEQ ID NO: 122069 - RNA, 20 nt, Artificial Sequence
  MKO10122069_B_Tmem254c
  gRNA
gcuuuccuuacccauuccuu

SEQ ID NO: 122070 - RNA, 20 nt, Artificial Sequence
  MKO10122070_B_Tmem254c
  gRNA
guuucagguauuggcuugcu

SEQ ID NO: 122071 - RNA, 20 nt, Artificial Sequence
  MKO10122071_B_Tmem254c
  gRNA
gacuuacuugcauaaaacca

SEQ ID NO: 122072 - RNA, 20 nt, Artificial Sequence
  MKO10122072_B_Tmem255a
  gRNA
ugaaaccacucuaugcuaac

SEQ ID NO: 122073 - RNA, 20 nt, Artificial Sequence
  MKO10122073_B_Tmem255a
  gRNA
uggcaccgguuagcauagag

SEQ ID NO: 122074 - RNA, 20 nt, Artificial Sequence
  MKO10122074_B_Tmem255a
  gRNA
ucuaucguguuuaucagcuu

SEQ ID NO: 122075 - RNA, 20 nt, Artificial Sequence
  MKO10122075_B_Tmem255b
  gRNA
guaugacgucuaucagacag

SEQ ID NO: 122076 - RNA, 20 nt, Artificial Sequence
  MKO10122076_B_Tmem255b
  gRNA
ucuacucucauccugaccau

SEQ ID NO: 122077 - RNA, 20 nt, Artificial Sequence
  MKO10122077_B_Tmem255b
  gRNA
uugcagcaaggccaaugguc

SEQ ID NO: 122078 - RNA, 20 nt, Artificial Sequence
  MKO10122078_B_Tmem256
  gRNA
uuacuucaccuccuucccgu

SEQ ID NO: 122079 - RNA, 20 nt, Artificial Sequence
  MKO10122079_B_Tmem256
  gRNA
gggagggagccugcuaaucu

SEQ ID NO: 122080 - RNA, 20 nt, Artificial Sequence
  MKO10122080_B_Tmem256
  gRNA
gcaggauuacuguuagcuuc

SEQ ID NO: 122081 - RNA, 20 nt, Artificial Sequence
  MKO10122081_B_Tmem258
  gRNA
cguagaugccaacccagagc

SEQ ID NO: 122082 - RNA, 20 nt, Artificial Sequence
  MKO10122082_B_Tmem258
  gRNA
uaaaggauacacgaagaacc

SEQ ID NO: 122083 - RNA, 20 nt, Artificial Sequence
  MKO10122083_B_Tmem258
  gRNA
uggccagaaguaccacaguc

SEQ ID NO: 122084 - RNA, 20 nt, Artificial Sequence
  MKO10122084_B_Tmem259
  gRNA
guacauuguggaguacucac

SEQ ID NO: 122085 - RNA, 20 nt, Artificial Sequence
  MKO10122085_B_Tmem259
  gRNA
ccgcuucagccgccuauugc

SEQ ID NO: 122086 - RNA, 20 nt, Artificial Sequence
  MKO10122086_B_Tmem259
  gRNA
ccuagggugaccaccaugac

SEQ ID NO: 122087 - RNA, 20 nt, Artificial Sequence
  MKO10122087_B_Tmem25
  gRNA
gccacugcugggcaucguug

SEQ ID NO: 122088 - RNA, 20 nt, Artificial Sequence
  MKO10122088_B_Tmem25
  gRNA
cagguggguuggcccgcacc

SEQ ID NO: 122089 - RNA, 20 nt, Artificial Sequence
  MKO10122089_B_Tmem25
  gRNA
acuugccuugggcacucuag

SEQ ID NO: 122090 - RNA, 20 nt, Artificial Sequence
  MKO10122090_B_Tmem260
  gRNA
uagcuuaaacaaucuguucg

SEQ ID NO: 122091 - RNA, 20 nt, Artificial Sequence
  MKO10122091_B_Tmem260
  gRNA
ugugcugauuacacaagcug

SEQ ID NO: 122092 - RNA, 20 nt, Artificial Sequence
  MKO10122092_B_Tmem260
  gRNA
aucacagccgcacaugagcu

SEQ ID NO: 122093 - RNA, 20 nt, Artificial Sequence
  MKO10122093_B_Tmem261
  gRNA
cagaacaacuacaccccaac

SEQ ID NO: 122094 - RNA, 20 nt, Artificial Sequence
  MKO10122094_B_Tmem261
  gRNA
acccgcgaaauccgccgugc

SEQ ID NO: 122095 - RNA, 20 nt, Artificial Sequence
  MKO10122095_B_Tmem261
  gRNA
cagcacgcgacaacuccagc

SEQ ID NO: 122096 - RNA, 20 nt, Artificial Sequence
  MKO10122096_B_Tmem26
  gRNA
uucuagaaccaacccuacuc

SEQ ID NO: 122097 - RNA, 20 nt, Artificial Sequence
  MKO10122097_B_Tmem26
  gRNA
gcugcaguucccccuugauc

SEQ ID NO: 122098 - RNA, 20 nt, Artificial Sequence
  MKO10122098_B_Tmem26
  gRNA
aauggggaauauccuugagc

SEQ ID NO: 122099 - RNA, 20 nt, Artificial Sequence
  MKO10122099_B_Tmem27
  gRNA
caaaccagaacgacacccuc

SEQ ID NO: 122100 - RNA, 20 nt, Artificial Sequence
  MKO10122100_B_Tmem27
  gRNA
gaugcuaagucuuacuuuaa

SEQ ID NO: 122101 - RNA, 20 nt, Artificial Sequence
  MKO10122101_B_Tmem27
  gRNA
cuuagcaucagagcagcucu

SEQ ID NO: 122102 - RNA, 20 nt, Artificial Sequence
  MKO10122102_B_Tmem28
  gRNA
ugauggauacuucaccaaag

SEQ ID NO: 122103 - RNA, 20 nt, Artificial Sequence
  MKO10122103_B_Tmem28
  gRNA
ggcaccgggucugcaccucc

SEQ ID NO: 122104 - RNA, 20 nt, Artificial Sequence
  MKO10122104_B_Tmem28
  gRNA
gccuccacaggcugucuaca

SEQ ID NO: 122105 - RNA, 20 nt, Artificial Sequence
  MKO10122105_B_Tmem29
  gRNA
uucugguacucucucacgau

SEQ ID NO: 122106 - RNA, 20 nt, Artificial Sequence
  MKO10122106_B_Tmem29
  gRNA
uccugaggcauucgagacgc

SEQ ID NO: 122107 - RNA, 20 nt, Artificial Sequence
  MKO10122107_B_Tmem29
  gRNA
gauggaugauccuccgaaga

SEQ ID NO: 122108 - RNA, 20 nt, Artificial Sequence
  MKO10122108_B_Tmem2
  gRNA
uuggggaguaaacugaucca

SEQ ID NO: 122109 - RNA, 20 nt, Artificial Sequence
  MKO10122109_B_Tmem2
  gRNA
cagaucaaaacccucgucuc

SEQ ID NO: 122110 - RNA, 20 nt, Artificial Sequence
  MKO10122110_B_Tmem2
  gRNA
ugcuucgcagaaucuugucc

SEQ ID NO: 122111 - RNA, 20 nt, Artificial Sequence
  MKO10122111_B_Tmem30a
  gRNA
cgagaugauagccaguuaaa

SEQ ID NO: 122112 - RNA, 20 nt, Artificial Sequence
  MKO10122112_B_Tmem30a
  gRNA
agauacguuagaauuguauc

SEQ ID NO: 122113 - RNA, 20 nt, Artificial Sequence
  MKO10122113_B_Tmem30a
  gRNA
caagcacaagaugucacauu

SEQ ID NO: 122114 - RNA, 20 nt, Artificial Sequence
  MKO10122114_B_Tmem30b
  gRNA
cgccguagcgccgguuguuc

SEQ ID NO: 122115 - RNA, 20 nt, Artificial Sequence
  MKO10122115_B_Tmem30b
  gRNA
gcgauggcggugcgaucgag

SEQ ID NO: 122116 - RNA, 20 nt, Artificial Sequence
  MKO10122116_B_Tmem30b
  gRNA
caaguuccgcaacccgccgc

SEQ ID NO: 122117 - RNA, 20 nt, Artificial Sequence
  MKO10122117_B_Tmem30c
  gRNA
aaauauccuuacccaccaau

SEQ ID NO: 122118 - RNA, 20 nt, Artificial Sequence
  MKO10122118_B_Tmem30c
  gRNA
gagugucauugugggacacu

SEQ ID NO: 122119 - RNA, 20 nt, Artificial Sequence
  MKO10122119_B_Tmem30c
  gRNA
auugccaacagcauauucaa

SEQ ID NO: 122120 - RNA, 20 nt, Artificial Sequence
  MKO10122120_B_Tmem33
  gRNA
ccaguugagcagagcguucc

SEQ ID NO: 122121 - RNA, 20 nt, Artificial Sequence
  MKO10122121_B_Tmem33
  gRNA
auucaugaugaccaauaaau

SEQ ID NO: 122122 - RNA, 20 nt, Artificial Sequence
  MKO10122122_B_Tmem33
  gRNA
cauugcuguguccaauuuau

SEQ ID NO: 122123 - RNA, 20 nt, Artificial Sequence
  MKO10122123_B_Tmem35
  gRNA
ggggccuucucauacaagga

SEQ ID NO: 122124 - RNA, 20 nt, Artificial Sequence
  MKO10122124_B_Tmem35
  gRNA
caaacgcuacgcccaugcuc

SEQ ID NO: 122125 - RNA, 20 nt, Artificial Sequence
  MKO10122125_B_Tmem35
  gRNA
ugagagggccaugauaguua

SEQ ID NO: 122126 - RNA, 20 nt, Artificial Sequence
  MKO10122126_B_Tmem37
  gRNA
caugggccuagcacgcagug

SEQ ID NO: 122127 - RNA, 20 nt, Artificial Sequence
  MKO10122127_B_Tmem37
  gRNA
uucuuccucaaugccgccag

SEQ ID NO: 122128 - RNA, 20 nt, Artificial Sequence
  MKO10122128_B_Tmem37
  gRNA
cuaguggaggaucaucucuu

SEQ ID NO: 122129 - RNA, 20 nt, Artificial Sequence
  MKO10122129_B_Tmem38a
  gRNA
uguugcccuccuguccaacg

SEQ ID NO: 122130 - RNA, 20 nt, Artificial Sequence
  MKO10122130_B_Tmem38a
  gRNA
ucaccuugcagcagacucgc

SEQ ID NO: 122131 - RNA, 20 nt, Artificial Sequence
  MKO10122131_B_Tmem38a
  gRNA
ccccaagaagcaggucggcc

SEQ ID NO: 122132 - RNA, 20 nt, Artificial Sequence
  MKO10122132_B_Tmem38b
  gRNA
ggaauaacccccuggcuagc

SEQ ID NO: 122133 - RNA, 20 nt, Artificial Sequence
  MKO10122133_B_Tmem38b
  gRNA
cccucgugaccuaguuuccc

SEQ ID NO: 122134 - RNA, 20 nt, Artificial Sequence
  MKO10122134_B_Tmem38b
  gRNA
agacucugcaagcagcauac

SEQ ID NO: 122135 - RNA, 20 nt, Artificial Sequence
  MKO10122135_B_Tmem39a
  gRNA
uguaugggcccucauuuccg

SEQ ID NO: 122136 - RNA, 20 nt, Artificial Sequence
  MKO10122136_B_Tmem39a
  gRNA
ucggcggcggcuguggcaau

SEQ ID NO: 122137 - RNA, 20 nt, Artificial Sequence
  MKO10122137_B_Tmem39a
  gRNA
accacagccuuaauuacccc

SEQ ID NO: 122138 - RNA, 20 nt, Artificial Sequence
  MKO10122138_B_Tmem39b
  gRNA
acaacggucugcgcggccag

SEQ ID NO: 122139 - RNA, 20 nt, Artificial Sequence
  MKO10122139_B_Tmem39b
  gRNA
ccagccugucgccgugagaa

SEQ ID NO: 122140 - RNA, 20 nt, Artificial Sequence
  MKO10122140_B_Tmem39b
  gRNA
cacccgcuucaccguucuca

SEQ ID NO: 122141 - RNA, 20 nt, Artificial Sequence
  MKO10122141_B_Tmem40
  gRNA
uuucuaggacuccgaaggag

SEQ ID NO: 122142 - RNA, 20 nt, Artificial Sequence
  MKO10122142_B_Tmem40
  gRNA
gcuggggaaauggugccuac

SEQ ID NO: 122143 - RNA, 20 nt, Artificial Sequence
  MKO10122143_B_Tmem40
  gRNA
uacucaccugacuccccagu

SEQ ID NO: 122144 - RNA, 20 nt, Artificial Sequence
  MKO10122144_B_Tmem41a
  gRNA
gcugugguuccccuccgauc

SEQ ID NO: 122145 - RNA, 20 nt, Artificial Sequence
  MKO10122145_B_Tmem41a
  gRNA
cagcuguuugccgaaaagac

SEQ ID NO: 122146 - RNA, 20 nt, Artificial Sequence
  MKO10122146_B_Tmem41a
  gRNA
ugccuuguucgggccauggc

SEQ ID NO: 122147 - RNA, 20 nt, Artificial Sequence
  MKO10122147_B_Tmem41b
  gRNA
acauacuuaccaaacaaaca

SEQ ID NO: 122148 - RNA, 20 nt, Artificial Sequence
  MKO10122148_B_Tmem41b
  gRNA
gaaaagccuugugcagaagc

SEQ ID NO: 122149 - RNA, 20 nt, Artificial Sequence
  MKO10122149_B_Tmem41b
  gRNA
ggaagagagggugaauauga

SEQ ID NO: 122150 - RNA, 20 nt, Artificial Sequence
  MKO10122150_B_Tmem42
  gRNA
aucuuaggcuaccugcugua

SEQ ID NO: 122151 - RNA, 20 nt, Artificial Sequence
  MKO10122151_B_Tmem42
  gRNA
gaagguccacaucagagaau

SEQ ID NO: 122152 - RNA, 20 nt, Artificial Sequence
  MKO10122152_B_Tmem42
  gRNA
uuucucgaacauacuuugcu

SEQ ID NO: 122153 - RNA, 20 nt, Artificial Sequence
  MKO10122153_B_Tmem43
  gRNA
ugccgucgcaguuucacagc

SEQ ID NO: 122154 - RNA, 20 nt, Artificial Sequence
  MKO10122154_B_Tmem43
  gRNA
aagucucacucagccgcucc

SEQ ID NO: 122155 - RNA, 20 nt, Artificial Sequence
  MKO10122155_B_Tmem43
  gRNA
uuucugcagugaguacacgg

SEQ ID NO: 122156 - RNA, 20 nt, Artificial Sequence
  MKO10122156_B_Tmem44
  gRNA
aaucuggaccgcuaucccca

SEQ ID NO: 122157 - RNA, 20 nt, Artificial Sequence
  MKO10122157_B_Tmem44
  gRNA
acacucaccggacuuggacu

SEQ ID NO: 122158 - RNA, 20 nt, Artificial Sequence
  MKO10122158_B_Tmem44
  gRNA
agcagguagccgaagacuuc

SEQ ID NO: 122159 - RNA, 20 nt, Artificial Sequence
  MKO10122159_B_Tmem45a
  gRNA
cuccuagguuagucaagucu

SEQ ID NO: 122160 - RNA, 20 nt, Artificial Sequence
  MKO10122160_B_Tmem45a
  gRNA
gcaucaauccuuauccucau

SEQ ID NO: 122161 - RNA, 20 nt, Artificial Sequence
  MKO10122161_B_Tmem45a
  gRNA
uaguagugaaacauaugauu

SEQ ID NO: 122162 - RNA, 20 nt, Artificial Sequence
  MKO10122162_B_Tmem45b
  gRNA
ccucauccgagccacucaaa

SEQ ID NO: 122163 - RNA, 20 nt, Artificial Sequence
  MKO10122163_B_Tmem45b
  gRNA
uuuguccuguucccgccauu

SEQ ID NO: 122164 - RNA, 20 nt, Artificial Sequence
  MKO10122164_B_Tmem45b
  gRNA
cguucacaaccgcccucccc

SEQ ID NO: 122165 - RNA, 20 nt, Artificial Sequence
  MKO10122165_B_Tmem47
  gRNA
auucgcaaugccagauaucc

SEQ ID NO: 122166 - RNA, 20 nt, Artificial Sequence
  MKO10122166_B_Tmem47
  gRNA
agauuggcagauugcuacuc

SEQ ID NO: 122167 - RNA, 20 nt, Artificial Sequence
  MKO10122167_B_Tmem47
  gRNA
gaaugauggcagcaccgccc

SEQ ID NO: 122168 - RNA, 20 nt, Artificial Sequence
  MKO10122168_B_Tmem50a
  gRNA
gaaaaggacguaguguaucc

SEQ ID NO: 122169 - RNA, 20 nt, Artificial Sequence
  MKO10122169_B_Tmem50a
  gRNA
uugcuaugacgccacaggua

SEQ ID NO: 122170 - RNA, 20 nt, Artificial Sequence
  MKO10122170_B_Tmem50a
  gRNA
uggaaaaauacagcaauccc

SEQ ID NO: 122171 - RNA, 20 nt, Artificial Sequence
  MKO10122171_B_Tmem50b
  gRNA
gaguaacauaugcaccaaaa

SEQ ID NO: 122172 - RNA, 20 nt, Artificial Sequence
  MKO10122172_B_Tmem50b
  gRNA
cauagcugucaccucgcacc

SEQ ID NO: 122173 - RNA, 20 nt, Artificial Sequence
  MKO10122173_B_Tmem50b
  gRNA
aaaugcuguauccaaugccc

SEQ ID NO: 122174 - RNA, 20 nt, Artificial Sequence
  MKO10122174_B_Tmem51
  gRNA
cacuacgcacugacggccau

SEQ ID NO: 122175 - RNA, 20 nt, Artificial Sequence
  MKO10122175_B_Tmem51
  gRNA
cagccccguuagcgacucau

SEQ ID NO: 122176 - RNA, 20 nt, Artificial Sequence
  MKO10122176_B_Tmem51
  gRNA
ccccuccuaugagucgcuaa

SEQ ID NO: 122177 - RNA, 20 nt, Artificial Sequence
  MKO10122177_B_Tmem52b
  gRNA
acucacauguaauggugcuc

SEQ ID NO: 122178 - RNA, 20 nt, Artificial Sequence
  MKO10122178_B_Tmem52b
  gRNA
gacacaguucuccucacucc

SEQ ID NO: 122179 - RNA, 20 nt, Artificial Sequence
  MKO10122179_B_Tmem52b
  gRNA
agcggaagcauacugaaguc

SEQ ID NO: 122180 - RNA, 20 nt, Artificial Sequence
  MKO10122180_B_Tmem52
  gRNA
acgccgcuggcgugugugac

SEQ ID NO: 122181 - RNA, 20 nt, Artificial Sequence
  MKO10122181_B_Tmem52
  gRNA
caucuucacaacuucaucgu

SEQ ID NO: 122182 - RNA, 20 nt, Artificial Sequence
  MKO10122182_B_Tmem52
  gRNA
gucuaaggaacauggccccg

SEQ ID NO: 122183 - RNA, 20 nt, Artificial Sequence
  MKO10122183_B_Tmem53
  gRNA
cucgaugcuguaauccagcu

SEQ ID NO: 122184 - RNA, 20 nt, Artificial Sequence
  MKO10122184_B_Tmem53
  gRNA
gugguagauagcacuauacu

SEQ ID NO: 122185 - RNA, 20 nt, Artificial Sequence
  MKO10122185_B_Tmem53
  gRNA
cagcccaagagaaucaccac

SEQ ID NO: 122186 - RNA, 20 nt, Artificial Sequence
  MKO10122186_B_Tmem54
  gRNA
cgcugcgcccagcucaugca

SEQ ID NO: 122187 - RNA, 20 nt, Artificial Sequence
  MKO10122187_B_Tmem54
  gRNA
cuguagaaccacagcgucac

SEQ ID NO: 122188 - RNA, 20 nt, Artificial Sequence
  MKO10122188_B_Tmem54
  gRNA
aucaacaugugucugcgcau

SEQ ID NO: 122189 - RNA, 20 nt, Artificial Sequence
  MKO10122189_B_Tmem55a
  gRNA
cgauggcuguauacggaggu

SEQ ID NO: 122190 - RNA, 20 nt, Artificial Sequence
  MKO10122190_B_Tmem55a
  gRNA
uaggauguccgagacccaac

SEQ ID NO: 122191 - RNA, 20 nt, Artificial Sequence
  MKO10122191_B_Tmem55a
  gRNA
ccaaucaaaacccccccaac

SEQ ID NO: 122192 - RNA, 20 nt, Artificial Sequence
  MKO10122192_B_Tmem55b
  gRNA
caucggacauacuucuuucc

SEQ ID NO: 122193 - RNA, 20 nt, Artificial Sequence
  MKO10122193_B_Tmem55b
  gRNA
acauugcaagaacacguuuc

SEQ ID NO: 122194 - RNA, 20 nt, Artificial Sequence
  MKO10122194_B_Tmem55b
  gRNA
agaauucacagaccgaaccu

SEQ ID NO: 122195 - RNA, 20 nt, Artificial Sequence
  MKO10122195_B_Tmem56
  gRNA
uuuauaauucaccauugcgc

SEQ ID NO: 122196 - RNA, 20 nt, Artificial Sequence
  MKO10122196_B_Tmem56
  gRNA
ccagagcggaucaguuauag

SEQ ID NO: 122197 - RNA, 20 nt, Artificial Sequence
  MKO10122197_B_Tmem56
  gRNA
auaaauauugcaacugcuuc

SEQ ID NO: 122198 - RNA, 20 nt, Artificial Sequence
  MKO10122198_B_Tmem57
  gRNA
uucuagcauuggauacccug

SEQ ID NO: 122199 - RNA, 20 nt, Artificial Sequence
  MKO10122199_B_Tmem57
  gRNA
uaccaguccuugguaucuga

SEQ ID NO: 122200 - RNA, 20 nt, Artificial Sequence
  MKO10122200_B_Tmem57
  gRNA
ggacaagugcccacacuacc

SEQ ID NO: 122201 - RNA, 20 nt, Artificial Sequence
  MKO10122201_B_Tmem59l
  gRNA
cuuguuauucggggacucug

SEQ ID NO: 122202 - RNA, 20 nt, Artificial Sequence
  MKO10122202_B_Tmem59l
  gRNA
cucagaguccccgaauaaca

SEQ ID NO: 122203 - RNA, 20 nt, Artificial Sequence
  MKO10122203_B_Tmem59l
  gRNA
gagccaucugcagcgagugg

SEQ ID NO: 122204 - RNA, 20 nt, Artificial Sequence
  MKO10122204_B_Tmem59
  gRNA
gaguuauacgcaugccagag

SEQ ID NO: 122205 - RNA, 20 nt, Artificial Sequence
  MKO10122205_B_Tmem59
  gRNA
gucguucuggagugacauga

SEQ ID NO: 122206 - RNA, 20 nt, Artificial Sequence
  MKO10122206_B_Tmem59
  gRNA
ugcggugcauacugaauuuc

SEQ ID NO: 122207 - RNA, 20 nt, Artificial Sequence
  MKO10122207_B_Tmem5
  gRNA
gauugccaggucuguaucuc

SEQ ID NO: 122208 - RNA, 20 nt, Artificial Sequence
  MKO10122208_B_Tmem5
  gRNA
cccuacauauguaauuucuu

SEQ ID NO: 122209 - RNA, 20 nt, Artificial Sequence
  MKO10122209_B_Tmem5
  gRNA
aucaugcagcauuguccagc

SEQ ID NO: 122210 - RNA, 20 nt, Artificial Sequence
  MKO10122210_B_Tmem60
  gRNA
uguuagagcgccagccagua

SEQ ID NO: 122211 - RNA, 20 nt, Artificial Sequence
  MKO10122211_B_Tmem60
  gRNA
cucagagaguacuccucacc

SEQ ID NO: 122212 - RNA, 20 nt, Artificial Sequence
  MKO10122212_B_Tmem60
  gRNA
auagugucaaauauccagac

SEQ ID NO: 122213 - RNA, 20 nt, Artificial Sequence
  MKO10122213_B_Tmem62
  gRNA
accaaguggcuggauaucaa

SEQ ID NO: 122214 - RNA, 20 nt, Artificial Sequence
  MKO10122214_B_Tmem62
  gRNA
aacuauugacaucauucaac

SEQ ID NO: 122215 - RNA, 20 nt, Artificial Sequence
  MKO10122215_B_Tmem62
  gRNA
ccauucuacuucauguuguc

SEQ ID NO: 122216 - RNA, 20 nt, Artificial Sequence
  MKO10122216_B_Tmem63a
  gRNA
cguccucuccgcaccacucc

SEQ ID NO: 122217 - RNA, 20 nt, Artificial Sequence
  MKO10122217_B_Tmem63a
  gRNA
ccagaaucuucuccuuauga

SEQ ID NO: 122218 - RNA, 20 nt, Artificial Sequence
  MKO10122218_B_Tmem63a
  gRNA
auagcccugguaucagaagc

SEQ ID NO: 122219 - RNA, 20 nt, Artificial Sequence
  MKO10122219_B_Tmem63b
  gRNA
cguagucccaggccaccuuc

SEQ ID NO: 122220 - RNA, 20 nt, Artificial Sequence
  MKO10122220_B_Tmem63b
  gRNA
ggacacucacauugucccuu

SEQ ID NO: 122221 - RNA, 20 nt, Artificial Sequence
  MKO10122221_B_Tmem63b
  gRNA
cacuuacuuuauccugaaga

SEQ ID NO: 122222 - RNA, 20 nt, Artificial Sequence
  MKO10122222_B_Tmem63c
  gRNA
cauccccgcauuuguugauc

SEQ ID NO: 122223 - RNA, 20 nt, Artificial Sequence
  MKO10122223_B_Tmem63c
  gRNA
cacugcugauacacaacgac

SEQ ID NO: 122224 - RNA, 20 nt, Artificial Sequence
  MKO10122224_B_Tmem63c
  gRNA
ugagaagucaucuccgucag

SEQ ID NO: 122225 - RNA, 20 nt, Artificial Sequence
  MKO10122225_B_Tmem64
  gRNA
ucaauuccacuugagcgcga

SEQ ID NO: 122226 - RNA, 20 nt, Artificial Sequence
  MKO10122226_B_Tmem64
  gRNA
aucuuccauaguccguagug

SEQ ID NO: 122227 - RNA, 20 nt, Artificial Sequence
  MKO10122227_B_Tmem64
  gRNA
gcccagcugaagacgccauc

SEQ ID NO: 122228 - RNA, 20 nt, Artificial Sequence
  MKO10122228_B_Tmem65
  gRNA
uuccaauagacaauucaauu

SEQ ID NO: 122229 - RNA, 20 nt, Artificial Sequence
  MKO10122229_B_Tmem65
  gRNA
acccaaauugaauugucuau

SEQ ID NO: 122230 - RNA, 20 nt, Artificial Sequence
  MKO10122230_B_Tmem65
  gRNA
gaagcucuaccacccacucc

SEQ ID NO: 122231 - RNA, 20 nt, Artificial Sequence
  MKO10122231_B_Tmem66
  gRNA
uaaguuguacuccaagccgc

SEQ ID NO: 122232 - RNA, 20 nt, Artificial Sequence
  MKO10122232_B_Tmem66
  gRNA
cgacgccuuucucagacucg

SEQ ID NO: 122233 - RNA, 20 nt, Artificial Sequence
  MKO10122233_B_Tmem66
  gRNA
cagucgggccuacucacccc

SEQ ID NO: 122234 - RNA, 20 nt, Artificial Sequence
  MKO10122234_B_Tmem67
  gRNA
gacugcauuucuuguccuag

SEQ ID NO: 122235 - RNA, 20 nt, Artificial Sequence
  MKO10122235_B_Tmem67
  gRNA
uagaaaggcguuacuaaaga

SEQ ID NO: 122236 - RNA, 20 nt, Artificial Sequence
  MKO10122236_B_Tmem67
  gRNA
acuuccuguguaugucuacc

SEQ ID NO: 122237 - RNA, 20 nt, Artificial Sequence
  MKO10122237_B_Tmem68
  gRNA
uaaucguaaaggcuuugcuc

SEQ ID NO: 122238 - RNA, 20 nt, Artificial Sequence
  MKO10122238_B_Tmem68
  gRNA
uuuacacaaaauauucgaga

SEQ ID NO: 122239 - RNA, 20 nt, Artificial Sequence
  MKO10122239_B_Tmem68
  gRNA
cucggcaaguucugccuuuc

SEQ ID NO: 122240 - RNA, 20 nt, Artificial Sequence
  MKO10122240_B_Tmem69
  gRNA
cacuucauccagaaaguuuc

SEQ ID NO: 122241 - RNA, 20 nt, Artificial Sequence
  MKO10122241_B_Tmem69
  gRNA
cguccuagcuuucacucaga

SEQ ID NO: 122242 - RNA, 20 nt, Artificial Sequence
  MKO10122242_B_Tmem69
  gRNA
ucuuaccacauuaucccaac

SEQ ID NO: 122243 - RNA, 20 nt, Artificial Sequence
  MKO10122243_B_Tmem70
  gRNA
acuacucaccaaauaucguu

SEQ ID NO: 122244 - RNA, 20 nt, Artificial Sequence
  MKO10122244_B_Tmem70
  gRNA
ccguaaaauaagacuugcaa

SEQ ID NO: 122245 - RNA, 20 nt, Artificial Sequence
  MKO10122245_B_Tmem70
  gRNA
gcugauuuauacuggaaacc

SEQ ID NO: 122246 - RNA, 20 nt, Artificial Sequence
  MKO10122246_B_Tmem71
  gRNA
agcccccgacuccucaccaa

SEQ ID NO: 122247 - RNA, 20 nt, Artificial Sequence
  MKO10122247_B_Tmem71
  gRNA
aguugacucacucccaagug

SEQ ID NO: 122248 - RNA, 20 nt, Artificial Sequence
  MKO10122248_B_Tmem71
  gRNA
gcacuucgaaaagaacaguu

SEQ ID NO: 122249 - RNA, 20 nt, Artificial Sequence
  MKO10122249_B_Tmem72
  gRNA
gcaccgagaccuuccuccgg

SEQ ID NO: 122250 - RNA, 20 nt, Artificial Sequence
  MKO10122250_B_Tmem72
  gRNA
cgccuacaugcugcugucag

SEQ ID NO: 122251 - RNA, 20 nt, Artificial Sequence
  MKO10122251_B_Tmem72
  gRNA
cuacuuuguggcucaacucu

SEQ ID NO: 122252 - RNA, 20 nt, Artificial Sequence
  MKO10122252_B_Tmem74b
  gRNA
agcauacgccaucccccgag

SEQ ID NO: 122253 - RNA, 20 nt, Artificial Sequence
  MKO10122253_B_Tmem74b
  gRNA
agggccccguggcgccaccc

SEQ ID NO: 122254 - RNA, 20 nt, Artificial Sequence
  MKO10122254_B_Tmem74b
  gRNA
gguaacgcccccaguccccc

SEQ ID NO: 122255 - RNA, 20 nt, Artificial Sequence
  MKO10122255_B_Tmem74
  gRNA
gaacaacucccccgagagug

SEQ ID NO: 122256 - RNA, 20 nt, Artificial Sequence
  MKO10122256_B_Tmem74
  gRNA
gauccacugucaccucccga

SEQ ID NO: 122257 - RNA, 20 nt, Artificial Sequence
  MKO10122257_B_Tmem74
  gRNA
caaacaagcuucucccuauc

SEQ ID NO: 122258 - RNA, 20 nt, Artificial Sequence
  MKO10122258_B_Tmem79
  gRNA
aggguaguccaagcggcucu

SEQ ID NO: 122259 - RNA, 20 nt, Artificial Sequence
  MKO10122259_B_Tmem79
  gRNA
uggaucuccacuucccgccu

SEQ ID NO: 122260 - RNA, 20 nt, Artificial Sequence
  MKO10122260_B_Tmem79
  gRNA
ccgagauauggcaaagagac

SEQ ID NO: 122261 - RNA, 20 nt, Artificial Sequence
  MKO10122261_B_Tmem80
  gRNA
cagaugcuguuucaccucag

SEQ ID NO: 122262 - RNA, 20 nt, Artificial Sequence
  MKO10122262_B_Tmem80
  gRNA
aaaguagcucagcucuaccu

SEQ ID NO: 122263 - RNA, 20 nt, Artificial Sequence
  MKO10122263_B_Tmem80
  gRNA
gggcagaguacagcccacug

SEQ ID NO: 122264 - RNA, 20 nt, Artificial Sequence
  MKO10122264_B_Tmem81
  gRNA
aagccuccaggugaagcgga

SEQ ID NO: 122265 - RNA, 20 nt, Artificial Sequence
  MKO10122265_B_Tmem81
  gRNA
aggaagccuuccgcuucacc

SEQ ID NO: 122266 - RNA, 20 nt, Artificial Sequence
  MKO10122266_B_Tmem81
  gRNA
cgagccaauucccccuuuau

SEQ ID NO: 122267 - RNA, 20 nt, Artificial Sequence
  MKO10122267_B_Tmem82
  gRNA
ccaugcgcaccagcaccguc

SEQ ID NO: 122268 - RNA, 20 nt, Artificial Sequence
  MKO10122268_B_Tmem82
  gRNA
ccagacggugcuggugcgca

SEQ ID NO: 122269 - RNA, 20 nt, Artificial Sequence
  MKO10122269_B_Tmem82
  gRNA
gucuggcucaggcuugaucg

SEQ ID NO: 122270 - RNA, 20 nt, Artificial Sequence
  MKO10122270_B_Tmem86a
  gRNA
agacaagucccacgaagaug

SEQ ID NO: 122271 - RNA, 20 nt, Artificial Sequence
  MKO10122271_B_Tmem86a
  gRNA
cgcgcacucaccacagugac

SEQ ID NO: 122272 - RNA, 20 nt, Artificial Sequence
  MKO10122272_B_Tmem86a
  gRNA
cgccgccgccauggugucuc

SEQ ID NO: 122273 - RNA, 20 nt, Artificial Sequence
  MKO10122273_B_Tmem86b
  gRNA
gucuugcccgugauggccua

SEQ ID NO: 122274 - RNA, 20 nt, Artificial Sequence
  MKO10122274_B_Tmem86b
  gRNA
ggucugaaaagagugucucc

SEQ ID NO: 122275 - RNA, 20 nt, Artificial Sequence
  MKO10122275_B_Tmem86b
  gRNA
cagcauggaugcuagaaaag

SEQ ID NO: 122276 - RNA, 20 nt, Artificial Sequence
  MKO10122276_B_Tmem87a
  gRNA
accagucuuuaaauauaacc

SEQ ID NO: 122277 - RNA, 20 nt, Artificial Sequence
  MKO10122277_B_Tmem87a
  gRNA
agaugaaauagagucauacu

SEQ ID NO: 122278 - RNA, 20 nt, Artificial Sequence
  MKO10122278_B_Tmem87a
  gRNA
auauuuaaagacuggucaca

SEQ ID NO: 122279 - RNA, 20 nt, Artificial Sequence
  MKO10122279_B_Tmem87b
  gRNA
ucacuuaccuccuccagauc

SEQ ID NO: 122280 - RNA, 20 nt, Artificial Sequence
  MKO10122280_B_Tmem87b
  gRNA
cagauacucacauucaauga

SEQ ID NO: 122281 - RNA, 20 nt, Artificial Sequence
  MKO10122281_B_Tmem87b
  gRNA
uuccagaauaaagaacuaac

SEQ ID NO: 122282 - RNA, 20 nt, Artificial Sequence
  MKO10122282_B_Tmem88b
  gRNA
ugcucacccuugagugacac

SEQ ID NO: 122283 - RNA, 20 nt, Artificial Sequence
  MKO10122283_B_Tmem88b
  gRNA
uccgaacacaaugagcgccg

SEQ ID NO: 122284 - RNA, 20 nt, Artificial Sequence
  MKO10122284_B_Tmem88b
  gRNA
agcagcggagaucuggccga

SEQ ID NO: 122285 - RNA, 20 nt, Artificial Sequence
  MKO10122285_B_Tmem88
  gRNA
cccgcagaugcgaggugcaa

SEQ ID NO: 122286 - RNA, 20 nt, Artificial Sequence
  MKO10122286_B_Tmem88
  gRNA
cucgggauccccuagauugc

SEQ ID NO: 122287 - RNA, 20 nt, Artificial Sequence
  MKO10122287_B_Tmem88
  gRNA
cucugggccgccagcgagaa

SEQ ID NO: 122288 - RNA, 20 nt, Artificial Sequence
  MKO10122288_B_Tmem89
  gRNA
ggauggcguccagcauguga

SEQ ID NO: 122289 - RNA, 20 nt, Artificial Sequence
  MKO10122289_B_Tmem89
  gRNA
agcuaagguugcuaaggguc

SEQ ID NO: 122290 - RNA, 20 nt, Artificial Sequence
  MKO10122290_B_Tmem89
  gRNA
agccaaacagcccagauauc

SEQ ID NO: 122291 - RNA, 20 nt, Artificial Sequence
  MKO10122291_B_Tmem8b
  gRNA
ugugcggugccgcaaugcaa

SEQ ID NO: 122292 - RNA, 20 nt, Artificial Sequence
  MKO10122292_B_Tmem8b
  gRNA
aggaaccagguccccgucug

SEQ ID NO: 122293 - RNA, 20 nt, Artificial Sequence
  MKO10122293_B_Tmem8b
  gRNA
ucgaaucccauucccacaga

SEQ ID NO: 122294 - RNA, 20 nt, Artificial Sequence
  MKO10122294_B_Tmem8c
  gRNA
cggccugugcuuuggggccc

SEQ ID NO: 122295 - RNA, 20 nt, Artificial Sequence
  MKO10122295_B_Tmem8c
  gRNA
guggagaaggucagcuuggc

SEQ ID NO: 122296 - RNA, 20 nt, Artificial Sequence
  MKO10122296_B_Tmem8c
  gRNA
caaagaagaaucgaagcauc

SEQ ID NO: 122297 - RNA, 20 nt, Artificial Sequence
  MKO10122297_B_Tmem8
  gRNA
acccucauuaccagcauauc

SEQ ID NO: 122298 - RNA, 20 nt, Artificial Sequence
  MKO10122298_B_Tmem8
  gRNA
cuuccacuuccgcgugcccc

SEQ ID NO: 122299 - RNA, 20 nt, Artificial Sequence
  MKO10122299_B_Tmem8
  gRNA
gccacgccuccuuccauauc

SEQ ID NO: 122300 - RNA, 20 nt, Artificial Sequence
  MKO10122300_B_Tmem91
  gRNA
cauggacaacuccagcauac

SEQ ID NO: 122301 - RNA, 20 nt, Artificial Sequence
  MKO10122301_B_Tmem91
  gRNA
gggcaucgcugccuucuguc

SEQ ID NO: 122302 - RNA, 20 nt, Artificial Sequence
  MKO10122302_B_Tmem91
  gRNA
gaugcuccuaccucaaaguc

SEQ ID NO: 122303 - RNA, 20 nt, Artificial Sequence
  MKO10122303_B_Tmem92
  gRNA
cccuagguucuuggucaucc

SEQ ID NO: 122304 - RNA, 20 nt, Artificial Sequence
  MKO10122304_B_Tmem92
  gRNA
uugacaggaugcuggacacc

SEQ ID NO: 122305 - RNA, 20 nt, Artificial Sequence
  MKO10122305_B_Tmem92
  gRNA
ccucauugaagcuuacuccu

SEQ ID NO: 122306 - RNA, 20 nt, Artificial Sequence
  MKO10122306_B_Tmem95
  gRNA
agaccucaccuaugacucuc

SEQ ID NO: 122307 - RNA, 20 nt, Artificial Sequence
  MKO10122307_B_Tmem95
  gRNA
ccuccuugauuccauuauac

SEQ ID NO: 122308 - RNA, 20 nt, Artificial Sequence
  MKO10122308_B_Tmem95
  gRNA
caccgaguccugagagucau

SEQ ID NO: 122309 - RNA, 20 nt, Artificial Sequence
  MKO10122309_B_Tmem97
  gRNA
gccgcccgaacuauacccgc

SEQ ID NO: 122310 - RNA, 20 nt, Artificial Sequence
  MKO10122310_B_Tmem97
  gRNA
cgugaacgacugacccucgu

SEQ ID NO: 122311 - RNA, 20 nt, Artificial Sequence
  MKO10122311_B_Tmem97
  gRNA
cagucguucacggaaacucu

SEQ ID NO: 122312 - RNA, 20 nt, Artificial Sequence
  MKO10122312_B_Tmem98
  gRNA
ccuucaagauggcgaugcag

SEQ ID NO: 122313 - RNA, 20 nt, Artificial Sequence
  MKO10122313_B_Tmem98
  gRNA
aggcccaucguggaccucau

SEQ ID NO: 122314 - RNA, 20 nt, Artificial Sequence
  MKO10122314_B_Tmem98
  gRNA
cucccucucaccgugcaucc

SEQ ID NO: 122315 - RNA, 20 nt, Artificial Sequence
  MKO10122315_B_Tmem9b
  gRNA
uggaguacgcucagcagcgc

SEQ ID NO: 122316 - RNA, 20 nt, Artificial Sequence
  MKO10122316_B_Tmem9b
  gRNA
uugcagagcgaugaugacgu

SEQ ID NO: 122317 - RNA, 20 nt, Artificial Sequence
  MKO10122317_B_Tmem9b
  gRNA
cuccaccuuguuuagaacau

SEQ ID NO: 122318 - RNA, 20 nt, Artificial Sequence
  MKO10122318_B_Tmem9
  gRNA
acagccgcugcguccauugg

SEQ ID NO: 122319 - RNA, 20 nt, Artificial Sequence
  MKO10122319_B_Tmem9
  gRNA
uaggcuuccacaucguggcc

SEQ ID NO: 122320 - RNA, 20 nt, Artificial Sequence
  MKO10122320_B_Tmem9
  gRNA
auugugcagcugcucaguau

SEQ ID NO: 122321 - RNA, 20 nt, Artificial Sequence
  MKO10122321_B_Tmf1
  gRNA
uugacuacuauuuaaucuag

SEQ ID NO: 122322 - RNA, 20 nt, Artificial Sequence
  MKO10122322_B_Tmf1
  gRNA
gaaaguucaacuagccugca

SEQ ID NO: 122323 - RNA, 20 nt, Artificial Sequence
  MKO10122323_B_Tmf1
  gRNA
agcagcaucucucuccuugc

SEQ ID NO: 122324 - RNA, 20 nt, Artificial Sequence
  MKO10122324_B_Tmie
  gRNA
agcauggcucggggcggcuc

SEQ ID NO: 122325 - RNA, 20 nt, Artificial Sequence
  MKO10122325_B_Tmie
  gRNA
agaugcccaccacgugccac

SEQ ID NO: 122326 - RNA, 20 nt, Artificial Sequence
  MKO10122326_B_Tmie
  gRNA
uguucugggacaugcgccug

SEQ ID NO: 122327 - RNA, 20 nt, Artificial Sequence
  MKO10122327_B_Tmigd1
  gRNA
caauggcuuccaaaccgugg

SEQ ID NO: 122328 - RNA, 20 nt, Artificial Sequence
  MKO10122328_B_Tmigd1
  gRNA
caucauugcugcuugugucg

SEQ ID NO: 122329 - RNA, 20 nt, Artificial Sequence
  MKO10122329_B_Tmigd1
  gRNA
cacgacacaagcagcaauga

SEQ ID NO: 122330 - RNA, 20 nt, Artificial Sequence
  MKO10122330_B_Tmlhe
  gRNA
aguuguugcaccaacaaagc

SEQ ID NO: 122331 - RNA, 20 nt, Artificial Sequence
  MKO10122331_B_Tmlhe
  gRNA
uaucuagucacaugaccauc

SEQ ID NO: 122332 - RNA, 20 nt, Artificial Sequence
  MKO10122332_B_Tmlhe
  gRNA
augccggucuagagcuagcu

SEQ ID NO: 122333 - RNA, 20 nt, Artificial Sequence
  MKO10122333_B_Tmod1
  gRNA
ccaaggcuugguaguacugc

SEQ ID NO: 122334 - RNA, 20 nt, Artificial Sequence
  MKO10122334_B_Tmod1
  gRNA
ccacuuggaaaagcaagcga

SEQ ID NO: 122335 - RNA, 20 nt, Artificial Sequence
  MKO10122335_B_Tmod1
  gRNA
accaaauucaacagacguag

SEQ ID NO: 122336 - RNA, 20 nt, Artificial Sequence
  MKO10122336_B_Tmod2
  gRNA
gccaccgaaccccacaaaug

SEQ ID NO: 122337 - RNA, 20 nt, Artificial Sequence
  MKO10122337_B_Tmod2
  gRNA
cagagugcaacgcuaccugc

SEQ ID NO: 122338 - RNA, 20 nt, Artificial Sequence
  MKO10122338_B_Tmod2
  gRNA
uuugaugaagagacgaccaa

SEQ ID NO: 122339 - RNA, 20 nt, Artificial Sequence
  MKO10122339_B_Tmod3
  gRNA
gacgauuaugugcccuacac

SEQ ID NO: 122340 - RNA, 20 nt, Artificial Sequence
  MKO10122340_B_Tmod3
  gRNA
aaggagccguucucuaucaa

SEQ ID NO: 122341 - RNA, 20 nt, Artificial Sequence
  MKO10122341_B_Tmod3
  gRNA
ucuucuguaagagucugcgc

SEQ ID NO: 122342 - RNA, 20 nt, Artificial Sequence
  MKO10122342_B_Tmod4
  gRNA
agucaaagagcgugaugacu

SEQ ID NO: 122343 - RNA, 20 nt, Artificial Sequence
  MKO10122343_B_Tmod4
  gRNA
uuuggagguucaucugguac

SEQ ID NO: 122344 - RNA, 20 nt, Artificial Sequence
  MKO10122344_B_Tmod4
  gRNA
gauuacgcuggagccugagc

SEQ ID NO: 122345 - RNA, 20 nt, Artificial Sequence
  MKO10122345_B_Tmpo
  gRNA
auacaccuggauccgaacau

SEQ ID NO: 122346 - RNA, 20 nt, Artificial Sequence
  MKO10122346_B_Tmpo
  gRNA
guaagauauggagugaaucc

SEQ ID NO: 122347 - RNA, 20 nt, Artificial Sequence
  MKO10122347_B_Tmpo
  gRNA
cccuuacccacaaugggacc

SEQ ID NO: 122348 - RNA, 20 nt, Artificial Sequence
  MKO10122348_B_Tmppe
  gRNA
gguacugagcaccgccguca

SEQ ID NO: 122349 - RNA, 20 nt, Artificial Sequence
  MKO10122349_B_Tmppe
  gRNA
cagaggcuuccgagucggag

SEQ ID NO: 122350 - RNA, 20 nt, Artificial Sequence
  MKO10122350_B_Tmppe
  gRNA
aaggagccacugccguccgc

SEQ ID NO: 122351 - RNA, 20 nt, Artificial Sequence
  MKO10122351_B_Tmprss11a
  gRNA
uguuccagccucccgcuaca

SEQ ID NO: 122352 - RNA, 20 nt, Artificial Sequence
  MKO10122352_B_Tmprss11a
  gRNA
auucaagucaauagcaacuc

SEQ ID NO: 122353 - RNA, 20 nt, Artificial Sequence
  MKO10122353_B_Tmprss11a
  gRNA
aaagagcucaaaucaacuga

SEQ ID NO: 122354 - RNA, 20 nt, Artificial Sequence
  MKO10122354_B_Tmprss11bnl
  gRNA
cccgcaaaucuaucccacca

SEQ ID NO: 122355 - RNA, 20 nt, Artificial Sequence
  MKO10122355_B_Tmprss11bnl
  gRNA
gcagcccuugggauaauuau

SEQ ID NO: 122356 - RNA, 20 nt, Artificial Sequence
  MKO10122356_B_Tmprss11bnl
  gRNA
caaacaauauaucaacucuc

SEQ ID NO: 122357 - RNA, 20 nt, Artificial Sequence
  MKO10122357_B_Tmprss11c
  gRNA
aagcucacacugugcaagua

SEQ ID NO: 122358 - RNA, 20 nt, Artificial Sequence
  MKO10122358_B_Tmprss11c
  gRNA
uguuaaccuuaaagcugaca

SEQ ID NO: 122359 - RNA, 20 nt, Artificial Sequence
  MKO10122359_B_Tmprss11c
  gRNA
cuacuaccaugucagcuuua

SEQ ID NO: 122360 - RNA, 20 nt, Artificial Sequence
  MKO10122360_B_Tmprss11d
  gRNA
aauaaguagaccugccauca

SEQ ID NO: 122361 - RNA, 20 nt, Artificial Sequence
  MKO10122361_B_Tmprss11d
  gRNA
uuacauguuaucucauucga

SEQ ID NO: 122362 - RNA, 20 nt, Artificial Sequence
  MKO10122362_B_Tmprss11d
  gRNA
gacaacgaaagcuacugcaa

SEQ ID NO: 122363 - RNA, 20 nt, Artificial Sequence
  MKO10122363_B_Tmprss11e
  gRNA
ugaaaagcugaaguaugcua

SEQ ID NO: 122364 - RNA, 20 nt, Artificial Sequence
  MKO10122364_B_Tmprss11e
  gRNA
cuccacacacguucucuucc

SEQ ID NO: 122365 - RNA, 20 nt, Artificial Sequence
  MKO10122365_B_Tmprss11e
  gRNA
cauuucauaaaucuccacua

SEQ ID NO: 122366 - RNA, 20 nt, Artificial Sequence
  MKO10122366_B_Tmprss11f
  gRNA
agucccauguuaucaagaua

SEQ ID NO: 122367 - RNA, 20 nt, Artificial Sequence
  MKO10122367_B_Tmprss11f
  gRNA
aagucaucagaucgagagaa

SEQ ID NO: 122368 - RNA, 20 nt, Artificial Sequence
  MKO10122368_B_Tmprss11f
  gRNA
ugcuccaguccagaugaaca

SEQ ID NO: 122369 - RNA, 20 nt, Artificial Sequence
  MKO10122369_B_Tmprss11g
  gRNA
ccaaagagcagucgaaauuu

SEQ ID NO: 122370 - RNA, 20 nt, Artificial Sequence
  MKO10122370_B_Tmprss11g
  gRNA
gacauaaugaugcuuuaaac

SEQ ID NO: 122371 - RNA, 20 nt, Artificial Sequence
  MKO10122371_B_Tmprss11g
  gRNA
uuucuucuaaccaguauucc

SEQ ID NO: 122372 - RNA, 20 nt, Artificial Sequence
  MKO10122372_B_Tmprss12
  gRNA
cccacagccauguccguaac

SEQ ID NO: 122373 - RNA, 20 nt, Artificial Sequence
  MKO10122373_B_Tmprss12
  gRNA
augggaccuuugacucaugc

SEQ ID NO: 122374 - RNA, 20 nt, Artificial Sequence
  MKO10122374_B_Tmprss12
  gRNA
ugauucguauauuccugcug

SEQ ID NO: 122375 - RNA, 20 nt, Artificial Sequence
  MKO10122375_B_Tmprss13
  gRNA
cuccaucacagcgaacugcg

SEQ ID NO: 122376 - RNA, 20 nt, Artificial Sequence
  MKO10122376_B_Tmprss13
  gRNA
auccacgcaguucgcuguga

SEQ ID NO: 122377 - RNA, 20 nt, Artificial Sequence
  MKO10122377_B_Tmprss13
  gRNA
cgggcagaucaucaucugcc

SEQ ID NO: 122378 - RNA, 20 nt, Artificial Sequence
  MKO10122378_B_Tmprss15
  gRNA
uugaacagcauugauaucac

SEQ ID NO: 122379 - RNA, 20 nt, Artificial Sequence
  MKO10122379_B_Tmprss15
  gRNA
agucuccuaccauuugcuga

SEQ ID NO: 122380 - RNA, 20 nt, Artificial Sequence
  MKO10122380_B_Tmprss15
  gRNA
acacccacugagcaaaaaag

SEQ ID NO: 122381 - RNA, 20 nt, Artificial Sequence
  MKO10122381_B_Tmprss2
  gRNA
ugugcucagacugauacccg

SEQ ID NO: 122382 - RNA, 20 nt, Artificial Sequence
  MKO10122382_B_Tmprss2
  gRNA
caacuguucuacgucugaga

SEQ ID NO: 122383 - RNA, 20 nt, Artificial Sequence
  MKO10122383_B_Tmprss2
  gRNA
acgguucucaucuucuccgu

SEQ ID NO: 122384 - RNA, 20 nt, Artificial Sequence
  MKO10122384_B_Tmprss3
  gRNA
guacucacugcccagaccga

SEQ ID NO: 122385 - RNA, 20 nt, Artificial Sequence
  MKO10122385_B_Tmprss3
  gRNA
ggaccaugugcuccgaugac

SEQ ID NO: 122386 - RNA, 20 nt, Artificial Sequence
  MKO10122386_B_Tmprss3
  gRNA
caugggggagaaugacccuc

SEQ ID NO: 122387 - RNA, 20 nt, Artificial Sequence
  MKO10122387_B_Tmprss4
  gRNA
gaaguugucgaaacagacug

SEQ ID NO: 122388 - RNA, 20 nt, Artificial Sequence
  MKO10122388_B_Tmprss4
  gRNA
ugaacuuaccacgguuguug

SEQ ID NO: 122389 - RNA, 20 nt, Artificial Sequence
  MKO10122389_B_Tmprss4
  gRNA
cuucccugaaaagcccggag

SEQ ID NO: 122390 - RNA, 20 nt, Artificial Sequence
  MKO10122390_B_Tmprss5
  gRNA
cuggcuccuggucugccacg

SEQ ID NO: 122391 - RNA, 20 nt, Artificial Sequence
  MKO10122391_B_Tmprss5
  gRNA
ugcucaacucucugcuagac

SEQ ID NO: 122392 - RNA, 20 nt, Artificial Sequence
  MKO10122392_B_Tmprss5
  gRNA
cuugaugucagacagauuca

SEQ ID NO: 122393 - RNA, 20 nt, Artificial Sequence
  MKO10122393_B_Tmprss6
  gRNA
accguaagccagguguacuc

SEQ ID NO: 122394 - RNA, 20 nt, Artificial Sequence
  MKO10122394_B_Tmprss6
  gRNA
uacgacuaugucguucacac

SEQ ID NO: 122395 - RNA, 20 nt, Artificial Sequence
  MKO10122395_B_Tmprss6
  gRNA
uagaguuguaguaaguaccc

SEQ ID NO: 122396 - RNA, 20 nt, Artificial Sequence
  MKO10122396_B_Tmprss7
  gRNA
gcaagcuccccacagaagug

SEQ ID NO: 122397 - RNA, 20 nt, Artificial Sequence
  MKO10122397_B_Tmprss7
  gRNA
gucuagggaauuucucucca

SEQ ID NO: 122398 - RNA, 20 nt, Artificial Sequence
  MKO10122398_B_Tmprss7
  gRNA
cacagacugcuuauaaaauu

SEQ ID NO: 122399 - RNA, 20 nt, Artificial Sequence
  MKO10122399_B_Tmprss9
  gRNA
ucugcagagcaugcgugagu

SEQ ID NO: 122400 - RNA, 20 nt, Artificial Sequence
  MKO10122400_B_Tmprss9
  gRNA
gcucugcuaugugcuccacg

SEQ ID NO: 122401 - RNA, 20 nt, Artificial Sequence
  MKO10122401_B_Tmprss9
  gRNA
agcucaccuguaacuaagca

SEQ ID NO: 122402 - RNA, 20 nt, Artificial Sequence
  MKO10122402_B_Tmsb10
  gRNA
ggaaaucgccagcuucgaua

SEQ ID NO: 122403 - RNA, 20 nt, Artificial Sequence
  MKO10122403_B_Tmsb10
  gRNA
gguguucuucuccugcgucu

SEQ ID NO: 122404 - RNA, 20 nt, Artificial Sequence
  MKO10122404_B_Tmsb10
  gRNA
gcugaagaaaaccgagacgc

SEQ ID NO: 122405 - RNA, 20 nt, Artificial Sequence
  MKO10122405_B_Tmsb15a
  gRNA
ccuagccaucgagcaagaga

SEQ ID NO: 122406 - RNA, 20 nt, Artificial Sequence
  MKO10122406_B_Tmsb15a
  gRNA
cucuccacuuccgacaaguc

SEQ ID NO: 122407 - RNA, 20 nt, Artificial Sequence
  MKO10122407_B_Tmsb15a
  gRNA
ccacuacuuacuuuccuucg

SEQ ID NO: 122408 - RNA, 20 nt, Artificial Sequence
  MKO10122408_B_Tmsb15b1
  gRNA
guuucaacuucugacaaguc

SEQ ID NO: 122409 - RNA, 20 nt, Artificial Sequence
  MKO10122409_B_Tmsb15b2
  gRNA
cauuguguucuuucucuugc

SEQ ID NO: 122410 - RNA, 20 nt, Artificial Sequence
  MKO10122410_B_Tmsb15b2
  gRNA
guuucaacuucugacaaguc

SEQ ID NO: 122411 - RNA, 20 nt, Artificial Sequence
  MKO10122411_B_Tmsb15l
  gRNA
cauuguguucuuucucuugc

SEQ ID NO: 122412 - RNA, 20 nt, Artificial Sequence
  MKO10122412_B_Tmsb15l
  gRNA
guuucaacuucugacaaguc

SEQ ID NO: 122413 - RNA, 20 nt, Artificial Sequence
  MKO10122413_B_Tmsb4x
  gRNA
auugaacaagagaagcaagc

SEQ ID NO: 122414 - RNA, 20 nt, Artificial Sequence
  MKO10122414_B_Tmuc1
  gRNA
uuucuagguggcuggcaucg

SEQ ID NO: 122415 - RNA, 20 nt, Artificial Sequence
  MKO10122415_B_Tmuc1
  gRNA
aagaagggggaagccguugu

SEQ ID NO: 122416 - RNA, 20 nt, Artificial Sequence
  MKO10122416_B_Tmuc1
  gRNA
aaccaagcacacuccaaaca

SEQ ID NO: 122417 - RNA, 20 nt, Artificial Sequence
  MKO10122417_B_Tmuc2
  gRNA
gagaacucagcucccgucca

SEQ ID NO: 122418 - RNA, 20 nt, Artificial Sequence
  MKO10122418_B_Tmuc2
  gRNA
cauugggagcaggccuaccc

SEQ ID NO: 122419 - RNA, 20 nt, Artificial Sequence
  MKO10122419_B_Tmuc2
  gRNA
ucuguucuaccgcagcaaca

SEQ ID NO: 122420 - RNA, 20 nt, Artificial Sequence
  MKO10122420_B_Tmuc3
  gRNA
uauguaccuauggaauuauc

SEQ ID NO: 122421 - RNA, 20 nt, Artificial Sequence
  MKO10122421_B_Tmuc3
  gRNA
uaauuauuuaccucagacau

SEQ ID NO: 122422 - RNA, 20 nt, Artificial Sequence
  MKO10122422_B_Tmuc3
  gRNA
uuccaggucacagguguugu

SEQ ID NO: 122423 - RNA, 20 nt, Artificial Sequence
  MKO10122423_B_Tmuc4
  gRNA
cuccagucagacacgccccu

SEQ ID NO: 122424 - RNA, 20 nt, Artificial Sequence
  MKO10122424_B_Tmuc4
  gRNA
gauacucagcaauacccaga

SEQ ID NO: 122425 - RNA, 20 nt, Artificial Sequence
  MKO10122425_B_Tmuc4
  gRNA
uuacuuaccagcagguaaca

SEQ ID NO: 122426 - RNA, 20 nt, Artificial Sequence
  MKO10122426_B_Tmub1
  gRNA
aucgccuacgccuucaauca

SEQ ID NO: 122427 - RNA, 20 nt, Artificial Sequence
  MKO10122427_B_Tmub1
  gRNA
ggggaaagaagggccgguac

SEQ ID NO: 122428 - RNA, 20 nt, Artificial Sequence
  MKO10122428_B_Tmub1
  gRNA
augugggggaccgacucucg

SEQ ID NO: 122429 - RNA, 20 nt, Artificial Sequence
  MKO10122429_B_Tmub2
  gRNA
gcaguggaucacgcaguugu

SEQ ID NO: 122430 - RNA, 20 nt, Artificial Sequence
  MKO10122430_B_Tmub2
  gRNA
uucuucaaaacaaccuuaug

SEQ ID NO: 122431 - RNA, 20 nt, Artificial Sequence
  MKO10122431_B_Tmub2
  gRNA
guggaccagcugguaaacca

SEQ ID NO: 122432 - RNA, 20 nt, Artificial Sequence
  MKO10122432_B_Tmx1
  gRNA
cgaguggggagaagaucuug

SEQ ID NO: 122433 - RNA, 20 nt, Artificial Sequence
  MKO10122433_B_Tmx1
  gRNA
auauugaaccuauaucauca

SEQ ID NO: 122434 - RNA, 20 nt, Artificial Sequence
  MKO10122434_B_Tmx1
  gRNA
aauacuuacugauaaauaga

SEQ ID NO: 122435 - RNA, 20 nt, Artificial Sequence
  MKO10122435_B_Tmx2
  gRNA
auccuuugcucccaucuaug

SEQ ID NO: 122436 - RNA, 20 nt, Artificial Sequence
  MKO10122436_B_Tmx2
  gRNA
gcgguucuucaucaucacaa

SEQ ID NO: 122437 - RNA, 20 nt, Artificial Sequence
  MKO10122437_B_Tmx2
  gRNA
cugcaagcccccgcuguaca

SEQ ID NO: 122438 - RNA, 20 nt, Artificial Sequence
  MKO10122438_B_Tmx3
  gRNA
uugacuuacagcuuaauugu

SEQ ID NO: 122439 - RNA, 20 nt, Artificial Sequence
  MKO10122439_B_Tmx3
  gRNA
caaggcauugcuucagaguu

SEQ ID NO: 122440 - RNA, 20 nt, Artificial Sequence
  MKO10122440_B_Tmx3
  gRNA
guaaaaaguuggaaccaauu

SEQ ID NO: 122441 - RNA, 20 nt, Artificial Sequence
  MKO10122441_B_Tmx4
  gRNA
uuagcaucucuggcaagauu

SEQ ID NO: 122442 - RNA, 20 nt, Artificial Sequence
  MKO10122442_B_Tmx4
  gRNA
guggaugucauucaagagcc

SEQ ID NO: 122443 - RNA, 20 nt, Artificial Sequence
  MKO10122443_B_Tmx4
  gRNA
aaaacuuacugaaaaaaugc

SEQ ID NO: 122444 - RNA, 20 nt, Artificial Sequence
  MKO10122444_B_Tnc
  gRNA
gagaugcaguuccgugugcc

SEQ ID NO: 122445 - RNA, 20 nt, Artificial Sequence
  MKO10122445_B_Tnc
  gRNA
cauucguguguucgccaucu

SEQ ID NO: 122446 - RNA, 20 nt, Artificial Sequence
  MKO10122446_B_Tnc
  gRNA
uagacauugcuuucgaaaca

SEQ ID NO: 122447 - RNA, 20 nt, Artificial Sequence
  MKO10122447_B_Tnfaip1
  gRNA
uuguacagcagcuucaccac

SEQ ID NO: 122448 - RNA, 20 nt, Artificial Sequence
  MKO10122448_B_Tnfaip1
  gRNA
acaguucaauguucuuuagc

SEQ ID NO: 122449 - RNA, 20 nt, Artificial Sequence
  MKO10122449_B_Tnfaip1
  gRNA
augauggggauguugcacac

SEQ ID NO: 122450 - RNA, 20 nt, Artificial Sequence
  MKO10122450_B_Tnfaip2
  gRNA
ggccauguucuuguccaaug

SEQ ID NO: 122451 - RNA, 20 nt, Artificial Sequence
  MKO10122451_B_Tnfaip2
  gRNA
uauucucaacagcccgaagu

SEQ ID NO: 122452 - RNA, 20 nt, Artificial Sequence
  MKO10122452_B_Tnfaip2
  gRNA
ucccugcagaucauuucaca

SEQ ID NO: 122453 - RNA, 20 nt, Artificial Sequence
  MKO10122453_B_Tnfaip3
  gRNA
cucggaacuuuaaauuccgc

SEQ ID NO: 122454 - RNA, 20 nt, Artificial Sequence
  MKO10122454_B_Tnfaip3
  gRNA
caggacuuugcuacgacacu

SEQ ID NO: 122455 - RNA, 20 nt, Artificial Sequence
  MKO10122455_B_Tnfaip3
  gRNA
cuuacuuugcagcguugauc

SEQ ID NO: 122456 - RNA, 20 nt, Artificial Sequence
  MKO10122456_B_Tnfaip6
  gRNA
uggcacauucggcucaagua

SEQ ID NO: 122457 - RNA, 20 nt, Artificial Sequence
  MKO10122457_B_Tnfaip6
  gRNA
cgcaaccuacaagcagcuag

SEQ ID NO: 122458 - RNA, 20 nt, Artificial Sequence
  MKO10122458_B_Tnfaip6
  gRNA
gacaguuaugaugacgucca

SEQ ID NO: 122459 - RNA, 20 nt, Artificial Sequence
  MKO10122459_B_Tnfaip8l1
  gRNA
guucacgcgcagccggaagg

SEQ ID NO: 122460 - RNA, 20 nt, Artificial Sequence
  MKO10122460_B_Tnfaip8l1
  gRNA
ugaacuguaccaggccacga

SEQ ID NO: 122461 - RNA, 20 nt, Artificial Sequence
  MKO10122461_B_Tnfaip8l1
  gRNA
cucugcugggcuguacagcg

SEQ ID NO: 122462 - RNA, 20 nt, Artificial Sequence
  MKO10122462_B_Tnfaip8l2
  gRNA
cacgauuucgucagaagcua

SEQ ID NO: 122463 - RNA, 20 nt, Artificial Sequence
  MKO10122463_B_Tnfaip8l2
  gRNA
ccaaagaauacacgcacagc

SEQ ID NO: 122464 - RNA, 20 nt, Artificial Sequence
  MKO10122464_B_Tnfaip8l2
  gRNA
gaucaaacacgugccugaug

SEQ ID NO: 122465 - RNA, 20 nt, Artificial Sequence
  MKO10122465_B_Tnfaip8l3
  gRNA
cacaguauggauucagauuc

SEQ ID NO: 122466 - RNA, 20 nt, Artificial Sequence
  MKO10122466_B_Tnfaip8l3
  gRNA
uccaugcggaccauagagag

SEQ ID NO: 122467 - RNA, 20 nt, Artificial Sequence
  MKO10122467_B_Tnfaip8l3
  gRNA
gaaccagacugcgaugacca

SEQ ID NO: 122468 - RNA, 20 nt, Artificial Sequence
  MKO10122468_B_Tnfaip8
  gRNA
ccucacguccauguccgugg

SEQ ID NO: 122469 - RNA, 20 nt, Artificial Sequence
  MKO10122469_B_Tnfaip8
  gRNA
ggcagucaaaccgaaugcuc

SEQ ID NO: 122470 - RNA, 20 nt, Artificial Sequence
  MKO10122470_B_Tnfaip8
  gRNA
acagaucgucauugaccuuc

SEQ ID NO: 122471 - RNA, 20 nt, Artificial Sequence
  MKO10122471_B_Tnfrsf10b
  gRNA
agugugucuccaaaacggcu

SEQ ID NO: 122472 - RNA, 20 nt, Artificial Sequence
  MKO10122472_B_Tnfrsf10b
  gRNA
ccaagaugcccaagccguuu

SEQ ID NO: 122473 - RNA, 20 nt, Artificial Sequence
  MKO10122473_B_Tnfrsf10b
  gRNA
aguucccuucugacagguac

SEQ ID NO: 122474 - RNA, 20 nt, Artificial Sequence
  MKO10122474_B_Tnfrsf11a
  gRNA
cagacugcgagugcugccgc

SEQ ID NO: 122475 - RNA, 20 nt, Artificial Sequence
  MKO10122475_B_Tnfrsf11a
  gRNA
uguugcagcagaugcgaacc

SEQ ID NO: 122476 - RNA, 20 nt, Artificial Sequence
  MKO10122476_B_Tnfrsf11a
  gRNA
guugacagugcagcucaaca

SEQ ID NO: 122477 - RNA, 20 nt, Artificial Sequence
  MKO10122477_B_Tnfrsf11b
  gRNA
cuaccaagauuauaccaaau

SEQ ID NO: 122478 - RNA, 20 nt, Artificial Sequence
  MKO10122478_B_Tnfrsf11b
  gRNA
uugcaaacuguguuucgcuc

SEQ ID NO: 122479 - RNA, 20 nt, Artificial Sequence
  MKO10122479_B_Tnfrsf11b
  gRNA
uccauaaacugaguagcuuc

SEQ ID NO: 122480 - RNA, 20 nt, Artificial Sequence
  MKO10122480_B_Tnfrsf12a
  gRNA
acuaagagcgccccccagaa

SEQ ID NO: 122481 - RNA, 20 nt, Artificial Sequence
  MKO10122481_B_Tnfrsf12a
  gRNA
cgcggaccucgacaagugca

SEQ ID NO: 122482 - RNA, 20 nt, Artificial Sequence
  MKO10122482_B_Tnfrsf12a
  gRNA
uagaaaccagcgccaaaacc

SEQ ID NO: 122483 - RNA, 20 nt, Artificial Sequence
  MKO10122483_B_Tnfrsf13b
  gRNA
cagguacuacgaccaucucc

SEQ ID NO: 122484 - RNA, 20 nt, Artificial Sequence
  MKO10122484_B_Tnfrsf13b
  gRNA
aucaauugccgaaaagagca

SEQ ID NO: 122485 - RNA, 20 nt, Artificial Sequence
  MKO10122485_B_Tnfrsf13b
  gRNA
ucugccccaaagaucaguac

SEQ ID NO: 122486 - RNA, 20 nt, Artificial Sequence
  MKO10122486_B_Tnfrsf13c
  gRNA
gacuccggguccgaagccag

SEQ ID NO: 122487 - RNA, 20 nt, Artificial Sequence
  MKO10122487_B_Tnfrsf13c
  gRNA
ccugccacgccacagcgucc

SEQ ID NO: 122488 - RNA, 20 nt, Artificial Sequence
  MKO10122488_B_Tnfrsf13c
  gRNA
cccaguucuguggcgggcac

SEQ ID NO: 122489 - RNA, 20 nt, Artificial Sequence
  MKO10122489_B_Tnfrsf14
  gRNA
ucaccuacuugguccagggc

SEQ ID NO: 122490 - RNA, 20 nt, Artificial Sequence
  MKO10122490_B_Tnfrsf14
  gRNA
acucccaccuggguugcaca

SEQ ID NO: 122491 - RNA, 20 nt, Artificial Sequence
  MKO10122491_B_Tnfrsf14
  gRNA
acuugcucaggccauuugca

SEQ ID NO: 122492 - RNA, 20 nt, Artificial Sequence
  MKO10122492_B_Tnfrsf17
  gRNA
gcuuugaggcucguccuuca

SEQ ID NO: 122493 - RNA, 20 nt, Artificial Sequence
  MKO10122493_B_Tnfrsf17
  gRNA
cacuuacuuggaucacagua

SEQ ID NO: 122494 - RNA, 20 nt, Artificial Sequence
  MKO10122494_B_Tnfrsf17
  gRNA
gacugucaaaauauucacug

SEQ ID NO: 122495 - RNA, 20 nt, Artificial Sequence
  MKO10122495_B_Tnfrsf18
  gRNA
caucgagacuccauacagca

SEQ ID NO: 122496 - RNA, 20 nt, Artificial Sequence
  MKO10122496_B_Tnfrsf18
  gRNA
uaccuugagacuccacccuc

SEQ ID NO: 122497 - RNA, 20 nt, Artificial Sequence
  MKO10122497_B_Tnfrsf18
  gRNA
aggucagccgaguguaguug

SEQ ID NO: 122498 - RNA, 20 nt, Artificial Sequence
  MKO10122498_B_Tnfrsf19
  gRNA
ucacucacagugugguucgu

SEQ ID NO: 122499 - RNA, 20 nt, Artificial Sequence
  MKO10122499_B_Tnfrsf19
  gRNA
gcagccagcgccgugucccg

SEQ ID NO: 122500 - RNA, 20 nt, Artificial Sequence
  MKO10122500_B_Tnfrsf19
  gRNA
guaacucucagguaccagca

SEQ ID NO: 122501 - RNA, 20 nt, Artificial Sequence
  MKO10122501_B_Tnfrsf1a
  gRNA
ugcugcaccaagugccacaa

SEQ ID NO: 122502 - RNA, 20 nt, Artificial Sequence
  MKO10122502_B_Tnfrsf1a
  gRNA
aggggcugcaguccacgcac

SEQ ID NO: 122503 - RNA, 20 nt, Artificial Sequence
  MKO10122503_B_Tnfrsf1a
  gRNA
cggacagucacucaccaagu

SEQ ID NO: 122504 - RNA, 20 nt, Artificial Sequence
  MKO10122504_B_Tnfrsf1b
  gRNA
agcucaaacauguacgaaac

SEQ ID NO: 122505 - RNA, 20 nt, Artificial Sequence
  MKO10122505_B_Tnfrsf1b
  gRNA
ucucuucaaggagccccaaa

SEQ ID NO: 122506 - RNA, 20 nt, Artificial Sequence
  MKO10122506_B_Tnfrsf1b
  gRNA
gaacuggccacuccgaagcc

SEQ ID NO: 122507 - RNA, 20 nt, Artificial Sequence
  MKO10122507_B_Tnfrsf21
  gRNA
uucuuugcaacgccagcgag

SEQ ID NO: 122508 - RNA, 20 nt, Artificial Sequence
  MKO10122508_B_Tnfrsf21
  gRNA
gacaauacgagcucaaccag

SEQ ID NO: 122509 - RNA, 20 nt, Artificial Sequence
  MKO10122509_B_Tnfrsf21
  gRNA
aaauggaucuacuaccgcaa

SEQ ID NO: 122510 - RNA, 20 nt, Artificial Sequence
  MKO10122510_B_Tnfrsf22
  gRNA
agcaaaguauacaagcaucc

SEQ ID NO: 122511 - RNA, 20 nt, Artificial Sequence
  MKO10122511_B_Tnfrsf22
  gRNA
uguugcaagaacuguucugc

SEQ ID NO: 122512 - RNA, 20 nt, Artificial Sequence
  MKO10122512_B_Tnfrsf22
  gRNA
cacagagaaagauaauuacc

SEQ ID NO: 122513 - RNA, 20 nt, Artificial Sequence
  MKO10122513_B_Tnfrsf23
  gRNA
aacagucagccaccauauuc

SEQ ID NO: 122514 - RNA, 20 nt, Artificial Sequence
  MKO10122514_B_Tnfrsf23
  gRNA
agcaaaguucacaaucaugc

SEQ ID NO: 122515 - RNA, 20 nt, Artificial Sequence
  MKO10122515_B_Tnfrsf23
  gRNA
acauucacagggaaagauaa

SEQ ID NO: 122516 - RNA, 20 nt, Artificial Sequence
  MKO10122516_B_Tnfrsf25
  gRNA
ucuggucaagaagguguccg

SEQ ID NO: 122517 - RNA, 20 nt, Artificial Sequence
  MKO10122517_B_Tnfrsf25
  gRNA
gacugcuccaccgagccaug

SEQ ID NO: 122518 - RNA, 20 nt, Artificial Sequence
  MKO10122518_B_Tnfrsf25
  gRNA
uaauuaccuguggugaggcc

SEQ ID NO: 122519 - RNA, 20 nt, Artificial Sequence
  MKO10122519_B_Tnfrsf26
  gRNA
accgucccggcacacagagc

SEQ ID NO: 122520 - RNA, 20 nt, Artificial Sequence
  MKO10122520_B_Tnfrsf26
  gRNA
acuauaacccuguguaagau

SEQ ID NO: 122521 - RNA, 20 nt, Artificial Sequence
  MKO10122521_B_Tnfrsf26
  gRNA
cucacauaggcacuuaccuc

SEQ ID NO: 122522 - RNA, 20 nt, Artificial Sequence
  MKO10122522_B_Tnfrsf4
  gRNA
uuguagccgcuguccugccg

SEQ ID NO: 122523 - RNA, 20 nt, Artificial Sequence
  MKO10122523_B_Tnfrsf4
  gRNA
ugagccgcugugaucauacc

SEQ ID NO: 122524 - RNA, 20 nt, Artificial Sequence
  MKO10122524_B_Tnfrsf4
  gRNA
cugcagacaguauccugagu

SEQ ID NO: 122525 - RNA, 20 nt, Artificial Sequence
  MKO10122525_B_Tnfrsf8
  gRNA
guggcugaggucuccggcac

SEQ ID NO: 122526 - RNA, 20 nt, Artificial Sequence
  MKO10122526_B_Tnfrsf8
  gRNA
cgggcgcaggaauugacugc

SEQ ID NO: 122527 - RNA, 20 nt, Artificial Sequence
  MKO10122527_B_Tnfrsf8
  gRNA
gccugcgugaccuguuugcc

SEQ ID NO: 122528 - RNA, 20 nt, Artificial Sequence
  MKO10122528_B_Tnfrsf9
  gRNA
agguugcaaaaccuguagcu

SEQ ID NO: 122529 - RNA, 20 nt, Artificial Sequence
  MKO10122529_B_Tnfrsf9
  gRNA
uggccaggagcuaacgaagc

SEQ ID NO: 122530 - RNA, 20 nt, Artificial Sequence
  MKO10122530_B_Tnfrsf9
  gRNA
gggaaacaacuguuacaacg

SEQ ID NO: 122531 - RNA, 20 nt, Artificial Sequence
  MKO10122531_B_Tnfsf10
  gRNA
gaagcaagcuaguccaauuu

SEQ ID NO: 122532 - RNA, 20 nt, Artificial Sequence
  MKO10122532_B_Tnfsf10
  gRNA
aguacuccucccuugcccag

SEQ ID NO: 122533 - RNA, 20 nt, Artificial Sequence
  MKO10122533_B_Tnfsf10
  gRNA
ggugacuuugagaaccuuuc

SEQ ID NO: 122534 - RNA, 20 nt, Artificial Sequence
  MKO10122534_B_Tnfsf11
  gRNA
cuucugcacggcccccugaa

SEQ ID NO: 122535 - RNA, 20 nt, Artificial Sequence
  MKO10122535_B_Tnfsf11
  gRNA
ugguuggauguggcccagcg

SEQ ID NO: 122536 - RNA, 20 nt, Artificial Sequence
  MKO10122536_B_Tnfsf11
  gRNA
ggagcuccugagaagcgcug

SEQ ID NO: 122537 - RNA, 20 nt, Artificial Sequence
  MKO10122537_B_Tnfsf12Tnfsf13
  gRNA
agaugcucaccacuucuucg

SEQ ID NO: 122538 - RNA, 20 nt, Artificial Sequence
  MKO10122538_B_Tnfsf12Tnfsf13
  gRNA
agcuauugcagcccauuaug

SEQ ID NO: 122539 - RNA, 20 nt, Artificial Sequence
  MKO10122539_B_Tnfsf12Tnfsf13
  gRNA
accuacucacagggggcucc

SEQ ID NO: 122540 - RNA, 20 nt, Artificial Sequence
  MKO10122540_B_Tnfsf12
  gRNA
agaugcucaccacuucuucg

SEQ ID NO: 122541 - RNA, 20 nt, Artificial Sequence
  MKO10122541_B_Tnfsf12
  gRNA
agcuauugcagcccauuaug

SEQ ID NO: 122542 - RNA, 20 nt, Artificial Sequence
  MKO10122542_B_Tnfsf12
  gRNA
accuacucacagggggcucc

SEQ ID NO: 122543 - RNA, 20 nt, Artificial Sequence
  MKO10122543_B_Tnfsf13b
  gRNA
gaacuuacacauuuguucca

SEQ ID NO: 122544 - RNA, 20 nt, Artificial Sequence
  MKO10122544_B_Tnfsf13b
  gRNA
cuauuucuucaucuacagcc

SEQ ID NO: 122545 - RNA, 20 nt, Artificial Sequence
  MKO10122545_B_Tnfsf13b
  gRNA
cauuaucaucauguugagaa

SEQ ID NO: 122546 - RNA, 20 nt, Artificial Sequence
  MKO10122546_B_Tnfsf13
  gRNA
ugcacuguagcagcuauugu

SEQ ID NO: 122547 - RNA, 20 nt, Artificial Sequence
  MKO10122547_B_Tnfsf13
  gRNA
agauuucgccccauccuucc

SEQ ID NO: 122548 - RNA, 20 nt, Artificial Sequence
  MKO10122548_B_Tnfsf13
  gRNA
ggaaggauggggcgaaaucu

SEQ ID NO: 122549 - RNA, 20 nt, Artificial Sequence
  MKO10122549_B_Tnfsf14
  gRNA
caagacguugaugcagucuc

SEQ ID NO: 122550 - RNA, 20 nt, Artificial Sequence
  MKO10122550_B_Tnfsf14
  gRNA
cucagaucaacgaucucacc

SEQ ID NO: 122551 - RNA, 20 nt, Artificial Sequence
  MKO10122551_B_Tnfsf14
  gRNA
aacccagcagcacaucuuac

SEQ ID NO: 122552 - RNA, 20 nt, Artificial Sequence
  MKO10122552_B_Tnfsf15
  gRNA
uugucauuucccauccucgc

SEQ ID NO: 122553 - RNA, 20 nt, Artificial Sequence
  MKO10122553_B_Tnfsf15
  gRNA
guuacagacucaccucccag

SEQ ID NO: 122554 - RNA, 20 nt, Artificial Sequence
  MKO10122554_B_Tnfsf15
  gRNA
gaacacuuacaaacuugcug

SEQ ID NO: 122555 - RNA, 20 nt, Artificial Sequence
  MKO10122555_B_Tnfsf18
  gRNA
aacugccaucgaguccugca

SEQ ID NO: 122556 - RNA, 20 nt, Artificial Sequence
  MKO10122556_B_Tnfsf18
  gRNA
acugaucuauacuucacuca

SEQ ID NO: 122557 - RNA, 20 nt, Artificial Sequence
  MKO10122557_B_Tnfsf18
  gRNA
ugagagaaucaaguccucaa

SEQ ID NO: 122558 - RNA, 20 nt, Artificial Sequence
  MKO10122558_B_Tnfsf4
  gRNA
gaucaaggccaagauucaag

SEQ ID NO: 122559 - RNA, 20 nt, Artificial Sequence
  MKO10122559_B_Tnfsf4
  gRNA
uaacugcuccucugagucuu

SEQ ID NO: 122560 - RNA, 20 nt, Artificial Sequence
  MKO10122560_B_Tnfsf4
  gRNA
ccuccaauccaaagacucag

SEQ ID NO: 122561 - RNA, 20 nt, Artificial Sequence
  MKO10122561_B_Tnfsf8
  gRNA
ugaucgccacugccacaaca

SEQ ID NO: 122562 - RNA, 20 nt, Artificial Sequence
  MKO10122562_B_Tnfsf8
  gRNA
ugagcucuuaccuccuuuaa

SEQ ID NO: 122563 - RNA, 20 nt, Artificial Sequence
  MKO10122563_B_Tnfsf8
  gRNA
cuucucaguuguauuuggag

SEQ ID NO: 122564 - RNA, 20 nt, Artificial Sequence
  MKO10122564_B_Tnfsf9
  gRNA
uugugaaacccgacaaccca

SEQ ID NO: 122565 - RNA, 20 nt, Artificial Sequence
  MKO10122565_B_Tnfsf9
  gRNA
uccuguguucgccaagcuac

SEQ ID NO: 122566 - RNA, 20 nt, Artificial Sequence
  MKO10122566_B_Tnfsf9
  gRNA
ucuucacccgcaccgagccu

SEQ ID NO: 122567 - RNA, 20 nt, Artificial Sequence
  MKO10122567_B_Tnf
  gRNA
ccagcgcgccaacgcccucc

SEQ ID NO: 122568 - RNA, 20 nt, Artificial Sequence
  MKO10122568_B_Tnf
  gRNA
guagacaagguacaacccau

SEQ ID NO: 122569 - RNA, 20 nt, Artificial Sequence
  MKO10122569_B_Tnf
  gRNA
ugggccauagaacugaugag

SEQ ID NO: 122570 - RNA, 20 nt, Artificial Sequence
  MKO10122570_B_Tnik
  gRNA
cacguauggucaaguuuaua

SEQ ID NO: 122571 - RNA, 20 nt, Artificial Sequence
  MKO10122571_B_Tnik
  gRNA
uuuaucaaaaagaacccucc

SEQ ID NO: 122572 - RNA, 20 nt, Artificial Sequence
  MKO10122572_B_Tnik
  gRNA
accaacucaaagaucccugc

SEQ ID NO: 122573 - RNA, 20 nt, Artificial Sequence
  MKO10122573_B_Tnip1
  gRNA
gcauggcccucgaguucaac

SEQ ID NO: 122574 - RNA, 20 nt, Artificial Sequence
  MKO10122574_B_Tnip1
  gRNA
guggcggcagugcugguagc

SEQ ID NO: 122575 - RNA, 20 nt, Artificial Sequence
  MKO10122575_B_Tnip1
  gRNA
agauggaagcguccagacuc

SEQ ID NO: 122576 - RNA, 20 nt, Artificial Sequence
  MKO10122576_B_Tnip2
  gRNA
ccuccaacugucuguuaagu

SEQ ID NO: 122577 - RNA, 20 nt, Artificial Sequence
  MKO10122577_B_Tnip2
  gRNA
caaacaagcagcgaugcuuc

SEQ ID NO: 122578 - RNA, 20 nt, Artificial Sequence
  MKO10122578_B_Tnip2
  gRNA
guaacuucuuaauaacacuc

SEQ ID NO: 122579 - RNA, 20 nt, Artificial Sequence
  MKO10122579_B_Tnip3
  gRNA
cccauuguugauugacaucc

SEQ ID NO: 122580 - RNA, 20 nt, Artificial Sequence
  MKO10122580_B_Tnip3
  gRNA
gugugcuccaccaagaagaa

SEQ ID NO: 122581 - RNA, 20 nt, Artificial Sequence
  MKO10122581_B_Tnip3
  gRNA
ccuggagcugaaaacuaaac

SEQ ID NO: 122582 - RNA, 20 nt, Artificial Sequence
  MKO10122582_B_Tnk1
  gRNA
ucaugacagauacuucccgc

SEQ ID NO: 122583 - RNA, 20 nt, Artificial Sequence
  MKO10122583_B_Tnk1
  gRNA
gggcuuugcucccgaacaga

SEQ ID NO: 122584 - RNA, 20 nt, Artificial Sequence
  MKO10122584_B_Tnk1
  gRNA
ugcuuugguguuguacaucg

SEQ ID NO: 122585 - RNA, 20 nt, Artificial Sequence
  MKO10122585_B_Tnk2
  gRNA
cucccggaugaagucgucca

SEQ ID NO: 122586 - RNA, 20 nt, Artificial Sequence
  MKO10122586_B_Tnk2
  gRNA
ugaggucaucucgaagccuc

SEQ ID NO: 122587 - RNA, 20 nt, Artificial Sequence
  MKO10122587_B_Tnk2
  gRNA
ccaugacuugcguuugcaca

SEQ ID NO: 122588 - RNA, 20 nt, Artificial Sequence
  MKO10122588_B_Tnks1bp1
  gRNA
gcgaagugccuguccgugag

SEQ ID NO: 122589 - RNA, 20 nt, Artificial Sequence
  MKO10122589_B_Tnks1bp1
  gRNA
auuacacgaacguuccccug

SEQ ID NO: 122590 - RNA, 20 nt, Artificial Sequence
  MKO10122590_B_Tnks1bp1
  gRNA
ggagacguuacccaagaguc

SEQ ID NO: 122591 - RNA, 20 nt, Artificial Sequence
  MKO10122591_B_Tnks2
  gRNA
ccaaccauccgaaauacaga

SEQ ID NO: 122592 - RNA, 20 nt, Artificial Sequence
  MKO10122592_B_Tnks2
  gRNA
cauuucuaggaguggcaaug

SEQ ID NO: 122593 - RNA, 20 nt, Artificial Sequence
  MKO10122593_B_Tnks2
  gRNA
ucugccaaagcuguucugac

SEQ ID NO: 122594 - RNA, 20 nt, Artificial Sequence
  MKO10122594_B_Tnks
  gRNA
ucacuuaccuagcagcuucu

SEQ ID NO: 122595 - RNA, 20 nt, Artificial Sequence
  MKO10122595_B_Tnks
  gRNA
acgaacuccuagaagcugcu

SEQ ID NO: 122596 - RNA, 20 nt, Artificial Sequence
  MKO10122596_B_Tnks
  gRNA
ccuuucguccaucacuugca

SEQ ID NO: 122597 - RNA, 20 nt, Artificial Sequence
  MKO10122597_B_Tnmd
  gRNA
gagcaaacacuucuggcccg

SEQ ID NO: 122598 - RNA, 20 nt, Artificial Sequence
  MKO10122598_B_Tnmd
  gRNA
uacacuggcaucuacuuugu

SEQ ID NO: 122599 - RNA, 20 nt, Artificial Sequence
  MKO10122599_B_Tnmd
  gRNA
cgagaagaagaagauuuaca

SEQ ID NO: 122600 - RNA, 20 nt, Artificial Sequence
  MKO10122600_B_Tnnc1
  gRNA
gauggccgaauugacuauga

SEQ ID NO: 122601 - RNA, 20 nt, Artificial Sequence
  MKO10122601_B_Tnnc1
  gRNA
cuagguagaacaguugacag

SEQ ID NO: 122602 - RNA, 20 nt, Artificial Sequence
  MKO10122602_B_Tnnc1
  gRNA
ugcaugaaggacgacagcaa

SEQ ID NO: 122603 - RNA, 20 nt, Artificial Sequence
  MKO10122603_B_Tnnc2
  gRNA
aucagcaucgaacaugucaa

SEQ ID NO: 122604 - RNA, 20 nt, Artificial Sequence
  MKO10122604_B_Tnnc2
  gRNA
ggacaucagcguuaaagagu

SEQ ID NO: 122605 - RNA, 20 nt, Artificial Sequence
  MKO10122605_B_Tnnc2
  gRNA
agugcuuccgcaucuuugac

SEQ ID NO: 122606 - RNA, 20 nt, Artificial Sequence
  MKO10122606_B_Tnni1
  gRNA
cucccguaaacucaugcuga

SEQ ID NO: 122607 - RNA, 20 nt, Artificial Sequence
  MKO10122607_B_Tnni1
  gRNA
augccuccacaacaccagag

SEQ ID NO: 122608 - RNA, 20 nt, Artificial Sequence
  MKO10122608_B_Tnni1
  gRNA
ucaccuucagcaugaguuua

SEQ ID NO: 122609 - RNA, 20 nt, Artificial Sequence
  MKO10122609_B_Tnni2
  gRNA
aagccgccgagaaucugaga

SEQ ID NO: 122610 - RNA, 20 nt, Artificial Sequence
  MKO10122610_B_Tnni2
  gRNA
ggcccggagacagcaccuga

SEQ ID NO: 122611 - RNA, 20 nt, Artificial Sequence
  MKO10122611_B_Tnni2
  gRNA
ugaagaggagaaauaugaca

SEQ ID NO: 122612 - RNA, 20 nt, Artificial Sequence
  MKO10122612_B_Tnni3k
  gRNA
gggacaggccacgcucugug

SEQ ID NO: 122613 - RNA, 20 nt, Artificial Sequence
  MKO10122613_B_Tnni3k
  gRNA
auccgugcccuuauguuaaa

SEQ ID NO: 122614 - RNA, 20 nt, Artificial Sequence
  MKO10122614_B_Tnni3k
  gRNA
caagaacuaagacacaucuu

SEQ ID NO: 122615 - RNA, 20 nt, Artificial Sequence
  MKO10122615_B_Tnni3
  gRNA
ccccgccccaccuuggcgug

SEQ ID NO: 122616 - RNA, 20 nt, Artificial Sequence
  MKO10122616_B_Tnni3
  gRNA
ucucuucaggagcagcgaug

SEQ ID NO: 122617 - RNA, 20 nt, Artificial Sequence
  MKO10122617_B_Tnni3
  gRNA
cuccagaaaacuucaguuga

SEQ ID NO: 122618 - RNA, 20 nt, Artificial Sequence
  MKO10122618_B_Tnnt1
  gRNA
ccucccagcccccgaggagc

SEQ ID NO: 122619 - RNA, 20 nt, Artificial Sequence
  MKO10122619_B_Tnnt1
  gRNA
gucucuagggagcaggcaga

SEQ ID NO: 122620 - RNA, 20 nt, Artificial Sequence
  MKO10122620_B_Tnnt1
  gRNA
cuccuuuccagaugaggaag

SEQ ID NO: 122621 - RNA, 20 nt, Artificial Sequence
  MKO10122621_B_Tnnt2
  gRNA
uucauaucuagggaacagga

SEQ ID NO: 122622 - RNA, 20 nt, Artificial Sequence
  MKO10122622_B_Tnnt2
  gRNA
guacuccuccaccaccuccu

SEQ ID NO: 122623 - RNA, 20 nt, Artificial Sequence
  MKO10122623_B_Tnnt2
  gRNA
ucacuuaccuucagcaucuu

SEQ ID NO: 122624 - RNA, 20 nt, Artificial Sequence
  MKO10122624_B_Tnnt3
  gRNA
agccaacucaccuuccucuu

SEQ ID NO: 122625 - RNA, 20 nt, Artificial Sequence
  MKO10122625_B_Tnnt3
  gRNA
uccacagaggaaguccaaga

SEQ ID NO: 122626 - RNA, 20 nt, Artificial Sequence
  MKO10122626_B_Tnn
  gRNA
ggaaagccgauucuccugaa

SEQ ID NO: 122627 - RNA, 20 nt, Artificial Sequence
  MKO10122627_B_Tnn
  gRNA
ccgugcucuugagcaacugc

SEQ ID NO: 122628 - RNA, 20 nt, Artificial Sequence
  MKO10122628_B_Tnn
  gRNA
aucacaguugugcccauccg

SEQ ID NO: 122629 - RNA, 20 nt, Artificial Sequence
  MKO10122629_B_Tnp1
  gRNA
agccgcaagcuaaagacuca

SEQ ID NO: 122630 - RNA, 20 nt, Artificial Sequence
  MKO10122630_B_Tnp1
  gRNA
ugccaugagucuuuagcuug

SEQ ID NO: 122631 - RNA, 20 nt, Artificial Sequence
  MKO10122631_B_Tnp1
  gRNA
gcguccugaaaaguaggaaa

SEQ ID NO: 122632 - RNA, 20 nt, Artificial Sequence
  MKO10122632_B_Tnp2
  gRNA
ugcaggugcacugauugcac

SEQ ID NO: 122633 - RNA, 20 nt, Artificial Sequence
  MKO10122633_B_Tnp2
  gRNA
ugagcaagagaaaggccguc

SEQ ID NO: 122634 - RNA, 20 nt, Artificial Sequence
  MKO10122634_B_Tnp2
  gRNA
ccuggcugcagcuccggcag

SEQ ID NO: 122635 - RNA, 20 nt, Artificial Sequence
  MKO10122635_B_Tnpo1
  gRNA
uucuuccagaugagcccaca

SEQ ID NO: 122636 - RNA, 20 nt, Artificial Sequence
  MKO10122636_B_Tnpo1
  gRNA
accaaaacucuguagccugc

SEQ ID NO: 122637 - RNA, 20 nt, Artificial Sequence
  MKO10122637_B_Tnpo1
  gRNA
cuuacaaaauuaaaaucuga

SEQ ID NO: 122638 - RNA, 20 nt, Artificial Sequence
  MKO10122638_B_Tnpo2
  gRNA
uggauagugaugcucucaac

SEQ ID NO: 122639 - RNA, 20 nt, Artificial Sequence
  MKO10122639_B_Tnpo2
  gRNA
gcgccuucacauuguucuug

SEQ ID NO: 122640 - RNA, 20 nt, Artificial Sequence
  MKO10122640_B_Tnpo2
  gRNA
uauaauccucugaguugagc

SEQ ID NO: 122641 - RNA, 20 nt, Artificial Sequence
  MKO10122641_B_Tnpo3
  gRNA
gucgccugucauuguaacac

SEQ ID NO: 122642 - RNA, 20 nt, Artificial Sequence
  MKO10122642_B_Tnpo3
  gRNA
ucgcccuacagaugccuucu

SEQ ID NO: 122643 - RNA, 20 nt, Artificial Sequence
  MKO10122643_B_Tnpo3
  gRNA
uguacgcauccuuuccaaga

SEQ ID NO: 122644 - RNA, 20 nt, Artificial Sequence
  MKO10122644_B_Tnrc18
  gRNA
caucgggaggaucggcugcu

SEQ ID NO: 122645 - RNA, 20 nt, Artificial Sequence
  MKO10122645_B_Tnrc18
  gRNA
gacacggcuggaccgggacc

SEQ ID NO: 122646 - RNA, 20 nt, Artificial Sequence
  MKO10122646_B_Tnrc18
  gRNA
cgucccgagccugccagcgu

SEQ ID NO: 122647 - RNA, 20 nt, Artificial Sequence
  MKO10122647_B_Tnrc6a
  gRNA
acguagagagaaaucuuagc

SEQ ID NO: 122648 - RNA, 20 nt, Artificial Sequence
  MKO10122648_B_Tnrc6a
  gRNA
gccacugaacaaaaaaucaa

SEQ ID NO: 122649 - RNA, 20 nt, Artificial Sequence
  MKO10122649_B_Tnrc6a
  gRNA
gcaagaagaagaacaguuga

SEQ ID NO: 122650 - RNA, 20 nt, Artificial Sequence
  MKO10122650_B_Tnrc6b
  gRNA
cauggcaagacuccaccucc

SEQ ID NO: 122651 - RNA, 20 nt, Artificial Sequence
  MKO10122651_B_Tnrc6b
  gRNA
gccuuugcagguggaacagg

SEQ ID NO: 122652 - RNA, 20 nt, Artificial Sequence
  MKO10122652_B_Tnrc6b
  gRNA
gaaaaaagaagccacccaga

SEQ ID NO: 122653 - RNA, 20 nt, Artificial Sequence
  MKO10122653_B_Tnrc6c
  gRNA
aagcguggaggcaccucccg

SEQ ID NO: 122654 - RNA, 20 nt, Artificial Sequence
  MKO10122654_B_Tnrc6c
  gRNA
aauggcaccaccggcucagc

SEQ ID NO: 122655 - RNA, 20 nt, Artificial Sequence
  MKO10122655_B_Tnrc6c
  gRNA
gcugccgcuagaaauagugc

SEQ ID NO: 122656 - RNA, 20 nt, Artificial Sequence
  MKO10122656_B_Tnr
  gRNA
agcguagacgcugauguugu

SEQ ID NO: 122657 - RNA, 20 nt, Artificial Sequence
  MKO10122657_B_Tnr
  gRNA
guacguacgaguggccaccu

SEQ ID NO: 122658 - RNA, 20 nt, Artificial Sequence
  MKO10122658_B_Tnr
  gRNA
aacuuuagcuucgaguccug

SEQ ID NO: 122659 - RNA, 20 nt, Artificial Sequence
  MKO10122659_B_Tns1
  gRNA
ggccuggcauuuccgaugac

SEQ ID NO: 122660 - RNA, 20 nt, Artificial Sequence
  MKO10122660_B_Tns1
  gRNA
uccuccguccagccaugaac

SEQ ID NO: 122661 - RNA, 20 nt, Artificial Sequence
  MKO10122661_B_Tns1
  gRNA
aacacagccuucccgaguga

SEQ ID NO: 122662 - RNA, 20 nt, Artificial Sequence
  MKO10122662_B_Tns3
  gRNA
gaacaacgacccccagcaug

SEQ ID NO: 122663 - RNA, 20 nt, Artificial Sequence
  MKO10122663_B_Tns3
  gRNA
acuucaccaacgucucagcc

SEQ ID NO: 122664 - RNA, 20 nt, Artificial Sequence
  MKO10122664_B_Tns3
  gRNA
ccuuacaaagcuuaauccaa

SEQ ID NO: 122665 - RNA, 20 nt, Artificial Sequence
  MKO10122665_B_Tns4
  gRNA
gcccaccaugaaguucguga

SEQ ID NO: 122666 - RNA, 20 nt, Artificial Sequence
  MKO10122666_B_Tns4
  gRNA
ccacugcgcggggagccaaa

SEQ ID NO: 122667 - RNA, 20 nt, Artificial Sequence
  MKO10122667_B_Tns4
  gRNA
agccgggugccuuugucauc

SEQ ID NO: 122668 - RNA, 20 nt, Artificial Sequence
  MKO10122668_B_Tnxb
  gRNA
cagcuaaccgaucugaugcc

SEQ ID NO: 122669 - RNA, 20 nt, Artificial Sequence
  MKO10122669_B_Tnxb
  gRNA
acuagugaucgaugguccuc

SEQ ID NO: 122670 - RNA, 20 nt, Artificial Sequence
  MKO10122670_B_Tnxb
  gRNA
ggcgccuggacaggacuacc

SEQ ID NO: 122671 - RNA, 20 nt, Artificial Sequence
  MKO10122671_B_Tob1
  gRNA
uuggacauugacgauguucg

SEQ ID NO: 122672 - RNA, 20 nt, Artificial Sequence
  MKO10122672_B_Tob1
  gRNA
uagugaaaccggcugugagc

SEQ ID NO: 122673 - RNA, 20 nt, Artificial Sequence
  MKO10122673_B_Tob1
  gRNA
cuacaaaagacuucucguug

SEQ ID NO: 122674 - RNA, 20 nt, Artificial Sequence
  MKO10122674_B_Tob2
  gRNA
accgcugccgaagggggccg

SEQ ID NO: 122675 - RNA, 20 nt, Artificial Sequence
  MKO10122675_B_Tob2
  gRNA
agcucucccucgccguccuu

SEQ ID NO: 122676 - RNA, 20 nt, Artificial Sequence
  MKO10122676_B_Tob2
  gRNA
uagcaccgccuccgaacacc

SEQ ID NO: 122677 - RNA, 20 nt, Artificial Sequence
  MKO10122677_B_Toe1
  gRNA
ucacucugcacgucuaccac

SEQ ID NO: 122678 - RNA, 20 nt, Artificial Sequence
  MKO10122678_B_Toe1
  gRNA
cgugcagagugacaacuuca

SEQ ID NO: 122679 - RNA, 20 nt, Artificial Sequence
  MKO10122679_B_Toe1
  gRNA
gacccguucuguccuguccc

SEQ ID NO: 122680 - RNA, 20 nt, Artificial Sequence
  MKO10122680_B_Tollip
  gRNA
uagaacgaguccacaccugg

SEQ ID NO: 122681 - RNA, 20 nt, Artificial Sequence
  MKO10122681_B_Tollip
  gRNA
uauaccacucguccuccacu

SEQ ID NO: 122682 - RNA, 20 nt, Artificial Sequence
  MKO10122682_B_Tollip
  gRNA
gacgagugguauagccugag

SEQ ID NO: 122683 - RNA, 20 nt, Artificial Sequence
  MKO10122683_B_Tom1l1
  gRNA
cugaauuuagaccugguccc

SEQ ID NO: 122684 - RNA, 20 nt, Artificial Sequence
  MKO10122684_B_Tom1l1
  gRNA
augaagacaucgagcuccug

SEQ ID NO: 122685 - RNA, 20 nt, Artificial Sequence
  MKO10122685_B_Tom1l1
  gRNA
agugaugacagccauauuga

SEQ ID NO: 122686 - RNA, 20 nt, Artificial Sequence
  MKO10122686_B_Tom1l2
  gRNA
uaagccgcuucuuuagagcc

SEQ ID NO: 122687 - RNA, 20 nt, Artificial Sequence
  MKO10122687_B_Tom1l2
  gRNA
ugcugaacggauuccccagc

SEQ ID NO: 122688 - RNA, 20 nt, Artificial Sequence
  MKO10122688_B_Tom1l2
  gRNA
aauccguucagcaccccugu

SEQ ID NO: 122689 - RNA, 20 nt, Artificial Sequence
  MKO10122689_B_Tom1
  gRNA
ugucacagauuuccauguug

SEQ ID NO: 122690 - RNA, 20 nt, Artificial Sequence
  MKO10122690_B_Tom1
  gRNA
uaagggccagcaugaccuca

SEQ ID NO: 122691 - RNA, 20 nt, Artificial Sequence
  MKO10122691_B_Tom1
  gRNA
agcagugaagaagcgaauua

SEQ ID NO: 122692 - RNA, 20 nt, Artificial Sequence
  MKO10122692_B_Tomm20l
  gRNA
caagauuccccucauuugcc

SEQ ID NO: 122693 - RNA, 20 nt, Artificial Sequence
  MKO10122693_B_Tomm20l
  gRNA
ggaaaacuuuguuuaauuag

SEQ ID NO: 122694 - RNA, 20 nt, Artificial Sequence
  MKO10122694_B_Tomm20l
  gRNA
ccaaggcccaggcgcccgcc

SEQ ID NO: 122695 - RNA, 20 nt, Artificial Sequence
  MKO10122695_B_Tomm20
  gRNA
uuccuugaagagauacagcu

SEQ ID NO: 122696 - RNA, 20 nt, Artificial Sequence
  MKO10122696_B_Tomm20
  gRNA
caccaagcuguaucucuuca

SEQ ID NO: 122697 - RNA, 20 nt, Artificial Sequence
  MKO10122697_B_Tomm20
  gRNA
aauuguaagugcucagagcu

SEQ ID NO: 122698 - RNA, 20 nt, Artificial Sequence
  MKO10122698_B_Tomm22
  gRNA
ggggcucuaccuccacuucc

SEQ ID NO: 122699 - RNA, 20 nt, Artificial Sequence
  MKO10122699_B_Tomm22
  gRNA
gucuucuuccagcuccuccu

SEQ ID NO: 122700 - RNA, 20 nt, Artificial Sequence
  MKO10122700_B_Tomm22
  gRNA
aacagcagcaacugcagcaa

SEQ ID NO: 122701 - RNA, 20 nt, Artificial Sequence
  MKO10122701_B_Tomm34
  gRNA
ccgcccuggaaggcaucaac

SEQ ID NO: 122702 - RNA, 20 nt, Artificial Sequence
  MKO10122702_B_Tomm34
  gRNA
accucugcucuucguagcug

SEQ ID NO: 122703 - RNA, 20 nt, Artificial Sequence
  MKO10122703_B_Tomm34
  gRNA
gagccucuuguguaguagcc

SEQ ID NO: 122704 - RNA, 20 nt, Artificial Sequence
  MKO10122704_B_Tomm40l
  gRNA
gcgagcuaaggcugucuucc

SEQ ID NO: 122705 - RNA, 20 nt, Artificial Sequence
  MKO10122705_B_Tomm40l
  gRNA
uucacgccuuccaucugugc

SEQ ID NO: 122706 - RNA, 20 nt, Artificial Sequence
  MKO10122706_B_Tomm40l
  gRNA
cuggcagcuuagccccacag

SEQ ID NO: 122707 - RNA, 20 nt, Artificial Sequence
  MKO10122707_B_Tomm40
  gRNA
acucaccuggauggccauuu

SEQ ID NO: 122708 - RNA, 20 nt, Artificial Sequence
  MKO10122708_B_Tomm40
  gRNA
ccugaacccaccaagacauc

SEQ ID NO: 122709 - RNA, 20 nt, Artificial Sequence
  MKO10122709_B_Tomm40
  gRNA
uugacaccuuccaucugaac

SEQ ID NO: 122710 - RNA, 20 nt, Artificial Sequence
  MKO10122710_B_Tomm5
  gRNA
aaagugugugcuaccaugcc

SEQ ID NO: 122711 - RNA, 20 nt, Artificial Sequence
  MKO10122711_B_Tomm5
  gRNA
uccagcuucuuuaagauaua

SEQ ID NO: 122712 - RNA, 20 nt, Artificial Sequence
  MKO10122712_B_Tomm5
  gRNA
aucuuccgcuucaucuccuc

SEQ ID NO: 122713 - RNA, 20 nt, Artificial Sequence
  MKO10122713_B_Tomm6
  gRNA
caggaacuugauccucaauu

SEQ ID NO: 122714 - RNA, 20 nt, Artificial Sequence
  MKO10122714_B_Tomm6
  gRNA
ggcgcucaccgucacuccgc

SEQ ID NO: 122715 - RNA, 20 nt, Artificial Sequence
  MKO10122715_B_Tomm6
  gRNA
agccagucucccacguuguc

SEQ ID NO: 122716 - RNA, 20 nt, Artificial Sequence
  MKO10122716_B_Tomm70a
  gRNA
caacagccuuuguacaaucu

SEQ ID NO: 122717 - RNA, 20 nt, Artificial Sequence
  MKO10122717_B_Tomm70a
  gRNA
gcgcaagcagccaaaaacaa

SEQ ID NO: 122718 - RNA, 20 nt, Artificial Sequence
  MKO10122718_B_Tomm70a
  gRNA
gacuucucucccuuaagcau

SEQ ID NO: 122719 - RNA, 20 nt, Artificial Sequence
  MKO10122719_B_Tomm7
  gRNA
ugagcaaagaagccaaacag

SEQ ID NO: 122720 - RNA, 20 nt, Artificial Sequence
  MKO10122720_B_Tomm7
  gRNA
caguccuuuauccccaaagu

SEQ ID NO: 122721 - RNA, 20 nt, Artificial Sequence
  MKO10122721_B_Tomm7
  gRNA
cugcagcagcucuucaaggg

SEQ ID NO: 122722 - RNA, 20 nt, Artificial Sequence
  MKO10122722_B_Tomt
  gRNA
caccuuuaacagggcccaug

SEQ ID NO: 122723 - RNA, 20 nt, Artificial Sequence
  MKO10122723_B_Tomt
  gRNA
auugcgcgagccuugccccc

SEQ ID NO: 122724 - RNA, 20 nt, Artificial Sequence
  MKO10122724_B_Tomt
  gRNA
uccucaccacgcuugaccau

SEQ ID NO: 122725 - RNA, 20 nt, Artificial Sequence
  MKO10122725_B_Tonsl
  gRNA
caccauuggccgcacccauc

SEQ ID NO: 122726 - RNA, 20 nt, Artificial Sequence
  MKO10122726_B_Tonsl
  gRNA
aucaagagauuccuuguugc

SEQ ID NO: 122727 - RNA, 20 nt, Artificial Sequence
  MKO10122727_B_Tonsl
  gRNA
ucaucucacucaguucccgc

SEQ ID NO: 122728 - RNA, 20 nt, Artificial Sequence
  MKO10122728_B_Top1mt
  gRNA
aauuucaagacggaaccacc

SEQ ID NO: 122729 - RNA, 20 nt, Artificial Sequence
  MKO10122729_B_Top1mt
  gRNA
accucggccacggaacaagc

SEQ ID NO: 122730 - RNA, 20 nt, Artificial Sequence
  MKO10122730_B_Top1mt
  gRNA
gccuacgagccccuuccuga

SEQ ID NO: 122731 - RNA, 20 nt, Artificial Sequence
  MKO10122731_B_Top1
  gRNA
aacacaaagaucgagaacac

SEQ ID NO: 122732 - RNA, 20 nt, Artificial Sequence
  MKO10122732_B_Top1
  gRNA
ugagcugccaucuuuguguu

SEQ ID NO: 122733 - RNA, 20 nt, Artificial Sequence
  MKO10122733_B_Top1
  gRNA
gagaaaaccaaacacaaaga

SEQ ID NO: 122734 - RNA, 20 nt, Artificial Sequence
  MKO10122734_B_Top2a
  gRNA
aguuguccaaauaugagagc

SEQ ID NO: 122735 - RNA, 20 nt, Artificial Sequence
  MKO10122735_B_Top2a
  gRNA
cucuguggaguuagugaccc

SEQ ID NO: 122736 - RNA, 20 nt, Artificial Sequence
  MKO10122736_B_Top2a
  gRNA
aaaaucuuugaugagauucu

SEQ ID NO: 122737 - RNA, 20 nt, Artificial Sequence
  MKO10122737_B_Top2b
  gRNA
ucaaagaucuuguauaagcc

SEQ ID NO: 122738 - RNA, 20 nt, Artificial Sequence
  MKO10122738_B_Top2b
  gRNA
agcuguccaaaaauuaaagc

SEQ ID NO: 122739 - RNA, 20 nt, Artificial Sequence
  MKO10122739_B_Top2b
  gRNA
augcugcugacaacaagcag

SEQ ID NO: 122740 - RNA, 20 nt, Artificial Sequence
  MKO10122740_B_Top3a
  gRNA
gaauuugacuaucaucugua

SEQ ID NO: 122741 - RNA, 20 nt, Artificial Sequence
  MKO10122741_B_Top3a
  gRNA
augauaaugacuucagucuc

SEQ ID NO: 122742 - RNA, 20 nt, Artificial Sequence
  MKO10122742_B_Top3a
  gRNA
aaaucuuguugaauuuagaa

SEQ ID NO: 122743 - RNA, 20 nt, Artificial Sequence
  MKO10122743_B_Top3b
  gRNA
gaacuugaccauguucagcu

SEQ ID NO: 122744 - RNA, 20 nt, Artificial Sequence
  MKO10122744_B_Top3b
  gRNA
ugacuauguugugcuguggc

SEQ ID NO: 122745 - RNA, 20 nt, Artificial Sequence
  MKO10122745_B_Top3b
  gRNA
uucaagaugacgucugucug

SEQ ID NO: 122746 - RNA, 20 nt, Artificial Sequence
  MKO10122746_B_Topaz1
  gRNA
guuguaaguggaagccuaga

SEQ ID NO: 122747 - RNA, 20 nt, Artificial Sequence
  MKO10122747_B_Topaz1
  gRNA
acagugcauaaguucagaca

SEQ ID NO: 122748 - RNA, 20 nt, Artificial Sequence
  MKO10122748_B_Topaz1
  gRNA
cucuccaguuucagcaaucc

SEQ ID NO: 122749 - RNA, 20 nt, Artificial Sequence
  MKO10122749_B_Topbp1
  gRNA
cucauugugcaagaaccaaa

SEQ ID NO: 122750 - RNA, 20 nt, Artificial Sequence
  MKO10122750_B_Topbp1
  gRNA
ucauaaauacguacaaauga

SEQ ID NO: 122751 - RNA, 20 nt, Artificial Sequence
  MKO10122751_B_Topbp1
  gRNA
uuacccguuugucuuuaucc

SEQ ID NO: 122752 - RNA, 20 nt, Artificial Sequence
  MKO10122752_B_Topors
  gRNA
ucccgccggcucaguaagcu

SEQ ID NO: 122753 - RNA, 20 nt, Artificial Sequence
  MKO10122753_B_Topors
  gRNA
gcuacgagaccucgaucuac

SEQ ID NO: 122754 - RNA, 20 nt, Artificial Sequence
  MKO10122754_B_Topors
  gRNA
uguaguccucgaccuguuac

SEQ ID NO: 122755 - RNA, 20 nt, Artificial Sequence
  MKO10122755_B_Tor1aip1
  gRNA
agaagcuaccauuguccagc

SEQ ID NO: 122756 - RNA, 20 nt, Artificial Sequence
  MKO10122756_B_Tor1aip1
  gRNA
ccauuaagaagcccaagacu

SEQ ID NO: 122757 - RNA, 20 nt, Artificial Sequence
  MKO10122757_B_Tor1aip1
  gRNA
aauacuaaaacgaaugaaag

SEQ ID NO: 122758 - RNA, 20 nt, Artificial Sequence
  MKO10122758_B_Tor1aip2
  gRNA
agcguuagagaaaccuccac

SEQ ID NO: 122759 - RNA, 20 nt, Artificial Sequence
  MKO10122759_B_Tor1aip2
  gRNA
ugucgcucauguuuguguuc

SEQ ID NO: 122760 - RNA, 20 nt, Artificial Sequence
  MKO10122760_B_Tor1aip2
  gRNA
aacacaaacaugagcgacag

SEQ ID NO: 122761 - RNA, 20 nt, Artificial Sequence
  MKO10122761_B_Tor1a
  gRNA
cuuguuauugaagaccgaca

SEQ ID NO: 122762 - RNA, 20 nt, Artificial Sequence
  MKO10122762_B_Tor1a
  gRNA
cuaccacaucguaauagucu

SEQ ID NO: 122763 - RNA, 20 nt, Artificial Sequence
  MKO10122763_B_Tor1a
  gRNA
gcagccggccucagucaucc

SEQ ID NO: 122764 - RNA, 20 nt, Artificial Sequence
  MKO10122764_B_Tor1b
  gRNA
acuacuaugagcagguggau

SEQ ID NO: 122765 - RNA, 20 nt, Artificial Sequence
  MKO10122765_B_Tor1b
  gRNA
ugccaccgaagugauucuca

SEQ ID NO: 122766 - RNA, 20 nt, Artificial Sequence
  MKO10122766_B_Tor1b
  gRNA
agugcaaaguagagacgaac

SEQ ID NO: 122767 - RNA, 20 nt, Artificial Sequence
  MKO10122767_B_Tor2a
  gRNA
gcuuguccaucucaucgaag

SEQ ID NO: 122768 - RNA, 20 nt, Artificial Sequence
  MKO10122768_B_Tor2a
  gRNA
agggcugcaggacuuccauc

SEQ ID NO: 122769 - RNA, 20 nt, Artificial Sequence
  MKO10122769_B_Tor2a
  gRNA
gaaaggaccaacggcuugcu

SEQ ID NO: 122770 - RNA, 20 nt, Artificial Sequence
  MKO10122770_B_Tor3a
  gRNA
uacugauggacaaccuguau

SEQ ID NO: 122771 - RNA, 20 nt, Artificial Sequence
  MKO10122771_B_Tor3a
  gRNA
cacguucgucuuugacgaag

SEQ ID NO: 122772 - RNA, 20 nt, Artificial Sequence
  MKO10122772_B_Tor3a
  gRNA
guuucuuucagcaaccucgg

SEQ ID NO: 122773 - RNA, 20 nt, Artificial Sequence
  MKO10122773_B_Tor4a
  gRNA
cuuccagcacugcgcgaaag

SEQ ID NO: 122774 - RNA, 20 nt, Artificial Sequence
  MKO10122774_B_Tor4a
  gRNA
cgcagacucggcggcgcaga

SEQ ID NO: 122775 - RNA, 20 nt, Artificial Sequence
  MKO10122775_B_Tor4a
  gRNA
gcaagaggcgcaggcguagu

SEQ ID NO: 122776 - RNA, 20 nt, Artificial Sequence
  MKO10122776_B_Tox2
  gRNA
ccacauggacgccacuauuu

SEQ ID NO: 122777 - RNA, 20 nt, Artificial Sequence
  MKO10122777_B_Tox2
  gRNA
cauaugccgccaccuccgag

SEQ ID NO: 122778 - RNA, 20 nt, Artificial Sequence
  MKO10122778_B_Tox2
  gRNA
ugauggugacagugccuacg

SEQ ID NO: 122779 - RNA, 20 nt, Artificial Sequence
  MKO10122779_B_Tox3
  gRNA
cagcgauccguugccuuccc

SEQ ID NO: 122780 - RNA, 20 nt, Artificial Sequence
  MKO10122780_B_Tox3
  gRNA
gcagugcaucaggcauaccc

SEQ ID NO: 122781 - RNA, 20 nt, Artificial Sequence
  MKO10122781_B_Tox3
  gRNA
uugggcuucuugccagaauc

SEQ ID NO: 122782 - RNA, 20 nt, Artificial Sequence
  MKO10122782_B_Tox4
  gRNA
caggaccuggaccauucuau

SEQ ID NO: 122783 - RNA, 20 nt, Artificial Sequence
  MKO10122783_B_Tox4
  gRNA
caguucugacugaucaauag

SEQ ID NO: 122784 - RNA, 20 nt, Artificial Sequence
  MKO10122784_B_Tox4
  gRNA
aacaaugcauacgcagagac

SEQ ID NO: 122785 - RNA, 20 nt, Artificial Sequence
  MKO10122785_B_Tox
  gRNA
gucgcagcugagcgcacagu

SEQ ID NO: 122786 - RNA, 20 nt, Artificial Sequence
  MKO10122786_B_Tox
  gRNA
acugugcgcucagcugcgac

SEQ ID NO: 122787 - RNA, 20 nt, Artificial Sequence
  MKO10122787_B_Tox
  gRNA
cgaagauuguggcaucaaug

SEQ ID NO: 122788 - RNA, 20 nt, Artificial Sequence
  MKO10122788_B_Tpbg
  gRNA
gugcgugaaccgcaaccugc

SEQ ID NO: 122789 - RNA, 20 nt, Artificial Sequence
  MKO10122789_B_Tpbg
  gRNA
cgcucaggccuugcacuccg

SEQ ID NO: 122790 - RNA, 20 nt, Artificial Sequence
  MKO10122790_B_Tpbg
  gRNA
cgcgucggcccccagcucuu

SEQ ID NO: 122791 - RNA, 20 nt, Artificial Sequence
  MKO10122791_B_Tpbpa
  gRNA
ucagcauccaacugcgcuuc

SEQ ID NO: 122792 - RNA, 20 nt, Artificial Sequence
  MKO10122792_B_Tpbpa
  gRNA
uuuacacccaauguuugaag

SEQ ID NO: 122793 - RNA, 20 nt, Artificial Sequence
  MKO10122793_B_Tpbpa
  gRNA
ucuguguaauccucaaauuc

SEQ ID NO: 122794 - RNA, 20 nt, Artificial Sequence
  MKO10122794_B_Tpbpb
  gRNA
ugucgaugccauccuucucc

SEQ ID NO: 122795 - RNA, 20 nt, Artificial Sequence
  MKO10122795_B_Tpbpb
  gRNA
ucuguguaauccucaaauuc

SEQ ID NO: 122796 - RNA, 20 nt, Artificial Sequence
  MKO10122796_B_Tpbpb
  gRNA
uguugaugacccugaauuug

SEQ ID NO: 122797 - RNA, 20 nt, Artificial Sequence
  MKO10122797_B_Tpcn1
  gRNA
ucuccagacguccguccucg

SEQ ID NO: 122798 - RNA, 20 nt, Artificial Sequence
  MKO10122798_B_Tpcn1
  gRNA
gagguaggccgccagcgcuc

SEQ ID NO: 122799 - RNA, 20 nt, Artificial Sequence
  MKO10122799_B_Tpcn1
  gRNA
caaccacuucuucuacauga

SEQ ID NO: 122800 - RNA, 20 nt, Artificial Sequence
  MKO10122800_B_Tpcn2
  gRNA
ccgcuccaucuaccaccgca

SEQ ID NO: 122801 - RNA, 20 nt, Artificial Sequence
  MKO10122801_B_Tpcn2
  gRNA
ugcaggugcugcagccgauc

SEQ ID NO: 122802 - RNA, 20 nt, Artificial Sequence
  MKO10122802_B_Tpcn2
  gRNA
cuucauugaagacgccauaa

SEQ ID NO: 122803 - RNA, 20 nt, Artificial Sequence
  MKO10122803_B_Tpd52l1
  gRNA
ccauaaguaugccugccaug

SEQ ID NO: 122804 - RNA, 20 nt, Artificial Sequence
  MKO10122804_B_Tpd52l1
  gRNA
gcuaaaggcagaguuaauuc

SEQ ID NO: 122805 - RNA, 20 nt, Artificial Sequence
  MKO10122805_B_Tpd52l1
  gRNA
cuucucuagcaugcucucug

SEQ ID NO: 122806 - RNA, 20 nt, Artificial Sequence
  MKO10122806_B_Tpd52l2
  gRNA
cugcuucagcuccccuaaug

SEQ ID NO: 122807 - RNA, 20 nt, Artificial Sequence
  MKO10122807_B_Tpd52l2
  gRNA
aucagcugcccuguccacca

SEQ ID NO: 122808 - RNA, 20 nt, Artificial Sequence
  MKO10122808_B_Tpd52l2
  gRNA
gucuccaagcuuccugcuga

SEQ ID NO: 122809 - RNA, 20 nt, Artificial Sequence
  MKO10122809_B_Tpd52
  gRNA
agcuugcgauagaguuucag

SEQ ID NO: 122810 - RNA, 20 nt, Artificial Sequence
  MKO10122810_B_Tpd52
  gRNA
uccucuuccgucagcgccuc

SEQ ID NO: 122811 - RNA, 20 nt, Artificial Sequence
  MKO10122811_B_Tpd52
  gRNA
cucagucaucaccaaaaagc

SEQ ID NO: 122812 - RNA, 20 nt, Artificial Sequence
  MKO10122812_B_Tpgs1
  gRNA
cgaucggccaccgcuugacc

SEQ ID NO: 122813 - RNA, 20 nt, Artificial Sequence
  MKO10122813_B_Tpgs1
  gRNA
cuguccgggaaauuggccgc

SEQ ID NO: 122814 - RNA, 20 nt, Artificial Sequence
  MKO10122814_B_Tpgs1
  gRNA
cucgaaguagugcgccaaga

SEQ ID NO: 122815 - RNA, 20 nt, Artificial Sequence
  MKO10122815_B_Tpgs2
  gRNA
cuucuugaguaucguccucu

SEQ ID NO: 122816 - RNA, 20 nt, Artificial Sequence
  MKO10122816_B_Tpgs2
  gRNA
agcgucauaugauuucuuca

SEQ ID NO: 122817 - RNA, 20 nt, Artificial Sequence
  MKO10122817_B_Tpgs2
  gRNA
cuagaggacgauacucaaga

SEQ ID NO: 122818 - RNA, 20 nt, Artificial Sequence
  MKO10122818_B_Tph1
  gRNA
ucuacccgacccacgccugc

SEQ ID NO: 122819 - RNA, 20 nt, Artificial Sequence
  MKO10122819_B_Tph1
  gRNA
uucuuccgugaauucaaucu

SEQ ID NO: 122820 - RNA, 20 nt, Artificial Sequence
  MKO10122820_B_Tph1
  gRNA
caguuauggagacugucccu

SEQ ID NO: 122821 - RNA, 20 nt, Artificial Sequence
  MKO10122821_B_Tph2
  gRNA
gaaagcacuuagacuauucc

SEQ ID NO: 122822 - RNA, 20 nt, Artificial Sequence
  MKO10122822_B_Tph2
  gRNA
aggacaaugucuaucgacag

SEQ ID NO: 122823 - RNA, 20 nt, Artificial Sequence
  MKO10122823_B_Tph2
  gRNA
uggauggucggcaucaagcu

SEQ ID NO: 122824 - RNA, 20 nt, Artificial Sequence
  MKO10122824_B_Tpi1
  gRNA
cgacuuugccagacagaagc

SEQ ID NO: 122825 - RNA, 20 nt, Artificial Sequence
  MKO10122825_B_Tpi1
  gRNA
uccuggccuaugaaccugug

SEQ ID NO: 122826 - RNA, 20 nt, Artificial Sequence
  MKO10122826_B_Tpi1
  gRNA
ccacagauaaugugaaagac

SEQ ID NO: 122827 - RNA, 20 nt, Artificial Sequence
  MKO10122827_B_Tpk1
  gRNA
agugucuucaagugcuccaa

SEQ ID NO: 122828 - RNA, 20 nt, Artificial Sequence
  MKO10122828_B_Tpk1
  gRNA
cacuuauaugaucucacuga

SEQ ID NO: 122829 - RNA, 20 nt, Artificial Sequence
  MKO10122829_B_Tpk1
  gRNA
aaggcugauuaagaaccaca

SEQ ID NO: 122830 - RNA, 20 nt, Artificial Sequence
  MKO10122830_B_Tpm1
  gRNA
ucugaacagacgcauccagc

SEQ ID NO: 122831 - RNA, 20 nt, Artificial Sequence
  MKO10122831_B_Tpm1
  gRNA
gacugaccucuucauacuuc

SEQ ID NO: 122832 - RNA, 20 nt, Artificial Sequence
  MKO10122832_B_Tpm1
  gRNA
auaauuacaguacucucaga

SEQ ID NO: 122833 - RNA, 20 nt, Artificial Sequence
  MKO10122833_B_Tpm2
  gRNA
ggacucagaccgcaaauaug

SEQ ID NO: 122834 - RNA, 20 nt, Artificial Sequence
  MKO10122834_B_Tpm2
  gRNA
ccggcaccuccucauauuug

SEQ ID NO: 122835 - RNA, 20 nt, Artificial Sequence
  MKO10122835_B_Tpm2
  gRNA
agcgcuccagcuccccuucc

SEQ ID NO: 122836 - RNA, 20 nt, Artificial Sequence
  MKO10122836_B_Tpm3
  gRNA
uugauugaaggcugaagcug

SEQ ID NO: 122837 - RNA, 20 nt, Artificial Sequence
  MKO10122837_B_Tpm3
  gRNA
cuccagcuucugcaaagcag

SEQ ID NO: 122838 - RNA, 20 nt, Artificial Sequence
  MKO10122838_B_Tpm3
  gRNA
caccucuucauacuuccuau

SEQ ID NO: 122839 - RNA, 20 nt, Artificial Sequence
  MKO10122839_B_Tpm4
  gRNA
gugcagaaaguguggugacc

SEQ ID NO: 122840 - RNA, 20 nt, Artificial Sequence
  MKO10122840_B_Tpm4
  gRNA
ggcuucgucagugaugugcu

SEQ ID NO: 122841 - RNA, 20 nt, Artificial Sequence
  MKO10122841_B_Tpm4
  gRNA
caaccgccgcauccaacugc

SEQ ID NO: 122842 - RNA, 20 nt, Artificial Sequence
  MKO10122842_B_Tpmt
  gRNA
ggcgagcgguucuucugugu

SEQ ID NO: 122843 - RNA, 20 nt, Artificial Sequence
  MKO10122843_B_Tpmt
  gRNA
caggcuguugaagaagcauu

SEQ ID NO: 122844 - RNA, 20 nt, Artificial Sequence
  MKO10122844_B_Tpmt
  gRNA
gcagcauauuugaucuuccu

SEQ ID NO: 122845 - RNA, 20 nt, Artificial Sequence
  MKO10122845_B_Tpo
  gRNA
aauagccccacugguggacu

SEQ ID NO: 122846 - RNA, 20 nt, Artificial Sequence
  MKO10122846_B_Tpo
  gRNA
aagccgugguauaagaaauu

SEQ ID NO: 122847 - RNA, 20 nt, Artificial Sequence
  MKO10122847_B_Tpo
  gRNA
ucaugguguuguagacugca

SEQ ID NO: 122848 - RNA, 20 nt, Artificial Sequence
  MKO10122848_B_Tpp1
  gRNA
gcugaguuucaucgcuaugu

SEQ ID NO: 122849 - RNA, 20 nt, Artificial Sequence
  MKO10122849_B_Tpp1
  gRNA
uggucacugaaucgcaguuc

SEQ ID NO: 122850 - RNA, 20 nt, Artificial Sequence
  MKO10122850_B_Tpp1
  gRNA
ugcaggaaaguaccuaaccc

SEQ ID NO: 122851 - RNA, 20 nt, Artificial Sequence
  MKO10122851_B_Tpp2
  gRNA
ugguuaugacuucuauccaa

SEQ ID NO: 122852 - RNA, 20 nt, Artificial Sequence
  MKO10122852_B_Tpp2
  gRNA
gaauuugauauugccaacaa

SEQ ID NO: 122853 - RNA, 20 nt, Artificial Sequence
  MKO10122853_B_Tpp2
  gRNA
accuacagauuccugcaaac

SEQ ID NO: 122854 - RNA, 20 nt, Artificial Sequence
  MKO10122854_B_Tppp2
  gRNA
cacguagccugaguugucag

SEQ ID NO: 122855 - RNA, 20 nt, Artificial Sequence
  MKO10122855_B_Tppp2
  gRNA
uuccaucgauucgcugucuu

SEQ ID NO: 122856 - RNA, 20 nt, Artificial Sequence
  MKO10122856_B_Tppp2
  gRNA
cuacgugaguggcuacaagg

SEQ ID NO: 122857 - RNA, 20 nt, Artificial Sequence
  MKO10122857_B_Tppp3
  gRNA
guuccuugcccgcuaucagc

SEQ ID NO: 122858 - RNA, 20 nt, Artificial Sequence
  MKO10122858_B_Tppp3
  gRNA
acuuacggugacgccaaugu

SEQ ID NO: 122859 - RNA, 20 nt, Artificial Sequence
  MKO10122859_B_Tppp3
  gRNA
gugagugccuacaaaaacgc

SEQ ID NO: 122860 - RNA, 20 nt, Artificial Sequence
  MKO10122860_B_Tppp
  gRNA
accgugacgccagagaugac

SEQ ID NO: 122861 - RNA, 20 nt, Artificial Sequence
  MKO10122861_B_Tppp
  gRNA
gucugugagccgugacaccg

SEQ ID NO: 122862 - RNA, 20 nt, Artificial Sequence
  MKO10122862_B_Tppp
  gRNA
cuuauccuugaaccgcuucu

SEQ ID NO: 122863 - RNA, 20 nt, Artificial Sequence
  MKO10122863_B_Tpra1
  gRNA
agaagcgggugauuucccac

SEQ ID NO: 122864 - RNA, 20 nt, Artificial Sequence
  MKO10122864_B_Tpra1
  gRNA
ugagcugagugugaucaucc

SEQ ID NO: 122865 - RNA, 20 nt, Artificial Sequence
  MKO10122865_B_Tpra1
  gRNA
ugcugcgacaguugcugaca

SEQ ID NO: 122866 - RNA, 20 nt, Artificial Sequence
  MKO10122866_B_Tprgl
  gRNA
ggcgaauaccgugcuggugc

SEQ ID NO: 122867 - RNA, 20 nt, Artificial Sequence
  MKO10122867_B_Tprgl
  gRNA
gcuccuucucguuguuccag

SEQ ID NO: 122868 - RNA, 20 nt, Artificial Sequence
  MKO10122868_B_Tprgl
  gRNA
uucucguccaugccagccau

SEQ ID NO: 122869 - RNA, 20 nt, Artificial Sequence
  MKO10122869_B_Tprg
  gRNA
gcuccuacaggauugaucac

SEQ ID NO: 122870 - RNA, 20 nt, Artificial Sequence
  MKO10122870_B_Tprg
  gRNA
gguggucucuacugucucgu

SEQ ID NO: 122871 - RNA, 20 nt, Artificial Sequence
  MKO10122871_B_Tprg
  gRNA
ggccacauagcacagacuuc

SEQ ID NO: 122872 - RNA, 20 nt, Artificial Sequence
  MKO10122872_B_Tprkb
  gRNA
gcugccacaaguaucugaaa

SEQ ID NO: 122873 - RNA, 20 nt, Artificial Sequence
  MKO10122873_B_Tprkb
  gRNA
accaucaauagauccuucca

SEQ ID NO: 122874 - RNA, 20 nt, Artificial Sequence
  MKO10122874_B_Tprkb
  gRNA
gacuuuccaaaggcaccugc

SEQ ID NO: 122875 - RNA, 20 nt, Artificial Sequence
  MKO10122875_B_Tprn
  gRNA
gcucgcugcggaaguccgag

SEQ ID NO: 122876 - RNA, 20 nt, Artificial Sequence
  MKO10122876_B_Tprn
  gRNA
augcaggcucuugucauuga

SEQ ID NO: 122877 - RNA, 20 nt, Artificial Sequence
  MKO10122877_B_Tprn
  gRNA
uggcuuaccaugaccuccuu

SEQ ID NO: 122878 - RNA, 20 nt, Artificial Sequence
  MKO10122878_B_Tpr
  gRNA
gccucaaguucugacacucc

SEQ ID NO: 122879 - RNA, 20 nt, Artificial Sequence
  MKO10122879_B_Tpr
  gRNA
caggaaguugaauauuuaac

SEQ ID NO: 122880 - RNA, 20 nt, Artificial Sequence
  MKO10122880_B_Tpr
  gRNA
agaggcuugucacugaaacc

SEQ ID NO: 122881 - RNA, 20 nt, Artificial Sequence
  MKO10122881_B_Tpsab1
  gRNA
agucggggugugugaugauc

SEQ ID NO: 122882 - RNA, 20 nt, Artificial Sequence
  MKO10122882_B_Tpsab1
  gRNA
ugcgugccaaugacaccuac

SEQ ID NO: 122883 - RNA, 20 nt, Artificial Sequence
  MKO10122883_B_Tpsab1
  gRNA
gguccagcuaugacacgaga

SEQ ID NO: 122884 - RNA, 20 nt, Artificial Sequence
  MKO10122884_B_Tpsb2
  gRNA
gaaaaucaucucccguguag

SEQ ID NO: 122885 - RNA, 20 nt, Artificial Sequence
  MKO10122885_B_Tpsb2
  gRNA
gucuucuucagggcgauuca

SEQ ID NO: 122886 - RNA, 20 nt, Artificial Sequence
  MKO10122886_B_Tpsb2
  gRNA
uggggcgacauugauaauga

SEQ ID NO: 122887 - RNA, 20 nt, Artificial Sequence
  MKO10122887_B_Tpsg1
  gRNA
guaacccgggcauagacgcc

SEQ ID NO: 122888 - RNA, 20 nt, Artificial Sequence
  MKO10122888_B_Tpsg1
  gRNA
ccccgggcgcauagcauguc

SEQ ID NO: 122889 - RNA, 20 nt, Artificial Sequence
  MKO10122889_B_Tpsg1
  gRNA
ugugaacucgucugauuauc

SEQ ID NO: 122890 - RNA, 20 nt, Artificial Sequence
  MKO10122890_B_Tpst1
  gRNA
gggcgcuaucgaaguggguu

SEQ ID NO: 122891 - RNA, 20 nt, Artificial Sequence
  MKO10122891_B_Tpst1
  gRNA
ccuucaacagacggagcaag

SEQ ID NO: 122892 - RNA, 20 nt, Artificial Sequence
  MKO10122892_B_Tpst1
  gRNA
cuuucugaaagaaaaacccc

SEQ ID NO: 122893 - RNA, 20 nt, Artificial Sequence
  MKO10122893_B_Tpst2
  gRNA
uaugcgaauccacccaacua

SEQ ID NO: 122894 - RNA, 20 nt, Artificial Sequence
  MKO10122894_B_Tpst2
  gRNA
aaaacgccagccaaucugaa

SEQ ID NO: 122895 - RNA, 20 nt, Artificial Sequence
  MKO10122895_B_Tpst2
  gRNA
cuggaaaucacgaacuuccu

SEQ ID NO: 122896 - RNA, 20 nt, Artificial Sequence
  MKO10122896_B_Tpt1
  gRNA
ucuccgacaucuacaagauc

SEQ ID NO: 122897 - RNA, 20 nt, Artificial Sequence
  MKO10122897_B_Tpt1
  gRNA
guucaugacaaugucaacac

SEQ ID NO: 122898 - RNA, 20 nt, Artificial Sequence
  MKO10122898_B_Tpt1
  gRNA
gguaguuauugaaauuagca

SEQ ID NO: 122899 - RNA, 20 nt, Artificial Sequence
  MKO10122899_B_Tpte
  gRNA
uuuaacucacuuuguacuga

SEQ ID NO: 122900 - RNA, 20 nt, Artificial Sequence
  MKO10122900_B_Tpte
  gRNA
uacaucuuguaaauauuugc

SEQ ID NO: 122901 - RNA, 20 nt, Artificial Sequence
  MKO10122901_B_Tpte
  gRNA
cagauaacacuaaucacuaa

SEQ ID NO: 122902 - RNA, 20 nt, Artificial Sequence
  MKO10122902_B_Tpx2
  gRNA
agccaagagauguguugcuc

SEQ ID NO: 122903 - RNA, 20 nt, Artificial Sequence
  MKO10122903_B_Tpx2
  gRNA
auacagcucucuuagcaucc

SEQ ID NO: 122904 - RNA, 20 nt, Artificial Sequence
  MKO10122904_B_Tpx2
  gRNA
ggccggagcaacacaucucu

SEQ ID NO: 122905 - RNA, 20 nt, Artificial Sequence
  MKO10122905_B_Tra2a
  gRNA
ggucugcccauguaaaugcc

SEQ ID NO: 122906 - RNA, 20 nt, Artificial Sequence
  MKO10122906_B_Tra2a
  gRNA
gaauguuuggacacccguga

SEQ ID NO: 122907 - RNA, 20 nt, Artificial Sequence
  MKO10122907_B_Tra2a
  gRNA
acuacauuaacaccacucag

SEQ ID NO: 122908 - RNA, 20 nt, Artificial Sequence
  MKO10122908_B_Tra2b
  gRNA
ucccguucugcuucccgaag

SEQ ID NO: 122909 - RNA, 20 nt, Artificial Sequence
  MKO10122909_B_Tra2b
  gRNA
gauccagaagaaguucuaga

SEQ ID NO: 122910 - RNA, 20 nt, Artificial Sequence
  MKO10122910_B_Tra2b
  gRNA
augacgccuucgaguagaca

SEQ ID NO: 122911 - RNA, 20 nt, Artificial Sequence
  MKO10122911_B_Trabd2b
  gRNA
cgcaguuguaguguuugaug

SEQ ID NO: 122912 - RNA, 20 nt, Artificial Sequence
  MKO10122912_B_Trabd2b
  gRNA
ugucaucgauguccuaagac

SEQ ID NO: 122913 - RNA, 20 nt, Artificial Sequence
  MKO10122913_B_Trabd2b
  gRNA
ucuuguagaugagcuccugc

SEQ ID NO: 122914 - RNA, 20 nt, Artificial Sequence
  MKO10122914_B_Trabd
  gRNA
gccucccugaacucgccacc

SEQ ID NO: 122915 - RNA, 20 nt, Artificial Sequence
  MKO10122915_B_Trabd
  gRNA
gcaaccggauguggucgugg

SEQ ID NO: 122916 - RNA, 20 nt, Artificial Sequence
  MKO10122916_B_Trabd
  gRNA
acguacagugacccagcuag

SEQ ID NO: 122917 - RNA, 20 nt, Artificial Sequence
  MKO10122917_B_Tradd
  gRNA
ucgugcagcccgaccggcuc

SEQ ID NO: 122918 - RNA, 20 nt, Artificial Sequence
  MKO10122918_B_Tradd
  gRNA
cgcgcccgcagaaccgcaac

SEQ ID NO: 122919 - RNA, 20 nt, Artificial Sequence
  MKO10122919_B_Tradd
  gRNA
cccgguuuccucuccgaccg

SEQ ID NO: 122920 - RNA, 20 nt, Artificial Sequence
  MKO10122920_B_Traf1
  gRNA
uccggccacacacugacucg

SEQ ID NO: 122921 - RNA, 20 nt, Artificial Sequence
  MKO10122921_B_Traf1
  gRNA
gaaaucaugugccccuuugc

SEQ ID NO: 122922 - RNA, 20 nt, Artificial Sequence
  MKO10122922_B_Traf1
  gRNA
ggaacagccaacaccugcaa

SEQ ID NO: 122923 - RNA, 20 nt, Artificial Sequence
  MKO10122923_B_Traf2
  gRNA
ccuucucgcugaggcggacc

SEQ ID NO: 122924 - RNA, 20 nt, Artificial Sequence
  MKO10122924_B_Traf2
  gRNA
ggggaccuugaaagaauacg

SEQ ID NO: 122925 - RNA, 20 nt, Artificial Sequence
  MKO10122925_B_Traf2
  gRNA
aaguuucccuuaaccuguga

SEQ ID NO: 122926 - RNA, 20 nt, Artificial Sequence
  MKO10122926_B_Traf3ip1
  gRNA
ugcccggccacaauucuagc

SEQ ID NO: 122927 - RNA, 20 nt, Artificial Sequence
  MKO10122927_B_Traf3ip1
  gRNA
aaugagcugcuucaauugau

SEQ ID NO: 122928 - RNA, 20 nt, Artificial Sequence
  MKO10122928_B_Traf3ip1
  gRNA
uggcaggugauuaggauaac

SEQ ID NO: 122929 - RNA, 20 nt, Artificial Sequence
  MKO10122929_B_Traf3ip2
  gRNA
uacccauaccucgggagccu

SEQ ID NO: 122930 - RNA, 20 nt, Artificial Sequence
  MKO10122930_B_Traf3ip2
  gRNA
gggguauugauaucauuaaa

SEQ ID NO: 122931 - RNA, 20 nt, Artificial Sequence
  MKO10122931_B_Traf3ip2
  gRNA
aggcccacgcccugugcaga

SEQ ID NO: 122932 - RNA, 20 nt, Artificial Sequence
  MKO10122932_B_Traf3ip3
  gRNA
uggaguugcuguccuagaca

SEQ ID NO: 122933 - RNA, 20 nt, Artificial Sequence
  MKO10122933_B_Traf3ip3
  gRNA
ucaccccggugcugucugug

SEQ ID NO: 122934 - RNA, 20 nt, Artificial Sequence
  MKO10122934_B_Traf3ip3
  gRNA
ucucucaggcacucagacaa

SEQ ID NO: 122935 - RNA, 20 nt, Artificial Sequence
  MKO10122935_B_Traf3
  gRNA
acgcaccugcaguuugauca

SEQ ID NO: 122936 - RNA, 20 nt, Artificial Sequence
  MKO10122936_B_Traf3
  gRNA
cauuccgacaguagaccuga

SEQ ID NO: 122937 - RNA, 20 nt, Artificial Sequence
  MKO10122937_B_Traf3
  gRNA
uugugcggagcagcugacuc

SEQ ID NO: 122938 - RNA, 20 nt, Artificial Sequence
  MKO10122938_B_Traf4
  gRNA
cgggccacuucgucaucuac

SEQ ID NO: 122939 - RNA, 20 nt, Artificial Sequence
  MKO10122939_B_Traf4
  gRNA
auuuguuuaugacaccaucc

SEQ ID NO: 122940 - RNA, 20 nt, Artificial Sequence
  MKO10122940_B_Traf4
  gRNA
ggcacucagacguggcaugc

SEQ ID NO: 122941 - RNA, 20 nt, Artificial Sequence
  MKO10122941_B_Traf5
  gRNA
cgacaccgaguaccaguuug

SEQ ID NO: 122942 - RNA, 20 nt, Artificial Sequence
  MKO10122942_B_Traf5
  gRNA
ggaaccggcaguaugcgcuc

SEQ ID NO: 122943 - RNA, 20 nt, Artificial Sequence
  MKO10122943_B_Traf5
  gRNA
gaaucgucccagaauaaucc

SEQ ID NO: 122944 - RNA, 20 nt, Artificial Sequence
  MKO10122944_B_Traf6
  gRNA
gaugccuaaucauuaugauc

SEQ ID NO: 122945 - RNA, 20 nt, Artificial Sequence
  MKO10122945_B_Traf6
  gRNA
cucucgcuuugcaaaauugu

SEQ ID NO: 122946 - RNA, 20 nt, Artificial Sequence
  MKO10122946_B_Traf6
  gRNA
caguccagaucauaaugauu

SEQ ID NO: 122947 - RNA, 20 nt, Artificial Sequence
  MKO10122947_B_Traf7
  gRNA
cgaauaggcaagggugcuag

SEQ ID NO: 122948 - RNA, 20 nt, Artificial Sequence
  MKO10122948_B_Traf7
  gRNA
augccguccuccucaucccg

SEQ ID NO: 122949 - RNA, 20 nt, Artificial Sequence
  MKO10122949_B_Traf7
  gRNA
cagcuuuaccgagggcugcu

SEQ ID NO: 122950 - RNA, 20 nt, Artificial Sequence
  MKO10122950_B_Trafd1
  gRNA
gugaauguccaugucagauu

SEQ ID NO: 122951 - RNA, 20 nt, Artificial Sequence
  MKO10122951_B_Trafd1
  gRNA
caacuucuuguugcauuuac

SEQ ID NO: 122952 - RNA, 20 nt, Artificial Sequence
  MKO10122952_B_Trafd1
  gRNA
accguuccccaaaucugaca

SEQ ID NO: 122953 - RNA, 20 nt, Artificial Sequence
  MKO10122953_B_Traip
  gRNA
cgguagcauugcguucuucc

SEQ ID NO: 122954 - RNA, 20 nt, Artificial Sequence
  MKO10122954_B_Traip
  gRNA
cuuggaugcagaauucuuaa

SEQ ID NO: 122955 - RNA, 20 nt, Artificial Sequence
  MKO10122955_B_Traip
  gRNA
aaagcucagcuuucccagaa

SEQ ID NO: 122956 - RNA, 20 nt, Artificial Sequence
  MKO10122956_B_Trak1
  gRNA
auucuacaccagugccgcug

SEQ ID NO: 122957 - RNA, 20 nt, Artificial Sequence
  MKO10122957_B_Trak1
  gRNA
gacuuacgggguugagcaga

SEQ ID NO: 122958 - RNA, 20 nt, Artificial Sequence
  MKO10122958_B_Trak1
  gRNA
uucauagaaagagcgggauu

SEQ ID NO: 122959 - RNA, 20 nt, Artificial Sequence
  MKO10122959_B_Trak2
  gRNA
cgaacugcaccuuggaucgu

SEQ ID NO: 122960 - RNA, 20 nt, Artificial Sequence
  MKO10122960_B_Trak2
  gRNA
agcggaacgucucuucagca

SEQ ID NO: 122961 - RNA, 20 nt, Artificial Sequence
  MKO10122961_B_Trak2
  gRNA
uuaaaagagcuugcccaauu

SEQ ID NO: 122962 - RNA, 20 nt, Artificial Sequence
  MKO10122962_B_Tram1l1
  gRNA
gguguugagccacgaauuca

SEQ ID NO: 122963 - RNA, 20 nt, Artificial Sequence
  MKO10122963_B_Tram1l1
  gRNA
guccucgaguugcaguaucc

SEQ ID NO: 122964 - RNA, 20 nt, Artificial Sequence
  MKO10122964_B_Tram1l1
  gRNA
uacaggguccuggacccgga

SEQ ID NO: 122965 - RNA, 20 nt, Artificial Sequence
  MKO10122965_B_Tram1
  gRNA
ucucagacccaacuauccug

SEQ ID NO: 122966 - RNA, 20 nt, Artificial Sequence
  MKO10122966_B_Tram1
  gRNA
uaggcucuccacaggauagu

SEQ ID NO: 122967 - RNA, 20 nt, Artificial Sequence
  MKO10122967_B_Tram1
  gRNA
aacaccuaccuguugcaggg

SEQ ID NO: 122968 - RNA, 20 nt, Artificial Sequence
  MKO10122968_B_Tram2
  gRNA
gaugacgacguagaacaaga

SEQ ID NO: 122969 - RNA, 20 nt, Artificial Sequence
  MKO10122969_B_Tram2
  gRNA
acucacgagagguacacaug

SEQ ID NO: 122970 - RNA, 20 nt, Artificial Sequence
  MKO10122970_B_Tram2
  gRNA
cacagcaaguucaaugaauc

SEQ ID NO: 122971 - RNA, 20 nt, Artificial Sequence
  MKO10122971_B_Trank1
  gRNA
aacauccgagcagcuucaua

SEQ ID NO: 122972 - RNA, 20 nt, Artificial Sequence
  MKO10122972_B_Trank1
  gRNA
agugaaaauaugaucaaagc

SEQ ID NO: 122973 - RNA, 20 nt, Artificial Sequence
  MKO10122973_B_Trank1
  gRNA
gcaauauguaauacagaagu

SEQ ID NO: 122974 - RNA, 20 nt, Artificial Sequence
  MKO10122974_B_Trap1a
  gRNA
gucuauaccagugaacccua

SEQ ID NO: 122975 - RNA, 20 nt, Artificial Sequence
  MKO10122975_B_Trap1a
  gRNA
guucauagacgcccuuuaug

SEQ ID NO: 122976 - RNA, 20 nt, Artificial Sequence
  MKO10122976_B_Trap1a
  gRNA
gucuucauccucaucgacag

SEQ ID NO: 122977 - RNA, 20 nt, Artificial Sequence
  MKO10122977_B_Trap1
  gRNA
aggacaguuauacagcacac

SEQ ID NO: 122978 - RNA, 20 nt, Artificial Sequence
  MKO10122978_B_Trap1
  gRNA
cccacacaaagucuggcuuc

SEQ ID NO: 122979 - RNA, 20 nt, Artificial Sequence
  MKO10122979_B_Trap1
  gRNA
cuccaaugccagugaugccu

SEQ ID NO: 122980 - RNA, 20 nt, Artificial Sequence
  MKO10122980_B_Trappc10
  gRNA
auccaacuuuguucaguuca

SEQ ID NO: 122981 - RNA, 20 nt, Artificial Sequence
  MKO10122981_B_Trappc10
  gRNA
agcuccaaaaaugauucacc

SEQ ID NO: 122982 - RNA, 20 nt, Artificial Sequence
  MKO10122982_B_Trappc10
  gRNA
cuguaccuucuccauuccau

SEQ ID NO: 122983 - RNA, 20 nt, Artificial Sequence
  MKO10122983_B_Trappc11
  gRNA
ucugaucuccguguaguaau

SEQ ID NO: 122984 - RNA, 20 nt, Artificial Sequence
  MKO10122984_B_Trappc11
  gRNA
accuuauaauguagcccaca

SEQ ID NO: 122985 - RNA, 20 nt, Artificial Sequence
  MKO10122985_B_Trappc11
  gRNA
gagcucacacacauugcaua

SEQ ID NO: 122986 - RNA, 20 nt, Artificial Sequence
  MKO10122986_B_Trappc12
  gRNA
agacuugaugcuucgcuucc

SEQ ID NO: 122987 - RNA, 20 nt, Artificial Sequence
  MKO10122987_B_Trappc12
  gRNA
uuggcgcugcuggugaaguu

SEQ ID NO: 122988 - RNA, 20 nt, Artificial Sequence
  MKO10122988_B_Trappc12
  gRNA
cugugagcaggcguccacac

SEQ ID NO: 122989 - RNA, 20 nt, Artificial Sequence
  MKO10122989_B_Trappc13
  gRNA
auugugaacacugauauaac

SEQ ID NO: 122990 - RNA, 20 nt, Artificial Sequence
  MKO10122990_B_Trappc13
  gRNA
ggaagugaauccccccaaac

SEQ ID NO: 122991 - RNA, 20 nt, Artificial Sequence
  MKO10122991_B_Trappc13
  gRNA
uccuguaacgugugaagaga

SEQ ID NO: 122992 - RNA, 20 nt, Artificial Sequence
  MKO10122992_B_Trappc1
  gRNA
aaccaccguacaugucuagc

SEQ ID NO: 122993 - RNA, 20 nt, Artificial Sequence
  MKO10122993_B_Trappc1
  gRNA
aaagugagcucuuucgaucc

SEQ ID NO: 122994 - RNA, 20 nt, Artificial Sequence
  MKO10122994_B_Trappc1
  gRNA
ugugucuacacuacagcgag

SEQ ID NO: 122995 - RNA, 20 nt, Artificial Sequence
  MKO10122995_B_Trappc2l
  gRNA
ggucccaccuugacuggaug

SEQ ID NO: 122996 - RNA, 20 nt, Artificial Sequence
  MKO10122996_B_Trappc2l
  gRNA
uggauacaccuuguaguccu

SEQ ID NO: 122997 - RNA, 20 nt, Artificial Sequence
  MKO10122997_B_Trappc2l
  gRNA
gaccaugacaaauuucaccu

SEQ ID NO: 122998 - RNA, 20 nt, Artificial Sequence
  MKO10122998_B_Trappc2
  gRNA
acuuuggauucugcuuuccc

SEQ ID NO: 122999 - RNA, 20 nt, Artificial Sequence
  MKO10122999_B_Trappc2
  gRNA
agcuucuacuucguaauugu

SEQ ID NO: 123000 - RNA, 20 nt, Artificial Sequence
  MKO10123000_B_Trappc2
  gRNA
uuauuaugcuucaugaugug

SEQ ID NO: 123001 - RNA, 20 nt, Artificial Sequence
  MKO10123001_B_Trappc3l
  gRNA
aauuaucaacauaaucgccc

SEQ ID NO: 123002 - RNA, 20 nt, Artificial Sequence
  MKO10123002_B_Trappc3l
  gRNA
ucugguugcccagcuaugca

SEQ ID NO: 123003 - RNA, 20 nt, Artificial Sequence
  MKO10123003_B_Trappc3l
  gRNA
uucuugcaagacagacuaaa

SEQ ID NO: 123004 - RNA, 20 nt, Artificial Sequence
  MKO10123004_B_Trappc3
  gRNA
gagauggcgugacagaaauc

SEQ ID NO: 123005 - RNA, 20 nt, Artificial Sequence
  MKO10123005_B_Trappc3
  gRNA
cuuccaaggggcuacaacau

SEQ ID NO: 123006 - RNA, 20 nt, Artificial Sequence
  MKO10123006_B_Trappc3
  gRNA
uggaguaaaugagggccgag

SEQ ID NO: 123007 - RNA, 20 nt, Artificial Sequence
  MKO10123007_B_Trappc4
  gRNA
augccugaacugcccuguuc

SEQ ID NO: 123008 - RNA, 20 nt, Artificial Sequence
  MKO10123008_B_Trappc4
  gRNA
ccagguucauccuaugaccc

SEQ ID NO: 123009 - RNA, 20 nt, Artificial Sequence
  MKO10123009_B_Trappc4
  gRNA
caagaauccauucuacuccu

SEQ ID NO: 123010 - RNA, 20 nt, Artificial Sequence
  MKO10123010_B_Trappc5
  gRNA
cgcccgaguccuagaugccc

SEQ ID NO: 123011 - RNA, 20 nt, Artificial Sequence
  MKO10123011_B_Trappc5
  gRNA
gauugcccgagaucgggccc

SEQ ID NO: 123012 - RNA, 20 nt, Artificial Sequence
  MKO10123012_B_Trappc5
  gRNA
ggacucgggcgcccaccugu

SEQ ID NO: 123013 - RNA, 20 nt, Artificial Sequence
  MKO10123013_B_Trappc6a
  gRNA
cucggggccacaguaucuag

SEQ ID NO: 123014 - RNA, 20 nt, Artificial Sequence
  MKO10123014_B_Trappc6a
  gRNA
ggcaucuaacuccucccuaa

SEQ ID NO: 123015 - RNA, 20 nt, Artificial Sequence
  MKO10123015_B_Trappc6a
  gRNA
ccgagcccauggugacaagg

SEQ ID NO: 123016 - RNA, 20 nt, Artificial Sequence
  MKO10123016_B_Trappc6b
  gRNA
cuaucaguccuugccccacu

SEQ ID NO: 123017 - RNA, 20 nt, Artificial Sequence
  MKO10123017_B_Trappc6b
  gRNA
uguuacuaagcuggagagca

SEQ ID NO: 123018 - RNA, 20 nt, Artificial Sequence
  MKO10123018_B_Trappc6b
  gRNA
uaguaucuagcauucacaug

SEQ ID NO: 123019 - RNA, 20 nt, Artificial Sequence
  MKO10123019_B_Trappc8
  gRNA
gugguuauaagguaugcugg

SEQ ID NO: 123020 - RNA, 20 nt, Artificial Sequence
  MKO10123020_B_Trappc8
  gRNA
gauuaugaccuuaacauaag

SEQ ID NO: 123021 - RNA, 20 nt, Artificial Sequence
  MKO10123021_B_Trappc8
  gRNA
agaaacucaugaucugaugc

SEQ ID NO: 123022 - RNA, 20 nt, Artificial Sequence
  MKO10123022_B_Trappc9
  gRNA
ugccacgcuucugaaucgcu

SEQ ID NO: 123023 - RNA, 20 nt, Artificial Sequence
  MKO10123023_B_Trappc9
  gRNA
gucaggauuuaugccguugg

SEQ ID NO: 123024 - RNA, 20 nt, Artificial Sequence
  MKO10123024_B_Trappc9
  gRNA
aagccgagcacaaccccucc

SEQ ID NO: 123025 - RNA, 20 nt, Artificial Sequence
  MKO10123025_B_Trau1
  gRNA
acuucuagccuucuugggcu

SEQ ID NO: 123026 - RNA, 20 nt, Artificial Sequence
  MKO10123026_B_Trau1
  gRNA
gucucugcuucucuacauag

SEQ ID NO: 123027 - RNA, 20 nt, Artificial Sequence
  MKO10123027_B_Trau1
  gRNA
guugaagaugcuccaauuua

SEQ ID NO: 123028 - RNA, 20 nt, Artificial Sequence
  MKO10123028_B_Trcg1
  gRNA
gcgcugacauuccugaaguu

SEQ ID NO: 123029 - RNA, 20 nt, Artificial Sequence
  MKO10123029_B_Trcg1
  gRNA
accgggaccaggauugaggc

SEQ ID NO: 123030 - RNA, 20 nt, Artificial Sequence
  MKO10123030_B_Trcg1
  gRNA
cagcaugacugaccuuaccc

SEQ ID NO: 123031 - RNA, 20 nt, Artificial Sequence
  MKO10123031_B_Trdmt1
  gRNA
acacauaccuugugaauggc

SEQ ID NO: 123032 - RNA, 20 nt, Artificial Sequence
  MKO10123032_B_Trdmt1
  gRNA
cuccaugccagccauucaca

SEQ ID NO: 123033 - RNA, 20 nt, Artificial Sequence
  MKO10123033_B_Trdmt1
  gRNA
auauucuagauauucuccca

SEQ ID NO: 123034 - RNA, 20 nt, Artificial Sequence
  MKO10123034_B_Trdn
  gRNA
aucugagccaaucuuggcaa

SEQ ID NO: 123035 - RNA, 20 nt, Artificial Sequence
  MKO10123035_B_Trdn
  gRNA
cauagaaauacaccaagaaa

SEQ ID NO: 123036 - RNA, 20 nt, Artificial Sequence
  MKO10123036_B_Trdn
  gRNA
gaaccucccuuaaaaagaaa

SEQ ID NO: 123037 - RNA, 20 nt, Artificial Sequence
  MKO10123037_B_Treh
  gRNA
uacagccagaucuacugcca

SEQ ID NO: 123038 - RNA, 20 nt, Artificial Sequence
  MKO10123038_B_Treh
  gRNA
gcuccugcaccaaguucaga

SEQ ID NO: 123039 - RNA, 20 nt, Artificial Sequence
  MKO10123039_B_Treh
  gRNA
ccagagucacuuccagcccg

SEQ ID NO: 123040 - RNA, 20 nt, Artificial Sequence
  MKO10123040_B_Trem1
  gRNA
cugugcguguucuuugucuc

SEQ ID NO: 123041 - RNA, 20 nt, Artificial Sequence
  MKO10123041_B_Trem1
  gRNA
cgcucugucagccuuguaau

SEQ ID NO: 123042 - RNA, 20 nt, Artificial Sequence
  MKO10123042_B_Trem1
  gRNA
gaugacugaaauaguaacac

SEQ ID NO: 123043 - RNA, 20 nt, Artificial Sequence
  MKO10123043_B_Trem2
  gRNA
cucgaaacucgaugacuccu

SEQ ID NO: 123044 - RNA, 20 nt, Artificial Sequence
  MKO10123044_B_Trem2
  gRNA
ccuuccugaagaagcggaau

SEQ ID NO: 123045 - RNA, 20 nt, Artificial Sequence
  MKO10123045_B_Trem2
  gRNA
caguccagcccucugaccac

SEQ ID NO: 123046 - RNA, 20 nt, Artificial Sequence
  MKO10123046_B_Trem3
  gRNA
guguggcuucauacuaaaca

SEQ ID NO: 123047 - RNA, 20 nt, Artificial Sequence
  MKO10123047_B_Trem3
  gRNA
ggaugucaccgcugcugcua

SEQ ID NO: 123048 - RNA, 20 nt, Artificial Sequence
  MKO10123048_B_Trem3
  gRNA
uuccaagacauccaaaguac

SEQ ID NO: 123049 - RNA, 20 nt, Artificial Sequence
  MKO10123049_B_Treml1
  gRNA
agcacucgcggaagggucca

SEQ ID NO: 123050 - RNA, 20 nt, Artificial Sequence
  MKO10123050_B_Treml1
  gRNA
cucucaguaucccccugauc

SEQ ID NO: 123051 - RNA, 20 nt, Artificial Sequence
  MKO10123051_B_Treml1
  gRNA
ugcugugcuccuguuggccc

SEQ ID NO: 123052 - RNA, 20 nt, Artificial Sequence
  MKO10123052_B_Treml2
  gRNA
uaaguuccggcgguucuugu

SEQ ID NO: 123053 - RNA, 20 nt, Artificial Sequence
  MKO10123053_B_Treml2
  gRNA
ucucuucuuccaaaacccgu

SEQ ID NO: 123054 - RNA, 20 nt, Artificial Sequence
  MKO10123054_B_Treml2
  gRNA
gagggucugaaauauggacu

SEQ ID NO: 123055 - RNA, 20 nt, Artificial Sequence
  MKO10123055_B_Treml4
  gRNA
gucaguggucuccucgggag

SEQ ID NO: 123056 - RNA, 20 nt, Artificial Sequence
  MKO10123056_B_Treml4
  gRNA
gagcaguugugaguaccucc

SEQ ID NO: 123057 - RNA, 20 nt, Artificial Sequence
  MKO10123057_B_Treml4
  gRNA
ucuggacugguauggccugg

SEQ ID NO: 123058 - RNA, 20 nt, Artificial Sequence
  MKO10123058_B_Trerf1
  gRNA
agaccgcuggugagcccuuc

SEQ ID NO: 123059 - RNA, 20 nt, Artificial Sequence
  MKO10123059_B_Trerf1
  gRNA
gagagcccaguccggauccc

SEQ ID NO: 123060 - RNA, 20 nt, Artificial Sequence
  MKO10123060_B_Trerf1
  gRNA
cuuugaucauaccuugauuc

SEQ ID NO: 123061 - RNA, 20 nt, Artificial Sequence
  MKO10123061_B_Trex1
  gRNA
agugcccagaccgccccgug

SEQ ID NO: 123062 - RNA, 20 nt, Artificial Sequence
  MKO10123062_B_Trex1
  gRNA
ccacuggaacaaccaaccua

SEQ ID NO: 123063 - RNA, 20 nt, Artificial Sequence
  MKO10123063_B_Trex1
  gRNA
guucguccacccacugcagu

SEQ ID NO: 123064 - RNA, 20 nt, Artificial Sequence
  MKO10123064_B_Trex2
  gRNA
accaucagguggcacguaca

SEQ ID NO: 123065 - RNA, 20 nt, Artificial Sequence
  MKO10123065_B_Trex2
  gRNA
acugccugcauugcggggcc

SEQ ID NO: 123066 - RNA, 20 nt, Artificial Sequence
  MKO10123066_B_Trex2
  gRNA
gcucaauaugagcccagcug

SEQ ID NO: 123067 - RNA, 20 nt, Artificial Sequence
  MKO10123067_B_Trf
  gRNA
gcgccuacguagccaaagaa

SEQ ID NO: 123068 - RNA, 20 nt, Artificial Sequence
  MKO10123068_B_Trf
  gRNA
cacagccacagcguaguagu

SEQ ID NO: 123069 - RNA, 20 nt, Artificial Sequence
  MKO10123069_B_Trf
  gRNA
aagaccguccuuccgccuga

SEQ ID NO: 123070 - RNA, 20 nt, Artificial Sequence
  MKO10123070_B_Trhde
  gRNA
acuuacuacaaccccacucu

SEQ ID NO: 123071 - RNA, 20 nt, Artificial Sequence
  MKO10123071_B_Trhde
  gRNA
uaagcauccuuaugcugcua

SEQ ID NO: 123072 - RNA, 20 nt, Artificial Sequence
  MKO10123072_B_Trhde
  gRNA
cagacuaccucuacccugcc

SEQ ID NO: 123073 - RNA, 20 nt, Artificial Sequence
  MKO10123073_B_Trhr2
  gRNA
gugaacgagugagacauugc

SEQ ID NO: 123074 - RNA, 20 nt, Artificial Sequence
  MKO10123074_B_Trhr2
  gRNA
cccggaauuucugcgacaug

SEQ ID NO: 123075 - RNA, 20 nt, Artificial Sequence
  MKO10123075_B_Trhr2
  gRNA
uguccgugacaaccagcgcc

SEQ ID NO: 123076 - RNA, 20 nt, Artificial Sequence
  MKO10123076_B_Trhr
  gRNA
uuauguugugccaaugaucc

SEQ ID NO: 123077 - RNA, 20 nt, Artificial Sequence
  MKO10123077_B_Trhr
  gRNA
uacaaccacugcgagcaucu

SEQ ID NO: 123078 - RNA, 20 nt, Artificial Sequence
  MKO10123078_B_Trhr
  gRNA
agaaauuucgugcagccuuc

SEQ ID NO: 123079 - RNA, 20 nt, Artificial Sequence
  MKO10123079_B_Trh
  gRNA
aagacguugaagccgaagag

SEQ ID NO: 123080 - RNA, 20 nt, Artificial Sequence
  MKO10123080_B_Trh
  gRNA
uuccucaagaaucgacguuc

SEQ ID NO: 123081 - RNA, 20 nt, Artificial Sequence
  MKO10123081_B_Trh
  gRNA
ccgacgugccaaccaagaca

SEQ ID NO: 123082 - RNA, 20 nt, Artificial Sequence
  MKO10123082_B_Triap1
  gRNA
ugccauggcccaugaacucc

SEQ ID NO: 123083 - RNA, 20 nt, Artificial Sequence
  MKO10123083_B_Triap1
  gRNA
acgaccagugcuucaaccgc

SEQ ID NO: 123084 - RNA, 20 nt, Artificial Sequence
  MKO10123084_B_Triap1
  gRNA
cguuugaagaggucggugca

SEQ ID NO: 123085 - RNA, 20 nt, Artificial Sequence
  MKO10123085_B_Trib1
  gRNA
gaacuguccacggcggauuu

SEQ ID NO: 123086 - RNA, 20 nt, Artificial Sequence
  MKO10123086_B_Trib1
  gRNA
ccuaugugcggagccgaaaa

SEQ ID NO: 123087 - RNA, 20 nt, Artificial Sequence
  MKO10123087_B_Trib1
  gRNA
cccccagcacgauggccgac

SEQ ID NO: 123088 - RNA, 20 nt, Artificial Sequence
  MKO10123088_B_Trib2
  gRNA
gagaucgcggaacaaaaccc

SEQ ID NO: 123089 - RNA, 20 nt, Artificial Sequence
  MKO10123089_B_Trib2
  gRNA
agauaaauuuccgcagcuug

SEQ ID NO: 123090 - RNA, 20 nt, Artificial Sequence
  MKO10123090_B_Trib2
  gRNA
guguucuuugagcgaagcua

SEQ ID NO: 123091 - RNA, 20 nt, Artificial Sequence
  MKO10123091_B_Trib3
  gRNA
cuggggagugguccgggcuc

SEQ ID NO: 123092 - RNA, 20 nt, Artificial Sequence
  MKO10123092_B_Trib3
  gRNA
gaagaugccugcgugaugac

SEQ ID NO: 123093 - RNA, 20 nt, Artificial Sequence
  MKO10123093_B_Trib3
  gRNA
aucugauccagucaucacgc

SEQ ID NO: 123094 - RNA, 20 nt, Artificial Sequence
  MKO10123094_B_Tril
  gRNA
ucuugcccaaaaaacggauc

SEQ ID NO: 123095 - RNA, 20 nt, Artificial Sequence
  MKO10123095_B_Tril
  gRNA
cacccccuaccuaguaugcg

SEQ ID NO: 123096 - RNA, 20 nt, Artificial Sequence
  MKO10123096_B_Tril
  gRNA
cgagaagcucucacgacuag

SEQ ID NO: 123097 - RNA, 20 nt, Artificial Sequence
  MKO10123097_B_Trim10
  gRNA
auaucagaagcacucuaaua

SEQ ID NO: 123098 - RNA, 20 nt, Artificial Sequence
  MKO10123098_B_Trim10
  gRNA
gucuucaucuccugccgcag

SEQ ID NO: 123099 - RNA, 20 nt, Artificial Sequence
  MKO10123099_B_Trim10
  gRNA
agaagugucucgugugucua

SEQ ID NO: 123100 - RNA, 20 nt, Artificial Sequence
  MKO10123100_B_Trim11
  gRNA
gcaccuacggaaacaaaugg

SEQ ID NO: 123101 - RNA, 20 nt, Artificial Sequence
  MKO10123101_B_Trim11
  gRNA
acccaccucggaaccuccgc

SEQ ID NO: 123102 - RNA, 20 nt, Artificial Sequence
  MKO10123102_B_Trim11
  gRNA
cgcaaugcuguuccaagccc

SEQ ID NO: 123103 - RNA, 20 nt, Artificial Sequence
  MKO10123103_B_Trim12a
  gRNA
uuucuuacaggagcagcugc

SEQ ID NO: 123104 - RNA, 20 nt, Artificial Sequence
  MKO10123104_B_Trim12a
  gRNA
gcucacuuucagacucugcc

SEQ ID NO: 123105 - RNA, 20 nt, Artificial Sequence
  MKO10123105_B_Trim12a
  gRNA
agaagcccaaagccaucgcc

SEQ ID NO: 123106 - RNA, 20 nt, Artificial Sequence
  MKO10123106_B_Trim12c
  gRNA
uuucuuacaggagcagcugc

SEQ ID NO: 123107 - RNA, 20 nt, Artificial Sequence
  MKO10123107_B_Trim12c
  gRNA
guguggagaacaucauaaaa

SEQ ID NO: 123108 - RNA, 20 nt, Artificial Sequence
  MKO10123108_B_Trim12c
  gRNA
agaagcccaaagccaucgcc

SEQ ID NO: 123109 - RNA, 20 nt, Artificial Sequence
  MKO10123109_B_Trim13
  gRNA
aguuaugcaaaccuaugacc

SEQ ID NO: 123110 - RNA, 20 nt, Artificial Sequence
  MKO10123110_B_Trim13
  gRNA
uaaaaucagcagacuuaguc

SEQ ID NO: 123111 - RNA, 20 nt, Artificial Sequence
  MKO10123111_B_Trim13
  gRNA
agcccuccaguuacucacga

SEQ ID NO: 123112 - RNA, 20 nt, Artificial Sequence
  MKO10123112_B_Trim14
  gRNA
uccuucaggcgaguguccau

SEQ ID NO: 123113 - RNA, 20 nt, Artificial Sequence
  MKO10123113_B_Trim14
  gRNA
ugucugcaacguguucccga

SEQ ID NO: 123114 - RNA, 20 nt, Artificial Sequence
  MKO10123114_B_Trim14
  gRNA
agacgccggggaaaggcuca

SEQ ID NO: 123115 - RNA, 20 nt, Artificial Sequence
  MKO10123115_B_Trim15
  gRNA
acuagaacggcagaucugca

SEQ ID NO: 123116 - RNA, 20 nt, Artificial Sequence
  MKO10123116_B_Trim15
  gRNA
uuaccugcucugauugaguc

SEQ ID NO: 123117 - RNA, 20 nt, Artificial Sequence
  MKO10123117_B_Trim15
  gRNA
ugaucuuuaccagaaccucc

SEQ ID NO: 123118 - RNA, 20 nt, Artificial Sequence
  MKO10123118_B_Trim16
  gRNA
acuccucgcagcuguacgga

SEQ ID NO: 123119 - RNA, 20 nt, Artificial Sequence
  MKO10123119_B_Trim16
  gRNA
agcuaaccauaagucuguuu

SEQ ID NO: 123120 - RNA, 20 nt, Artificial Sequence
  MKO10123120_B_Trim16
  gRNA
ccuuauagcuuucuagcaau

SEQ ID NO: 123121 - RNA, 20 nt, Artificial Sequence
  MKO10123121_B_Trim17
  gRNA
cuucagcgugcaguacccag

SEQ ID NO: 123122 - RNA, 20 nt, Artificial Sequence
  MKO10123122_B_Trim17
  gRNA
gcacaaggucuugauagccg

SEQ ID NO: 123123 - RNA, 20 nt, Artificial Sequence
  MKO10123123_B_Trim17
  gRNA
ucagguccagggagcggcuu

SEQ ID NO: 123124 - RNA, 20 nt, Artificial Sequence
  MKO10123124_B_Trim21
  gRNA
cgucaauaucuaacgugucc

SEQ ID NO: 123125 - RNA, 20 nt, Artificial Sequence
  MKO10123125_B_Trim21
  gRNA
ucuacaggagaagauccacg

SEQ ID NO: 123126 - RNA, 20 nt, Artificial Sequence
  MKO10123126_B_Trim21
  gRNA
guuggccgagaagauggaaa

SEQ ID NO: 123127 - RNA, 20 nt, Artificial Sequence
  MKO10123127_B_Trim23
  gRNA
aagcucguaccuugugaccu

SEQ ID NO: 123128 - RNA, 20 nt, Artificial Sequence
  MKO10123128_B_Trim23
  gRNA
aauaagcucugacacaugau

SEQ ID NO: 123129 - RNA, 20 nt, Artificial Sequence
  MKO10123129_B_Trim23
  gRNA
ucaugagguuuaucagcuag

SEQ ID NO: 123130 - RNA, 20 nt, Artificial Sequence
  MKO10123130_B_Trim24
  gRNA
gcacacucuugacugcaaac

SEQ ID NO: 123131 - RNA, 20 nt, Artificial Sequence
  MKO10123131_B_Trim24
  gRNA
uacucuaaucaccaaacuga

SEQ ID NO: 123132 - RNA, 20 nt, Artificial Sequence
  MKO10123132_B_Trim24
  gRNA
cagaaagaagaaguaucucc

SEQ ID NO: 123133 - RNA, 20 nt, Artificial Sequence
  MKO10123133_B_Trim25
  gRNA
cuacaucccuaagauagauc

SEQ ID NO: 123134 - RNA, 20 nt, Artificial Sequence
  MKO10123134_B_Trim25
  gRNA
ucucacauccuccaaugcuu

SEQ ID NO: 123135 - RNA, 20 nt, Artificial Sequence
  MKO10123135_B_Trim25
  gRNA
uugauaaugggaaucuacca

SEQ ID NO: 123136 - RNA, 20 nt, Artificial Sequence
  MKO10123136_B_Trim26
  gRNA
uuacuuguuggcgaaguccu

SEQ ID NO: 123137 - RNA, 20 nt, Artificial Sequence
  MKO10123137_B_Trim26
  gRNA
cuaggaugucugcacuacac

SEQ ID NO: 123138 - RNA, 20 nt, Artificial Sequence
  MKO10123138_B_Trim26
  gRNA
caagggagaagcugauauuc

SEQ ID NO: 123139 - RNA, 20 nt, Artificial Sequence
  MKO10123139_B_Trim27
  gRNA
gaaagucuaaaacaguucac

SEQ ID NO: 123140 - RNA, 20 nt, Artificial Sequence
  MKO10123140_B_Trim27
  gRNA
acauuggagacacacugagc

SEQ ID NO: 123141 - RNA, 20 nt, Artificial Sequence
  MKO10123141_B_Trim27
  gRNA
gcaggcccgagcugagcuuu

SEQ ID NO: 123142 - RNA, 20 nt, Artificial Sequence
  MKO10123142_B_Trim28
  gRNA
ucuccaucucgagucuuagc

SEQ ID NO: 123143 - RNA, 20 nt, Artificial Sequence
  MKO10123143_B_Trim28
  gRNA
gaggaaccaacguaaacucu

SEQ ID NO: 123144 - RNA, 20 nt, Artificial Sequence
  MKO10123144_B_Trim28
  gRNA
ccuugguguauuucacccgc

SEQ ID NO: 123145 - RNA, 20 nt, Artificial Sequence
  MKO10123145_B_Trim29
  gRNA
gaccgagcugucacugcaaa

SEQ ID NO: 123146 - RNA, 20 nt, Artificial Sequence
  MKO10123146_B_Trim29
  gRNA
ccacucguucccauagcugc

SEQ ID NO: 123147 - RNA, 20 nt, Artificial Sequence
  MKO10123147_B_Trim29
  gRNA
cgauccuggagcagaacuuc

SEQ ID NO: 123148 - RNA, 20 nt, Artificial Sequence
  MKO10123148_B_Trim2
  gRNA
agcuggacgcagucaacaaa

SEQ ID NO: 123149 - RNA, 20 nt, Artificial Sequence
  MKO10123149_B_Trim2
  gRNA
gaguccucgccguugcugcc

SEQ ID NO: 123150 - RNA, 20 nt, Artificial Sequence
  MKO10123150_B_Trim2
  gRNA
gcagcacaaggccucgcucc

SEQ ID NO: 123151 - RNA, 20 nt, Artificial Sequence
  MKO10123151_B_Trim30a
  gRNA
ugcagcaugccuuucagauc

SEQ ID NO: 123152 - RNA, 20 nt, Artificial Sequence
  MKO10123152_B_Trim30a
  gRNA
cucaaccuuagaaaugcugc

SEQ ID NO: 123153 - RNA, 20 nt, Artificial Sequence
  MKO10123153_B_Trim30a
  gRNA
gugcaaauuguguccugaga

SEQ ID NO: 123154 - RNA, 20 nt, Artificial Sequence
  MKO10123154_B_Trim30b
  gRNA
guaucaugaaauuugacauu

SEQ ID NO: 123155 - RNA, 20 nt, Artificial Sequence
  MKO10123155_B_Trim30b
  gRNA
ucaccuacaauucagugucu

SEQ ID NO: 123156 - RNA, 20 nt, Artificial Sequence
  MKO10123156_B_Trim30b
  gRNA
uucuagacaugucuacuucc

SEQ ID NO: 123157 - RNA, 20 nt, Artificial Sequence
  MKO10123157_B_Trim30d
  gRNA
guguaaauuauguccugaca

SEQ ID NO: 123158 - RNA, 20 nt, Artificial Sequence
  MKO10123158_B_Trim30d
  gRNA
uccaaagcuccacauuugaa

SEQ ID NO: 123159 - RNA, 20 nt, Artificial Sequence
  MKO10123159_B_Trim30d
  gRNA
augagaaaagaugugaugaa

SEQ ID NO: 123160 - RNA, 20 nt, Artificial Sequence
  MKO10123160_B_Trim31
  gRNA
acucaccuuuaguagcucca

SEQ ID NO: 123161 - RNA, 20 nt, Artificial Sequence
  MKO10123161_B_Trim31
  gRNA
ccucaccuuugaguucuguc

SEQ ID NO: 123162 - RNA, 20 nt, Artificial Sequence
  MKO10123162_B_Trim31
  gRNA
acaggugcagauugagucac

SEQ ID NO: 123163 - RNA, 20 nt, Artificial Sequence
  MKO10123163_B_Trim32
  gRNA
ccuaccaucuggccaguuug

SEQ ID NO: 123164 - RNA, 20 nt, Artificial Sequence
  MKO10123164_B_Trim32
  gRNA
gggagaaguugacucgucua

SEQ ID NO: 123165 - RNA, 20 nt, Artificial Sequence
  MKO10123165_B_Trim32
  gRNA
gggcuucccccgcgaaacag

SEQ ID NO: 123166 - RNA, 20 nt, Artificial Sequence
  MKO10123166_B_Trim33
  gRNA
ucacuaaagaccaccugauc

SEQ ID NO: 123167 - RNA, 20 nt, Artificial Sequence
  MKO10123167_B_Trim33
  gRNA
gaagauaaugcaagugcagu

SEQ ID NO: 123168 - RNA, 20 nt, Artificial Sequence
  MKO10123168_B_Trim33
  gRNA
guguagagacugucaacuuu

SEQ ID NO: 123169 - RNA, 20 nt, Artificial Sequence
  MKO10123169_B_Trim34a
  gRNA
gcucagccucugcccccgcc

SEQ ID NO: 123170 - RNA, 20 nt, Artificial Sequence
  MKO10123170_B_Trim34a
  gRNA
uguagcaugccacucagauc

SEQ ID NO: 123171 - RNA, 20 nt, Artificial Sequence
  MKO10123171_B_Trim34a
  gRNA
ccaucccuaggagucagauc

SEQ ID NO: 123172 - RNA, 20 nt, Artificial Sequence
  MKO10123172_B_Trim34b
  gRNA
gcucagccucugcccccgcc

SEQ ID NO: 123173 - RNA, 20 nt, Artificial Sequence
  MKO10123173_B_Trim34b
  gRNA
uguagcaugccacucagauc

SEQ ID NO: 123174 - RNA, 20 nt, Artificial Sequence
  MKO10123174_B_Trim34b
  gRNA
ccaucccuaggagucagauc

SEQ ID NO: 123175 - RNA, 20 nt, Artificial Sequence
  MKO10123175_B_Trim35
  gRNA
agucccugcaguaccgaguc

SEQ ID NO: 123176 - RNA, 20 nt, Artificial Sequence
  MKO10123176_B_Trim35
  gRNA
acaagcuccgugauuuccug

SEQ ID NO: 123177 - RNA, 20 nt, Artificial Sequence
  MKO10123177_B_Trim35
  gRNA
ggcccugaggcgcaccuaug

SEQ ID NO: 123178 - RNA, 20 nt, Artificial Sequence
  MKO10123178_B_Trim36
  gRNA
gcuucaaaauuuaucauccc

SEQ ID NO: 123179 - RNA, 20 nt, Artificial Sequence
  MKO10123179_B_Trim36
  gRNA
cacugcucauggugguuacc

SEQ ID NO: 123180 - RNA, 20 nt, Artificial Sequence
  MKO10123180_B_Trim36
  gRNA
gugggaaucauuccaaucac

SEQ ID NO: 123181 - RNA, 20 nt, Artificial Sequence
  MKO10123181_B_Trim37
  gRNA
cuccccaaagugcacacuga

SEQ ID NO: 123182 - RNA, 20 nt, Artificial Sequence
  MKO10123182_B_Trim37
  gRNA
uuuccgauguuucauuugua

SEQ ID NO: 123183 - RNA, 20 nt, Artificial Sequence
  MKO10123183_B_Trim37
  gRNA
ucuccauacaaaugaaacau

SEQ ID NO: 123184 - RNA, 20 nt, Artificial Sequence
  MKO10123184_B_Trim38
  gRNA
gccucaccuguagcaauuuc

SEQ ID NO: 123185 - RNA, 20 nt, Artificial Sequence
  MKO10123185_B_Trim38
  gRNA
acgugaaaaacacuuugagc

SEQ ID NO: 123186 - RNA, 20 nt, Artificial Sequence
  MKO10123186_B_Trim38
  gRNA
uuaccuuccaggcauuuauu

SEQ ID NO: 123187 - RNA, 20 nt, Artificial Sequence
  MKO10123187_B_Trim39
  gRNA
agcuuuaccuugagcucccc

SEQ ID NO: 123188 - RNA, 20 nt, Artificial Sequence
  MKO10123188_B_Trim39
  gRNA
cucuucggaggcuuugcagc

SEQ ID NO: 123189 - RNA, 20 nt, Artificial Sequence
  MKO10123189_B_Trim39
  gRNA
agaacuucagcaauuucccc

SEQ ID NO: 123190 - RNA, 20 nt, Artificial Sequence
  MKO10123190_B_Trim3
  gRNA
ugcgcggcacucaccacaca

SEQ ID NO: 123191 - RNA, 20 nt, Artificial Sequence
  MKO10123191_B_Trim3
  gRNA
gcugucugcagcuaucgccu

SEQ ID NO: 123192 - RNA, 20 nt, Artificial Sequence
  MKO10123192_B_Trim3
  gRNA
auggaugucugccggcacac

SEQ ID NO: 123193 - RNA, 20 nt, Artificial Sequence
  MKO10123193_B_Trim40
  gRNA
ccaggaugccagugacuuac

SEQ ID NO: 123194 - RNA, 20 nt, Artificial Sequence
  MKO10123194_B_Trim40
  gRNA
ggaccaagaggacuuaccag

SEQ ID NO: 123195 - RNA, 20 nt, Artificial Sequence
  MKO10123195_B_Trim40
  gRNA
ccuucaacagcugaaggcuc

SEQ ID NO: 123196 - RNA, 20 nt, Artificial Sequence
  MKO10123196_B_Trim41
  gRNA
uccucacgauggcgucuguc

SEQ ID NO: 123197 - RNA, 20 nt, Artificial Sequence
  MKO10123197_B_Trim41
  gRNA
aucccucaggccaagcuaca

SEQ ID NO: 123198 - RNA, 20 nt, Artificial Sequence
  MKO10123198_B_Trim41
  gRNA
uuccacaugcccuuguagcu

SEQ ID NO: 123199 - RNA, 20 nt, Artificial Sequence
  MKO10123199_B_Trim42
  gRNA
guaaaggccgucagucgucu

SEQ ID NO: 123200 - RNA, 20 nt, Artificial Sequence
  MKO10123200_B_Trim42
  gRNA
gacgugcccaacagaagacg

SEQ ID NO: 123201 - RNA, 20 nt, Artificial Sequence
  MKO10123201_B_Trim42
  gRNA
gugggaagaaccgggcuaag

SEQ ID NO: 123202 - RNA, 20 nt, Artificial Sequence
  MKO10123202_B_Trim43a
  gRNA
ucuuugcaggaguaagcuag

SEQ ID NO: 123203 - RNA, 20 nt, Artificial Sequence
  MKO10123203_B_Trim43a
  gRNA
agaauuauguagaaauagag

SEQ ID NO: 123204 - RNA, 20 nt, Artificial Sequence
  MKO10123204_B_Trim43a
  gRNA
cuauuucuacauaauucugc

SEQ ID NO: 123205 - RNA, 20 nt, Artificial Sequence
  MKO10123205_B_Trim43b
  gRNA
ucaccugcaccagcagcucc

SEQ ID NO: 123206 - RNA, 20 nt, Artificial Sequence
  MKO10123206_B_Trim43b
  gRNA
acuuggaugacuuguucaga

SEQ ID NO: 123207 - RNA, 20 nt, Artificial Sequence
  MKO10123207_B_Trim43b
  gRNA
uccuugcaggaguaagcuag

SEQ ID NO: 123208 - RNA, 20 nt, Artificial Sequence
  MKO10123208_B_Trim43c
  gRNA
uucagaaguccgugaagcua

SEQ ID NO: 123209 - RNA, 20 nt, Artificial Sequence
  MKO10123209_B_Trim43c
  gRNA
acuuggaugacuuguucaga

SEQ ID NO: 123210 - RNA, 20 nt, Artificial Sequence
  MKO10123210_B_Trim43c
  gRNA
uugagccuugcagucagccc

SEQ ID NO: 123211 - RNA, 20 nt, Artificial Sequence
  MKO10123211_B_Trim44
  gRNA
uucuucuagagcaaagauuc

SEQ ID NO: 123212 - RNA, 20 nt, Artificial Sequence
  MKO10123212_B_Trim44
  gRNA
cauugcugccuucaguccac

SEQ ID NO: 123213 - RNA, 20 nt, Artificial Sequence
  MKO10123213_B_Trim44
  gRNA
ucauguguccucuucuucac

SEQ ID NO: 123214 - RNA, 20 nt, Artificial Sequence
  MKO10123214_B_Trim45
  gRNA
aaucucuaaguccgagccgc

SEQ ID NO: 123215 - RNA, 20 nt, Artificial Sequence
  MKO10123215_B_Trim45
  gRNA
ccgcguuuccuacaccccca

SEQ ID NO: 123216 - RNA, 20 nt, Artificial Sequence
  MKO10123216_B_Trim45
  gRNA
ccucgggacagagcaugggc

SEQ ID NO: 123217 - RNA, 20 nt, Artificial Sequence
  MKO10123217_B_Trim46
  gRNA
uuguacccacaacgugugcc

SEQ ID NO: 123218 - RNA, 20 nt, Artificial Sequence
  MKO10123218_B_Trim46
  gRNA
uacgccguacucugcagagu

SEQ ID NO: 123219 - RNA, 20 nt, Artificial Sequence
  MKO10123219_B_Trim46
  gRNA
cuguaagacaugucaacgac

SEQ ID NO: 123220 - RNA, 20 nt, Artificial Sequence
  MKO10123220_B_Trim47
  gRNA
cugggaccggcccaacauug

SEQ ID NO: 123221 - RNA, 20 nt, Artificial Sequence
  MKO10123221_B_Trim47
  gRNA
acagcgcagccgccuaagca

SEQ ID NO: 123222 - RNA, 20 nt, Artificial Sequence
  MKO10123222_B_Trim47
  gRNA
cucucaccgcuuugaccacc

SEQ ID NO: 123223 - RNA, 20 nt, Artificial Sequence
  MKO10123223_B_Trim50
  gRNA
ccucaccuggcagaaccuuc

SEQ ID NO: 123224 - RNA, 20 nt, Artificial Sequence
  MKO10123224_B_Trim50
  gRNA
ccgcauaucugagcugaagg

SEQ ID NO: 123225 - RNA, 20 nt, Artificial Sequence
  MKO10123225_B_Trim50
  gRNA
aggaacguggaggagcacau

SEQ ID NO: 123226 - RNA, 20 nt, Artificial Sequence
  MKO10123226_B_Trim52
  gRNA
ucagcugcccgcaaugccga

SEQ ID NO: 123227 - RNA, 20 nt, Artificial Sequence
  MKO10123227_B_Trim52
  gRNA
ccccacauccgccugugcgu

SEQ ID NO: 123228 - RNA, 20 nt, Artificial Sequence
  MKO10123228_B_Trim52
  gRNA
uuuaaggaccccguguccau

SEQ ID NO: 123229 - RNA, 20 nt, Artificial Sequence
  MKO10123229_B_Trim54
  gRNA
guuuccgaugcccaucuugu

SEQ ID NO: 123230 - RNA, 20 nt, Artificial Sequence
  MKO10123230_B_Trim54
  gRNA
ggcgggcaaugaccgugugc

SEQ ID NO: 123231 - RNA, 20 nt, Artificial Sequence
  MKO10123231_B_Trim54
  gRNA
acaaccucgugccuacaaga

SEQ ID NO: 123232 - RNA, 20 nt, Artificial Sequence
  MKO10123232_B_Trim55
  gRNA
uaacaccaccucaugucugc

SEQ ID NO: 123233 - RNA, 20 nt, Artificial Sequence
  MKO10123233_B_Trim55
  gRNA
ccuggagaacguauccaagu

SEQ ID NO: 123234 - RNA, 20 nt, Artificial Sequence
  MKO10123234_B_Trim55
  gRNA
ggcgccaaaaaccuugcaca

SEQ ID NO: 123235 - RNA, 20 nt, Artificial Sequence
  MKO10123235_B_Trim56
  gRNA
cugugccgacgacuuaugcc

SEQ ID NO: 123236 - RNA, 20 nt, Artificial Sequence
  MKO10123236_B_Trim56
  gRNA
auugugccuguacccgccga

SEQ ID NO: 123237 - RNA, 20 nt, Artificial Sequence
  MKO10123237_B_Trim56
  gRNA
gcaagcaggggugaucgaua

SEQ ID NO: 123238 - RNA, 20 nt, Artificial Sequence
  MKO10123238_B_Trim58
  gRNA
gagcgagaggagucuugaca

SEQ ID NO: 123239 - RNA, 20 nt, Artificial Sequence
  MKO10123239_B_Trim58
  gRNA
caggcuggcccaacagaaca

SEQ ID NO: 123240 - RNA, 20 nt, Artificial Sequence
  MKO10123240_B_Trim58
  gRNA
ccagaugugaggcuaucaca

SEQ ID NO: 123241 - RNA, 20 nt, Artificial Sequence
  MKO10123241_B_Trim59
  gRNA
ugagucuccacuuaaauuuc

SEQ ID NO: 123242 - RNA, 20 nt, Artificial Sequence
  MKO10123242_B_Trim59
  gRNA
uucaaagaugcuguaacaga

SEQ ID NO: 123243 - RNA, 20 nt, Artificial Sequence
  MKO10123243_B_Trim59
  gRNA
caauuagcuccuuaaaauac

SEQ ID NO: 123244 - RNA, 20 nt, Artificial Sequence
  MKO10123244_B_Trim60
  gRNA
cucaagccagaauacugcgc

SEQ ID NO: 123245 - RNA, 20 nt, Artificial Sequence
  MKO10123245_B_Trim60
  gRNA
caaaaauaugccgaccuugc

SEQ ID NO: 123246 - RNA, 20 nt, Artificial Sequence
  MKO10123246_B_Trim60
  gRNA
gccauugcaacguuaaaguu

SEQ ID NO: 123247 - RNA, 20 nt, Artificial Sequence
  MKO10123247_B_Trim61
  gRNA
acuuaccucggggcacauuu

SEQ ID NO: 123248 - RNA, 20 nt, Artificial Sequence
  MKO10123248_B_Trim61
  gRNA
cacccaaugcaacauaaguu

SEQ ID NO: 123249 - RNA, 20 nt, Artificial Sequence
  MKO10123249_B_Trim61
  gRNA
cgugaucugauaauuucgcu

SEQ ID NO: 123250 - RNA, 20 nt, Artificial Sequence
  MKO10123250_B_Trim62
  gRNA
accaaagcgcuuugacguag

SEQ ID NO: 123251 - RNA, 20 nt, Artificial Sequence
  MKO10123251_B_Trim62
  gRNA
gcagcuccucaagcgacagu

SEQ ID NO: 123252 - RNA, 20 nt, Artificial Sequence
  MKO10123252_B_Trim62
  gRNA
gaagucuucguacguuaggu

SEQ ID NO: 123253 - RNA, 20 nt, Artificial Sequence
  MKO10123253_B_Trim63
  gRNA
ucuucaggagaauagccacc

SEQ ID NO: 123254 - RNA, 20 nt, Artificial Sequence
  MKO10123254_B_Trim63
  gRNA
gcagacgaucaucucucagc

SEQ ID NO: 123255 - RNA, 20 nt, Artificial Sequence
  MKO10123255_B_Trim63
  gRNA
caucuacugucucacgugug

SEQ ID NO: 123256 - RNA, 20 nt, Artificial Sequence
  MKO10123256_B_Trim65
  gRNA
uggggaggcucuucucuuca

SEQ ID NO: 123257 - RNA, 20 nt, Artificial Sequence
  MKO10123257_B_Trim65
  gRNA
ccaguacccucgcucucagc

SEQ ID NO: 123258 - RNA, 20 nt, Artificial Sequence
  MKO10123258_B_Trim65
  gRNA
uuaagagacccugggucccc

SEQ ID NO: 123259 - RNA, 20 nt, Artificial Sequence
  MKO10123259_B_Trim66
  gRNA
gcucuuugugcuccaccauc

SEQ ID NO: 123260 - RNA, 20 nt, Artificial Sequence
  MKO10123260_B_Trim66
  gRNA
cucucuuagaugcaggcacg

SEQ ID NO: 123261 - RNA, 20 nt, Artificial Sequence
  MKO10123261_B_Trim66
  gRNA
ucucuggcaggggugaaugg

SEQ ID NO: 123262 - RNA, 20 nt, Artificial Sequence
  MKO10123262_B_Trim67
  gRNA
ucaucuggacgaaauccagc

SEQ ID NO: 123263 - RNA, 20 nt, Artificial Sequence
  MKO10123263_B_Trim67
  gRNA
gggcgucacacugagccacc

SEQ ID NO: 123264 - RNA, 20 nt, Artificial Sequence
  MKO10123264_B_Trim67
  gRNA
gguggcucagugugacgccc

SEQ ID NO: 123265 - RNA, 20 nt, Artificial Sequence
  MKO10123265_B_Trim68
  gRNA
aagacagauugccgugugcu

SEQ ID NO: 123266 - RNA, 20 nt, Artificial Sequence
  MKO10123266_B_Trim68
  gRNA
guauucaggaagccuugaac

SEQ ID NO: 123267 - RNA, 20 nt, Artificial Sequence
  MKO10123267_B_Trim68
  gRNA
cuugcaguggaaacuccagc

SEQ ID NO: 123268 - RNA, 20 nt, Artificial Sequence
  MKO10123268_B_Trim69
  gRNA
ggugaaucugaaccagauuc

SEQ ID NO: 123269 - RNA, 20 nt, Artificial Sequence
  MKO10123269_B_Trim69
  gRNA
acaucacaaagcucauagag

SEQ ID NO: 123270 - RNA, 20 nt, Artificial Sequence
  MKO10123270_B_Trim69
  gRNA
agaugcuauuucugcuuaca

SEQ ID NO: 123271 - RNA, 20 nt, Artificial Sequence
  MKO10123271_B_Trim6
  gRNA
uccucacuaggagugaguuc

SEQ ID NO: 123272 - RNA, 20 nt, Artificial Sequence
  MKO10123272_B_Trim6
  gRNA
gaagcuaaaagcucuuaucc

SEQ ID NO: 123273 - RNA, 20 nt, Artificial Sequence
  MKO10123273_B_Trim6
  gRNA
augugggugauguuacaaaa

SEQ ID NO: 123274 - RNA, 20 nt, Artificial Sequence
  MKO10123274_B_Trim71
  gRNA
ccucgaagccguacuuguuc

SEQ ID NO: 123275 - RNA, 20 nt, Artificial Sequence
  MKO10123275_B_Trim71
  gRNA
ggcgaaggugguccagucug

SEQ ID NO: 123276 - RNA, 20 nt, Artificial Sequence
  MKO10123276_B_Trim71
  gRNA
cgucacagcucgccacaaga

SEQ ID NO: 123277 - RNA, 20 nt, Artificial Sequence
  MKO10123277_B_Trim72
  gRNA
gcgcaaggagaagacuguag

SEQ ID NO: 123278 - RNA, 20 nt, Artificial Sequence
  MKO10123278_B_Trim72
  gRNA
ccugucagagucaccaccac

SEQ ID NO: 123279 - RNA, 20 nt, Artificial Sequence
  MKO10123279_B_Trim72
  gRNA
uugcucaccugcugguuacc

SEQ ID NO: 123280 - RNA, 20 nt, Artificial Sequence
  MKO10123280_B_Trim75
  gRNA
ugagagccacgggcgccacc

SEQ ID NO: 123281 - RNA, 20 nt, Artificial Sequence
  MKO10123281_B_Trim75
  gRNA
agagcagcaccaguugcgag

SEQ ID NO: 123282 - RNA, 20 nt, Artificial Sequence
  MKO10123282_B_Trim75
  gRNA
gccgcaagagcuacaagcau

SEQ ID NO: 123283 - RNA, 20 nt, Artificial Sequence
  MKO10123283_B_Trim7
  gRNA
ugucucuguagaggaucucc

SEQ ID NO: 123284 - RNA, 20 nt, Artificial Sequence
  MKO10123284_B_Trim7
  gRNA
cuucaucucagaugagacug

SEQ ID NO: 123285 - RNA, 20 nt, Artificial Sequence
  MKO10123285_B_Trim7
  gRNA
cuucuuucuccagcucuccc

SEQ ID NO: 123286 - RNA, 20 nt, Artificial Sequence
  MKO10123286_B_Trim8
  gRNA
cuccaagcuguuccugaacg

SEQ ID NO: 123287 - RNA, 20 nt, Artificial Sequence
  MKO10123287_B_Trim8
  gRNA
gcucgagucagacaagcgcc

SEQ ID NO: 123288 - RNA, 20 nt, Artificial Sequence
  MKO10123288_B_Trim8
  gRNA
cugacucgagcuuguacagc

SEQ ID NO: 123289 - RNA, 20 nt, Artificial Sequence
  MKO10123289_B_Trim9
  gRNA
ucaucgaugcccuaaaccga

SEQ ID NO: 123290 - RNA, 20 nt, Artificial Sequence
  MKO10123290_B_Trim9
  gRNA
cccuguccgacaauccauuc

SEQ ID NO: 123291 - RNA, 20 nt, Artificial Sequence
  MKO10123291_B_Trim9
  gRNA
caucgaugagcgcaucacac

SEQ ID NO: 123292 - RNA, 20 nt, Artificial Sequence
  MKO10123292_B_Triml1
  gRNA
acaucacucguuccuucuca

SEQ ID NO: 123293 - RNA, 20 nt, Artificial Sequence
  MKO10123293_B_Triml1
  gRNA
ggccauccugaaccaugaga

SEQ ID NO: 123294 - RNA, 20 nt, Artificial Sequence
  MKO10123294_B_Triml1
  gRNA
cugagccugugucacaucac

SEQ ID NO: 123295 - RNA, 20 nt, Artificial Sequence
  MKO10123295_B_Triml2
  gRNA
gaagucccaagaaaugcuac

SEQ ID NO: 123296 - RNA, 20 nt, Artificial Sequence
  MKO10123296_B_Triml2
  gRNA
gauuagguccauuuaaguuc

SEQ ID NO: 123297 - RNA, 20 nt, Artificial Sequence
  MKO10123297_B_Triml2
  gRNA
aucugccguugcacugcucc

SEQ ID NO: 123298 - RNA, 20 nt, Artificial Sequence
  MKO10123298_B_Triobp
  gRNA
uacugacgucacagaguaug

SEQ ID NO: 123299 - RNA, 20 nt, Artificial Sequence
  MKO10123299_B_Triobp
  gRNA
gcaccuuaccuccucagccg

SEQ ID NO: 123300 - RNA, 20 nt, Artificial Sequence
  MKO10123300_B_Triobp
  gRNA
augucaaucuuggaugagcc

SEQ ID NO: 123301 - RNA, 20 nt, Artificial Sequence
  MKO10123301_B_Trio
  gRNA
acagugauuguggacaugcg

SEQ ID NO: 123302 - RNA, 20 nt, Artificial Sequence
  MKO10123302_B_Trio
  gRNA
cagaaacagaggacgaauuu

SEQ ID NO: 123303 - RNA, 20 nt, Artificial Sequence
  MKO10123303_B_Trio
  gRNA
gaaaaagucgccuaucuuuc

SEQ ID NO: 123304 - RNA, 20 nt, Artificial Sequence
  MKO10123304_B_Trip10
  gRNA
ucgucgggcccagcagcagc

SEQ ID NO: 123305 - RNA, 20 nt, Artificial Sequence
  MKO10123305_B_Trip10
  gRNA
cugcgaagucauugaccucc

SEQ ID NO: 123306 - RNA, 20 nt, Artificial Sequence
  MKO10123306_B_Trip10
  gRNA
ucaucuuugguaggucucuu

SEQ ID NO: 123307 - RNA, 20 nt, Artificial Sequence
  MKO10123307_B_Trip11
  gRNA
guagcagauuucccuaauuc

SEQ ID NO: 123308 - RNA, 20 nt, Artificial Sequence
  MKO10123308_B_Trip11
  gRNA
uucuccucucucccggaauu

SEQ ID NO: 123309 - RNA, 20 nt, Artificial Sequence
  MKO10123309_B_Trip11
  gRNA
cuuucugcuguaacugacuu

SEQ ID NO: 123310 - RNA, 20 nt, Artificial Sequence
  MKO10123310_B_Trip12
  gRNA
acaauugccgucaacaagca

SEQ ID NO: 123311 - RNA, 20 nt, Artificial Sequence
  MKO10123311_B_Trip12
  gRNA
gugcuaguccagacuacaac

SEQ ID NO: 123312 - RNA, 20 nt, Artificial Sequence
  MKO10123312_B_Trip12
  gRNA
gcuguuggcaugaccaccuc

SEQ ID NO: 123313 - RNA, 20 nt, Artificial Sequence
  MKO10123313_B_Trip13
  gRNA
ugaccuccacaucauacacg

SEQ ID NO: 123314 - RNA, 20 nt, Artificial Sequence
  MKO10123314_B_Trip13
  gRNA
caccgugcagcagcaccacc

SEQ ID NO: 123315 - RNA, 20 nt, Artificial Sequence
  MKO10123315_B_Trip13
  gRNA
acucuucucagacaagaacg

SEQ ID NO: 123316 - RNA, 20 nt, Artificial Sequence
  MKO10123316_B_Trip4
  gRNA
accgggagccgcuaguacac

SEQ ID NO: 123317 - RNA, 20 nt, Artificial Sequence
  MKO10123317_B_Trip4
  gRNA
uccuccuacuccgcuuuagc

SEQ ID NO: 123318 - RNA, 20 nt, Artificial Sequence
  MKO10123318_B_Trip4
  gRNA
uugaccuccacagcuacguc

SEQ ID NO: 123319 - RNA, 20 nt, Artificial Sequence
  MKO10123319_B_Trip6
  gRNA
cugggguagguccaccauag

SEQ ID NO: 123320 - RNA, 20 nt, Artificial Sequence
  MKO10123320_B_Trip6
  gRNA
gaucauccgcccuggcaguc

SEQ ID NO: 123321 - RNA, 20 nt, Artificial Sequence
  MKO10123321_B_Trip6
  gRNA
uggaacaccccagcgccugc

SEQ ID NO: 123322 - RNA, 20 nt, Artificial Sequence
  MKO10123322_B_Triqk
  gRNA
caccuuacgcuguguccuug

SEQ ID NO: 123323 - RNA, 20 nt, Artificial Sequence
  MKO10123323_B_Triqk
  gRNA
ugcuuucuguacugaucaac

SEQ ID NO: 123324 - RNA, 20 nt, Artificial Sequence
  MKO10123324_B_Triqk
  gRNA
gaucaguacagaaagcaaau

SEQ ID NO: 123325 - RNA, 20 nt, Artificial Sequence
  MKO10123325_B_Trit1
  gRNA
ccucugcgugcugacgauga

SEQ ID NO: 123326 - RNA, 20 nt, Artificial Sequence
  MKO10123326_B_Trit1
  gRNA
guccucuuggaggcccucuc

SEQ ID NO: 123327 - RNA, 20 nt, Artificial Sequence
  MKO10123327_B_Trit1
  gRNA
gcaccacaugaucagcuuug

SEQ ID NO: 123328 - RNA, 20 nt, Artificial Sequence
  MKO10123328_B_Trmt10a
  gRNA
ccgagccucucauccagugc

SEQ ID NO: 123329 - RNA, 20 nt, Artificial Sequence
  MKO10123329_B_Trmt10a
  gRNA
cacuagcccuccaaucacgu

SEQ ID NO: 123330 - RNA, 20 nt, Artificial Sequence
  MKO10123330_B_Trmt10a
  gRNA
acacaccugcacuggaugag

SEQ ID NO: 123331 - RNA, 20 nt, Artificial Sequence
  MKO10123331_B_Trmt10b
  gRNA
cucaagucaacacauagucu

SEQ ID NO: 123332 - RNA, 20 nt, Artificial Sequence
  MKO10123332_B_Trmt10b
  gRNA
cuaccuucuuugacaugugc

SEQ ID NO: 123333 - RNA, 20 nt, Artificial Sequence
  MKO10123333_B_Trmt10b
  gRNA
agguacacaaggguuuccag

SEQ ID NO: 123334 - RNA, 20 nt, Artificial Sequence
  MKO10123334_B_Trmt10c
  gRNA
uaaaugugcgcacguggaaa

SEQ ID NO: 123335 - RNA, 20 nt, Artificial Sequence
  MKO10123335_B_Trmt10c
  gRNA
uguugcuauguuuaaccguu

SEQ ID NO: 123336 - RNA, 20 nt, Artificial Sequence
  MKO10123336_B_Trmt10c
  gRNA
ccauccaauucuagcugcuc

SEQ ID NO: 123337 - RNA, 20 nt, Artificial Sequence
  MKO10123337_B_Trmt112
  gRNA
uccccugcagguugauguac

SEQ ID NO: 123338 - RNA, 20 nt, Artificial Sequence
  MKO10123338_B_Trmt112
  gRNA
aucuccuaagcucccaugug

SEQ ID NO: 123339 - RNA, 20 nt, Artificial Sequence
  MKO10123339_B_Trmt112
  gRNA
aagcgccgcccacuccacuu

SEQ ID NO: 123340 - RNA, 20 nt, Artificial Sequence
  MKO10123340_B_Trmt11
  gRNA
gucgaaucugaaugcagaua

SEQ ID NO: 123341 - RNA, 20 nt, Artificial Sequence
  MKO10123341_B_Trmt11
  gRNA
ggaaauaaagucuuuacuau

SEQ ID NO: 123342 - RNA, 20 nt, Artificial Sequence
  MKO10123342_B_Trmt11
  gRNA
guuucuugcaauaucuucag

SEQ ID NO: 123343 - RNA, 20 nt, Artificial Sequence
  MKO10123343_B_Trmt12
  gRNA
guucaacguuuggcaaaacg

SEQ ID NO: 123344 - RNA, 20 nt, Artificial Sequence
  MKO10123344_B_Trmt12
  gRNA
caacguccuuccgaagcacu

SEQ ID NO: 123345 - RNA, 20 nt, Artificial Sequence
  MKO10123345_B_Trmt12
  gRNA
caccaugccguugccaagac

SEQ ID NO: 123346 - RNA, 20 nt, Artificial Sequence
  MKO10123346_B_Trmt13
  gRNA
uuuauuaggaagaaaauacu

SEQ ID NO: 123347 - RNA, 20 nt, Artificial Sequence
  MKO10123347_B_Trmt13
  gRNA
aaauugagaaaagcaaguga

SEQ ID NO: 123348 - RNA, 20 nt, Artificial Sequence
  MKO10123348_B_Trmt13
  gRNA
ucuucagauagagaagaaaa

SEQ ID NO: 123349 - RNA, 20 nt, Artificial Sequence
  MKO10123349_B_Trmt1l
  gRNA
guuaagcgccaugucaacaa

SEQ ID NO: 123350 - RNA, 20 nt, Artificial Sequence
  MKO10123350_B_Trmt1l
  gRNA
aacuugcccgcuguguccua

SEQ ID NO: 123351 - RNA, 20 nt, Artificial Sequence
  MKO10123351_B_Trmt1l
  gRNA
gacaccuucagaauuuacac

SEQ ID NO: 123352 - RNA, 20 nt, Artificial Sequence
  MKO10123352_B_Trmt1
  gRNA
caaccuaccgggcaucugcc

SEQ ID NO: 123353 - RNA, 20 nt, Artificial Sequence
  MKO10123353_B_Trmt1
  gRNA
gaguuugcucgaauucaucu

SEQ ID NO: 123354 - RNA, 20 nt, Artificial Sequence
  MKO10123354_B_Trmt1
  gRNA
ccacucacucuggauucccu

SEQ ID NO: 123355 - RNA, 20 nt, Artificial Sequence
  MKO10123355_B_Trmt2a
  gRNA
guccccaccggaugaauucc

SEQ ID NO: 123356 - RNA, 20 nt, Artificial Sequence
  MKO10123356_B_Trmt2a
  gRNA
cgucuaccccaacuccgacc

SEQ ID NO: 123357 - RNA, 20 nt, Artificial Sequence
  MKO10123357_B_Trmt2a
  gRNA
caauaaagcuuguugccccc

SEQ ID NO: 123358 - RNA, 20 nt, Artificial Sequence
  MKO10123358_B_Trmt2b
  gRNA
cugauguugugacuccacuc

SEQ ID NO: 123359 - RNA, 20 nt, Artificial Sequence
  MKO10123359_B_Trmt2b
  gRNA
acagucuuuggauugccauc

SEQ ID NO: 123360 - RNA, 20 nt, Artificial Sequence
  MKO10123360_B_Trmt2b
  gRNA
cuuguuccgguagccagugg

SEQ ID NO: 123361 - RNA, 20 nt, Artificial Sequence
  MKO10123361_B_Trmt44
  gRNA
uaccagcagauacguagcaa

SEQ ID NO: 123362 - RNA, 20 nt, Artificial Sequence
  MKO10123362_B_Trmt44
  gRNA
uccacaucuugagcaacgag

SEQ ID NO: 123363 - RNA, 20 nt, Artificial Sequence
  MKO10123363_B_Trmt44
  gRNA
accauucuccuucguuguga

SEQ ID NO: 123364 - RNA, 20 nt, Artificial Sequence
  MKO10123364_B_Trmt5
  gRNA
ucaccacccucugacguucg

SEQ ID NO: 123365 - RNA, 20 nt, Artificial Sequence
  MKO10123365_B_Trmt5
  gRNA
uacguaccgaaauuuccaaa

SEQ ID NO: 123366 - RNA, 20 nt, Artificial Sequence
  MKO10123366_B_Trmt5
  gRNA
guacguauugucaauguugc

SEQ ID NO: 123367 - RNA, 20 nt, Artificial Sequence
  MKO10123367_B_Trmt61a
  gRNA
cucguaugccacgaaacuca

SEQ ID NO: 123368 - RNA, 20 nt, Artificial Sequence
  MKO10123368_B_Trmt61a
  gRNA
gaugccagccccuuccguag

SEQ ID NO: 123369 - RNA, 20 nt, Artificial Sequence
  MKO10123369_B_Trmt61a
  gRNA
ucucuaaguuguuggccccc

SEQ ID NO: 123370 - RNA, 20 nt, Artificial Sequence
  MKO10123370_B_Trmt6
  gRNA
aaucgaaauauaguugauga

SEQ ID NO: 123371 - RNA, 20 nt, Artificial Sequence
  MKO10123371_B_Trmt6
  gRNA
auguauuaugcaagagaacc

SEQ ID NO: 123372 - RNA, 20 nt, Artificial Sequence
  MKO10123372_B_Trmt6
  gRNA
uaucaucuugaguaaguuuc

SEQ ID NO: 123373 - RNA, 20 nt, Artificial Sequence
  MKO10123373_B_Trmu
  gRNA
uguccuaugugaaggaguau

SEQ ID NO: 123374 - RNA, 20 nt, Artificial Sequence
  MKO10123374_B_Trmu
  gRNA
augcuuauugcaguugaugu

SEQ ID NO: 123375 - RNA, 20 nt, Artificial Sequence
  MKO10123375_B_Trmu
  gRNA
cucucuucugaagcacguga

SEQ ID NO: 123376 - RNA, 20 nt, Artificial Sequence
  MKO10123376_B_Trnau1ap
  gRNA
cuuuguggaauucgcagauu

SEQ ID NO: 123377 - RNA, 20 nt, Artificial Sequence
  MKO10123377_B_Trnau1ap
  gRNA
gucuggcuguuucccauaag

SEQ ID NO: 123378 - RNA, 20 nt, Artificial Sequence
  MKO10123378_B_Trnau1ap
  gRNA
uaugcagcuggaacccuaca

SEQ ID NO: 123379 - RNA, 20 nt, Artificial Sequence
  MKO10123379_B_Trnp1
  gRNA
gggccgccggcgccuggugu

SEQ ID NO: 123380 - RNA, 20 nt, Artificial Sequence
  MKO10123380_B_Trnp1
  gRNA
uaagucaccgcccuuacccg

SEQ ID NO: 123381 - RNA, 20 nt, Artificial Sequence
  MKO10123381_B_Trnp1
  gRNA
cggccgagacacccguggaa

SEQ ID NO: 123382 - RNA, 20 nt, Artificial Sequence
  MKO10123382_B_Trnt1
  gRNA
aucuacuccaacuacaccuc

SEQ ID NO: 123383 - RNA, 20 nt, Artificial Sequence
  MKO10123383_B_Trnt1
  gRNA
ugucaggcucuucaauccuu

SEQ ID NO: 123384 - RNA, 20 nt, Artificial Sequence
  MKO10123384_B_Trnt1
  gRNA
acacuguuugauuacuucaa

SEQ ID NO: 123385 - RNA, 20 nt, Artificial Sequence
  MKO10123385_B_Troap
  gRNA
cuccacucgacccagcuuac

SEQ ID NO: 123386 - RNA, 20 nt, Artificial Sequence
  MKO10123386_B_Troap
  gRNA
cacaaacucuauagccccua

SEQ ID NO: 123387 - RNA, 20 nt, Artificial Sequence
  MKO10123387_B_Troap
  gRNA
cacucccucaccugacaaga

SEQ ID NO: 123388 - RNA, 20 nt, Artificial Sequence
  MKO10123388_B_Trove2
  gRNA
gcuaauucagugcuugaacc

SEQ ID NO: 123389 - RNA, 20 nt, Artificial Sequence
  MKO10123389_B_Trove2
  gRNA
agcaagaagcgcuucccagu

SEQ ID NO: 123390 - RNA, 20 nt, Artificial Sequence
  MKO10123390_B_Trove2
  gRNA
uguugccgcagcaaugugca

SEQ ID NO: 123391 - RNA, 20 nt, Artificial Sequence
  MKO10123391_B_Tro
  gRNA
ucaucgggugcccacauucc

SEQ ID NO: 123392 - RNA, 20 nt, Artificial Sequence
  MKO10123392_B_Tro
  gRNA
gguggaagccgccugcccca

SEQ ID NO: 123393 - RNA, 20 nt, Artificial Sequence
  MKO10123393_B_Tro
  gRNA
aggcuaccugagcgcuugau

SEQ ID NO: 123394 - RNA, 20 nt, Artificial Sequence
  MKO10123394_B_Trp53bp1
  gRNA
ggggugggagcaaacgcucc

SEQ ID NO: 123395 - RNA, 20 nt, Artificial Sequence
  MKO10123395_B_Trp53bp1
  gRNA
ccguucaaugaccugacuga

SEQ ID NO: 123396 - RNA, 20 nt, Artificial Sequence
  MKO10123396_B_Trp53bp1
  gRNA
cuaggauauuguaucaaauc

SEQ ID NO: 123397 - RNA, 20 nt, Artificial Sequence
  MKO10123397_B_Trp53bp2
  gRNA
cuccuuccuccgaugcucgc

SEQ ID NO: 123398 - RNA, 20 nt, Artificial Sequence
  MKO10123398_B_Trp53bp2
  gRNA
acugccauuuagccgaagug

SEQ ID NO: 123399 - RNA, 20 nt, Artificial Sequence
  MKO10123399_B_Trp53bp2
  gRNA
guuugcagguuaacaguccu

SEQ ID NO: 123400 - RNA, 20 nt, Artificial Sequence
  MKO10123400_B_Trp53i11
  gRNA
ggacugcaccccgaaguagc

SEQ ID NO: 123401 - RNA, 20 nt, Artificial Sequence
  MKO10123401_B_Trp53i11
  gRNA
uuaucucguugcccaaaacc

SEQ ID NO: 123402 - RNA, 20 nt, Artificial Sequence
  MKO10123402_B_Trp53i11
  gRNA
acgagauaaaguuugcugug

SEQ ID NO: 123403 - RNA, 20 nt, Artificial Sequence
  MKO10123403_B_Trp53i13
  gRNA
accuguguguaagucacucu

SEQ ID NO: 123404 - RNA, 20 nt, Artificial Sequence
  MKO10123404_B_Trp53i13
  gRNA
ccacaggccuucaggacaag

SEQ ID NO: 123405 - RNA, 20 nt, Artificial Sequence
  MKO10123405_B_Trp53i13
  gRNA
gugugggagacgguguguac

SEQ ID NO: 123406 - RNA, 20 nt, Artificial Sequence
  MKO10123406_B_Trp53inp1
  gRNA
aauccaccugcuguaaaaca

SEQ ID NO: 123407 - RNA, 20 nt, Artificial Sequence
  MKO10123407_B_Trp53inp1
  gRNA
agacugaauaaaauguuugu

SEQ ID NO: 123408 - RNA, 20 nt, Artificial Sequence
  MKO10123408_B_Trp53inp1
  gRNA
ucuucuuucucacugaauuc

SEQ ID NO: 123409 - RNA, 20 nt, Artificial Sequence
  MKO10123409_B_Trp53inp2
  gRNA
uccacccgcgcccuccuuga

SEQ ID NO: 123410 - RNA, 20 nt, Artificial Sequence
  MKO10123410_B_Trp53inp2
  gRNA
cuggcucaucaucgaccuac

SEQ ID NO: 123411 - RNA, 20 nt, Artificial Sequence
  MKO10123411_B_Trp53inp2
  gRNA
cccggacaguuggagucuuc

SEQ ID NO: 123412 - RNA, 20 nt, Artificial Sequence
  MKO10123412_B_Trp53rk
  gRNA
acagcuccacuacccgacca

SEQ ID NO: 123413 - RNA, 20 nt, Artificial Sequence
  MKO10123413_B_Trp53rk
  gRNA
accgcuucccgaagaguuac

SEQ ID NO: 123414 - RNA, 20 nt, Artificial Sequence
  MKO10123414_B_Trp53rk
  gRNA
gcggcuccgcucgcgcgccg

SEQ ID NO: 123415 - RNA, 20 nt, Artificial Sequence
  MKO10123415_B_Trp53ug5
  gRNA
uacaauucaaguucccgucu

SEQ ID NO: 123416 - RNA, 20 nt, Artificial Sequence
  MKO10123416_B_Trp53ug5
  gRNA
agcucuugaauagcuucaag

SEQ ID NO: 123417 - RNA, 20 nt, Artificial Sequence
  MKO10123417_B_Trp53ug5
  gRNA
aacuccauaagcuggccaga

SEQ ID NO: 123418 - RNA, 20 nt, Artificial Sequence
  MKO10123418_B_Trp53
  gRNA
ggccuuaccaggauaucuuc

SEQ ID NO: 123419 - RNA, 20 nt, Artificial Sequence
  MKO10123419_B_Trp53
  gRNA
auaagccugaaaaugucucc

SEQ ID NO: 123420 - RNA, 20 nt, Artificial Sequence
  MKO10123420_B_Trp53
  gRNA
gugcugugacuucuuguaga

SEQ ID NO: 123421 - RNA, 20 nt, Artificial Sequence
  MKO10123421_B_Trp63
  gRNA
guggggucaucaccuugauc

SEQ ID NO: 123422 - RNA, 20 nt, Artificial Sequence
  MKO10123422_B_Trp63
  gRNA
agucaucugauucgaguaga

SEQ ID NO: 123423 - RNA, 20 nt, Artificial Sequence
  MKO10123423_B_Trp63
  gRNA
uucuacucgaaucagaugac

SEQ ID NO: 123424 - RNA, 20 nt, Artificial Sequence
  MKO10123424_B_Trp73
  gRNA
ugacagggucauccacguac

SEQ ID NO: 123425 - RNA, 20 nt, Artificial Sequence
  MKO10123425_B_Trp73
  gRNA
ggggcagcgcuuaacaaugu

SEQ ID NO: 123426 - RNA, 20 nt, Artificial Sequence
  MKO10123426_B_Trp73
  gRNA
uccgggguguaggggcucgc

SEQ ID NO: 123427 - RNA, 20 nt, Artificial Sequence
  MKO10123427_B_Trpa1
  gRNA
ugccaugcacagcuauguga

SEQ ID NO: 123428 - RNA, 20 nt, Artificial Sequence
  MKO10123428_B_Trpa1
  gRNA
agcuguguaaaucaaauaag

SEQ ID NO: 123429 - RNA, 20 nt, Artificial Sequence
  MKO10123429_B_Trpa1
  gRNA
auggaauuaaucuuagcaua

SEQ ID NO: 123430 - RNA, 20 nt, Artificial Sequence
  MKO10123430_B_Trpc1
  gRNA
ggcaaucgacucugaaguag

SEQ ID NO: 123431 - RNA, 20 nt, Artificial Sequence
  MKO10123431_B_Trpc1
  gRNA
aaaguccgcagaugcacuuu

SEQ ID NO: 123432 - RNA, 20 nt, Artificial Sequence
  MKO10123432_B_Trpc1
  gRNA
aacuauugaaaacgaaagcu

SEQ ID NO: 123433 - RNA, 20 nt, Artificial Sequence
  MKO10123433_B_Trpc2
  gRNA
gcaacucgaagccauagucc

SEQ ID NO: 123434 - RNA, 20 nt, Artificial Sequence
  MKO10123434_B_Trpc2
  gRNA
agacuucacuacauaugauc

SEQ ID NO: 123435 - RNA, 20 nt, Artificial Sequence
  MKO10123435_B_Trpc2
  gRNA
acccagcugagcaccuucaa

SEQ ID NO: 123436 - RNA, 20 nt, Artificial Sequence
  MKO10123436_B_Trpc3
  gRNA
caauccaauagccgauggcg

SEQ ID NO: 123437 - RNA, 20 nt, Artificial Sequence
  MKO10123437_B_Trpc3
  gRNA
ccuccuccgagucccgacac

SEQ ID NO: 123438 - RNA, 20 nt, Artificial Sequence
  MKO10123438_B_Trpc3
  gRNA
gcaaugcaaagacuucguag

SEQ ID NO: 123439 - RNA, 20 nt, Artificial Sequence
  MKO10123439_B_Trpc4ap
  gRNA
gacaaauuguccaaauggag

SEQ ID NO: 123440 - RNA, 20 nt, Artificial Sequence
  MKO10123440_B_Trpc4ap
  gRNA
caguuaccuugagaaugcuu

SEQ ID NO: 123441 - RNA, 20 nt, Artificial Sequence
  MKO10123441_B_Trpc4ap
  gRNA
auagccuccauagagagaag

SEQ ID NO: 123442 - RNA, 20 nt, Artificial Sequence
  MKO10123442_B_Trpc4
  gRNA
agguccaccaccaaccaucg

SEQ ID NO: 123443 - RNA, 20 nt, Artificial Sequence
  MKO10123443_B_Trpc4
  gRNA
gccuggaccgugaaugccug

SEQ ID NO: 123444 - RNA, 20 nt, Artificial Sequence
  MKO10123444_B_Trpc4
  gRNA
gaagauugucgcguuuguaa

SEQ ID NO: 123445 - RNA, 20 nt, Artificial Sequence
  MKO10123445_B_Trpc5
  gRNA
aguauaaugguucucgucca

SEQ ID NO: 123446 - RNA, 20 nt, Artificial Sequence
  MKO10123446_B_Trpc5
  gRNA
ucacggaauacauccaugau

SEQ ID NO: 123447 - RNA, 20 nt, Artificial Sequence
  MKO10123447_B_Trpc5
  gRNA
gacauaggccacgaucuuca

SEQ ID NO: 123448 - RNA, 20 nt, Artificial Sequence
  MKO10123448_B_Trpc6
  gRNA
gcagacgauucuucgugaga

SEQ ID NO: 123449 - RNA, 20 nt, Artificial Sequence
  MKO10123449_B_Trpc6
  gRNA
cacaccaguauaugagagcc

SEQ ID NO: 123450 - RNA, 20 nt, Artificial Sequence
  MKO10123450_B_Trpc6
  gRNA
cauucaugacgagcagcccc

SEQ ID NO: 123451 - RNA, 20 nt, Artificial Sequence
  MKO10123451_B_Trpc7
  gRNA
ccuucagucacucgcgcucc

SEQ ID NO: 123452 - RNA, 20 nt, Artificial Sequence
  MKO10123452_B_Trpc7
  gRNA
gcgaugugaacuugcaaguc

SEQ ID NO: 123453 - RNA, 20 nt, Artificial Sequence
  MKO10123453_B_Trpc7
  gRNA
aguuugauucggcucagacu

SEQ ID NO: 123454 - RNA, 20 nt, Artificial Sequence
  MKO10123454_B_Trpd52l3
  gRNA
gauaggacucgaggugagac

SEQ ID NO: 123455 - RNA, 20 nt, Artificial Sequence
  MKO10123455_B_Trpd52l3
  gRNA
uucgccacaccgcuucucuu

SEQ ID NO: 123456 - RNA, 20 nt, Artificial Sequence
  MKO10123456_B_Trpd52l3
  gRNA
ggcugguggagcugacggcu

SEQ ID NO: 123457 - RNA, 20 nt, Artificial Sequence
  MKO10123457_B_Trpm1
  gRNA
ccucagcaccauacuugccc

SEQ ID NO: 123458 - RNA, 20 nt, Artificial Sequence
  MKO10123458_B_Trpm1
  gRNA
aacggcacccugggcaagua

SEQ ID NO: 123459 - RNA, 20 nt, Artificial Sequence
  MKO10123459_B_Trpm1
  gRNA
cacaggugucgucagccaug

SEQ ID NO: 123460 - RNA, 20 nt, Artificial Sequence
  MKO10123460_B_Trpm2
  gRNA
uuacccugcguccgagaguu

SEQ ID NO: 123461 - RNA, 20 nt, Artificial Sequence
  MKO10123461_B_Trpm2
  gRNA
gcaguauguccgggucuccc

SEQ ID NO: 123462 - RNA, 20 nt, Artificial Sequence
  MKO10123462_B_Trpm2
  gRNA
uuauacccacgagcaacacu

SEQ ID NO: 123463 - RNA, 20 nt, Artificial Sequence
  MKO10123463_B_Trpm3
  gRNA
cccgaagacuugcuugaguu

SEQ ID NO: 123464 - RNA, 20 nt, Artificial Sequence
  MKO10123464_B_Trpm3
  gRNA
gaccccuccagugaagaucc

SEQ ID NO: 123465 - RNA, 20 nt, Artificial Sequence
  MKO10123465_B_Trpm3
  gRNA
agaacggugagcuugcucau

SEQ ID NO: 123466 - RNA, 20 nt, Artificial Sequence
  MKO10123466_B_Trpm4
  gRNA
cagucccccagugacgaucc

SEQ ID NO: 123467 - RNA, 20 nt, Artificial Sequence
  MKO10123467_B_Trpm4
  gRNA
gggcagccguaguuaccgag

SEQ ID NO: 123468 - RNA, 20 nt, Artificial Sequence
  MKO10123468_B_Trpm4
  gRNA
aacugcucaccccgcaucau

SEQ ID NO: 123469 - RNA, 20 nt, Artificial Sequence
  MKO10123469_B_Trpm5
  gRNA
ggugggugaggaacgaccuu

SEQ ID NO: 123470 - RNA, 20 nt, Artificial Sequence
  MKO10123470_B_Trpm5
  gRNA
gcccgucguucccacuccca

SEQ ID NO: 123471 - RNA, 20 nt, Artificial Sequence
  MKO10123471_B_Trpm5
  gRNA
uggugaccccaacacccuag

SEQ ID NO: 123472 - RNA, 20 nt, Artificial Sequence
  MKO10123472_B_Trpm6
  gRNA
ugaaguucugaagaccccca

SEQ ID NO: 123473 - RNA, 20 nt, Artificial Sequence
  MKO10123473_B_Trpm6
  gRNA
aaaagcccuacagauaccuu

SEQ ID NO: 123474 - RNA, 20 nt, Artificial Sequence
  MKO10123474_B_Trpm6
  gRNA
uuucagaaauccuggaucga

SEQ ID NO: 123475 - RNA, 20 nt, Artificial Sequence
  MKO10123475_B_Trpm7
  gRNA
ugcucucuauccaggauuuc

SEQ ID NO: 123476 - RNA, 20 nt, Artificial Sequence
  MKO10123476_B_Trpm7
  gRNA
agauuugucagcaacuuguc

SEQ ID NO: 123477 - RNA, 20 nt, Artificial Sequence
  MKO10123477_B_Trpm7
  gRNA
ugcugacaaaucugacaucc

SEQ ID NO: 123478 - RNA, 20 nt, Artificial Sequence
  MKO10123478_B_Trpm8
  gRNA
uacggccugaugaaguacau

SEQ ID NO: 123479 - RNA, 20 nt, Artificial Sequence
  MKO10123479_B_Trpm8
  gRNA
ucugggugccuucgaugugc

SEQ ID NO: 123480 - RNA, 20 nt, Artificial Sequence
  MKO10123480_B_Trpm8
  gRNA
cacccgucacugaaaugacc

SEQ ID NO: 123481 - RNA, 20 nt, Artificial Sequence
  MKO10123481_B_Trps1
  gRNA
uuccuacccguaacagcgac

SEQ ID NO: 123482 - RNA, 20 nt, Artificial Sequence
  MKO10123482_B_Trps1
  gRNA
ggcacaugacucaaguagug

SEQ ID NO: 123483 - RNA, 20 nt, Artificial Sequence
  MKO10123483_B_Trps1
  gRNA
ucuacugccaagccauacau

SEQ ID NO: 123484 - RNA, 20 nt, Artificial Sequence
  MKO10123484_B_Trpt1
  gRNA
cugggacuucccaugcgagc

SEQ ID NO: 123485 - RNA, 20 nt, Artificial Sequence
  MKO10123485_B_Trpt1
  gRNA
aggcauucguccaaauugug

SEQ ID NO: 123486 - RNA, 20 nt, Artificial Sequence
  MKO10123486_B_Trpt1
  gRNA
aggggcgucaguuccaacuc

SEQ ID NO: 123487 - RNA, 20 nt, Artificial Sequence
  MKO10123487_B_Trpv1
  gRNA
cuccugcgaucauagagccu

SEQ ID NO: 123488 - RNA, 20 nt, Artificial Sequence
  MKO10123488_B_Trpv1
  gRNA
ugccauguuccgccuuucaa

SEQ ID NO: 123489 - RNA, 20 nt, Artificial Sequence
  MKO10123489_B_Trpv1
  gRNA
agacaggucuuucccgucuc

SEQ ID NO: 123490 - RNA, 20 nt, Artificial Sequence
  MKO10123490_B_Trpv2
  gRNA
acaggucguacagugacacu

SEQ ID NO: 123491 - RNA, 20 nt, Artificial Sequence
  MKO10123491_B_Trpv2
  gRNA
ccgugaccgacucuucagug

SEQ ID NO: 123492 - RNA, 20 nt, Artificial Sequence
  MKO10123492_B_Trpv2
  gRNA
caaaccgauuuggguccugu

SEQ ID NO: 123493 - RNA, 20 nt, Artificial Sequence
  MKO10123493_B_Trpv3
  gRNA
uacucaccacugccggaugu

SEQ ID NO: 123494 - RNA, 20 nt, Artificial Sequence
  MKO10123494_B_Trpv3
  gRNA
ccaacaccaaagagaucgug

SEQ ID NO: 123495 - RNA, 20 nt, Artificial Sequence
  MKO10123495_B_Trpv3
  gRNA
acccaucuucuccaagccga

SEQ ID NO: 123496 - RNA, 20 nt, Artificial Sequence
  MKO10123496_B_Trpv4
  gRNA
gggagccgacgugcacgccc

SEQ ID NO: 123497 - RNA, 20 nt, Artificial Sequence
  MKO10123497_B_Trpv4
  gRNA
caguccaucuagguccgcag

SEQ ID NO: 123498 - RNA, 20 nt, Artificial Sequence
  MKO10123498_B_Trpv4
  gRNA
cgacaccaucccgguguugc

SEQ ID NO: 123499 - RNA, 20 nt, Artificial Sequence
  MKO10123499_B_Trpv5
  gRNA
ugcugcuauaaugcugaugg

SEQ ID NO: 123500 - RNA, 20 nt, Artificial Sequence
  MKO10123500_B_Trpv5
  gRNA
acacugugugagccauuugu

SEQ ID NO: 123501 - RNA, 20 nt, Artificial Sequence
  MKO10123501_B_Trpv5
  gRNA
guuagguugcucauugagca

SEQ ID NO: 123502 - RNA, 20 nt, Artificial Sequence
  MKO10123502_B_Trpv6
  gRNA
guuagacugcucauugagca

SEQ ID NO: 123503 - RNA, 20 nt, Artificial Sequence
  MKO10123503_B_Trpv6
  gRNA
gugaagugcaguuuccccca

SEQ ID NO: 123504 - RNA, 20 nt, Artificial Sequence
  MKO10123504_B_Trpv6
  gRNA
ccccucgggcaagcagagca

SEQ ID NO: 123505 - RNA, 20 nt, Artificial Sequence
  MKO10123505_B_Trrap
  gRNA
aacgaaguugaaaaugaugc

SEQ ID NO: 123506 - RNA, 20 nt, Artificial Sequence
  MKO10123506_B_Trrap
  gRNA
uugagcugcacaaacaguuc

SEQ ID NO: 123507 - RNA, 20 nt, Artificial Sequence
  MKO10123507_B_Trrap
  gRNA
uccaggaauguagaauacug

SEQ ID NO: 123508 - RNA, 20 nt, Artificial Sequence
  MKO10123508_B_Trub1
  gRNA
ggugguuucaccucugauug

SEQ ID NO: 123509 - RNA, 20 nt, Artificial Sequence
  MKO10123509_B_Trub1
  gRNA
acgcuggacagugcagcgca

SEQ ID NO: 123510 - RNA, 20 nt, Artificial Sequence
  MKO10123510_B_Trub1
  gRNA
uccuagagguauaucaccau

SEQ ID NO: 123511 - RNA, 20 nt, Artificial Sequence
  MKO10123511_B_Trub2
  gRNA
cagcguguucgcuucuugcu

SEQ ID NO: 123512 - RNA, 20 nt, Artificial Sequence
  MKO10123512_B_Trub2
  gRNA
gggacaucgcuuggaugucc

SEQ ID NO: 123513 - RNA, 20 nt, Artificial Sequence
  MKO10123513_B_Trub2
  gRNA
guaugaugcucaucucacca

SEQ ID NO: 123514 - RNA, 20 nt, Artificial Sequence
  MKO10123514_B_Try10
  gRNA
agagcacaacaucaacgucc

SEQ ID NO: 123515 - RNA, 20 nt, Artificial Sequence
  MKO10123515_B_Try10
  gRNA
accaagaacaugaucugugu

SEQ ID NO: 123516 - RNA, 20 nt, Artificial Sequence
  MKO10123516_B_Try10
  gRNA
gagcugcagacaccacccac

SEQ ID NO: 123517 - RNA, 20 nt, Artificial Sequence
  MKO10123517_B_Try4
  gRNA
cuacucaccaccaaagcuca

SEQ ID NO: 123518 - RNA, 20 nt, Artificial Sequence
  MKO10123518_B_Try4
  gRNA
cagccgcauccaagugagac

SEQ ID NO: 123519 - RNA, 20 nt, Artificial Sequence
  MKO10123519_B_Try4
  gRNA
cccagaccugcuccagugcc

SEQ ID NO: 123520 - RNA, 20 nt, Artificial Sequence
  MKO10123520_B_Try5
  gRNA
agagaauucuauccccuacc

SEQ ID NO: 123521 - RNA, 20 nt, Artificial Sequence
  MKO10123521_B_Try5
  gRNA
ggggauagaauucucucggc

SEQ ID NO: 123522 - RNA, 20 nt, Artificial Sequence
  MKO10123522_B_Try5
  gRNA
agcuguccauugcaaaccac

SEQ ID NO: 123523 - RNA, 20 nt, Artificial Sequence
  MKO10123523_B_Tsacc
  gRNA
ucaacgacagauagcuauuu

SEQ ID NO: 123524 - RNA, 20 nt, Artificial Sequence
  MKO10123524_B_Tsacc
  gRNA
uuagcuggcgugaaauuugc

SEQ ID NO: 123525 - RNA, 20 nt, Artificial Sequence
  MKO10123525_B_Tsacc
  gRNA
ccacagcucauuuauggaau

SEQ ID NO: 123526 - RNA, 20 nt, Artificial Sequence
  MKO10123526_B_Tsc1
  gRNA
ccaguacucaccuuaucgug

SEQ ID NO: 123527 - RNA, 20 nt, Artificial Sequence
  MKO10123527_B_Tsc1
  gRNA
ucauacuguagugagagcgc

SEQ ID NO: 123528 - RNA, 20 nt, Artificial Sequence
  MKO10123528_B_Tsc1
  gRNA
uucccugacugcgggaucau

SEQ ID NO: 123529 - RNA, 20 nt, Artificial Sequence
  MKO10123529_B_Tsc22d1
  gRNA
cccucaccgcauacaucaaa

SEQ ID NO: 123530 - RNA, 20 nt, Artificial Sequence
  MKO10123530_B_Tsc22d1
  gRNA
uuccagcucuggugcaagug

SEQ ID NO: 123531 - RNA, 20 nt, Artificial Sequence
  MKO10123531_B_Tsc22d1
  gRNA
caacaaaauagagcaagcua

SEQ ID NO: 123532 - RNA, 20 nt, Artificial Sequence
  MKO10123532_B_Tsc22d2
  gRNA
uguuguugagaagugcuacc

SEQ ID NO: 123533 - RNA, 20 nt, Artificial Sequence
  MKO10123533_B_Tsc22d2
  gRNA
aguaaucauaccuaucccag

SEQ ID NO: 123534 - RNA, 20 nt, Artificial Sequence
  MKO10123534_B_Tsc22d2
  gRNA
gucccaacucccagcccaac

SEQ ID NO: 123535 - RNA, 20 nt, Artificial Sequence
  MKO10123535_B_Tsc22d3
  gRNA
ggaugugguuuccguuaaac

SEQ ID NO: 123536 - RNA, 20 nt, Artificial Sequence
  MKO10123536_B_Tsc22d3
  gRNA
gcucacgaaucugcuccuuu

SEQ ID NO: 123537 - RNA, 20 nt, Artificial Sequence
  MKO10123537_B_Tsc22d3
  gRNA
cugauagaccgccaccucca

SEQ ID NO: 123538 - RNA, 20 nt, Artificial Sequence
  MKO10123538_B_Tsc22d4
  gRNA
cggaauggcucuccgccacc

SEQ ID NO: 123539 - RNA, 20 nt, Artificial Sequence
  MKO10123539_B_Tsc22d4
  gRNA
cauguuugccgugcgagaag

SEQ ID NO: 123540 - RNA, 20 nt, Artificial Sequence
  MKO10123540_B_Tsc22d4
  gRNA
accuggacagcgaugacgau

SEQ ID NO: 123541 - RNA, 20 nt, Artificial Sequence
  MKO10123541_B_Tsc2
  gRNA
ugacgaauacauugcaucaa

SEQ ID NO: 123542 - RNA, 20 nt, Artificial Sequence
  MKO10123542_B_Tsc2
  gRNA
uugucuuuagggugaucguu

SEQ ID NO: 123543 - RNA, 20 nt, Artificial Sequence
  MKO10123543_B_Tsc2
  gRNA
auaaggugagaacugcaugc

SEQ ID NO: 123544 - RNA, 20 nt, Artificial Sequence
  MKO10123544_B_Tsen15
  gRNA
ucaaaacugaccugaggguc

SEQ ID NO: 123545 - RNA, 20 nt, Artificial Sequence
  MKO10123545_B_Tsen15
  gRNA
ccaaguuuauauagcauucu

SEQ ID NO: 123546 - RNA, 20 nt, Artificial Sequence
  MKO10123546_B_Tsen15
  gRNA
uggcaugaaguaaacugugu

SEQ ID NO: 123547 - RNA, 20 nt, Artificial Sequence
  MKO10123547_B_Tsen2
  gRNA
ggguuggcgauugugaaguu

SEQ ID NO: 123548 - RNA, 20 nt, Artificial Sequence
  MKO10123548_B_Tsen2
  gRNA
uacuucucugaggugauuau

SEQ ID NO: 123549 - RNA, 20 nt, Artificial Sequence
  MKO10123549_B_Tsen2
  gRNA
ugugcagaagaaauccauac

SEQ ID NO: 123550 - RNA, 20 nt, Artificial Sequence
  MKO10123550_B_Tsen34
  gRNA
gauucuucaucuccccaacc

SEQ ID NO: 123551 - RNA, 20 nt, Artificial Sequence
  MKO10123551_B_Tsen34
  gRNA
caaacucaccaggauagacc

SEQ ID NO: 123552 - RNA, 20 nt, Artificial Sequence
  MKO10123552_B_Tsen34
  gRNA
caucacuggucucacucccu

SEQ ID NO: 123553 - RNA, 20 nt, Artificial Sequence
  MKO10123553_B_Tsen54
  gRNA
aggcagauaccugguacugc

SEQ ID NO: 123554 - RNA, 20 nt, Artificial Sequence
  MKO10123554_B_Tsen54
  gRNA
cugccgcacaggggaaauuc

SEQ ID NO: 123555 - RNA, 20 nt, Artificial Sequence
  MKO10123555_B_Tsen54
  gRNA
uaugccucuuggauagacag

SEQ ID NO: 123556 - RNA, 20 nt, Artificial Sequence
  MKO10123556_B_Tsfm
  gRNA
acugucagaaccugacggau

SEQ ID NO: 123557 - RNA, 20 nt, Artificial Sequence
  MKO10123557_B_Tsfm
  gRNA
uuguggcggugaccucaagc

SEQ ID NO: 123558 - RNA, 20 nt, Artificial Sequence
  MKO10123558_B_Tsfm
  gRNA
agcaaagccgccaagcucca

SEQ ID NO: 123559 - RNA, 20 nt, Artificial Sequence
  MKO10123559_B_Tsg101
  gRNA
aaacagauagggggguuaua

SEQ ID NO: 123560 - RNA, 20 nt, Artificial Sequence
  MKO10123560_B_Tsg101
  gRNA
acaaucccagugcguuaucg

SEQ ID NO: 123561 - RNA, 20 nt, Artificial Sequence
  MKO10123561_B_Tsg101
  gRNA
agcuccagcaacucugaccg

SEQ ID NO: 123562 - RNA, 20 nt, Artificial Sequence
  MKO10123562_B_Tsga10
  gRNA
cagcacaugcuauucuucgu

SEQ ID NO: 123563 - RNA, 20 nt, Artificial Sequence
  MKO10123563_B_Tsga10
  gRNA
cauucuucguaggucaguga

SEQ ID NO: 123564 - RNA, 20 nt, Artificial Sequence
  MKO10123564_B_Tsga10
  gRNA
auggacaccgagagugagcu

SEQ ID NO: 123565 - RNA, 20 nt, Artificial Sequence
  MKO10123565_B_Tsga13
  gRNA
ugcaguuuagugggcuucaa

SEQ ID NO: 123566 - RNA, 20 nt, Artificial Sequence
  MKO10123566_B_Tsga13
  gRNA
gaugcacuguguagugucug

SEQ ID NO: 123567 - RNA, 20 nt, Artificial Sequence
  MKO10123567_B_Tsga13
  gRNA
cuacacagugcauccaaaca

SEQ ID NO: 123568 - RNA, 20 nt, Artificial Sequence
  MKO10123568_B_Tsga8
  gRNA
ugaagccuauaaugccaauu

SEQ ID NO: 123569 - RNA, 20 nt, Artificial Sequence
  MKO10123569_B_Tsga8
  gRNA
aguagcgacugcuucuccgc

SEQ ID NO: 123570 - RNA, 20 nt, Artificial Sequence
  MKO10123570_B_Tsga8
  gRNA
accgcguuucccacgcuugu

SEQ ID NO: 123571 - RNA, 20 nt, Artificial Sequence
  MKO10123571_B_Tshb
  gRNA
cacguacauuguauacucag

SEQ ID NO: 123572 - RNA, 20 nt, Artificial Sequence
  MKO10123572_B_Tshb
  gRNA
auccugagagagugcauauu

SEQ ID NO: 123573 - RNA, 20 nt, Artificial Sequence
  MKO10123573_B_Tshb
  gRNA
gucgccauaagcugcaagug

SEQ ID NO: 123574 - RNA, 20 nt, Artificial Sequence
  MKO10123574_B_Tshr
  gRNA
cuauagaugcaacucugcag

SEQ ID NO: 123575 - RNA, 20 nt, Artificial Sequence
  MKO10123575_B_Tshr
  gRNA
gcggcaggcuggggauucgg

SEQ ID NO: 123576 - RNA, 20 nt, Artificial Sequence
  MKO10123576_B_Tshr
  gRNA
ggagcucugucaaggcauca

SEQ ID NO: 123577 - RNA, 20 nt, Artificial Sequence
  MKO10123577_B_Tshz1
  gRNA
gcccgagcagcaugccgagg

SEQ ID NO: 123578 - RNA, 20 nt, Artificial Sequence
  MKO10123578_B_Tshz1
  gRNA
ucucguagcuuacguucccg

SEQ ID NO: 123579 - RNA, 20 nt, Artificial Sequence
  MKO10123579_B_Tshz1
  gRNA
uccguagccagcgucuugau

SEQ ID NO: 123580 - RNA, 20 nt, Artificial Sequence
  MKO10123580_B_Tshz2
  gRNA
uaaguagagcgaugccaagg

SEQ ID NO: 123581 - RNA, 20 nt, Artificial Sequence
  MKO10123581_B_Tshz2
  gRNA
gacaucgaaaacacgcuucu

SEQ ID NO: 123582 - RNA, 20 nt, Artificial Sequence
  MKO10123582_B_Tshz2
  gRNA
ggagaucucccgagugucgu

SEQ ID NO: 123583 - RNA, 20 nt, Artificial Sequence
  MKO10123583_B_Tshz3
  gRNA
cgcucguaccugcugcgcgc

SEQ ID NO: 123584 - RNA, 20 nt, Artificial Sequence
  MKO10123584_B_Tshz3
  gRNA
gccucgcaaacggucuuugu

SEQ ID NO: 123585 - RNA, 20 nt, Artificial Sequence
  MKO10123585_B_Tshz3
  gRNA
uagcugcaaacugcgccugc

SEQ ID NO: 123586 - RNA, 20 nt, Artificial Sequence
  MKO10123586_B_Tsks
  gRNA
ugccguggagcccgacuccu

SEQ ID NO: 123587 - RNA, 20 nt, Artificial Sequence
  MKO10123587_B_Tsks
  gRNA
gguagaaagccgugcccagc

SEQ ID NO: 123588 - RNA, 20 nt, Artificial Sequence
  MKO10123588_B_Tsks
  gRNA
ucagcacguucagacucugc

SEQ ID NO: 123589 - RNA, 20 nt, Artificial Sequence
  MKO10123589_B_Tsku
  gRNA
gguaacgcagggguaggucu

SEQ ID NO: 123590 - RNA, 20 nt, Artificial Sequence
  MKO10123590_B_Tsku
  gRNA
gcuuuacaaagugucagcgu

SEQ ID NO: 123591 - RNA, 20 nt, Artificial Sequence
  MKO10123591_B_Tsku
  gRNA
gugacuccagguagcgcagu

SEQ ID NO: 123592 - RNA, 20 nt, Artificial Sequence
  MKO10123592_B_Tslp
  gRNA
acagagaaaugacgguacuc

SEQ ID NO: 123593 - RNA, 20 nt, Artificial Sequence
  MKO10123593_B_Tslp
  gRNA
uccccgacaaaacauuugcc

SEQ ID NO: 123594 - RNA, 20 nt, Artificial Sequence
  MKO10123594_B_Tslp
  gRNA
gcccucaaugaccacugccc

SEQ ID NO: 123595 - RNA, 20 nt, Artificial Sequence
  MKO10123595_B_Tsnaxip1
  gRNA
gcaggaggaguuccuugcgc

SEQ ID NO: 123596 - RNA, 20 nt, Artificial Sequence
  MKO10123596_B_Tsnaxip1
  gRNA
uucgauuauguagaacuguc

SEQ ID NO: 123597 - RNA, 20 nt, Artificial Sequence
  MKO10123597_B_Tsnaxip1
  gRNA
acuagaaaacuaccugcgca

SEQ ID NO: 123598 - RNA, 20 nt, Artificial Sequence
  MKO10123598_B_Tsnax
  gRNA
ccuaaggaccaggaggguuc

SEQ ID NO: 123599 - RNA, 20 nt, Artificial Sequence
  MKO10123599_B_Tsnax
  gRNA
auguguucuagcauuucagc

SEQ ID NO: 123600 - RNA, 20 nt, Artificial Sequence
  MKO10123600_B_Tsnax
  gRNA
gucaguaucuccuccauauc

SEQ ID NO: 123601 - RNA, 20 nt, Artificial Sequence
  MKO10123601_B_Tsn
  gRNA
gaaucucuguaacagccucu

SEQ ID NO: 123602 - RNA, 20 nt, Artificial Sequence
  MKO10123602_B_Tsn
  gRNA
aaaaggguuucaucuggaug

SEQ ID NO: 123603 - RNA, 20 nt, Artificial Sequence
  MKO10123603_B_Tsn
  gRNA
uuuaauucuugccagugaac

SEQ ID NO: 123604 - RNA, 20 nt, Artificial Sequence
  MKO10123604_B_Tspan10
  gRNA
augcagccaucauucacuac

SEQ ID NO: 123605 - RNA, 20 nt, Artificial Sequence
  MKO10123605_B_Tspan10
  gRNA
ucggcucaccugagacagca

SEQ ID NO: 123606 - RNA, 20 nt, Artificial Sequence
  MKO10123606_B_Tspan10
  gRNA
augcagccccuugcugucuc

SEQ ID NO: 123607 - RNA, 20 nt, Artificial Sequence
  MKO10123607_B_Tspan11
  gRNA
gguagguggggcagccguca

SEQ ID NO: 123608 - RNA, 20 nt, Artificial Sequence
  MKO10123608_B_Tspan11
  gRNA
uggcacauguguacuaccag

SEQ ID NO: 123609 - RNA, 20 nt, Artificial Sequence
  MKO10123609_B_Tspan11
  gRNA
cagcgcguacaucuugucuc

SEQ ID NO: 123610 - RNA, 20 nt, Artificial Sequence
  MKO10123610_B_Tspan12
  gRNA
ccagcauucccacgaugaua

SEQ ID NO: 123611 - RNA, 20 nt, Artificial Sequence
  MKO10123611_B_Tspan12
  gRNA
accauaucugaccacuguac

SEQ ID NO: 123612 - RNA, 20 nt, Artificial Sequence
  MKO10123612_B_Tspan12
  gRNA
cgucaucuucuguguagaac

SEQ ID NO: 123613 - RNA, 20 nt, Artificial Sequence
  MKO10123613_B_Tspan13
  gRNA
gcugaucuccagucuccgag

SEQ ID NO: 123614 - RNA, 20 nt, Artificial Sequence
  MKO10123614_B_Tspan13
  gRNA
gcugccuggggcaucggcuu

SEQ ID NO: 123615 - RNA, 20 nt, Artificial Sequence
  MKO10123615_B_Tspan13
  gRNA
cacagcaguucaaauuccuc

SEQ ID NO: 123616 - RNA, 20 nt, Artificial Sequence
  MKO10123616_B_Tspan14
  gRNA
augcccacagcccgacucca

SEQ ID NO: 123617 - RNA, 20 nt, Artificial Sequence
  MKO10123617_B_Tspan14
  gRNA
gcugugggcauggagcgaaa

SEQ ID NO: 123618 - RNA, 20 nt, Artificial Sequence
  MKO10123618_B_Tspan14
  gRNA
agagcaacaucaaguccuau

SEQ ID NO: 123619 - RNA, 20 nt, Artificial Sequence
  MKO10123619_B_Tspan15
  gRNA
aguaauucucgauuccucuc

SEQ ID NO: 123620 - RNA, 20 nt, Artificial Sequence
  MKO10123620_B_Tspan15
  gRNA
caccaauaagcuccaugacc

SEQ ID NO: 123621 - RNA, 20 nt, Artificial Sequence
  MKO10123621_B_Tspan15
  gRNA
cgaugaacaugaccaccccc

SEQ ID NO: 123622 - RNA, 20 nt, Artificial Sequence
  MKO10123622_B_Tspan17
  gRNA
gaaccuuaucgacuuugcuc

SEQ ID NO: 123623 - RNA, 20 nt, Artificial Sequence
  MKO10123623_B_Tspan17
  gRNA
agggcaccccacagcgcuca

SEQ ID NO: 123624 - RNA, 20 nt, Artificial Sequence
  MKO10123624_B_Tspan17
  gRNA
aacccaagccgugagcgcug

SEQ ID NO: 123625 - RNA, 20 nt, Artificial Sequence
  MKO10123625_B_Tspan18
  gRNA
caccggcuuccgagaaaucg

SEQ ID NO: 123626 - RNA, 20 nt, Artificial Sequence
  MKO10123626_B_Tspan18
  gRNA
caguacgauguaggcaccgg

SEQ ID NO: 123627 - RNA, 20 nt, Artificial Sequence
  MKO10123627_B_Tspan18
  gRNA
cagcgucagcagccgaaaca

SEQ ID NO: 123628 - RNA, 20 nt, Artificial Sequence
  MKO10123628_B_Tspan1
  gRNA
ccugcuaucgaaaaagacua

SEQ ID NO: 123629 - RNA, 20 nt, Artificial Sequence
  MKO10123629_B_Tspan1
  gRNA
ccauuguaguguuccauacu

SEQ ID NO: 123630 - RNA, 20 nt, Artificial Sequence
  MKO10123630_B_Tspan1
  gRNA
ccacccuguugugccaaccc

SEQ ID NO: 123631 - RNA, 20 nt, Artificial Sequence
  MKO10123631_B_Tspan2
  gRNA
acagcgacuaccuuaaagac

SEQ ID NO: 123632 - RNA, 20 nt, Artificial Sequence
  MKO10123632_B_Tspan2
  gRNA
agaaacccacagucaucauc

SEQ ID NO: 123633 - RNA, 20 nt, Artificial Sequence
  MKO10123633_B_Tspan2
  gRNA
guuacucacugcugagugga

SEQ ID NO: 123634 - RNA, 20 nt, Artificial Sequence
  MKO10123634_B_Tspan31
  gRNA
cggucuugagcaacaguacc

SEQ ID NO: 123635 - RNA, 20 nt, Artificial Sequence
  MKO10123635_B_Tspan31
  gRNA
gaaugcuagacaccacaccg

SEQ ID NO: 123636 - RNA, 20 nt, Artificial Sequence
  MKO10123636_B_Tspan31
  gRNA
gacaaagcccucaagauccu

SEQ ID NO: 123637 - RNA, 20 nt, Artificial Sequence
  MKO10123637_B_Tspan32
  gRNA
cacuggagccaucauguguc

SEQ ID NO: 123638 - RNA, 20 nt, Artificial Sequence
  MKO10123638_B_Tspan32
  gRNA
gagauucuacaaccccaccc

SEQ ID NO: 123639 - RNA, 20 nt, Artificial Sequence
  MKO10123639_B_Tspan32
  gRNA
ccuagcggggcuccugagcc

SEQ ID NO: 123640 - RNA, 20 nt, Artificial Sequence
  MKO10123640_B_Tspan33
  gRNA
ggauccgauacagccgcaga

SEQ ID NO: 123641 - RNA, 20 nt, Artificial Sequence
  MKO10123641_B_Tspan33
  gRNA
uggccgugggugucuaugcc

SEQ ID NO: 123642 - RNA, 20 nt, Artificial Sequence
  MKO10123642_B_Tspan33
  gRNA
ggacgcccaccacgaucagc

SEQ ID NO: 123643 - RNA, 20 nt, Artificial Sequence
  MKO10123643_B_Tspan3
  gRNA
uuguagcacagcagccgauc

SEQ ID NO: 123644 - RNA, 20 nt, Artificial Sequence
  MKO10123644_B_Tspan3
  gRNA
ccccucugaccucuacgccg

SEQ ID NO: 123645 - RNA, 20 nt, Artificial Sequence
  MKO10123645_B_Tspan3
  gRNA
gggauacguguacagagcaa

SEQ ID NO: 123646 - RNA, 20 nt, Artificial Sequence
  MKO10123646_B_Tspan4
  gRNA
agcucuuaccgacuuccacc

SEQ ID NO: 123647 - RNA, 20 nt, Artificial Sequence
  MKO10123647_B_Tspan4
  gRNA
ccugcaucuguauggcacac

SEQ ID NO: 123648 - RNA, 20 nt, Artificial Sequence
  MKO10123648_B_Tspan4
  gRNA
gcaacauaccuugucacugu

SEQ ID NO: 123649 - RNA, 20 nt, Artificial Sequence
  MKO10123649_B_Tspan5
  gRNA
gaaccucauagacuucaccc

SEQ ID NO: 123650 - RNA, 20 nt, Artificial Sequence
  MKO10123650_B_Tspan5
  gRNA
acacugggucaaagccaccg

SEQ ID NO: 123651 - RNA, 20 nt, Artificial Sequence
  MKO10123651_B_Tspan5
  gRNA
auuccugggugaagucuaug

SEQ ID NO: 123652 - RNA, 20 nt, Artificial Sequence
  MKO10123652_B_Tspan6
  gRNA
gaacuaguugccgccauugu

SEQ ID NO: 123653 - RNA, 20 nt, Artificial Sequence
  MKO10123653_B_Tspan6
  gRNA
acagguagcgaaacaaccaa

SEQ ID NO: 123654 - RNA, 20 nt, Artificial Sequence
  MKO10123654_B_Tspan6
  gRNA
uaacuaugaaaacgcucuga

SEQ ID NO: 123655 - RNA, 20 nt, Artificial Sequence
  MKO10123655_B_Tspan7
  gRNA
aacuuacgcugcgcugcaca

SEQ ID NO: 123656 - RNA, 20 nt, Artificial Sequence
  MKO10123656_B_Tspan7
  gRNA
auugccauuguaguucugca

SEQ ID NO: 123657 - RNA, 20 nt, Artificial Sequence
  MKO10123657_B_Tspan7
  gRNA
gaucacuggggugauccugu

SEQ ID NO: 123658 - RNA, 20 nt, Artificial Sequence
  MKO10123658_B_Tspan8
  gRNA
auagcguuucauucagaauu

SEQ ID NO: 123659 - RNA, 20 nt, Artificial Sequence
  MKO10123659_B_Tspan8
  gRNA
aggagccgcuuucaaaccug

SEQ ID NO: 123660 - RNA, 20 nt, Artificial Sequence
  MKO10123660_B_Tspan8
  gRNA
caucaugguucuagguuucc

SEQ ID NO: 123661 - RNA, 20 nt, Artificial Sequence
  MKO10123661_B_Tspan9
  gRNA
ugacuacacagacugguauc

SEQ ID NO: 123662 - RNA, 20 nt, Artificial Sequence
  MKO10123662_B_Tspan9
  gRNA
gaacgccuggaacaucaucc

SEQ ID NO: 123663 - RNA, 20 nt, Artificial Sequence
  MKO10123663_B_Tspan9
  gRNA
ggugaacgagaaugccaagc

SEQ ID NO: 123664 - RNA, 20 nt, Artificial Sequence
  MKO10123664_B_Tspear
  gRNA
ccacccacccuaucaguaag

SEQ ID NO: 123665 - RNA, 20 nt, Artificial Sequence
  MKO10123665_B_Tspear
  gRNA
ugugggguggcaucugaucc

SEQ ID NO: 123666 - RNA, 20 nt, Artificial Sequence
  MKO10123666_B_Tspear
  gRNA
gcuccucuuacugauagggu

SEQ ID NO: 123667 - RNA, 20 nt, Artificial Sequence
  MKO10123667_B_Tspo2
  gRNA
aggaacucggagggggcuuc

SEQ ID NO: 123668 - RNA, 20 nt, Artificial Sequence
  MKO10123668_B_Tspo2
  gRNA
ccgccaucaccuaccgccug

SEQ ID NO: 123669 - RNA, 20 nt, Artificial Sequence
  MKO10123669_B_Tspo2
  gRNA
ucauucaucagccauccagu

SEQ ID NO: 123670 - RNA, 20 nt, Artificial Sequence
  MKO10123670_B_Tspo
  gRNA
cgugauaacucuggccggcg

SEQ ID NO: 123671 - RNA, 20 nt, Artificial Sequence
  MKO10123671_B_Tspo
  gRNA
gguauggcuccuacauaguc

SEQ ID NO: 123672 - RNA, 20 nt, Artificial Sequence
  MKO10123672_B_Tspo
  gRNA
guucccuugggucucuacac

SEQ ID NO: 123673 - RNA, 20 nt, Artificial Sequence
  MKO10123673_B_Tspyl1
  gRNA
cucccuuauugggcgacguc

SEQ ID NO: 123674 - RNA, 20 nt, Artificial Sequence
  MKO10123674_B_Tspyl1
  gRNA
gcgaaugcgacgacacuacc

SEQ ID NO: 123675 - RNA, 20 nt, Artificial Sequence
  MKO10123675_B_Tspyl1
  gRNA
ccccgcgccccgagaugucg

SEQ ID NO: 123676 - RNA, 20 nt, Artificial Sequence
  MKO10123676_B_Tspyl2
  gRNA
acuuaccugagcgguugcgc

SEQ ID NO: 123677 - RNA, 20 nt, Artificial Sequence
  MKO10123677_B_Tspyl2
  gRNA
gucauggcuccugcgauuau

SEQ ID NO: 123678 - RNA, 20 nt, Artificial Sequence
  MKO10123678_B_Tspyl2
  gRNA
guacgcuacuauaugagacg

SEQ ID NO: 123679 - RNA, 20 nt, Artificial Sequence
  MKO10123679_B_Tspyl3
  gRNA
gugugcaucccgcucuugua

SEQ ID NO: 123680 - RNA, 20 nt, Artificial Sequence
  MKO10123680_B_Tspyl3
  gRNA
ugaggaagacucuguagccg

SEQ ID NO: 123681 - RNA, 20 nt, Artificial Sequence
  MKO10123681_B_Tspyl3
  gRNA
ugccucccgcguucugaacc

SEQ ID NO: 123682 - RNA, 20 nt, Artificial Sequence
  MKO10123682_B_Tspyl4
  gRNA
agacgcgccuccauccgcac

SEQ ID NO: 123683 - RNA, 20 nt, Artificial Sequence
  MKO10123683_B_Tspyl4
  gRNA
aguugugcugcggcagcgag

SEQ ID NO: 123684 - RNA, 20 nt, Artificial Sequence
  MKO10123684_B_Tspyl4
  gRNA
gagugacaccacucgaccug

SEQ ID NO: 123685 - RNA, 20 nt, Artificial Sequence
  MKO10123685_B_Tspyl5
  gRNA
accccuacuccguccgcuca

SEQ ID NO: 123686 - RNA, 20 nt, Artificial Sequence
  MKO10123686_B_Tspyl5
  gRNA
cgaaagucuucccgcgccaa

SEQ ID NO: 123687 - RNA, 20 nt, Artificial Sequence
  MKO10123687_B_Tspyl5
  gRNA
cuaaguggugaagucgcaac

SEQ ID NO: 123688 - RNA, 20 nt, Artificial Sequence
  MKO10123688_B_Tsr1
  gRNA
uuuaaagggaacggauccac

SEQ ID NO: 123689 - RNA, 20 nt, Artificial Sequence
  MKO10123689_B_Tsr1
  gRNA
cacacuuacuauagguggga

SEQ ID NO: 123690 - RNA, 20 nt, Artificial Sequence
  MKO10123690_B_Tsr1
  gRNA
gcuggcuggcgcgaugccuc

SEQ ID NO: 123691 - RNA, 20 nt, Artificial Sequence
  MKO10123691_B_Tsr2
  gRNA
agcugcaguccgagcugcgc

SEQ ID NO: 123692 - RNA, 20 nt, Artificial Sequence
  MKO10123692_B_Tsr2
  gRNA
gagcagccccaucacccuuc

SEQ ID NO: 123693 - RNA, 20 nt, Artificial Sequence
  MKO10123693_B_Tsr2
  gRNA
ggaacauggucuguagcugu

SEQ ID NO: 123694 - RNA, 20 nt, Artificial Sequence
  MKO10123694_B_Tsr3
  gRNA
gggaguuugugaaucucaac

SEQ ID NO: 123695 - RNA, 20 nt, Artificial Sequence
  MKO10123695_B_Tsr3
  gRNA
ucgcagucauagacugcucc

SEQ ID NO: 123696 - RNA, 20 nt, Artificial Sequence
  MKO10123696_B_Tsr3
  gRNA
caccagggacacgccugaag

SEQ ID NO: 123697 - RNA, 20 nt, Artificial Sequence
  MKO10123697_B_Tssc1
  gRNA
cgucccaaccaagaagcgaa

SEQ ID NO: 123698 - RNA, 20 nt, Artificial Sequence
  MKO10123698_B_Tssc1
  gRNA
ccgauagccacauccugcug

SEQ ID NO: 123699 - RNA, 20 nt, Artificial Sequence
  MKO10123699_B_Tssc1
  gRNA
uagugucgugugggaaccga

SEQ ID NO: 123700 - RNA, 20 nt, Artificial Sequence
  MKO10123700_B_Tssc4
  gRNA
aggucguauggcggagacag

SEQ ID NO: 123701 - RNA, 20 nt, Artificial Sequence
  MKO10123701_B_Tssc4
  gRNA
ggacccuccaucgcccccca

SEQ ID NO: 123702 - RNA, 20 nt, Artificial Sequence
  MKO10123702_B_Tssc4
  gRNA
ggaggcugaugaacccaccg

SEQ ID NO: 123703 - RNA, 20 nt, Artificial Sequence
  MKO10123703_B_Tssk1
  gRNA
ugagcgccuaaaguucaacg

SEQ ID NO: 123704 - RNA, 20 nt, Artificial Sequence
  MKO10123704_B_Tssk1
  gRNA
ugaccgccacguugaacuuu

SEQ ID NO: 123705 - RNA, 20 nt, Artificial Sequence
  MKO10123705_B_Tssk1
  gRNA
cccuguucaguucgcugcug

SEQ ID NO: 123706 - RNA, 20 nt, Artificial Sequence
  MKO10123706_B_Tssk2
  gRNA
gaucucguaggucuuaauga

SEQ ID NO: 123707 - RNA, 20 nt, Artificial Sequence
  MKO10123707_B_Tssk2
  gRNA
ugcgcccacucccgucccgc

SEQ ID NO: 123708 - RNA, 20 nt, Artificial Sequence
  MKO10123708_B_Tssk2
  gRNA
guaucgagcugauugcaagu

SEQ ID NO: 123709 - RNA, 20 nt, Artificial Sequence
  MKO10123709_B_Tssk3
  gRNA
uaucagcugggcaagaccau

SEQ ID NO: 123710 - RNA, 20 nt, Artificial Sequence
  MKO10123710_B_Tssk3
  gRNA
cuucaaucgaagaaguuagu

SEQ ID NO: 123711 - RNA, 20 nt, Artificial Sequence
  MKO10123711_B_Tssk3
  gRNA
aggugcuacccaagucacgc

SEQ ID NO: 123712 - RNA, 20 nt, Artificial Sequence
  MKO10123712_B_Tssk4
  gRNA
cccagccuaucgcucuguca

SEQ ID NO: 123713 - RNA, 20 nt, Artificial Sequence
  MKO10123713_B_Tssk4
  gRNA
uaagaagggcuacuaugcac

SEQ ID NO: 123714 - RNA, 20 nt, Artificial Sequence
  MKO10123714_B_Tssk4
  gRNA
aucccgaguauacaucauuu

SEQ ID NO: 123715 - RNA, 20 nt, Artificial Sequence
  MKO10123715_B_Tssk5
  gRNA
cguuguacuucuugcucaug

SEQ ID NO: 123716 - RNA, 20 nt, Artificial Sequence
  MKO10123716_B_Tssk5
  gRNA
ggcuaucaagauugugucca

SEQ ID NO: 123717 - RNA, 20 nt, Artificial Sequence
  MKO10123717_B_Tssk5
  gRNA
cugucagcuuuaugaagccc

SEQ ID NO: 123718 - RNA, 20 nt, Artificial Sequence
  MKO10123718_B_Tssk6
  gRNA
agcaauguccgagucgucga

SEQ ID NO: 123719 - RNA, 20 nt, Artificial Sequence
  MKO10123719_B_Tssk6
  gRNA
ucgaaaacguguacgaugug

SEQ ID NO: 123720 - RNA, 20 nt, Artificial Sequence
  MKO10123720_B_Tssk6
  gRNA
gguagagcacgccgcgcuuc

SEQ ID NO: 123721 - RNA, 20 nt, Artificial Sequence
  MKO10123721_B_Tsua3
  gRNA
cuauccuauugacgagacaa

SEQ ID NO: 123722 - RNA, 20 nt, Artificial Sequence
  MKO10123722_B_Tsua3
  gRNA
cgucauccaucucgcugcaa

SEQ ID NO: 123723 - RNA, 20 nt, Artificial Sequence
  MKO10123723_B_Tsua3
  gRNA
ggaugauugacgugcagaac

SEQ ID NO: 123724 - RNA, 20 nt, Artificial Sequence
  MKO10123724_B_Tstd1
  gRNA
gggucuccaggccacacaac

SEQ ID NO: 123725 - RNA, 20 nt, Artificial Sequence
  MKO10123725_B_Tstd1
  gRNA
uccccucucagugucugaau

SEQ ID NO: 123726 - RNA, 20 nt, Artificial Sequence
  MKO10123726_B_Tstd1
  gRNA
gcgucacagucacacaagug

SEQ ID NO: 123727 - RNA, 20 nt, Artificial Sequence
  MKO10123727_B_Tstd2
  gRNA
ugccaucaccugcaccuuac

SEQ ID NO: 123728 - RNA, 20 nt, Artificial Sequence
  MKO10123728_B_Tstd2
  gRNA
ccuuaaaaucauccucgcuc

SEQ ID NO: 123729 - RNA, 20 nt, Artificial Sequence
  MKO10123729_B_Tstd2
  gRNA
gggcuaacauggcucacauc

SEQ ID NO: 123730 - RNA, 20 nt, Artificial Sequence
  MKO10123730_B_Tstd3
  gRNA
ucccuauaagucacacccuu

SEQ ID NO: 123731 - RNA, 20 nt, Artificial Sequence
  MKO10123731_B_Tstd3
  gRNA
ggaucaguggagccugcgcu

SEQ ID NO: 123732 - RNA, 20 nt, Artificial Sequence
  MKO10123732_B_Tstd3
  gRNA
uauggacacagcaauaucac

SEQ ID NO: 123733 - RNA, 20 nt, Artificial Sequence
  MKO10123733_B_Tst
  gRNA
ucucgaagccaucuuucguc

SEQ ID NO: 123734 - RNA, 20 nt, Artificial Sequence
  MKO10123734_B_Tst
  gRNA
cgccaggcacgugucgcucc

SEQ ID NO: 123735 - RNA, 20 nt, Artificial Sequence
  MKO10123735_B_Tst
  gRNA
uuugcgugccuggcgggucc

SEQ ID NO: 123736 - RNA, 20 nt, Artificial Sequence
  MKO10123736_B_Tsx
  gRNA
aauaaugugaaagucaucac

SEQ ID NO: 123737 - RNA, 20 nt, Artificial Sequence
  MKO10123737_B_Tsx
  gRNA
uuggcaaguguccucaucau

SEQ ID NO: 123738 - RNA, 20 nt, Artificial Sequence
  MKO10123738_B_Tsx
  gRNA
gcaauacuugcccagagcag

SEQ ID NO: 123739 - RNA, 20 nt, Artificial Sequence
  MKO10123739_B_Ttbk1
  gRNA
cacaggccggacguccccag

SEQ ID NO: 123740 - RNA, 20 nt, Artificial Sequence
  MKO10123740_B_Ttbk1
  gRNA
gggcuucggugagaucuaug

SEQ ID NO: 123741 - RNA, 20 nt, Artificial Sequence
  MKO10123741_B_Ttbk1
  gRNA
cauaguuaaacuucucguua

SEQ ID NO: 123742 - RNA, 20 nt, Artificial Sequence
  MKO10123742_B_Ttbk2
  gRNA
uggagaaauuuacgaugccu

SEQ ID NO: 123743 - RNA, 20 nt, Artificial Sequence
  MKO10123743_B_Ttbk2
  gRNA
ucugugcaguuaagaaagau

SEQ ID NO: 123744 - RNA, 20 nt, Artificial Sequence
  MKO10123744_B_Ttbk2
  gRNA
gaccauguuuguagauuuau

SEQ ID NO: 123745 - RNA, 20 nt, Artificial Sequence
  MKO10123745_B_Tuc12
  gRNA
caguccuccacaaacucccg

SEQ ID NO: 123746 - RNA, 20 nt, Artificial Sequence
  MKO10123746_B_Tuc12
  gRNA
agggaaaccucgggaguuug

SEQ ID NO: 123747 - RNA, 20 nt, Artificial Sequence
  MKO10123747_B_Tuc12
  gRNA
ucugcugucagaugccuucu

SEQ ID NO: 123748 - RNA, 20 nt, Artificial Sequence
  MKO10123748_B_Tuc13
  gRNA
gagucugacugcgaacugag

SEQ ID NO: 123749 - RNA, 20 nt, Artificial Sequence
  MKO10123749_B_Tuc13
  gRNA
cguagagaccgcugcccacc

SEQ ID NO: 123750 - RNA, 20 nt, Artificial Sequence
  MKO10123750_B_Tuc13
  gRNA
cuuuccauaggaagccaucg

SEQ ID NO: 123751 - RNA, 20 nt, Artificial Sequence
  MKO10123751_B_Tuc14
  gRNA
uaucaccacguucaauaucu

SEQ ID NO: 123752 - RNA, 20 nt, Artificial Sequence
  MKO10123752_B_Tuc14
  gRNA
auugucgucaugcacuucag

SEQ ID NO: 123753 - RNA, 20 nt, Artificial Sequence
  MKO10123753_B_Tuc14
  gRNA
ccuuuaucauauuaucaaac

SEQ ID NO: 123754 - RNA, 20 nt, Artificial Sequence
  MKO10123754_B_Tuc16
  gRNA
uucugggaacgggcacugug

SEQ ID NO: 123755 - RNA, 20 nt, Artificial Sequence
  MKO10123755_B_Tuc16
  gRNA
ggaauaacaaguaccugaac

SEQ ID NO: 123756 - RNA, 20 nt, Artificial Sequence
  MKO10123756_B_Tuc16
  gRNA
cucuuaccaguuuggggucc

SEQ ID NO: 123757 - RNA, 20 nt, Artificial Sequence
  MKO10123757_B_Tuc17
  gRNA
agaagaccccgacuguauca

SEQ ID NO: 123758 - RNA, 20 nt, Artificial Sequence
  MKO10123758_B_Tuc17
  gRNA
uggggaugcuucaaguucau

SEQ ID NO: 123759 - RNA, 20 nt, Artificial Sequence
  MKO10123759_B_Tuc17
  gRNA
aucuucuuuagguaagagag

SEQ ID NO: 123760 - RNA, 20 nt, Artificial Sequence
  MKO10123760_B_Tuc18
  gRNA
aaagucacugucucucccga

SEQ ID NO: 123761 - RNA, 20 nt, Artificial Sequence
  MKO10123761_B_Tuc18
  gRNA
uaccucugaccuucuaguaa

SEQ ID NO: 123762 - RNA, 20 nt, Artificial Sequence
  MKO10123762_B_Tuc18
  gRNA
gaucuucuuccuuuacuaga

SEQ ID NO: 123763 - RNA, 20 nt, Artificial Sequence
  MKO10123763_B_Tuc19
  gRNA
gcauguuccgguugcuucgc

SEQ ID NO: 123764 - RNA, 20 nt, Artificial Sequence
  MKO10123764_B_Tuc19
  gRNA
uguugucacucucauacgca

SEQ ID NO: 123765 - RNA, 20 nt, Artificial Sequence
  MKO10123765_B_Tuc19
  gRNA
ucgucugacgcguccucucc

SEQ ID NO: 123766 - RNA, 20 nt, Artificial Sequence
  MKO10123766_B_Tuc1
  gRNA
gagcgcuaaacuaaaggagg

SEQ ID NO: 123767 - RNA, 20 nt, Artificial Sequence
  MKO10123767_B_Tuc1
  gRNA
aacaggcugggcacaucuga

SEQ ID NO: 123768 - RNA, 20 nt, Artificial Sequence
  MKO10123768_B_Tuc1
  gRNA
aaugagcgguuuaagagagg

SEQ ID NO: 123769 - RNA, 20 nt, Artificial Sequence
  MKO10123769_B_Tuc21a
  gRNA
uucgaucauuuacuacagcc

SEQ ID NO: 123770 - RNA, 20 nt, Artificial Sequence
  MKO10123770_B_Tuc21a
  gRNA
gcagcuugaaggaaauucgc

SEQ ID NO: 123771 - RNA, 20 nt, Artificial Sequence
  MKO10123771_B_Tuc21a
  gRNA
ugauggauuucuucacaacg

SEQ ID NO: 123772 - RNA, 20 nt, Artificial Sequence
  MKO10123772_B_Tuc21b
  gRNA
cgugguaaaaucggaagacu

SEQ ID NO: 123773 - RNA, 20 nt, Artificial Sequence
  MKO10123773_B_Tuc21b
  gRNA
acccuccaucagugugccgu

SEQ ID NO: 123774 - RNA, 20 nt, Artificial Sequence
  MKO10123774_B_Tuc21b
  gRNA
cuuaugcuaaaaaagcccug

SEQ ID NO: 123775 - RNA, 20 nt, Artificial Sequence
  MKO10123775_B_Tuc22
  gRNA
gccagccuucaaccguacuc

SEQ ID NO: 123776 - RNA, 20 nt, Artificial Sequence
  MKO10123776_B_Tuc22
  gRNA
ccauggcaacacucuuuauc

SEQ ID NO: 123777 - RNA, 20 nt, Artificial Sequence
  MKO10123777_B_Tuc22
  gRNA
cuugaggaccucuccgagca

SEQ ID NO: 123778 - RNA, 20 nt, Artificial Sequence
  MKO10123778_B_Tuc23l
  gRNA
ucagacucuacuauacucug

SEQ ID NO: 123779 - RNA, 20 nt, Artificial Sequence
  MKO10123779_B_Tuc23l
  gRNA
uaugguuaccugacacugag

SEQ ID NO: 123780 - RNA, 20 nt, Artificial Sequence
  MKO10123780_B_Tuc23l
  gRNA
guucucuacuuguuacugug

SEQ ID NO: 123781 - RNA, 20 nt, Artificial Sequence
  MKO10123781_B_Tuc23
  gRNA
cagcagcaacgacuucgucu

SEQ ID NO: 123782 - RNA, 20 nt, Artificial Sequence
  MKO10123782_B_Tuc23
  gRNA
acgacagcuugauucgagac

SEQ ID NO: 123783 - RNA, 20 nt, Artificial Sequence
  MKO10123783_B_Tuc23
  gRNA
ggaguuucucucgagggggc

SEQ ID NO: 123784 - RNA, 20 nt, Artificial Sequence
  MKO10123784_B_Tuc24
  gRNA
gaaauacuauaaggaagcgc

SEQ ID NO: 123785 - RNA, 20 nt, Artificial Sequence
  MKO10123785_B_Tuc24
  gRNA
auacuaccaagaaacgagcc

SEQ ID NO: 123786 - RNA, 20 nt, Artificial Sequence
  MKO10123786_B_Tuc24
  gRNA
gggccauucuacaaugaucu

SEQ ID NO: 123787 - RNA, 20 nt, Artificial Sequence
  MKO10123787_B_Tuc25
  gRNA
cuccccgagcagcugccgca

SEQ ID NO: 123788 - RNA, 20 nt, Artificial Sequence
  MKO10123788_B_Tuc25
  gRNA
ccuacuuugaauucccgauc

SEQ ID NO: 123789 - RNA, 20 nt, Artificial Sequence
  MKO10123789_B_Tuc25
  gRNA
agccucgaugauagaacacc

SEQ ID NO: 123790 - RNA, 20 nt, Artificial Sequence
  MKO10123790_B_Tuc26
  gRNA
aaaccgccuacuguuccauc

SEQ ID NO: 123791 - RNA, 20 nt, Artificial Sequence
  MKO10123791_B_Tuc26
  gRNA
ggaauaugaaaaugcaacga

SEQ ID NO: 123792 - RNA, 20 nt, Artificial Sequence
  MKO10123792_B_Tuc26
  gRNA
cuuucgcagagagauuucac

SEQ ID NO: 123793 - RNA, 20 nt, Artificial Sequence
  MKO10123793_B_Tuc27
  gRNA
ugaggaugcaaguccacaag

SEQ ID NO: 123794 - RNA, 20 nt, Artificial Sequence
  MKO10123794_B_Tuc27
  gRNA
cugauucaccaucuagaaug

SEQ ID NO: 123795 - RNA, 20 nt, Artificial Sequence
  MKO10123795_B_Tuc27
  gRNA
cagcagcugguauuccuacu

SEQ ID NO: 123796 - RNA, 20 nt, Artificial Sequence
  MKO10123796_B_Tuc28
  gRNA
ccagcgccuugugguacugc

SEQ ID NO: 123797 - RNA, 20 nt, Artificial Sequence
  MKO10123797_B_Tuc28
  gRNA
uuccaaggggaauuaccgag

SEQ ID NO: 123798 - RNA, 20 nt, Artificial Sequence
  MKO10123798_B_Tuc28
  gRNA
ggccucucgguaauuccccu

SEQ ID NO: 123799 - RNA, 20 nt, Artificial Sequence
  MKO10123799_B_Tuc29
  gRNA
auauaacaaccuguaugcuc

SEQ ID NO: 123800 - RNA, 20 nt, Artificial Sequence
  MKO10123800_B_Tuc29
  gRNA
uggccugugaaagucucgug

SEQ ID NO: 123801 - RNA, 20 nt, Artificial Sequence
  MKO10123801_B_Tuc29
  gRNA
gccguccgugugucaguuca

SEQ ID NO: 123802 - RNA, 20 nt, Artificial Sequence
  MKO10123802_B_Tuc30a1
  gRNA
aaucaaagcuuucaacaguc

SEQ ID NO: 123803 - RNA, 20 nt, Artificial Sequence
  MKO10123803_B_Tuc30a1
  gRNA
ugacaugccuccuagagcag

SEQ ID NO: 123804 - RNA, 20 nt, Artificial Sequence
  MKO10123804_B_Tuc30a1
  gRNA
gccuguauccagaagccacc

SEQ ID NO: 123805 - RNA, 20 nt, Artificial Sequence
  MKO10123805_B_Tuc30a2
  gRNA
gaugccacgcucaaugauau

SEQ ID NO: 123806 - RNA, 20 nt, Artificial Sequence
  MKO10123806_B_Tuc30a2
  gRNA
ugcuguaacaagcuaaagcu

SEQ ID NO: 123807 - RNA, 20 nt, Artificial Sequence
  MKO10123807_B_Tuc30a2
  gRNA
cuuuagcuuguuacagcaac

SEQ ID NO: 123808 - RNA, 20 nt, Artificial Sequence
  MKO10123808_B_Tuc30b
  gRNA
agaugaugaaucugccaaaa

SEQ ID NO: 123809 - RNA, 20 nt, Artificial Sequence
  MKO10123809_B_Tuc30b
  gRNA
cuuuguagagcagacaaccu

SEQ ID NO: 123810 - RNA, 20 nt, Artificial Sequence
  MKO10123810_B_Tuc30b
  gRNA
agcagcucacagauccccga

SEQ ID NO: 123811 - RNA, 20 nt, Artificial Sequence
  MKO10123811_B_Tuc32
  gRNA
ggcagauguguagucgucca

SEQ ID NO: 123812 - RNA, 20 nt, Artificial Sequence
  MKO10123812_B_Tuc32
  gRNA
aaggcacuagaccucaaucc

SEQ ID NO: 123813 - RNA, 20 nt, Artificial Sequence
  MKO10123813_B_Tuc32
  gRNA
aaaacagcaucuugaaaucc

SEQ ID NO: 123814 - RNA, 20 nt, Artificial Sequence
  MKO10123814_B_Tuc33
  gRNA
ugccacgccucccacgagug

SEQ ID NO: 123815 - RNA, 20 nt, Artificial Sequence
  MKO10123815_B_Tuc33
  gRNA
augcagcugagaacgaggau

SEQ ID NO: 123816 - RNA, 20 nt, Artificial Sequence
  MKO10123816_B_Tuc33
  gRNA
gaagcacuacagcuaacccc

SEQ ID NO: 123817 - RNA, 20 nt, Artificial Sequence
  MKO10123817_B_Tuc34
  gRNA
uugauuucaacgccauacuu

SEQ ID NO: 123818 - RNA, 20 nt, Artificial Sequence
  MKO10123818_B_Tuc34
  gRNA
cauuaagcauucugcgggcu

SEQ ID NO: 123819 - RNA, 20 nt, Artificial Sequence
  MKO10123819_B_Tuc34
  gRNA
ggcugaugcccuguaccgcu

SEQ ID NO: 123820 - RNA, 20 nt, Artificial Sequence
  MKO10123820_B_Tuc36
  gRNA
cggcuccagggggauguagc

SEQ ID NO: 123821 - RNA, 20 nt, Artificial Sequence
  MKO10123821_B_Tuc36
  gRNA
cauggggacuccaaaugauc

SEQ ID NO: 123822 - RNA, 20 nt, Artificial Sequence
  MKO10123822_B_Tuc36
  gRNA
uucaacccugauacccccuu

SEQ ID NO: 123823 - RNA, 20 nt, Artificial Sequence
  MKO10123823_B_Tuc37
  gRNA
agccagaacagcugcucgcc

SEQ ID NO: 123824 - RNA, 20 nt, Artificial Sequence
  MKO10123824_B_Tuc37
  gRNA
ugccaggcgagcagcuguuc

SEQ ID NO: 123825 - RNA, 20 nt, Artificial Sequence
  MKO10123825_B_Tuc37
  gRNA
uucaccagguggcucggaca

SEQ ID NO: 123826 - RNA, 20 nt, Artificial Sequence
  MKO10123826_B_Tuc38
  gRNA
uuuccuuccaguacgucaag

SEQ ID NO: 123827 - RNA, 20 nt, Artificial Sequence
  MKO10123827_B_Tuc38
  gRNA
uucccgugccaacgagcaca

SEQ ID NO: 123828 - RNA, 20 nt, Artificial Sequence
  MKO10123828_B_Tuc38
  gRNA
gccaccaagacucuugucau

SEQ ID NO: 123829 - RNA, 20 nt, Artificial Sequence
  MKO10123829_B_Tuc39a
  gRNA
ggaccagugcaugacagccc

SEQ ID NO: 123830 - RNA, 20 nt, Artificial Sequence
  MKO10123830_B_Tuc39a
  gRNA
gguccagggcugucaugcac

SEQ ID NO: 123831 - RNA, 20 nt, Artificial Sequence
  MKO10123831_B_Tuc39a
  gRNA
agaaugccuacuacagagag

SEQ ID NO: 123832 - RNA, 20 nt, Artificial Sequence
  MKO10123832_B_Tuc39b
  gRNA
uuguaccaugcgagaccaaa

SEQ ID NO: 123833 - RNA, 20 nt, Artificial Sequence
  MKO10123833_B_Tuc39b
  gRNA
ggagagcauguaccacgccu

SEQ ID NO: 123834 - RNA, 20 nt, Artificial Sequence
  MKO10123834_B_Tuc39b
  gRNA
ggaucucaagagcggccugg

SEQ ID NO: 123835 - RNA, 20 nt, Artificial Sequence
  MKO10123835_B_Tuc39c
  gRNA
gaucaucaucgcugacugcc

SEQ ID NO: 123836 - RNA, 20 nt, Artificial Sequence
  MKO10123836_B_Tuc39c
  gRNA
uaccaaaaagcugacgaagc

SEQ ID NO: 123837 - RNA, 20 nt, Artificial Sequence
  MKO10123837_B_Tuc39c
  gRNA
cuccuccucgaaugucauca

SEQ ID NO: 123838 - RNA, 20 nt, Artificial Sequence
  MKO10123838_B_Tuc39d
  gRNA
uugcggcguucauuccgauc

SEQ ID NO: 123839 - RNA, 20 nt, Artificial Sequence
  MKO10123839_B_Tuc39d
  gRNA
cgagauaaagucacuauccu

SEQ ID NO: 123840 - RNA, 20 nt, Artificial Sequence
  MKO10123840_B_Tuc39d
  gRNA
gcauaaguucuaagaccugu

SEQ ID NO: 123841 - RNA, 20 nt, Artificial Sequence
  MKO10123841_B_Tuc3
  gRNA
uuaucucagcagcacgagaa

SEQ ID NO: 123842 - RNA, 20 nt, Artificial Sequence
  MKO10123842_B_Tuc3
  gRNA
auuacaacaucuugaguuga

SEQ ID NO: 123843 - RNA, 20 nt, Artificial Sequence
  MKO10123843_B_Tuc3
  gRNA
aaugauucauuccuuauuga

SEQ ID NO: 123844 - RNA, 20 nt, Artificial Sequence
  MKO10123844_B_Tuc4
  gRNA
gaugaugaucgauauccaga

SEQ ID NO: 123845 - RNA, 20 nt, Artificial Sequence
  MKO10123845_B_Tuc4
  gRNA
uucuucccucaaugaugugc

SEQ ID NO: 123846 - RNA, 20 nt, Artificial Sequence
  MKO10123846_B_Tuc4
  gRNA
gucauugcccucaucuuuau

SEQ ID NO: 123847 - RNA, 20 nt, Artificial Sequence
  MKO10123847_B_Tuc5
  gRNA
uuugcuagggacugguggau

SEQ ID NO: 123848 - RNA, 20 nt, Artificial Sequence
  MKO10123848_B_Tuc5
  gRNA
acacauagugucgaagaugc

SEQ ID NO: 123849 - RNA, 20 nt, Artificial Sequence
  MKO10123849_B_Tuc5
  gRNA
cacaccaggagcggccauca

SEQ ID NO: 123850 - RNA, 20 nt, Artificial Sequence
  MKO10123850_B_Tuc7b
  gRNA
cguccugcucccgguccaca

SEQ ID NO: 123851 - RNA, 20 nt, Artificial Sequence
  MKO10123851_B_Tuc7b
  gRNA
gcuugcgcacuucagucagc

SEQ ID NO: 123852 - RNA, 20 nt, Artificial Sequence
  MKO10123852_B_Tuc7b
  gRNA
uuacugguagaggacgaaac

SEQ ID NO: 123853 - RNA, 20 nt, Artificial Sequence
  MKO10123853_B_Tuc7
  gRNA
aaguaggacagcucauaguc

SEQ ID NO: 123854 - RNA, 20 nt, Artificial Sequence
  MKO10123854_B_Tuc7
  gRNA
cccacauccgccugacugag

SEQ ID NO: 123855 - RNA, 20 nt, Artificial Sequence
  MKO10123855_B_Tuc7
  gRNA
ucuucacauaugcgcucugg

SEQ ID NO: 123856 - RNA, 20 nt, Artificial Sequence
  MKO10123856_B_Tuc8
  gRNA
cuuccagaugagcuagugau

SEQ ID NO: 123857 - RNA, 20 nt, Artificial Sequence
  MKO10123857_B_Tuc8
  gRNA
ccuccuguuugguuagugcc

SEQ ID NO: 123858 - RNA, 20 nt, Artificial Sequence
  MKO10123858_B_Tuc8
  gRNA
gaggaccgacucaagcuguc

SEQ ID NO: 123859 - RNA, 20 nt, Artificial Sequence
  MKO10123859_B_Tuc9b
  gRNA
acgugcgcugcgcuaccuac

SEQ ID NO: 123860 - RNA, 20 nt, Artificial Sequence
  MKO10123860_B_Tuc9b
  gRNA
aggcccagcucggaaugucg

SEQ ID NO: 123861 - RNA, 20 nt, Artificial Sequence
  MKO10123861_B_Tuc9b
  gRNA
cagcccacgacauuccgagc

SEQ ID NO: 123862 - RNA, 20 nt, Artificial Sequence
  MKO10123862_B_Tuc9c
  gRNA
cacugcuacaacaaccuagc

SEQ ID NO: 123863 - RNA, 20 nt, Artificial Sequence
  MKO10123863_B_Tuc9c
  gRNA
aguaccgagaugcugugagu

SEQ ID NO: 123864 - RNA, 20 nt, Artificial Sequence
  MKO10123864_B_Tuc9c
  gRNA
uucauuaaccaaacaugccc

SEQ ID NO: 123865 - RNA, 20 nt, Artificial Sequence
  MKO10123865_B_Tuc9
  gRNA
ugagcuucaucuccgucagc

SEQ ID NO: 123866 - RNA, 20 nt, Artificial Sequence
  MKO10123866_B_Tuc9
  gRNA
ucgcagacaccaaugugauu

SEQ ID NO: 123867 - RNA, 20 nt, Artificial Sequence
  MKO10123867_B_Tuc9
  gRNA
auaguccccaagaugauaga

SEQ ID NO: 123868 - RNA, 20 nt, Artificial Sequence
  MKO10123868_B_Ttf1
  gRNA
auucccuccauggaaacgac

SEQ ID NO: 123869 - RNA, 20 nt, Artificial Sequence
  MKO10123869_B_Ttf1
  gRNA
caucaaagaucuucuuugca

SEQ ID NO: 123870 - RNA, 20 nt, Artificial Sequence
  MKO10123870_B_Ttf1
  gRNA
cuuaccaaugugcagucuga

SEQ ID NO: 123871 - RNA, 20 nt, Artificial Sequence
  MKO10123871_B_Ttf2
  gRNA
agugguguggaaacguccca

SEQ ID NO: 123872 - RNA, 20 nt, Artificial Sequence
  MKO10123872_B_Ttf2
  gRNA
gcucgcucaggggccucucc

SEQ ID NO: 123873 - RNA, 20 nt, Artificial Sequence
  MKO10123873_B_Ttf2
  gRNA
gcaaugccuaccugccgcca

SEQ ID NO: 123874 - RNA, 20 nt, Artificial Sequence
  MKO10123874_B_Tti1
  gRNA
acuuacaagugaugaccccc

SEQ ID NO: 123875 - RNA, 20 nt, Artificial Sequence
  MKO10123875_B_Tti1
  gRNA
gggcccccucugugaaaauc

SEQ ID NO: 123876 - RNA, 20 nt, Artificial Sequence
  MKO10123876_B_Tti1
  gRNA
aaaucugaaaauccgccuga

SEQ ID NO: 123877 - RNA, 20 nt, Artificial Sequence
  MKO10123877_B_Tti2
  gRNA
aacuugucaugcaguauacu

SEQ ID NO: 123878 - RNA, 20 nt, Artificial Sequence
  MKO10123878_B_Tti2
  gRNA
uacugcagcaaguccgcagc

SEQ ID NO: 123879 - RNA, 20 nt, Artificial Sequence
  MKO10123879_B_Tti2
  gRNA
ccacaguaaccacaauguga

SEQ ID NO: 123880 - RNA, 20 nt, Artificial Sequence
  MKO10123880_B_Ttk
  gRNA
uucgagcaaagcucucauuc

SEQ ID NO: 123881 - RNA, 20 nt, Artificial Sequence
  MKO10123881_B_Ttk
  gRNA
uguucccaacccucauaauu

SEQ ID NO: 123882 - RNA, 20 nt, Artificial Sequence
  MKO10123882_B_Ttk
  gRNA
uucuuacccauauaaaaccc

SEQ ID NO: 123883 - RNA, 20 nt, Artificial Sequence
  MKO10123883_B_Ttll10
  gRNA
aacuacugcagcuuucggga

SEQ ID NO: 123884 - RNA, 20 nt, Artificial Sequence
  MKO10123884_B_Ttll10
  gRNA
agucagcuggaccaagaugc

SEQ ID NO: 123885 - RNA, 20 nt, Artificial Sequence
  MKO10123885_B_Ttll10
  gRNA
agcccguccggggaggucac

SEQ ID NO: 123886 - RNA, 20 nt, Artificial Sequence
  MKO10123886_B_Ttll11
  gRNA
acaacuucuacccucgcucc

SEQ ID NO: 123887 - RNA, 20 nt, Artificial Sequence
  MKO10123887_B_Ttll11
  gRNA
ucaccuugagccgagcacug

SEQ ID NO: 123888 - RNA, 20 nt, Artificial Sequence
  MKO10123888_B_Ttll11
  gRNA
cgugacagugacauacucuc

SEQ ID NO: 123889 - RNA, 20 nt, Artificial Sequence
  MKO10123889_B_Ttll12
  gRNA
cugggcccccgccgacaugc

SEQ ID NO: 123890 - RNA, 20 nt, Artificial Sequence
  MKO10123890_B_Ttll12
  gRNA
ccucuccguaggcaaagucc

SEQ ID NO: 123891 - RNA, 20 nt, Artificial Sequence
  MKO10123891_B_Ttll12
  gRNA
ccgacuuaccgccugugucu

SEQ ID NO: 123892 - RNA, 20 nt, Artificial Sequence
  MKO10123892_B_Ttll13
  gRNA
cgccccugacagccgcuauc

SEQ ID NO: 123893 - RNA, 20 nt, Artificial Sequence
  MKO10123893_B_Ttll13
  gRNA
acguagcuauggggacuucc

SEQ ID NO: 123894 - RNA, 20 nt, Artificial Sequence
  MKO10123894_B_Ttll13
  gRNA
aacgagucauggacaugaag

SEQ ID NO: 123895 - RNA, 20 nt, Artificial Sequence
  MKO10123895_B_Ttll1
  gRNA
guuuguccaccuuaccaacg

SEQ ID NO: 123896 - RNA, 20 nt, Artificial Sequence
  MKO10123896_B_Ttll1
  gRNA
ucugcgaaagcuuauugaug

SEQ ID NO: 123897 - RNA, 20 nt, Artificial Sequence
  MKO10123897_B_Ttll1
  gRNA
aaacauguugucgagcucac

SEQ ID NO: 123898 - RNA, 20 nt, Artificial Sequence
  MKO10123898_B_Ttll2
  gRNA
uguacagaaugucccucuag

SEQ ID NO: 123899 - RNA, 20 nt, Artificial Sequence
  MKO10123899_B_Ttll2
  gRNA
cacaaacuugguguagucag

SEQ ID NO: 123900 - RNA, 20 nt, Artificial Sequence
  MKO10123900_B_Ttll2
  gRNA
aaacucuaugagagaugcau

SEQ ID NO: 123901 - RNA, 20 nt, Artificial Sequence
  MKO10123901_B_Ttll3
  gRNA
ccacguagagagagccguca

SEQ ID NO: 123902 - RNA, 20 nt, Artificial Sequence
  MKO10123902_B_Ttll3
  gRNA
gcugggugauagcgaugcca

SEQ ID NO: 123903 - RNA, 20 nt, Artificial Sequence
  MKO10123903_B_Ttll3
  gRNA
gggucucauuucgaaccaug

SEQ ID NO: 123904 - RNA, 20 nt, Artificial Sequence
  MKO10123904_B_Ttll4
  gRNA
ccguacaacuuucucaugau

SEQ ID NO: 123905 - RNA, 20 nt, Artificial Sequence
  MKO10123905_B_Ttll4
  gRNA
guaaccccuaccaucuauuu

SEQ ID NO: 123906 - RNA, 20 nt, Artificial Sequence
  MKO10123906_B_Ttll4
  gRNA
aacagaggaggcugcuucgg

SEQ ID NO: 123907 - RNA, 20 nt, Artificial Sequence
  MKO10123907_B_Ttll5
  gRNA
ccuccaguccacauaauaca

SEQ ID NO: 123908 - RNA, 20 nt, Artificial Sequence
  MKO10123908_B_Ttll5
  gRNA
gucuuauaagauugugagaa

SEQ ID NO: 123909 - RNA, 20 nt, Artificial Sequence
  MKO10123909_B_Ttll5
  gRNA
gacuguacaaaaacaucauu

SEQ ID NO: 123910 - RNA, 20 nt, Artificial Sequence
  MKO10123910_B_Ttll6
  gRNA
gauacuuaccgcugucauac

SEQ ID NO: 123911 - RNA, 20 nt, Artificial Sequence
  MKO10123911_B_Ttll6
  gRNA
ugaucaaucuaucuaacugc

SEQ ID NO: 123912 - RNA, 20 nt, Artificial Sequence
  MKO10123912_B_Ttll6
  gRNA
gcuugauuucuuucaccgac

SEQ ID NO: 123913 - RNA, 20 nt, Artificial Sequence
  MKO10123913_B_Ttll7
  gRNA
auuauuacagcuaauguugc

SEQ ID NO: 123914 - RNA, 20 nt, Artificial Sequence
  MKO10123914_B_Ttll7
  gRNA
uccccaccugguaguucugc

SEQ ID NO: 123915 - RNA, 20 nt, Artificial Sequence
  MKO10123915_B_Ttll7
  gRNA
uauucagggaucaucuccug

SEQ ID NO: 123916 - RNA, 20 nt, Artificial Sequence
  MKO10123916_B_Ttll8
  gRNA
ucccguagugauuuagcauc

SEQ ID NO: 123917 - RNA, 20 nt, Artificial Sequence
  MKO10123917_B_Ttll8
  gRNA
cgaugauauccacgauguga

SEQ ID NO: 123918 - RNA, 20 nt, Artificial Sequence
  MKO10123918_B_Ttll8
  gRNA
gacaggguaguguccauaga

SEQ ID NO: 123919 - RNA, 20 nt, Artificial Sequence
  MKO10123919_B_Ttll9
  gRNA
gacucaccucguagugguuc

SEQ ID NO: 123920 - RNA, 20 nt, Artificial Sequence
  MKO10123920_B_Ttll9
  gRNA
cucuuugacuuccacccauc

SEQ ID NO: 123921 - RNA, 20 nt, Artificial Sequence
  MKO10123921_B_Ttll9
  gRNA
ccuacagaaucaaaauucca

SEQ ID NO: 123922 - RNA, 20 nt, Artificial Sequence
  MKO10123922_B_Ttl
  gRNA
ugauguucagagcgcugguu

SEQ ID NO: 123923 - RNA, 20 nt, Artificial Sequence
  MKO10123923_B_Ttl
  gRNA
auuucuggaucacgugcacu

SEQ ID NO: 123924 - RNA, 20 nt, Artificial Sequence
  MKO10123924_B_Ttl
  gRNA
uguuauacugauggucaacc

SEQ ID NO: 123925 - RNA, 20 nt, Artificial Sequence
  MKO10123925_B_Ttn
  gRNA
ggugcccgcacgugucugac

SEQ ID NO: 123926 - RNA, 20 nt, Artificial Sequence
  MKO10123926_B_Ttn
  gRNA
aguagcucuuccaacgcugu

SEQ ID NO: 123927 - RNA, 20 nt, Artificial Sequence
  MKO10123927_B_Ttn
  gRNA
uugaaccaccaauucugcag

SEQ ID NO: 123928 - RNA, 20 nt, Artificial Sequence
  MKO10123928_B_Ttpal
  gRNA
cccgaaaguuugauuaugac

SEQ ID NO: 123929 - RNA, 20 nt, Artificial Sequence
  MKO10123929_B_Ttpal
  gRNA
cagcagcacggcguuccagg

SEQ ID NO: 123930 - RNA, 20 nt, Artificial Sequence
  MKO10123930_B_Ttpal
  gRNA
cuggcccaggagguugucgc

SEQ ID NO: 123931 - RNA, 20 nt, Artificial Sequence
  MKO10123931_B_Ttpa
  gRNA
cucuacugccaguagaaucc

SEQ ID NO: 123932 - RNA, 20 nt, Artificial Sequence
  MKO10123932_B_Ttpa
  gRNA
cacaucagagcucauuguac

SEQ ID NO: 123933 - RNA, 20 nt, Artificial Sequence
  MKO10123933_B_Ttpa
  gRNA
uccuuuccacugaaaguucg

SEQ ID NO: 123934 - RNA, 20 nt, Artificial Sequence
  MKO10123934_B_Ttr
  gRNA
uuuacagccacgucuacagc

SEQ ID NO: 123935 - RNA, 20 nt, Artificial Sequence
  MKO10123935_B_Ttr
  gRNA
gacgacagccguggugcugu

SEQ ID NO: 123936 - RNA, 20 nt, Artificial Sequence
  MKO10123936_B_Ttr
  gRNA
acacaaauaccaguccagcg

SEQ ID NO: 123937 - RNA, 20 nt, Artificial Sequence
  MKO10123937_B_Ttyh1
  gRNA
ccaggugacgcaaccuccuc

SEQ ID NO: 123938 - RNA, 20 nt, Artificial Sequence
  MKO10123938_B_Ttyh1
  gRNA
uuucccuucagugccggcau

SEQ ID NO: 123939 - RNA, 20 nt, Artificial Sequence
  MKO10123939_B_Ttyh1
  gRNA
ggaagugcugucaguccgca

SEQ ID NO: 123940 - RNA, 20 nt, Artificial Sequence
  MKO10123940_B_Ttyh2
  gRNA
aacgcgaaccacaccuucuc

SEQ ID NO: 123941 - RNA, 20 nt, Artificial Sequence
  MKO10123941_B_Ttyh2
  gRNA
ucagcgagaucauugcugcc

SEQ ID NO: 123942 - RNA, 20 nt, Artificial Sequence
  MKO10123942_B_Ttyh2
  gRNA
ucugcaccguguggucccgc

SEQ ID NO: 123943 - RNA, 20 nt, Artificial Sequence
  MKO10123943_B_Ttyh3
  gRNA
ggcauggcguagugaguagg

SEQ ID NO: 123944 - RNA, 20 nt, Artificial Sequence
  MKO10123944_B_Ttyh3
  gRNA
gggccucauccgaagcucca

SEQ ID NO: 123945 - RNA, 20 nt, Artificial Sequence
  MKO10123945_B_Ttyh3
  gRNA
ugauaacaucaagcaagagc

SEQ ID NO: 123946 - RNA, 20 nt, Artificial Sequence
  MKO10123946_B_Tuba1a
  gRNA
guggccacgagcauaguuau

SEQ ID NO: 123947 - RNA, 20 nt, Artificial Sequence
  MKO10123947_B_Tuba1a
  gRNA
agccagcuuaccgaugaccg

SEQ ID NO: 123948 - RNA, 20 nt, Artificial Sequence
  MKO10123948_B_Tuba1a
  gRNA
ccacaggcugaccagugcac

SEQ ID NO: 123949 - RNA, 20 nt, Artificial Sequence
  MKO10123949_B_Tuba1b
  gRNA
agccagcuuaccgaugaccg

SEQ ID NO: 123950 - RNA, 20 nt, Artificial Sequence
  MKO10123950_B_Tuba1b
  gRNA
uuugcagaugaaguucgcac

SEQ ID NO: 123951 - RNA, 20 nt, Artificial Sequence
  MKO10123951_B_Tuba1b
  gRNA
ccagcuugcgaauccugucc

SEQ ID NO: 123952 - RNA, 20 nt, Artificial Sequence
  MKO10123952_B_Tuba1c
  gRNA
ccagcuugcgaauccugucc

SEQ ID NO: 123953 - RNA, 20 nt, Artificial Sequence
  MKO10123953_B_Tuba1c
  gRNA
uuugcagaugaaguucgcac

SEQ ID NO: 123954 - RNA, 20 nt, Artificial Sequence
  MKO10123954_B_Tuba1c
  gRNA
ccuccucauaauccuucucu

SEQ ID NO: 123955 - RNA, 20 nt, Artificial Sequence
  MKO10123955_B_Tuba3a
  gRNA
gguucccaaagaugucaacg

SEQ ID NO: 123956 - RNA, 20 nt, Artificial Sequence
  MKO10123956_B_Tuba3a
  gRNA
gagaccuggccaaagugcag

SEQ ID NO: 123957 - RNA, 20 nt, Artificial Sequence
  MKO10123957_B_Tuba3a
  gRNA
caagcaccuacccaccacag

SEQ ID NO: 123958 - RNA, 20 nt, Artificial Sequence
  MKO10123958_B_Tuba3b
  gRNA
cauccaucacagccucccua

SEQ ID NO: 123959 - RNA, 20 nt, Artificial Sequence
  MKO10123959_B_Tuba3b
  gRNA
gguucccaaagaugucaaug

SEQ ID NO: 123960 - RNA, 20 nt, Artificial Sequence
  MKO10123960_B_Tuba3b
  gRNA
uaacuaccagccuccuacug

SEQ ID NO: 123961 - RNA, 20 nt, Artificial Sequence
  MKO10123961_B_Tuba4a
  gRNA
ccuugcucaccgauuacagu

SEQ ID NO: 123962 - RNA, 20 nt, Artificial Sequence
  MKO10123962_B_Tuba4a
  gRNA
gaccuggagccuacuguaau

SEQ ID NO: 123963 - RNA, 20 nt, Artificial Sequence
  MKO10123963_B_Tuba4a
  gRNA
gcugacgguaugggccauuu

SEQ ID NO: 123964 - RNA, 20 nt, Artificial Sequence
  MKO10123964_B_Tuba8
  gRNA
gucgucaucguugaucuugc

SEQ ID NO: 123965 - RNA, 20 nt, Artificial Sequence
  MKO10123965_B_Tuba8
  gRNA
caacgggaaacacgugcccc

SEQ ID NO: 123966 - RNA, 20 nt, Artificial Sequence
  MKO10123966_B_Tuba8
  gRNA
ccaucuacgacaucugccgc

SEQ ID NO: 123967 - RNA, 20 nt, Artificial Sequence
  MKO10123967_B_Tubal3
  gRNA
ccccaucaucuccgcugaaa

SEQ ID NO: 123968 - RNA, 20 nt, Artificial Sequence
  MKO10123968_B_Tubal3
  gRNA
cccagcaagcauccccgauc

SEQ ID NO: 123969 - RNA, 20 nt, Artificial Sequence
  MKO10123969_B_Tubal3
  gRNA
uugcugggaacuguauugcc

SEQ ID NO: 123970 - RNA, 20 nt, Artificial Sequence
  MKO10123970_B_Tubb1
  gRNA
guaccgagcccucucaguag

SEQ ID NO: 123971 - RNA, 20 nt, Artificial Sequence
  MKO10123971_B_Tubb1
  gRNA
agguccacaaggacggcucg

SEQ ID NO: 123972 - RNA, 20 nt, Artificial Sequence
  MKO10123972_B_Tubb1
  gRNA
guuuacuacaacgaagccua

SEQ ID NO: 123973 - RNA, 20 nt, Artificial Sequence
  MKO10123973_B_Tubb2a
  gRNA
auacagagccucauugucaa

SEQ ID NO: 123974 - RNA, 20 nt, Artificial Sequence
  MKO10123974_B_Tubb2a
  gRNA
cauccuaguggaccuggagc

SEQ ID NO: 123975 - RNA, 20 nt, Artificial Sequence
  MKO10123975_B_Tubb2a
  gRNA
gaggugauaagcgaugagca

SEQ ID NO: 123976 - RNA, 20 nt, Artificial Sequence
  MKO10123976_B_Tubb2b
  gRNA
guauacuacaaugaagcaac

SEQ ID NO: 123977 - RNA, 20 nt, Artificial Sequence
  MKO10123977_B_Tubb2b
  gRNA
ucaccgaacacgaaguuguc

SEQ ID NO: 123978 - RNA, 20 nt, Artificial Sequence
  MKO10123978_B_Tubb2b
  gRNA
cagguaauaaauaugugccu

SEQ ID NO: 123979 - RNA, 20 nt, Artificial Sequence
  MKO10123979_B_Tubb3
  gRNA
cucauaggucagaguggugc

SEQ ID NO: 123980 - RNA, 20 nt, Artificial Sequence
  MKO10123980_B_Tubb3
  gRNA
cagcucacaaguaugugccc

SEQ ID NO: 123981 - RNA, 20 nt, Artificial Sequence
  MKO10123981_B_Tubb3
  gRNA
ccacggucagguagcgaccg

SEQ ID NO: 123982 - RNA, 20 nt, Artificial Sequence
  MKO10123982_B_Tubb4a
  gRNA
gacgcaccuuggccccgauc

SEQ ID NO: 123983 - RNA, 20 nt, Artificial Sequence
  MKO10123983_B_Tubb4a
  gRNA
caggucgaccagcacggcuc

SEQ ID NO: 123984 - RNA, 20 nt, Artificial Sequence
  MKO10123984_B_Tubb4a
  gRNA
uccccaggucaauccggagc

SEQ ID NO: 123985 - RNA, 20 nt, Artificial Sequence
  MKO10123985_B_Tubb4b
  gRNA
gagguaaucagcgacgagca

SEQ ID NO: 123986 - RNA, 20 nt, Artificial Sequence
  MKO10123986_B_Tubb4b
  gRNA
ucaccaaagacgaaguuauc

SEQ ID NO: 123987 - RNA, 20 nt, Artificial Sequence
  MKO10123987_B_Tubb4b
  gRNA
cccugaacgcaccgagucca

SEQ ID NO: 123988 - RNA, 20 nt, Artificial Sequence
  MKO10123988_B_Tubb5
  gRNA
guaugucccucgagcuaucu

SEQ ID NO: 123989 - RNA, 20 nt, Artificial Sequence
  MKO10123989_B_Tubb5
  gRNA
gccaaaaggaccugagcgaa

SEQ ID NO: 123990 - RNA, 20 nt, Artificial Sequence
  MKO10123990_B_Tubb5
  gRNA
gaccccaccgguaccuacca

SEQ ID NO: 123991 - RNA, 20 nt, Artificial Sequence
  MKO10123991_B_Tubb6
  gRNA
gucgaugcaguaggucucgu

SEQ ID NO: 123992 - RNA, 20 nt, Artificial Sequence
  MKO10123992_B_Tubb6
  gRNA
cuugcaggacagacgggugc

SEQ ID NO: 123993 - RNA, 20 nt, Artificial Sequence
  MKO10123993_B_Tubb6
  gRNA
gacccaccuugguaccgauc

SEQ ID NO: 123994 - RNA, 20 nt, Artificial Sequence
  MKO10123994_B_Tubd1
  gRNA
uuguagcuucuguguaacga

SEQ ID NO: 123995 - RNA, 20 nt, Artificial Sequence
  MKO10123995_B_Tubd1
  gRNA
gucgauagugacaguacagc

SEQ ID NO: 123996 - RNA, 20 nt, Artificial Sequence
  MKO10123996_B_Tubd1
  gRNA
cuguucuaagagggacaacg

SEQ ID NO: 123997 - RNA, 20 nt, Artificial Sequence
  MKO10123997_B_Tube1
  gRNA
cuaucaaacacgucucucag

SEQ ID NO: 123998 - RNA, 20 nt, Artificial Sequence
  MKO10123998_B_Tube1
  gRNA
acgcuauaagcagcuucuuc

SEQ ID NO: 123999 - RNA, 20 nt, Artificial Sequence
  MKO10123999_B_Tube1
  gRNA
ucuuucagagcuguugggga

SEQ ID NO: 124000 - RNA, 20 nt, Artificial Sequence
  MKO10124000_B_Tubg1
  gRNA
ucuuaguuggguucgaguuc

SEQ ID NO: 124001 - RNA, 20 nt, Artificial Sequence
  MKO10124001_B_Tubg1
  gRNA
ugaugucaaaaauguccucg

SEQ ID NO: 124002 - RNA, 20 nt, Artificial Sequence
  MKO10124002_B_Tubg1
  gRNA
guacugugucauuccauugc

SEQ ID NO: 124003 - RNA, 20 nt, Artificial Sequence
  MKO10124003_B_Tubg2
  gRNA
cagccccgagggcaucguag

SEQ ID NO: 124004 - RNA, 20 nt, Artificial Sequence
  MKO10124004_B_Tubg2
  gRNA
acagggugagaaaauucacg

SEQ ID NO: 124005 - RNA, 20 nt, Artificial Sequence
  MKO10124005_B_Tubg2
  gRNA
auuauagaccgagaagcaga

SEQ ID NO: 124006 - RNA, 20 nt, Artificial Sequence
  MKO10124006_B_Tubgcp2
  gRNA
acaucuuagaggcugcaaca

SEQ ID NO: 124007 - RNA, 20 nt, Artificial Sequence
  MKO10124007_B_Tubgcp2
  gRNA
gauguccacacaagagcuag

SEQ ID NO: 124008 - RNA, 20 nt, Artificial Sequence
  MKO10124008_B_Tubgcp2
  gRNA
uaugagagaccaacauuggc

SEQ ID NO: 124009 - RNA, 20 nt, Artificial Sequence
  MKO10124009_B_Tubgcp3
  gRNA
cgauaacucucacagcaaac

SEQ ID NO: 124010 - RNA, 20 nt, Artificial Sequence
  MKO10124010_B_Tubgcp3
  gRNA
ccuccugcugaaccuuagug

SEQ ID NO: 124011 - RNA, 20 nt, Artificial Sequence
  MKO10124011_B_Tubgcp3
  gRNA
cccucgcaagcaggccagca

SEQ ID NO: 124012 - RNA, 20 nt, Artificial Sequence
  MKO10124012_B_Tubgcp4
  gRNA
auucaggacacuagucucac

SEQ ID NO: 124013 - RNA, 20 nt, Artificial Sequence
  MKO10124013_B_Tubgcp4
  gRNA
ugucaauuacuccuuagauc

SEQ ID NO: 124014 - RNA, 20 nt, Artificial Sequence
  MKO10124014_B_Tubgcp4
  gRNA
agaucccaugcagucccccu

SEQ ID NO: 124015 - RNA, 20 nt, Artificial Sequence
  MKO10124015_B_Tubgcp5
  gRNA
aucucaacaaagcugcuagu

SEQ ID NO: 124016 - RNA, 20 nt, Artificial Sequence
  MKO10124016_B_Tubgcp5
  gRNA
uccacauaauugcuguuuga

SEQ ID NO: 124017 - RNA, 20 nt, Artificial Sequence
  MKO10124017_B_Tubgcp5
  gRNA
uccuucaaacagcaauuaug

SEQ ID NO: 124018 - RNA, 20 nt, Artificial Sequence
  MKO10124018_B_Tubgcp6
  gRNA
ggugcugggagcguauugga

SEQ ID NO: 124019 - RNA, 20 nt, Artificial Sequence
  MKO10124019_B_Tubgcp6
  gRNA
cagccccccuggucaccgag

SEQ ID NO: 124020 - RNA, 20 nt, Artificial Sequence
  MKO10124020_B_Tubgcp6
  gRNA
auggcucagccguguguaac

SEQ ID NO: 124021 - RNA, 20 nt, Artificial Sequence
  MKO10124021_B_Tub
  gRNA
acugggcugugcgcccccgc

SEQ ID NO: 124022 - RNA, 20 nt, Artificial Sequence
  MKO10124022_B_Tub
  gRNA
ccggggccguccaucugcau

SEQ ID NO: 124023 - RNA, 20 nt, Artificial Sequence
  MKO10124023_B_Tub
  gRNA
agccucagccaagaaaucca

SEQ ID NO: 124024 - RNA, 20 nt, Artificial Sequence
  MKO10124024_B_Tufm
  gRNA
uccacccagaauaugaucac

SEQ ID NO: 124025 - RNA, 20 nt, Artificial Sequence
  MKO10124025_B_Tufm
  gRNA
cgagcgacgccccgcuucag

SEQ ID NO: 124026 - RNA, 20 nt, Artificial Sequence
  MKO10124026_B_Tufm
  gRNA
agcccgaccccauuucugca

SEQ ID NO: 124027 - RNA, 20 nt, Artificial Sequence
  MKO10124027_B_Tuft1
  gRNA
acgcuccagagugaacugac

SEQ ID NO: 124028 - RNA, 20 nt, Artificial Sequence
  MKO10124028_B_Tuft1
  gRNA
auauaaguagcaagcuugac

SEQ ID NO: 124029 - RNA, 20 nt, Artificial Sequence
  MKO10124029_B_Tuft1
  gRNA
ucaccuuaaugaucucuuca

SEQ ID NO: 124030 - RNA, 20 nt, Artificial Sequence
  MKO10124030_B_Tulp1
  gRNA
aguugcccgcgccccagacc

SEQ ID NO: 124031 - RNA, 20 nt, Artificial Sequence
  MKO10124031_B_Tulp1
  gRNA
gcccccgcugcgccccaaac

SEQ ID NO: 124032 - RNA, 20 nt, Artificial Sequence
  MKO10124032_B_Tulp1
  gRNA
uacccucagcggccaugaag

SEQ ID NO: 124033 - RNA, 20 nt, Artificial Sequence
  MKO10124033_B_Tulp2
  gRNA
cgccagagaauucauccucc

SEQ ID NO: 124034 - RNA, 20 nt, Artificial Sequence
  MKO10124034_B_Tulp2
  gRNA
acccuggaggaugaauucuc

SEQ ID NO: 124035 - RNA, 20 nt, Artificial Sequence
  MKO10124035_B_Tulp2
  gRNA
cgucucaggagaaugaacag

SEQ ID NO: 124036 - RNA, 20 nt, Artificial Sequence
  MKO10124036_B_Tulp3
  gRNA
cucuccucugagcgagccga

SEQ ID NO: 124037 - RNA, 20 nt, Artificial Sequence
  MKO10124037_B_Tulp3
  gRNA
agcccccaagccagaccuuc

SEQ ID NO: 124038 - RNA, 20 nt, Artificial Sequence
  MKO10124038_B_Tulp3
  gRNA
gcuucagcugccgaagccuc

SEQ ID NO: 124039 - RNA, 20 nt, Artificial Sequence
  MKO10124039_B_Tulp4
  gRNA
uaagcagccuagagucccga

SEQ ID NO: 124040 - RNA, 20 nt, Artificial Sequence
  MKO10124040_B_Tulp4
  gRNA
cagcucagcgaacugcccaa

SEQ ID NO: 124041 - RNA, 20 nt, Artificial Sequence
  MKO10124041_B_Tulp4
  gRNA
uguuuccacagaugggcccg

SEQ ID NO: 124042 - RNA, 20 nt, Artificial Sequence
  MKO10124042_B_Tusc1
  gRNA
cccaugauccggacguuccg

SEQ ID NO: 124043 - RNA, 20 nt, Artificial Sequence
  MKO10124043_B_Tusc1
  gRNA
agcgcuccuccagcugucgc

SEQ ID NO: 124044 - RNA, 20 nt, Artificial Sequence
  MKO10124044_B_Tusc1
  gRNA
cgccgucgagacccucgccc

SEQ ID NO: 124045 - RNA, 20 nt, Artificial Sequence
  MKO10124045_B_Tusc2
  gRNA
uccauguucuacgaugaaga

SEQ ID NO: 124046 - RNA, 20 nt, Artificial Sequence
  MKO10124046_B_Tusc2
  gRNA
cggggaaauccacguggauu

SEQ ID NO: 124047 - RNA, 20 nt, Artificial Sequence
  MKO10124047_B_Tusc2
  gRNA
uccaucuucaucguagaaca

SEQ ID NO: 124048 - RNA, 20 nt, Artificial Sequence
  MKO10124048_B_Tusc3
  gRNA
aaaagcagaugaauaacgcc

SEQ ID NO: 124049 - RNA, 20 nt, Artificial Sequence
  MKO10124049_B_Tusc3
  gRNA
cauucugaagaucgagcgcc

SEQ ID NO: 124050 - RNA, 20 nt, Artificial Sequence
  MKO10124050_B_Tusc3
  gRNA
uaacgaagaauaucaaaucc

SEQ ID NO: 124051 - RNA, 20 nt, Artificial Sequence
  MKO10124051_B_Tusc5
  gRNA
ccucuugcuucugccccguc

SEQ ID NO: 124052 - RNA, 20 nt, Artificial Sequence
  MKO10124052_B_Tusc5
  gRNA
ccccucggagaugaccuuga

SEQ ID NO: 124053 - RNA, 20 nt, Artificial Sequence
  MKO10124053_B_Tusc5
  gRNA
cccagcgcagccuccgcuuc

SEQ ID NO: 124054 - RNA, 20 nt, Artificial Sequence
  MKO10124054_B_Tuu1
  gRNA
uuucaagugggcaucgaggc

SEQ ID NO: 124055 - RNA, 20 nt, Artificial Sequence
  MKO10124055_B_Tuu1
  gRNA
cacaaaaguaccgguuacug

SEQ ID NO: 124056 - RNA, 20 nt, Artificial Sequence
  MKO10124056_B_Tuu1
  gRNA
gagauguaucccucaguaac

SEQ ID NO: 124057 - RNA, 20 nt, Artificial Sequence
  MKO10124057_B_Tvp23a
  gRNA
gaauguaacuggaagacuca

SEQ ID NO: 124058 - RNA, 20 nt, Artificial Sequence
  MKO10124058_B_Tvp23a
  gRNA
acaggucucugcaaaccaca

SEQ ID NO: 124059 - RNA, 20 nt, Artificial Sequence
  MKO10124059_B_Tvp23a
  gRNA
aggcagaggcacgcaucuuc

SEQ ID NO: 124060 - RNA, 20 nt, Artificial Sequence
  MKO10124060_B_Tvp23b
  gRNA
ugcugcugucaugcgacuuu

SEQ ID NO: 124061 - RNA, 20 nt, Artificial Sequence
  MKO10124061_B_Tvp23b
  gRNA
gaaugucacagguagacuaa

SEQ ID NO: 124062 - RNA, 20 nt, Artificial Sequence
  MKO10124062_B_Tvp23b
  gRNA
uagccaaaagauucuugacu

SEQ ID NO: 124063 - RNA, 20 nt, Artificial Sequence
  MKO10124063_B_Twf1
  gRNA
acgucagaaaaugcuguaug

SEQ ID NO: 124064 - RNA, 20 nt, Artificial Sequence
  MKO10124064_B_Twf1
  gRNA
cugaaaauaucuaucgaaaa

SEQ ID NO: 124065 - RNA, 20 nt, Artificial Sequence
  MKO10124065_B_Twf1
  gRNA
guaguccaccuucagacucc

SEQ ID NO: 124066 - RNA, 20 nt, Artificial Sequence
  MKO10124066_B_Twf2
  gRNA
gggcacgcaccucauugauu

SEQ ID NO: 124067 - RNA, 20 nt, Artificial Sequence
  MKO10124067_B_Twf2
  gRNA
gcccccagaacagcucgugc

SEQ ID NO: 124068 - RNA, 20 nt, Artificial Sequence
  MKO10124068_B_Twf2
  gRNA
ugagcucuucgggacaguaa

SEQ ID NO: 124069 - RNA, 20 nt, Artificial Sequence
  MKO10124069_B_Twist1
  gRNA
gcuccgcugcuagugggacg

SEQ ID NO: 124070 - RNA, 20 nt, Artificial Sequence
  MKO10124070_B_Twist1
  gRNA
ugcagcuccucguacgacug

SEQ ID NO: 124071 - RNA, 20 nt, Artificial Sequence
  MKO10124071_B_Twist1
  gRNA
gcgcacgcagucgcugaacg

SEQ ID NO: 124072 - RNA, 20 nt, Artificial Sequence
  MKO10124072_B_Twist2
  gRNA
cgcgcccuccaugcgccaca

SEQ ID NO: 124073 - RNA, 20 nt, Artificial Sequence
  MKO10124073_B_Twist2
  gRNA
cccuucuugccgcgcuuacc

SEQ ID NO: 124074 - RNA, 20 nt, Artificial Sequence
  MKO10124074_B_Twist2
  gRNA
ucuugcuguagcgccgcuuc

SEQ ID NO: 124075 - RNA, 20 nt, Artificial Sequence
  MKO10124075_B_Twistnb
  gRNA
agcagaaacugucguugaag

SEQ ID NO: 124076 - RNA, 20 nt, Artificial Sequence
  MKO10124076_B_Twistnb
  gRNA
cugauguuaucauaugcaau

SEQ ID NO: 124077 - RNA, 20 nt, Artificial Sequence
  MKO10124077_B_Twistnb
  gRNA
aacaguugauaguguuacag

SEQ ID NO: 124078 - RNA, 20 nt, Artificial Sequence
  MKO10124078_B_Twsg1
  gRNA
guugugaaaccagcgauacu

SEQ ID NO: 124079 - RNA, 20 nt, Artificial Sequence
  MKO10124079_B_Twsg1
  gRNA
ccuccgucagcgcccugaac

SEQ ID NO: 124080 - RNA, 20 nt, Artificial Sequence
  MKO10124080_B_Twsg1
  gRNA
gaggcauuugcucacaucgc

SEQ ID NO: 124081 - RNA, 20 nt, Artificial Sequence
  MKO10124081_B_Txk
  gRNA
cgaaccacggccucugacgc

SEQ ID NO: 124082 - RNA, 20 nt, Artificial Sequence
  MKO10124082_B_Txk
  gRNA
gccgcugcucaguacagaag

SEQ ID NO: 124083 - RNA, 20 nt, Artificial Sequence
  MKO10124083_B_Txk
  gRNA
accucuucuguacugagcag

SEQ ID NO: 124084 - RNA, 20 nt, Artificial Sequence
  MKO10124084_B_Txlna
  gRNA
cgagcaauacgagcuucgug

SEQ ID NO: 124085 - RNA, 20 nt, Artificial Sequence
  MKO10124085_B_Txlna
  gRNA
auccgagcgagugaugaagu

SEQ ID NO: 124086 - RNA, 20 nt, Artificial Sequence
  MKO10124086_B_Txlna
  gRNA
ugcuguguuccccucgcaga

SEQ ID NO: 124087 - RNA, 20 nt, Artificial Sequence
  MKO10124087_B_Txlnb
  gRNA
gaagcuccuacugaaacagc

SEQ ID NO: 124088 - RNA, 20 nt, Artificial Sequence
  MKO10124088_B_Txlnb
  gRNA
ucgagaacugcagcagaagc

SEQ ID NO: 124089 - RNA, 20 nt, Artificial Sequence
  MKO10124089_B_Txlnb
  gRNA
agaggcucaagaacugaugc

SEQ ID NO: 124090 - RNA, 20 nt, Artificial Sequence
  MKO10124090_B_Txlng
  gRNA
aaaugaaauccaagcucagu

SEQ ID NO: 124091 - RNA, 20 nt, Artificial Sequence
  MKO10124091_B_Txlng
  gRNA
ccuugcuguguucacucuga

SEQ ID NO: 124092 - RNA, 20 nt, Artificial Sequence
  MKO10124092_B_Txlng
  gRNA
aaacacccuuucaaccccag

SEQ ID NO: 124093 - RNA, 20 nt, Artificial Sequence
  MKO10124093_B_Txn1
  gRNA
agucauccacauccacuuca

SEQ ID NO: 124094 - RNA, 20 nt, Artificial Sequence
  MKO10124094_B_Txn1
  gRNA
caacaggugggggaguucuc

SEQ ID NO: 124095 - RNA, 20 nt, Artificial Sequence
  MKO10124095_B_Txn1
  gRNA
aguggauguggaugacugcc

SEQ ID NO: 124096 - RNA, 20 nt, Artificial Sequence
  MKO10124096_B_Txn2
  gRNA
ugguguguacuguccgggcu

SEQ ID NO: 124097 - RNA, 20 nt, Artificial Sequence
  MKO10124097_B_Txn2
  gRNA
caccacguccccguucuuga

SEQ ID NO: 124098 - RNA, 20 nt, Artificial Sequence
  MKO10124098_B_Txn2
  gRNA
ggacgugguggacaaguuug

SEQ ID NO: 124099 - RNA, 20 nt, Artificial Sequence
  MKO10124099_B_Txndc11
  gRNA
ucaaaguauccgaguacucc

SEQ ID NO: 124100 - RNA, 20 nt, Artificial Sequence
  MKO10124100_B_Txndc11
  gRNA
uuuggaccaaucgaauacaa

SEQ ID NO: 124101 - RNA, 20 nt, Artificial Sequence
  MKO10124101_B_Txndc11
  gRNA
cgaugauacagauguaucac

SEQ ID NO: 124102 - RNA, 20 nt, Artificial Sequence
  MKO10124102_B_Txndc12
  gRNA
gaugaagacuucagcccuga

SEQ ID NO: 124103 - RNA, 20 nt, Artificial Sequence
  MKO10124103_B_Txndc12
  gRNA
gacucuggaagauggcaaga

SEQ ID NO: 124104 - RNA, 20 nt, Artificial Sequence
  MKO10124104_B_Txndc12
  gRNA
uucuguagauucugcaaauu

SEQ ID NO: 124105 - RNA, 20 nt, Artificial Sequence
  MKO10124105_B_Txndc15
  gRNA
ugguccucuucuacaccccg

SEQ ID NO: 124106 - RNA, 20 nt, Artificial Sequence
  MKO10124106_B_Txndc15
  gRNA
uacagccuuucuaccagauu

SEQ ID NO: 124107 - RNA, 20 nt, Artificial Sequence
  MKO10124107_B_Txndc15
  gRNA
cuggcagaaaaccggcacca

SEQ ID NO: 124108 - RNA, 20 nt, Artificial Sequence
  MKO10124108_B_Txndc16
  gRNA
cacaucaaacaagauguccg

SEQ ID NO: 124109 - RNA, 20 nt, Artificial Sequence
  MKO10124109_B_Txndc16
  gRNA
uucucauacguagaagccau

SEQ ID NO: 124110 - RNA, 20 nt, Artificial Sequence
  MKO10124110_B_Txndc16
  gRNA
caacugaaaucccauagucc

SEQ ID NO: 124111 - RNA, 20 nt, Artificial Sequence
  MKO10124111_B_Txndc17
  gRNA
gccucaccuuccacgcaguc

SEQ ID NO: 124112 - RNA, 20 nt, Artificial Sequence
  MKO10124112_B_Txndc17
  gRNA
uuuacagccucaaaaacuug

SEQ ID NO: 124113 - RNA, 20 nt, Artificial Sequence
  MKO10124113_B_Txndc17
  gRNA
cagagaagaucaucuccaca

SEQ ID NO: 124114 - RNA, 20 nt, Artificial Sequence
  MKO10124114_B_Txndc2
  gRNA
gacaugaacaguguucaagc

SEQ ID NO: 124115 - RNA, 20 nt, Artificial Sequence
  MKO10124115_B_Txndc2
  gRNA
gaggaggugcucaaagacgc

SEQ ID NO: 124116 - RNA, 20 nt, Artificial Sequence
  MKO10124116_B_Txndc2
  gRNA
gaaugucauccucccuguaa

SEQ ID NO: 124117 - RNA, 20 nt, Artificial Sequence
  MKO10124117_B_Txndc5
  gRNA
gcucugggugguuccgcuuc

SEQ ID NO: 124118 - RNA, 20 nt, Artificial Sequence
  MKO10124118_B_Txndc5
  gRNA
caaggucuacguggccaaag

SEQ ID NO: 124119 - RNA, 20 nt, Artificial Sequence
  MKO10124119_B_Txndc5
  gRNA
acuuaccuugccaaucuuga

SEQ ID NO: 124120 - RNA, 20 nt, Artificial Sequence
  MKO10124120_B_Txndc8
  gRNA
ccugagcaaacgugacauuu

SEQ ID NO: 124121 - RNA, 20 nt, Artificial Sequence
  MKO10124121_B_Txndc8
  gRNA
gauguucaaguacacccaaa

SEQ ID NO: 124122 - RNA, 20 nt, Artificial Sequence
  MKO10124122_B_Txndc8
  gRNA
gaaauccuuaccuggaaaac

SEQ ID NO: 124123 - RNA, 20 nt, Artificial Sequence
  MKO10124123_B_Txndc9
  gRNA
ccuggaggaacugguucucc

SEQ ID NO: 124124 - RNA, 20 nt, Artificial Sequence
  MKO10124124_B_Txndc9
  gRNA
aagacgcaagauuauguugu

SEQ ID NO: 124125 - RNA, 20 nt, Artificial Sequence
  MKO10124125_B_Txndc9
  gRNA
auguggugucucuguagaaa

SEQ ID NO: 124126 - RNA, 20 nt, Artificial Sequence
  MKO10124126_B_Txnip
  gRNA
aaaauccucaccauuagguc

SEQ ID NO: 124127 - RNA, 20 nt, Artificial Sequence
  MKO10124127_B_Txnip
  gRNA
cccagcaggugagaacgaga

SEQ ID NO: 124128 - RNA, 20 nt, Artificial Sequence
  MKO10124128_B_Txnip
  gRNA
gagacugacacacguccauc

SEQ ID NO: 124129 - RNA, 20 nt, Artificial Sequence
  MKO10124129_B_Txnl1
  gRNA
cagcacuuagaaaaugaucc

SEQ ID NO: 124130 - RNA, 20 nt, Artificial Sequence
  MKO10124130_B_Txnl1
  gRNA
ccuacagcuccuuauuacug

SEQ ID NO: 124131 - RNA, 20 nt, Artificial Sequence
  MKO10124131_B_Txnl1
  gRNA
caaccagcuuuguuaauaaa

SEQ ID NO: 124132 - RNA, 20 nt, Artificial Sequence
  MKO10124132_B_Txnl4a
  gRNA
cgcccgcaaaggccgggguc

SEQ ID NO: 124133 - RNA, 20 nt, Artificial Sequence
  MKO10124133_B_Txnl4a
  gRNA
gcacugucauguucuucuuc

SEQ ID NO: 124134 - RNA, 20 nt, Artificial Sequence
  MKO10124134_B_Txnl4a
  gRNA
ucguacaucuuguugaaguc

SEQ ID NO: 124135 - RNA, 20 nt, Artificial Sequence
  MKO10124135_B_Txnl4b
  gRNA
uguugguucucagguuuggg

SEQ ID NO: 124136 - RNA, 20 nt, Artificial Sequence
  MKO10124136_B_Txnl4b
  gRNA
cugcccauugaagaaaaaua

SEQ ID NO: 124137 - RNA, 20 nt, Artificial Sequence
  MKO10124137_B_Txnl4b
  gRNA
uguguuaaaugucuugauag

SEQ ID NO: 124138 - RNA, 20 nt, Artificial Sequence
  MKO10124138_B_Txnrd1
  gRNA
cauugguccucacaggauug

SEQ ID NO: 124139 - RNA, 20 nt, Artificial Sequence
  MKO10124139_B_Txnrd1
  gRNA
ucaccccaucuggucccaag

SEQ ID NO: 124140 - RNA, 20 nt, Artificial Sequence
  MKO10124140_B_Txnrd1
  gRNA
ccccgcuaccugggcauccc

SEQ ID NO: 124141 - RNA, 20 nt, Artificial Sequence
  MKO10124141_B_Txnrd2
  gRNA
uaccuuccuuggcacaagcu

SEQ ID NO: 124142 - RNA, 20 nt, Artificial Sequence
  MKO10124142_B_Txnrd2
  gRNA
gauugccuaccucggggaga

SEQ ID NO: 124143 - RNA, 20 nt, Artificial Sequence
  MKO10124143_B_Txnrd2
  gRNA
cccaguucaaggauuucaca

SEQ ID NO: 124144 - RNA, 20 nt, Artificial Sequence
  MKO10124144_B_Txnrd3
  gRNA
gauuacgaccucaucaucau

SEQ ID NO: 124145 - RNA, 20 nt, Artificial Sequence
  MKO10124145_B_Txnrd3
  gRNA
uggaugugaccgaacuuucc

SEQ ID NO: 124146 - RNA, 20 nt, Artificial Sequence
  MKO10124146_B_Txnrd3
  gRNA
agaugacggggccaguguuc

SEQ ID NO: 124147 - RNA, 20 nt, Artificial Sequence
  MKO10124147_B_Tyk2
  gRNA
guauaccggugugguuuccc

SEQ ID NO: 124148 - RNA, 20 nt, Artificial Sequence
  MKO10124148_B_Tyk2
  gRNA
cagcggucugcccacuguuc

SEQ ID NO: 124149 - RNA, 20 nt, Artificial Sequence
  MKO10124149_B_Tyk2
  gRNA
gagugcgaagagauucaagc

SEQ ID NO: 124150 - RNA, 20 nt, Artificial Sequence
  MKO10124150_B_Tymp
  gRNA
caccaggugccaaugaucag

SEQ ID NO: 124151 - RNA, 20 nt, Artificial Sequence
  MKO10124151_B_Tymp
  gRNA
auacuuaggggccaugcuaa

SEQ ID NO: 124152 - RNA, 20 nt, Artificial Sequence
  MKO10124152_B_Tymp
  gRNA
uucaggucaccuguaaugag

SEQ ID NO: 124153 - RNA, 20 nt, Artificial Sequence
  MKO10124153_B_Tyms
  gRNA
gaagaaucaucaugugugcc

SEQ ID NO: 124154 - RNA, 20 nt, Artificial Sequence
  MKO10124154_B_Tyms
  gRNA
cuccucagaucuuccccuga

SEQ ID NO: 124155 - RNA, 20 nt, Artificial Sequence
  MKO10124155_B_Tyms
  gRNA
ggcaaggaggcagugccauc

SEQ ID NO: 124156 - RNA, 20 nt, Artificial Sequence
  MKO10124156_B_Tyro3
  gRNA
cagaccguuccacugacuuu

SEQ ID NO: 124157 - RNA, 20 nt, Artificial Sequence
  MKO10124157_B_Tyro3
  gRNA
cagaacccguaaccauuuac

SEQ ID NO: 124158 - RNA, 20 nt, Artificial Sequence
  MKO10124158_B_Tyro3
  gRNA
agugaagaugaccgugucuc

SEQ ID NO: 124159 - RNA, 20 nt, Artificial Sequence
  MKO10124159_B_Tyrobp
  gRNA
ugagacugagucgccuuauc

SEQ ID NO: 124160 - RNA, 20 nt, Artificial Sequence
  MKO10124160_B_Tyrobp
  gRNA
cuuaccacucugggccugua

SEQ ID NO: 124161 - RNA, 20 nt, Artificial Sequence
  MKO10124161_B_Tyrobp
  gRNA
ucucagcaauguguuguuuc

SEQ ID NO: 124162 - RNA, 20 nt, Artificial Sequence
  MKO10124162_B_Tyrp1
  gRNA
cuuggaagaguacgauaccc

SEQ ID NO: 124163 - RNA, 20 nt, Artificial Sequence
  MKO10124163_B_Tyrp1
  gRNA
aguagaaucgaaguugcuuc

SEQ ID NO: 124164 - RNA, 20 nt, Artificial Sequence
  MKO10124164_B_Tyrp1
  gRNA
ucaggaagacgcugcacugc

SEQ ID NO: 124165 - RNA, 20 nt, Artificial Sequence
  MKO10124165_B_Tyr
  gRNA
aaauuauauugagccuuacu

SEQ ID NO: 124166 - RNA, 20 nt, Artificial Sequence
  MKO10124166_B_Tyr
  gRNA
ucgucuuuguccaugaggag

SEQ ID NO: 124167 - RNA, 20 nt, Artificial Sequence
  MKO10124167_B_Tyr
  gRNA
ccauugauccagauucauac

SEQ ID NO: 124168 - RNA, 20 nt, Artificial Sequence
  MKO10124168_B_Tysnd1
  gRNA
guuguugucucgaguguugc

SEQ ID NO: 124169 - RNA, 20 nt, Artificial Sequence
  MKO10124169_B_Tysnd1
  gRNA
accacaccacugagccgguc

SEQ ID NO: 124170 - RNA, 20 nt, Artificial Sequence
  MKO10124170_B_Tysnd1
  gRNA
ugcgggcccucggugaccuc

SEQ ID NO: 124171 - RNA, 20 nt, Artificial Sequence
  MKO10124171_B_Tyw1
  gRNA
uuaccugcuucuugaugauc

SEQ ID NO: 124172 - RNA, 20 nt, Artificial Sequence
  MKO10124172_B_Tyw1
  gRNA
aagaagcagacacacguuuc

SEQ ID NO: 124173 - RNA, 20 nt, Artificial Sequence
  MKO10124173_B_Tyw1
  gRNA
ucuccuaucagacugucauc

SEQ ID NO: 124174 - RNA, 20 nt, Artificial Sequence
  MKO10124174_B_Tyw3
  gRNA
accacaucgucucucgcaca

SEQ ID NO: 124175 - RNA, 20 nt, Artificial Sequence
  MKO10124175_B_Tyw3
  gRNA
aaacuucaaaacagcuucgc

SEQ ID NO: 124176 - RNA, 20 nt, Artificial Sequence
  MKO10124176_B_Tyw3
  gRNA
uuauccuccaugugcaaugc

SEQ ID NO: 124177 - RNA, 20 nt, Artificial Sequence
  MKO10124177_B_Tyw5
  gRNA
cucuggaccaacuuguuaaa

SEQ ID NO: 124178 - RNA, 20 nt, Artificial Sequence
  MKO10124178_B_Tyw5
  gRNA
ucgaguccuuccaacacaag

SEQ ID NO: 124179 - RNA, 20 nt, Artificial Sequence
  MKO10124179_B_Tyw5
  gRNA
aggaugagaaauacuacuua

SEQ ID NO: 124180 - RNA, 20 nt, Artificial Sequence
  MKO10124180_B_T
  gRNA
ugacggcugacaaccaccgc

SEQ ID NO: 124181 - RNA, 20 nt, Artificial Sequence
  MKO10124181_B_T
  gRNA
accguacauugggaauaccc

SEQ ID NO: 124182 - RNA, 20 nt, Artificial Sequence
  MKO10124182_B_T
  gRNA
accgggggacugccagcagc

SEQ ID NO: 124183 - RNA, 20 nt, Artificial Sequence
  MKO10124183_B_U2af1l4
  gRNA
uguugugaagucgggagcac

SEQ ID NO: 124184 - RNA, 20 nt, Artificial Sequence
  MKO10124184_B_U2af1l4
  gRNA
uaacguagacauugcccacg

SEQ ID NO: 124185 - RNA, 20 nt, Artificial Sequence
  MKO10124185_B_U2af1l4
  gRNA
acacuaugauaacuucuuug

SEQ ID NO: 124186 - RNA, 20 nt, Artificial Sequence
  MKO10124186_B_U2af1
  gRNA
caauaaaccaaccuuuagcc

SEQ ID NO: 124187 - RNA, 20 nt, Artificial Sequence
  MKO10124187_B_U2af1
  gRNA
ucaggaagucuucacugaga

SEQ ID NO: 124188 - RNA, 20 nt, Artificial Sequence
  MKO10124188_B_U2af1
  gRNA
cucgaaaauggcggaauacu

SEQ ID NO: 124189 - RNA, 20 nt, Artificial Sequence
  MKO10124189_B_U2af2
  gRNA
uacugggacgugccaccgcc

SEQ ID NO: 124190 - RNA, 20 nt, Artificial Sequence
  MKO10124190_B_U2af2
  gRNA
cucagcaaaccuuugaccag

SEQ ID NO: 124191 - RNA, 20 nt, Artificial Sequence
  MKO10124191_B_U2af2
  gRNA
uacgugggcaacaucccuuu

SEQ ID NO: 124192 - RNA, 20 nt, Artificial Sequence
  MKO10124192_B_U2surp
  gRNA
cuggccuucugagauccgcc

SEQ ID NO: 124193 - RNA, 20 nt, Artificial Sequence
  MKO10124193_B_U2surp
  gRNA
aagcuuaaagcauucaguau

SEQ ID NO: 124194 - RNA, 20 nt, Artificial Sequence
  MKO10124194_B_U2surp
  gRNA
augaaugaacaucugaugau

SEQ ID NO: 124195 - RNA, 20 nt, Artificial Sequence
  MKO10124195_B_Uaca
  gRNA
agggaggaaugcgcuucacc

SEQ ID NO: 124196 - RNA, 20 nt, Artificial Sequence
  MKO10124196_B_Uaca
  gRNA
caacaucaaugccaugcgua

SEQ ID NO: 124197 - RNA, 20 nt, Artificial Sequence
  MKO10124197_B_Uaca
  gRNA
cguguccguacuuagcugcc

SEQ ID NO: 124198 - RNA, 20 nt, Artificial Sequence
  MKO10124198_B_Uap1l1
  gRNA
cuccuuuauagauggcaacg

SEQ ID NO: 124199 - RNA, 20 nt, Artificial Sequence
  MKO10124199_B_Uap1l1
  gRNA
ggaggcuugcucuacaacgc

SEQ ID NO: 124200 - RNA, 20 nt, Artificial Sequence
  MKO10124200_B_Uap1l1
  gRNA
caugaccagugaguuuaccc

SEQ ID NO: 124201 - RNA, 20 nt, Artificial Sequence
  MKO10124201_B_Uap1
  gRNA
augcagaauccaaugaaccg

SEQ ID NO: 124202 - RNA, 20 nt, Artificial Sequence
  MKO10124202_B_Uap1
  gRNA
gcucaaaggcgaaguucaga

SEQ ID NO: 124203 - RNA, 20 nt, Artificial Sequence
  MKO10124203_B_Uap1
  gRNA
cagaacaauggaaucaacga

SEQ ID NO: 124204 - RNA, 20 nt, Artificial Sequence
  MKO10124204_B_Uba1y
  gRNA
ggcugucacucuccaugauc

SEQ ID NO: 124205 - RNA, 20 nt, Artificial Sequence
  MKO10124205_B_Uba1y
  gRNA
ggugaauucugccauagcca

SEQ ID NO: 124206 - RNA, 20 nt, Artificial Sequence
  MKO10124206_B_Uba1y
  gRNA
uuaggaaaugucaaaaaaua

SEQ ID NO: 124207 - RNA, 20 nt, Artificial Sequence
  MKO10124207_B_Uba1
  gRNA
acauccagcguccuugucuc

SEQ ID NO: 124208 - RNA, 20 nt, Artificial Sequence
  MKO10124208_B_Uba1
  gRNA
cucuagggaauggcgaagaa

SEQ ID NO: 124209 - RNA, 20 nt, Artificial Sequence
  MKO10124209_B_Uba1
  gRNA
uagacgagagccuuuacucc

SEQ ID NO: 124210 - RNA, 20 nt, Artificial Sequence
  MKO10124210_B_Uba2
  gRNA
ccacccccaagccaacauug

SEQ ID NO: 124211 - RNA, 20 nt, Artificial Sequence
  MKO10124211_B_Uba2
  gRNA
cguacuucaugaugcuguca

SEQ ID NO: 124212 - RNA, 20 nt, Artificial Sequence
  MKO10124212_B_Uba2
  gRNA
aaaaacuccacauuauaguc

SEQ ID NO: 124213 - RNA, 20 nt, Artificial Sequence
  MKO10124213_B_Uba3
  gRNA
augugagcuucugaaaaauc

SEQ ID NO: 124214 - RNA, 20 nt, Artificial Sequence
  MKO10124214_B_Uba3
  gRNA
uacauguaucuaacaagaac

SEQ ID NO: 124215 - RNA, 20 nt, Artificial Sequence
  MKO10124215_B_Uba3
  gRNA
uaaaaacugucuauuuaaau

SEQ ID NO: 124216 - RNA, 20 nt, Artificial Sequence
  MKO10124216_B_Uba52
  gRNA
accuuucuggauguuguagu

SEQ ID NO: 124217 - RNA, 20 nt, Artificial Sequence
  MKO10124217_B_Uba52
  gRNA
gaucuucgugaagacccuga

SEQ ID NO: 124218 - RNA, 20 nt, Artificial Sequence
  MKO10124218_B_Uba52
  gRNA
gcuuuauuugaccuucuucu

SEQ ID NO: 124219 - RNA, 20 nt, Artificial Sequence
  MKO10124219_B_Uba5
  gRNA
acgcagcagaacacacccug

SEQ ID NO: 124220 - RNA, 20 nt, Artificial Sequence
  MKO10124220_B_Uba5
  gRNA
uccguuucaaugccaucaga

SEQ ID NO: 124221 - RNA, 20 nt, Artificial Sequence
  MKO10124221_B_Uba5
  gRNA
gccgucugauggcauugaaa

SEQ ID NO: 124222 - RNA, 20 nt, Artificial Sequence
  MKO10124222_B_Uba6
  gRNA
gcaaagaaucuuguucuugc

SEQ ID NO: 124223 - RNA, 20 nt, Artificial Sequence
  MKO10124223_B_Uba6
  gRNA
uaacaacaucaucuucacac

SEQ ID NO: 124224 - RNA, 20 nt, Artificial Sequence
  MKO10124224_B_Uba6
  gRNA
uaccaugacaacagaaucuu

SEQ ID NO: 124225 - RNA, 20 nt, Artificial Sequence
  MKO10124225_B_Uba7
  gRNA
agucuugcuauguggccugc

SEQ ID NO: 124226 - RNA, 20 nt, Artificial Sequence
  MKO10124226_B_Uba7
  gRNA
guccagaucuccguccacag

SEQ ID NO: 124227 - RNA, 20 nt, Artificial Sequence
  MKO10124227_B_Uba7
  gRNA
acccaugacagcugccaucc

SEQ ID NO: 124228 - RNA, 20 nt, Artificial Sequence
  MKO10124228_B_Ubac1
  gRNA
agcaguccggucagugcugc

SEQ ID NO: 124229 - RNA, 20 nt, Artificial Sequence
  MKO10124229_B_Ubac1
  gRNA
ugacgucucagcagaagaaa

SEQ ID NO: 124230 - RNA, 20 nt, Artificial Sequence
  MKO10124230_B_Ubac1
  gRNA
ccaccucaaugagagacacg

SEQ ID NO: 124231 - RNA, 20 nt, Artificial Sequence
  MKO10124231_B_Ubac2
  gRNA
agcagaagacucuucgacag

SEQ ID NO: 124232 - RNA, 20 nt, Artificial Sequence
  MKO10124232_B_Ubac2
  gRNA
ggcccaggaucugcgccacc

SEQ ID NO: 124233 - RNA, 20 nt, Artificial Sequence
  MKO10124233_B_Ubac2
  gRNA
uugaaagacgcuuucuguag

SEQ ID NO: 124234 - RNA, 20 nt, Artificial Sequence
  MKO10124234_B_Ubald1
  gRNA
caccauguucucccgucuca

SEQ ID NO: 124235 - RNA, 20 nt, Artificial Sequence
  MKO10124235_B_Ubald1
  gRNA
cagcagcccaauggccacgu

SEQ ID NO: 124236 - RNA, 20 nt, Artificial Sequence
  MKO10124236_B_Ubald1
  gRNA
cuacagccaccaccaccaga

SEQ ID NO: 124237 - RNA, 20 nt, Artificial Sequence
  MKO10124237_B_Ubald2
  gRNA
cagcagcugcugcgccugau

SEQ ID NO: 124238 - RNA, 20 nt, Artificial Sequence
  MKO10124238_B_Ubald2
  gRNA
cagcgccaugucggugaaca

SEQ ID NO: 124239 - RNA, 20 nt, Artificial Sequence
  MKO10124239_B_Ubald2
  gRNA
gucucaucucuggccaucca

SEQ ID NO: 124240 - RNA, 20 nt, Artificial Sequence
  MKO10124240_B_Ubap1
  gRNA
auaggcagacccacuuucgc

SEQ ID NO: 124241 - RNA, 20 nt, Artificial Sequence
  MKO10124241_B_Ubap1
  gRNA
cagugccugcaguuccaaau

SEQ ID NO: 124242 - RNA, 20 nt, Artificial Sequence
  MKO10124242_B_Ubap1
  gRNA
cucgacuaucucuuugcaca

SEQ ID NO: 124243 - RNA, 20 nt, Artificial Sequence
  MKO10124243_B_Ubap2l
  gRNA
uauacuguaaaugaugacgu

SEQ ID NO: 124244 - RNA, 20 nt, Artificial Sequence
  MKO10124244_B_Ubap2l
  gRNA
uuucaguugauugauaucac

SEQ ID NO: 124245 - RNA, 20 nt, Artificial Sequence
  MKO10124245_B_Ubap2l
  gRNA
ccauaaugaugcugacuuug

SEQ ID NO: 124246 - RNA, 20 nt, Artificial Sequence
  MKO10124246_B_Ubap2
  gRNA
ggcaagcgggcccgaggcag

SEQ ID NO: 124247 - RNA, 20 nt, Artificial Sequence
  MKO10124247_B_Ubap2
  gRNA
caucaccauuacagucaugu

SEQ ID NO: 124248 - RNA, 20 nt, Artificial Sequence
  MKO10124248_B_Ubap2
  gRNA
aggcaacagcugagcagaug

SEQ ID NO: 124249 - RNA, 20 nt, Artificial Sequence
  MKO10124249_B_Ubash3a
  gRNA
agugcacaaaacgcaugucu

SEQ ID NO: 124250 - RNA, 20 nt, Artificial Sequence
  MKO10124250_B_Ubash3a
  gRNA
aagucacagagugucacgug

SEQ ID NO: 124251 - RNA, 20 nt, Artificial Sequence
  MKO10124251_B_Ubash3a
  gRNA
aggguagaacuuaugggcca

SEQ ID NO: 124252 - RNA, 20 nt, Artificial Sequence
  MKO10124252_B_Ubash3b
  gRNA
guccucuaccuccgcccgac

SEQ ID NO: 124253 - RNA, 20 nt, Artificial Sequence
  MKO10124253_B_Ubash3b
  gRNA
cuaauggcccugucgggcgg

SEQ ID NO: 124254 - RNA, 20 nt, Artificial Sequence
  MKO10124254_B_Ubash3b
  gRNA
cagaacauugacgucaagcu

SEQ ID NO: 124255 - RNA, 20 nt, Artificial Sequence
  MKO10124255_B_Ubb
  gRNA
aucuucgugaagacccugac

SEQ ID NO: 124256 - RNA, 20 nt, Artificial Sequence
  MKO10124256_B_Ubb
  gRNA
uguuguaaucagagagggug

SEQ ID NO: 124257 - RNA, 20 nt, Artificial Sequence
  MKO10124257_B_Ubb
  gRNA
ugacaccaucgagaacguga

SEQ ID NO: 124258 - RNA, 20 nt, Artificial Sequence
  MKO10124258_B_Ubc
  gRNA
uaacacugggcucgacgucc

SEQ ID NO: 124259 - RNA, 20 nt, Artificial Sequence
  MKO10124259_B_Ubc
  gRNA
cacacccaagaacaagcaca

SEQ ID NO: 124260 - RNA, 20 nt, Artificial Sequence
  MKO10124260_B_Ubc
  gRNA
cacuuaguccuucgccucag

SEQ ID NO: 124261 - RNA, 20 nt, Artificial Sequence
  MKO10124261_B_Ubd
  gRNA
caaaggucauuaaccgccau

SEQ ID NO: 124262 - RNA, 20 nt, Artificial Sequence
  MKO10124262_B_Ubd
  gRNA
aguccaaaaacgaggggcaa

SEQ ID NO: 124263 - RNA, 20 nt, Artificial Sequence
  MKO10124263_B_Ubd
  gRNA
gguuuccuugucaaucccau

SEQ ID NO: 124264 - RNA, 20 nt, Artificial Sequence
  MKO10124264_B_Ube2a
  gRNA
caccuguauggacguuaaaa

SEQ ID NO: 124265 - RNA, 20 nt, Artificial Sequence
  MKO10124265_B_Ube2a
  gRNA
cggagugagcggggcuccgu

SEQ ID NO: 124266 - RNA, 20 nt, Artificial Sequence
  MKO10124266_B_Ube2a
  gRNA
uuagagacaaaucuaacagu

SEQ ID NO: 124267 - RNA, 20 nt, Artificial Sequence
  MKO10124267_B_Ube2b
  gRNA
ugggacuccaucgauucugc

SEQ ID NO: 124268 - RNA, 20 nt, Artificial Sequence
  MKO10124268_B_Ube2b
  gRNA
uccaaaauguuucauccaaa

SEQ ID NO: 124269 - RNA, 20 nt, Artificial Sequence
  MKO10124269_B_Ube2b
  gRNA
cugaaaacaacaucaugcag

SEQ ID NO: 124270 - RNA, 20 nt, Artificial Sequence
  MKO10124270_B_Ube2cbp
  gRNA
aucccgaccccuuugcuaau

SEQ ID NO: 124271 - RNA, 20 nt, Artificial Sequence
  MKO10124271_B_Ube2cbp
  gRNA
uugggagagaccaugucauc

SEQ ID NO: 124272 - RNA, 20 nt, Artificial Sequence
  MKO10124272_B_Ube2cbp
  gRNA
augaagaggccuauuagcaa

SEQ ID NO: 124273 - RNA, 20 nt, Artificial Sequence
  MKO10124273_B_Ube2c
  gRNA
gcaggaacugaugauccuca

SEQ ID NO: 124274 - RNA, 20 nt, Artificial Sequence
  MKO10124274_B_Ube2c
  gRNA
acccugcuaccaccccaacg

SEQ ID NO: 124275 - RNA, 20 nt, Artificial Sequence
  MKO10124275_B_Ube2c
  gRNA
uccgcagcguguguguucaa

SEQ ID NO: 124276 - RNA, 20 nt, Artificial Sequence
  MKO10124276_B_Ube2d1
  gRNA
accuuucgauacagucaaag

SEQ ID NO: 124277 - RNA, 20 nt, Artificial Sequence
  MKO10124277_B_Ube2d1
  gRNA
cagccugacagcgccuauca

SEQ ID NO: 124278 - RNA, 20 nt, Artificial Sequence
  MKO10124278_B_Ube2d1
  gRNA
aaacuuacagucaucuccca

SEQ ID NO: 124279 - RNA, 20 nt, Artificial Sequence
  MKO10124279_B_Ube2d2a
  gRNA
ucuuaaggaauugaaugacc

SEQ ID NO: 124280 - RNA, 20 nt, Artificial Sequence
  MKO10124280_B_Ube2d2a
  gRNA
uacuuacuaucaucuccaac

SEQ ID NO: 124281 - RNA, 20 nt, Artificial Sequence
  MKO10124281_B_Ube2d2a
  gRNA
cacccaaauauuaacaguaa

SEQ ID NO: 124282 - RNA, 20 nt, Artificial Sequence
  MKO10124282_B_Ube2d2b
  gRNA
ggcccucagcgcauucugcc

SEQ ID NO: 124283 - RNA, 20 nt, Artificial Sequence
  MKO10124283_B_Ube2d2b
  gRNA
gccaaaugauagucccuauc

SEQ ID NO: 124284 - RNA, 20 nt, Artificial Sequence
  MKO10124284_B_Ube2d2b
  gRNA
acaugcagcgguacuguauc

SEQ ID NO: 124285 - RNA, 20 nt, Artificial Sequence
  MKO10124285_B_Ube2d3
  gRNA
ccugcuuuaacuauuucuaa

SEQ ID NO: 124286 - RNA, 20 nt, Artificial Sequence
  MKO10124286_B_Ube2d3
  gRNA
uacuuacugucaucuccaac

SEQ ID NO: 124287 - RNA, 20 nt, Artificial Sequence
  MKO10124287_B_Ube2d3
  gRNA
cagaaugacagcccauauca

SEQ ID NO: 124288 - RNA, 20 nt, Artificial Sequence
  MKO10124288_B_Ube2dnl1
  gRNA
agagccauugcccccaaacu

SEQ ID NO: 124289 - RNA, 20 nt, Artificial Sequence
  MKO10124289_B_Ube2dnl1
  gRNA
cgagcaguuguuuguccucc

SEQ ID NO: 124290 - RNA, 20 nt, Artificial Sequence
  MKO10124290_B_Ube2dnl1
  gRNA
aauugcuaaagucuaccaca

SEQ ID NO: 124291 - RNA, 20 nt, Artificial Sequence
  MKO10124291_B_Ube2dnl2
  gRNA
uuuaagagaguacaauagac

SEQ ID NO: 124292 - RNA, 20 nt, Artificial Sequence
  MKO10124292_B_Ube2dnl2
  gRNA
uuugcaauuucagggaccag

SEQ ID NO: 124293 - RNA, 20 nt, Artificial Sequence
  MKO10124293_B_Ube2dnl2
  gRNA
uagauaucuugaauucuaug

SEQ ID NO: 124294 - RNA, 20 nt, Artificial Sequence
  MKO10124294_B_Ube2e1
  gRNA
uaccaggauugcagucugua

SEQ ID NO: 124295 - RNA, 20 nt, Artificial Sequence
  MKO10124295_B_Ube2e1
  gRNA
auuucacagugcugguccca

SEQ ID NO: 124296 - RNA, 20 nt, Artificial Sequence
  MKO10124296_B_Ube2e1
  gRNA
ccuccagggucuguguauga

SEQ ID NO: 124297 - RNA, 20 nt, Artificial Sequence
  MKO10124297_B_Ube2e2
  gRNA
uacagugauagauucucguu

SEQ ID NO: 124298 - RNA, 20 nt, Artificial Sequence
  MKO10124298_B_Ube2e2
  gRNA
ugaauggaggucaacuauau

SEQ ID NO: 124299 - RNA, 20 nt, Artificial Sequence
  MKO10124299_B_Ube2e2
  gRNA
ggagcuugcagaaaucacgc

SEQ ID NO: 124300 - RNA, 20 nt, Artificial Sequence
  MKO10124300_B_Ube2e3
  gRNA
guuucuuaccugcaguuagg

SEQ ID NO: 124301 - RNA, 20 nt, Artificial Sequence
  MKO10124301_B_Ube2e3
  gRNA
gaauuauguugcguaucucu

SEQ ID NO: 124302 - RNA, 20 nt, Artificial Sequence
  MKO10124302_B_Ube2e3
  gRNA
uugauccuccuccuaacugc

SEQ ID NO: 124303 - RNA, 20 nt, Artificial Sequence
  MKO10124303_B_Ube2f
  gRNA
ugaaagcaaugaagcuuguu

SEQ ID NO: 124304 - RNA, 20 nt, Artificial Sequence
  MKO10124304_B_Ube2f
  gRNA
uucccccguuucugugaugu

SEQ ID NO: 124305 - RNA, 20 nt, Artificial Sequence
  MKO10124305_B_Ube2f
  gRNA
ugaaaugcuugacuaaaauc

SEQ ID NO: 124306 - RNA, 20 nt, Artificial Sequence
  MKO10124306_B_Ube2g1
  gRNA
ggccggaggggauaaucuuu

SEQ ID NO: 124307 - RNA, 20 nt, Artificial Sequence
  MKO10124307_B_Ube2g1
  gRNA
ucccaaaagauuauccccuc

SEQ ID NO: 124308 - RNA, 20 nt, Artificial Sequence
  MKO10124308_B_Ube2g1
  gRNA
uauacuuacuaaaguguauc

SEQ ID NO: 124309 - RNA, 20 nt, Artificial Sequence
  MKO10124309_B_Ube2g2
  gRNA
uuaccugccacgauuccuuc

SEQ ID NO: 124310 - RNA, 20 nt, Artificial Sequence
  MKO10124310_B_Ube2g2
  gRNA
guugggauggaacaucucac

SEQ ID NO: 124311 - RNA, 20 nt, Artificial Sequence
  MKO10124311_B_Ube2g2
  gRNA
uuaacccugaauccuccaga

SEQ ID NO: 124312 - RNA, 20 nt, Artificial Sequence
  MKO10124312_B_Ube2h
  gRNA
accaugucaucccccagucc

SEQ ID NO: 124313 - RNA, 20 nt, Artificial Sequence
  MKO10124313_B_Ube2h
  gRNA
cguguccauccgccucuugc

SEQ ID NO: 124314 - RNA, 20 nt, Artificial Sequence
  MKO10124314_B_Ube2h
  gRNA
cgaauucauugaguccuccu

SEQ ID NO: 124315 - RNA, 20 nt, Artificial Sequence
  MKO10124315_B_Ube2i
  gRNA
acccuuacccccuucuuucc

SEQ ID NO: 124316 - RNA, 20 nt, Artificial Sequence
  MKO10124316_B_Ube2i
  gRNA
accuguuugauggugauagc

SEQ ID NO: 124317 - RNA, 20 nt, Artificial Sequence
  MKO10124317_B_Ube2i
  gRNA
gucccaacaaagaacccuga

SEQ ID NO: 124318 - RNA, 20 nt, Artificial Sequence
  MKO10124318_B_Ube2j1
  gRNA
gguuucaugggguacucugg

SEQ ID NO: 124319 - RNA, 20 nt, Artificial Sequence
  MKO10124319_B_Ube2j1
  gRNA
acuguuagcaggauaaugcu

SEQ ID NO: 124320 - RNA, 20 nt, Artificial Sequence
  MKO10124320_B_Ube2j1
  gRNA
gcuaauggacgauuugaagu

SEQ ID NO: 124321 - RNA, 20 nt, Artificial Sequence
  MKO10124321_B_Ube2j2
  gRNA
ccuggggagcauagagacgu

SEQ ID NO: 124322 - RNA, 20 nt, Artificial Sequence
  MKO10124322_B_Ube2j2
  gRNA
uaccauucaagaauauuuga

SEQ ID NO: 124323 - RNA, 20 nt, Artificial Sequence
  MKO10124323_B_Ube2j2
  gRNA
cuccaacaacagcaacacaa

SEQ ID NO: 124324 - RNA, 20 nt, Artificial Sequence
  MKO10124324_B_Ube2k
  gRNA
aauaccuuagggggguuaaa

SEQ ID NO: 124325 - RNA, 20 nt, Artificial Sequence
  MKO10124325_B_Ube2k
  gRNA
agcagcaaugacucugcgca

SEQ ID NO: 124326 - RNA, 20 nt, Artificial Sequence
  MKO10124326_B_Ube2k
  gRNA
auauccauuuaaccccccua

SEQ ID NO: 124327 - RNA, 20 nt, Artificial Sequence
  MKO10124327_B_Ube2l3
  gRNA
gauccaagauggcggccagc

SEQ ID NO: 124328 - RNA, 20 nt, Artificial Sequence
  MKO10124328_B_Ube2l3
  gRNA
cuugaagagauccgcaaaug

SEQ ID NO: 124329 - RNA, 20 nt, Artificial Sequence
  MKO10124329_B_Ube2l3
  gRNA
auaaauuagcuucaucaacc

SEQ ID NO: 124330 - RNA, 20 nt, Artificial Sequence
  MKO10124330_B_Ube2l6
  gRNA
ggagcuggagagucuuucga

SEQ ID NO: 124331 - RNA, 20 nt, Artificial Sequence
  MKO10124331_B_Ube2l6
  gRNA
gaaaucaauccgcacuugga

SEQ ID NO: 124332 - RNA, 20 nt, Artificial Sequence
  MKO10124332_B_Ube2l6
  gRNA
ucuggaagagccugugcguc

SEQ ID NO: 124333 - RNA, 20 nt, Artificial Sequence
  MKO10124333_B_Ube2m
  gRNA
cccgauguaaccaccucuca

SEQ ID NO: 124334 - RNA, 20 nt, Artificial Sequence
  MKO10124334_B_Ube2m
  gRNA
gaagcugaugucacacgucu

SEQ ID NO: 124335 - RNA, 20 nt, Artificial Sequence
  MKO10124335_B_Ube2m
  gRNA
aaauuauggaguuuaucgua

SEQ ID NO: 124336 - RNA, 20 nt, Artificial Sequence
  MKO10124336_B_Ube2n
  gRNA
guaggaaacccagcguuugc

SEQ ID NO: 124337 - RNA, 20 nt, Artificial Sequence
  MKO10124337_B_Ube2n
  gRNA
auauuaaguaccuguuucua

SEQ ID NO: 124338 - RNA, 20 nt, Artificial Sequence
  MKO10124338_B_Ube2n
  gRNA
agauggccgggcugccccgc

SEQ ID NO: 124339 - RNA, 20 nt, Artificial Sequence
  MKO10124339_B_Ube2o
  gRNA
gcaugugucgaaccacaucc

SEQ ID NO: 124340 - RNA, 20 nt, Artificial Sequence
  MKO10124340_B_Ube2o
  gRNA
gacugugccgucaagcucau

SEQ ID NO: 124341 - RNA, 20 nt, Artificial Sequence
  MKO10124341_B_Ube2o
  gRNA
gauauagucuccauacauga

SEQ ID NO: 124342 - RNA, 20 nt, Artificial Sequence
  MKO10124342_B_Ube2q1
  gRNA
agcucuugcagcaucugaag

SEQ ID NO: 124343 - RNA, 20 nt, Artificial Sequence
  MKO10124343_B_Ube2q1
  gRNA
aucuucagacuucuugcccu

SEQ ID NO: 124344 - RNA, 20 nt, Artificial Sequence
  MKO10124344_B_Ube2q1
  gRNA
acccugcugugccccccauc

SEQ ID NO: 124345 - RNA, 20 nt, Artificial Sequence
  MKO10124345_B_Ube2q2
  gRNA
acccaucuucuucaccaaua

SEQ ID NO: 124346 - RNA, 20 nt, Artificial Sequence
  MKO10124346_B_Ube2q2
  gRNA
uuuguaggauauagaagacu

SEQ ID NO: 124347 - RNA, 20 nt, Artificial Sequence
  MKO10124347_B_Ube2q2
  gRNA
agaaguaacuucagaagaag

SEQ ID NO: 124348 - RNA, 20 nt, Artificial Sequence
  MKO10124348_B_Ube2ql1
  gRNA
agacacaugagaaauacggc

SEQ ID NO: 124349 - RNA, 20 nt, Artificial Sequence
  MKO10124349_B_Ube2ql1
  gRNA
cgcugaggcgcgcgaugucc

SEQ ID NO: 124350 - RNA, 20 nt, Artificial Sequence
  MKO10124350_B_Ube2ql1
  gRNA
ggcagcaaacuggcgcauga

SEQ ID NO: 124351 - RNA, 20 nt, Artificial Sequence
  MKO10124351_B_Ube2r2
  gRNA
ggugaauauggguaaucaau

SEQ ID NO: 124352 - RNA, 20 nt, Artificial Sequence
  MKO10124352_B_Ube2r2
  gRNA
agugaagguccccacaaccc

SEQ ID NO: 124353 - RNA, 20 nt, Artificial Sequence
  MKO10124353_B_Ube2r2
  gRNA
cuucuccgccucagcuuuag

SEQ ID NO: 124354 - RNA, 20 nt, Artificial Sequence
  MKO10124354_B_Ube2s
  gRNA
ucagaagggacucccuaugc

SEQ ID NO: 124355 - RNA, 20 nt, Artificial Sequence
  MKO10124355_B_Ube2s
  gRNA
cccagagucugcacucaaug

SEQ ID NO: 124356 - RNA, 20 nt, Artificial Sequence
  MKO10124356_B_Ube2s
  gRNA
guggaucagcaggcacuuga

SEQ ID NO: 124357 - RNA, 20 nt, Artificial Sequence
  MKO10124357_B_Ube2t
  gRNA
cuuccacuagaaucaauguu

SEQ ID NO: 124358 - RNA, 20 nt, Artificial Sequence
  MKO10124358_B_Ube2t
  gRNA
uauucucaaauugccaccaa

SEQ ID NO: 124359 - RNA, 20 nt, Artificial Sequence
  MKO10124359_B_Ube2t
  gRNA
uggaaguuaucauuccugag

SEQ ID NO: 124360 - RNA, 20 nt, Artificial Sequence
  MKO10124360_B_Ube2u
  gRNA
cuucgcaauucaguuuguga

SEQ ID NO: 124361 - RNA, 20 nt, Artificial Sequence
  MKO10124361_B_Ube2u
  gRNA
caauucuuacuugguaaugc

SEQ ID NO: 124362 - RNA, 20 nt, Artificial Sequence
  MKO10124362_B_Ube2u
  gRNA
uaagugaugauaugaugaau

SEQ ID NO: 124363 - RNA, 20 nt, Artificial Sequence
  MKO10124363_B_Ube2v1
  gRNA
cccucgaaauuuccgacugu

SEQ ID NO: 124364 - RNA, 20 nt, Artificial Sequence
  MKO10124364_B_Ube2v1
  gRNA
cuuccagcucuuccaacagu

SEQ ID NO: 124365 - RNA, 20 nt, Artificial Sequence
  MKO10124365_B_Ube2v1
  gRNA
uacagccuuaagauagagug

SEQ ID NO: 124366 - RNA, 20 nt, Artificial Sequence
  MKO10124366_B_Ube2v2
  gRNA
gaacuugaagaaggacaaaa

SEQ ID NO: 124367 - RNA, 20 nt, Artificial Sequence
  MKO10124367_B_Ube2v2
  gRNA
uauagccugaaaguagaaug

SEQ ID NO: 124368 - RNA, 20 nt, Artificial Sequence
  MKO10124368_B_Ube2v2
  gRNA
uuuguuacaaaucuaacuga

SEQ ID NO: 124369 - RNA, 20 nt, Artificial Sequence
  MKO10124369_B_Ube2w
  gRNA
acugacugcacugagagcgc

SEQ ID NO: 124370 - RNA, 20 nt, Artificial Sequence
  MKO10124370_B_Ube2w
  gRNA
ggaccagucuucuguuagaa

SEQ ID NO: 124371 - RNA, 20 nt, Artificial Sequence
  MKO10124371_B_Ube2w
  gRNA
uugcagaaugacccaccucc

SEQ ID NO: 124372 - RNA, 20 nt, Artificial Sequence
  MKO10124372_B_Ube2z
  gRNA
aaucccuaccacaacgaacc

SEQ ID NO: 124373 - RNA, 20 nt, Artificial Sequence
  MKO10124373_B_Ube2z
  gRNA
cgacacuguugacaugacua

SEQ ID NO: 124374 - RNA, 20 nt, Artificial Sequence
  MKO10124374_B_Ube2z
  gRNA
aaccccaacuucuaccgcaa

SEQ ID NO: 124375 - RNA, 20 nt, Artificial Sequence
  MKO10124375_B_Ube3a
  gRNA
aacugcuucuucaagucugc

SEQ ID NO: 124376 - RNA, 20 nt, Artificial Sequence
  MKO10124376_B_Ube3a
  gRNA
acagcuagagaugauugcua

SEQ ID NO: 124377 - RNA, 20 nt, Artificial Sequence
  MKO10124377_B_Ube3a
  gRNA
gauccucaucccuccaagaa

SEQ ID NO: 124378 - RNA, 20 nt, Artificial Sequence
  MKO10124378_B_Ube3b
  gRNA
agggcucaccucgcuguccu

SEQ ID NO: 124379 - RNA, 20 nt, Artificial Sequence
  MKO10124379_B_Ube3b
  gRNA
guuuauaugcaaaacuaccg

SEQ ID NO: 124380 - RNA, 20 nt, Artificial Sequence
  MKO10124380_B_Ube3b
  gRNA
acucaccuuuggcucauucu

SEQ ID NO: 124381 - RNA, 20 nt, Artificial Sequence
  MKO10124381_B_Ube3c
  gRNA
cucucuguuugucaagcaau

SEQ ID NO: 124382 - RNA, 20 nt, Artificial Sequence
  MKO10124382_B_Ube3c
  gRNA
gcugagccgagucagugcau

SEQ ID NO: 124383 - RNA, 20 nt, Artificial Sequence
  MKO10124383_B_Ube3c
  gRNA
uaagguugggaccaucagca

SEQ ID NO: 124384 - RNA, 20 nt, Artificial Sequence
  MKO10124384_B_Ube4a
  gRNA
ucaaaucuaccaguugcuca

SEQ ID NO: 124385 - RNA, 20 nt, Artificial Sequence
  MKO10124385_B_Ube4a
  gRNA
cugagauuagccgcuccuuc

SEQ ID NO: 124386 - RNA, 20 nt, Artificial Sequence
  MKO10124386_B_Ube4a
  gRNA
cgauuauugcuucaagaucc

SEQ ID NO: 124387 - RNA, 20 nt, Artificial Sequence
  MKO10124387_B_Ube4b
  gRNA
aucucugucgcgguccuucc

SEQ ID NO: 124388 - RNA, 20 nt, Artificial Sequence
  MKO10124388_B_Ube4b
  gRNA
uucccgaauccacauccacc

SEQ ID NO: 124389 - RNA, 20 nt, Artificial Sequence
  MKO10124389_B_Ube4b
  gRNA
ccuguguaggaguugcccau

SEQ ID NO: 124390 - RNA, 20 nt, Artificial Sequence
  MKO10124390_B_Ubfd1
  gRNA
agaugugaugccgucuguua

SEQ ID NO: 124391 - RNA, 20 nt, Artificial Sequence
  MKO10124391_B_Ubfd1
  gRNA
cccgaaagaugcugcccagc

SEQ ID NO: 124392 - RNA, 20 nt, Artificial Sequence
  MKO10124392_B_Ubfd1
  gRNA
ucuggcauguacaauaaguc

SEQ ID NO: 124393 - RNA, 20 nt, Artificial Sequence
  MKO10124393_B_Ubiad1
  gRNA
gauguuugccuacgcugucc

SEQ ID NO: 124394 - RNA, 20 nt, Artificial Sequence
  MKO10124394_B_Ubiad1
  gRNA
gaagaacgaauggcccgagc

SEQ ID NO: 124395 - RNA, 20 nt, Artificial Sequence
  MKO10124395_B_Ubiad1
  gRNA
caagugcgccuccuacgugu

SEQ ID NO: 124396 - RNA, 20 nt, Artificial Sequence
  MKO10124396_B_Ubl3
  gRNA
cgggggcuuaccuugugagu

SEQ ID NO: 124397 - RNA, 20 nt, Artificial Sequence
  MKO10124397_B_Ubl3
  gRNA
uaaaugagucgaagaauguu

SEQ ID NO: 124398 - RNA, 20 nt, Artificial Sequence
  MKO10124398_B_Ubl3
  gRNA
cugccagagcccaacucaca

SEQ ID NO: 124399 - RNA, 20 nt, Artificial Sequence
  MKO10124399_B_Ubl4a
  gRNA
ccucacuugccggcguuugc

SEQ ID NO: 124400 - RNA, 20 nt, Artificial Sequence
  MKO10124400_B_Ubl4a
  gRNA
cucuucaucagcgagauuca

SEQ ID NO: 124401 - RNA, 20 nt, Artificial Sequence
  MKO10124401_B_Ubl4a
  gRNA
cuugaaucucgcugaugaag

SEQ ID NO: 124402 - RNA, 20 nt, Artificial Sequence
  MKO10124402_B_Ubl4b
  gRNA
ggaagccccugcuguugcau

SEQ ID NO: 124403 - RNA, 20 nt, Artificial Sequence
  MKO10124403_B_Ubl4b
  gRNA
uaccucucagauuacagcau

SEQ ID NO: 124404 - RNA, 20 nt, Artificial Sequence
  MKO10124404_B_Ubl4b
  gRNA
uuauccagcgcugcauccuc

SEQ ID NO: 124405 - RNA, 20 nt, Artificial Sequence
  MKO10124405_B_Ubl4
  gRNA
ccuugaacagcagacguugc

SEQ ID NO: 124406 - RNA, 20 nt, Artificial Sequence
  MKO10124406_B_Ubl4
  gRNA
aacuagguugagcuuagaau

SEQ ID NO: 124407 - RNA, 20 nt, Artificial Sequence
  MKO10124407_B_Ubl4
  gRNA
guucgaugucauccaguguu

SEQ ID NO: 124408 - RNA, 20 nt, Artificial Sequence
  MKO10124408_B_Ubl5
  gRNA
caguuucuucaagucgccga

SEQ ID NO: 124409 - RNA, 20 nt, Artificial Sequence
  MKO10124409_B_Ubl5
  gRNA
uacaaucucccagagacacg

SEQ ID NO: 124410 - RNA, 20 nt, Artificial Sequence
  MKO10124410_B_Ubl5
  gRNA
uccagccacaaugauugagg

SEQ ID NO: 124411 - RNA, 20 nt, Artificial Sequence
  MKO10124411_B_Ubl7
  gRNA
uagcugcccugagagaguuc

SEQ ID NO: 124412 - RNA, 20 nt, Artificial Sequence
  MKO10124412_B_Ubl7
  gRNA
gucucuuccagggguucucc

SEQ ID NO: 124413 - RNA, 20 nt, Artificial Sequence
  MKO10124413_B_Ubl7
  gRNA
cccuuaccagguuucugauc

SEQ ID NO: 124414 - RNA, 20 nt, Artificial Sequence
  MKO10124414_B_Ublcp1
  gRNA
aaguaguugaaguagaaaau

SEQ ID NO: 124415 - RNA, 20 nt, Artificial Sequence
  MKO10124415_B_Ublcp1
  gRNA
uugaugacaucaucauuguc

SEQ ID NO: 124416 - RNA, 20 nt, Artificial Sequence
  MKO10124416_B_Ublcp1
  gRNA
uagggaggaaaaccuccuga

SEQ ID NO: 124417 - RNA, 20 nt, Artificial Sequence
  MKO10124417_B_Ubn1
  gRNA
auaagguggaggcccuugca

SEQ ID NO: 124418 - RNA, 20 nt, Artificial Sequence
  MKO10124418_B_Ubn1
  gRNA
uucucagaagcggaaguuga

SEQ ID NO: 124419 - RNA, 20 nt, Artificial Sequence
  MKO10124419_B_Ubn1
  gRNA
uucaggguggaaagaaacgu

SEQ ID NO: 124420 - RNA, 20 nt, Artificial Sequence
  MKO10124420_B_Ubn2
  gRNA
uucagcauaccccaguugcu

SEQ ID NO: 124421 - RNA, 20 nt, Artificial Sequence
  MKO10124421_B_Ubn2
  gRNA
uccuuaugcucaucaguaaa

SEQ ID NO: 124422 - RNA, 20 nt, Artificial Sequence
  MKO10124422_B_Ubn2
  gRNA
gcuucucuaacaacaaaaua

SEQ ID NO: 124423 - RNA, 20 nt, Artificial Sequence
  MKO10124423_B_Ubox5
  gRNA
ucggcacagaaggugaccac

SEQ ID NO: 124424 - RNA, 20 nt, Artificial Sequence
  MKO10124424_B_Ubox5
  gRNA
cuggggauuaccggagcugg

SEQ ID NO: 124425 - RNA, 20 nt, Artificial Sequence
  MKO10124425_B_Ubox5
  gRNA
uggagccaaggguagaaguc

SEQ ID NO: 124426 - RNA, 20 nt, Artificial Sequence
  MKO10124426_B_Ubp1
  gRNA
gucgaagucgugcaccagcc

SEQ ID NO: 124427 - RNA, 20 nt, Artificial Sequence
  MKO10124427_B_Ubp1
  gRNA
uguacuguagccgccuguca

SEQ ID NO: 124428 - RNA, 20 nt, Artificial Sequence
  MKO10124428_B_Ubp1
  gRNA
augcuggauaaucgcaaaau

SEQ ID NO: 124429 - RNA, 20 nt, Artificial Sequence
  MKO10124429_B_Ubqln1
  gRNA
accgggcgcgcaggacagug

SEQ ID NO: 124430 - RNA, 20 nt, Artificial Sequence
  MKO10124430_B_Ubqln1
  gRNA
gccgcacuguccugcgcgcc

SEQ ID NO: 124431 - RNA, 20 nt, Artificial Sequence
  MKO10124431_B_Ubqln1
  gRNA
acaaaaguugccgcugcauu

SEQ ID NO: 124432 - RNA, 20 nt, Artificial Sequence
  MKO10124432_B_Ubqln2
  gRNA
gcggaucacgauucuccgug

SEQ ID NO: 124433 - RNA, 20 nt, Artificial Sequence
  MKO10124433_B_Ubqln2
  gRNA
aguggguccuauaggcccga

SEQ ID NO: 124434 - RNA, 20 nt, Artificial Sequence
  MKO10124434_B_Ubqln2
  gRNA
gugauccgcugcccaauccu

SEQ ID NO: 124435 - RNA, 20 nt, Artificial Sequence
  MKO10124435_B_Ubqln3
  gRNA
ucguaacccuuccaugaugc

SEQ ID NO: 124436 - RNA, 20 nt, Artificial Sequence
  MKO10124436_B_Ubqln3
  gRNA
aagaugcagcgucggaccau

SEQ ID NO: 124437 - RNA, 20 nt, Artificial Sequence
  MKO10124437_B_Ubqln3
  gRNA
ggaucgugcacucaguaacc

SEQ ID NO: 124438 - RNA, 20 nt, Artificial Sequence
  MKO10124438_B_Ubqln4
  gRNA
gcccauccuugaugccgugc

SEQ ID NO: 124439 - RNA, 20 nt, Artificial Sequence
  MKO10124439_B_Ubqln4
  gRNA
cggagggcauuauacccucc

SEQ ID NO: 124440 - RNA, 20 nt, Artificial Sequence
  MKO10124440_B_Ubqln4
  gRNA
cuucgcaggcaagauccuca

SEQ ID NO: 124441 - RNA, 20 nt, Artificial Sequence
  MKO10124441_B_Ubqlnl
  gRNA
cagaaaguacagcccccguc

SEQ ID NO: 124442 - RNA, 20 nt, Artificial Sequence
  MKO10124442_B_Ubqlnl
  gRNA
cgagugauugugaagacucc

SEQ ID NO: 124443 - RNA, 20 nt, Artificial Sequence
  MKO10124443_B_Ubqlnl
  gRNA
gcauuauuacaaauugagca

SEQ ID NO: 124444 - RNA, 20 nt, Artificial Sequence
  MKO10124444_B_Ubr1
  gRNA
agcguuccaguuguguggga

SEQ ID NO: 124445 - RNA, 20 nt, Artificial Sequence
  MKO10124445_B_Ubr1
  gRNA
acauugcccauugaaugaag

SEQ ID NO: 124446 - RNA, 20 nt, Artificial Sequence
  MKO10124446_B_Ubr1
  gRNA
agccaggagaauauucccuu

SEQ ID NO: 124447 - RNA, 20 nt, Artificial Sequence
  MKO10124447_B_Ubr2
  gRNA
agggccccggcaguagauuu

SEQ ID NO: 124448 - RNA, 20 nt, Artificial Sequence
  MKO10124448_B_Ubr2
  gRNA
ggccaucgaccgcaguuugc

SEQ ID NO: 124449 - RNA, 20 nt, Artificial Sequence
  MKO10124449_B_Ubr2
  gRNA
uguucugccgaagagaucgc

SEQ ID NO: 124450 - RNA, 20 nt, Artificial Sequence
  MKO10124450_B_Ubr3
  gRNA
ucaggucuuuguaguucugc

SEQ ID NO: 124451 - RNA, 20 nt, Artificial Sequence
  MKO10124451_B_Ubr3
  gRNA
cuuauucaguacuuaagaga

SEQ ID NO: 124452 - RNA, 20 nt, Artificial Sequence
  MKO10124452_B_Ubr3
  gRNA
agacaucaucaguaagucuu

SEQ ID NO: 124453 - RNA, 20 nt, Artificial Sequence
  MKO10124453_B_Ubr4
  gRNA
ggacuucaucauugcuguaa

SEQ ID NO: 124454 - RNA, 20 nt, Artificial Sequence
  MKO10124454_B_Ubr4
  gRNA
cagcugccaccgacugaagc

SEQ ID NO: 124455 - RNA, 20 nt, Artificial Sequence
  MKO10124455_B_Ubr4
  gRNA
ccccaguaagccccgagcuc

SEQ ID NO: 124456 - RNA, 20 nt, Artificial Sequence
  MKO10124456_B_Ubr5
  gRNA
ucuuacccaucauuauuauc

SEQ ID NO: 124457 - RNA, 20 nt, Artificial Sequence
  MKO10124457_B_Ubr5
  gRNA
gacuccccgugguuucucuc

SEQ ID NO: 124458 - RNA, 20 nt, Artificial Sequence
  MKO10124458_B_Ubr5
  gRNA
acagggaggaccucuaggcc

SEQ ID NO: 124459 - RNA, 20 nt, Artificial Sequence
  MKO10124459_B_Ubr7
  gRNA
acacacuguaucaucucauc

SEQ ID NO: 124460 - RNA, 20 nt, Artificial Sequence
  MKO10124460_B_Ubr7
  gRNA
ucucuuucaggacaaaucaa

SEQ ID NO: 124461 - RNA, 20 nt, Artificial Sequence
  MKO10124461_B_Ubr7
  gRNA
gauucucuuaccucaucuuc

SEQ ID NO: 124462 - RNA, 20 nt, Artificial Sequence
  MKO10124462_B_Ubtd1
  gRNA
uugaguugccccaccguguc

SEQ ID NO: 124463 - RNA, 20 nt, Artificial Sequence
  MKO10124463_B_Ubtd1
  gRNA
ucgcaaugagcccuugaaga

SEQ ID NO: 124464 - RNA, 20 nt, Artificial Sequence
  MKO10124464_B_Ubtd1
  gRNA
ggagcaaacgagaugaguuc

SEQ ID NO: 124465 - RNA, 20 nt, Artificial Sequence
  MKO10124465_B_Ubtd2
  gRNA
gcgcaguuguccaucuguca

SEQ ID NO: 124466 - RNA, 20 nt, Artificial Sequence
  MKO10124466_B_Ubtd2
  gRNA
cggccccaugggcgggugcg

SEQ ID NO: 124467 - RNA, 20 nt, Artificial Sequence
  MKO10124467_B_Ubtd2
  gRNA
aggcaucccagaucucuuuc

SEQ ID NO: 124468 - RNA, 20 nt, Artificial Sequence
  MKO10124468_B_Ubtfl1
  gRNA
gcugacgguauuucucagcc

SEQ ID NO: 124469 - RNA, 20 nt, Artificial Sequence
  MKO10124469_B_Ubtfl1
  gRNA
cugcucuguucguccaaacu

SEQ ID NO: 124470 - RNA, 20 nt, Artificial Sequence
  MKO10124470_B_Ubtfl1
  gRNA
agauuccucagggacuauuc

SEQ ID NO: 124471 - RNA, 20 nt, Artificial Sequence
  MKO10124471_B_Ubtf
  gRNA
gggacccauaccuuggccuu

SEQ ID NO: 124472 - RNA, 20 nt, Artificial Sequence
  MKO10124472_B_Ubtf
  gRNA
agguccagguugcucaucuc

SEQ ID NO: 124473 - RNA, 20 nt, Artificial Sequence
  MKO10124473_B_Ubtf
  gRNA
cuggagaaugaacggagaag

SEQ ID NO: 124474 - RNA, 20 nt, Artificial Sequence
  MKO10124474_B_Ubxn10
  gRNA
cgaccuccagaccguccucg

SEQ ID NO: 124475 - RNA, 20 nt, Artificial Sequence
  MKO10124475_B_Ubxn10
  gRNA
ugaaauagcgcacgaaccuu

SEQ ID NO: 124476 - RNA, 20 nt, Artificial Sequence
  MKO10124476_B_Ubxn10
  gRNA
guccgacggcuccucgaugu

SEQ ID NO: 124477 - RNA, 20 nt, Artificial Sequence
  MKO10124477_B_Ubxn11
  gRNA
gaacgacgagaugcugucca

SEQ ID NO: 124478 - RNA, 20 nt, Artificial Sequence
  MKO10124478_B_Ubxn11
  gRNA
agacgagggauaagagucua

SEQ ID NO: 124479 - RNA, 20 nt, Artificial Sequence
  MKO10124479_B_Ubxn11
  gRNA
gcaucggugccccugugagu

SEQ ID NO: 124480 - RNA, 20 nt, Artificial Sequence
  MKO10124480_B_Ubxn1
  gRNA
cccacgcccucagagcaagu

SEQ ID NO: 124481 - RNA, 20 nt, Artificial Sequence
  MKO10124481_B_Ubxn1
  gRNA
cacagggaaccagggcaucg

SEQ ID NO: 124482 - RNA, 20 nt, Artificial Sequence
  MKO10124482_B_Ubxn1
  gRNA
ccaucgcagccucgaugccc

SEQ ID NO: 124483 - RNA, 20 nt, Artificial Sequence
  MKO10124483_B_Ubxn2a
  gRNA
guuucugaacuccaucaaaa

SEQ ID NO: 124484 - RNA, 20 nt, Artificial Sequence
  MKO10124484_B_Ubxn2a
  gRNA
uaccuguuucuucuguucag

SEQ ID NO: 124485 - RNA, 20 nt, Artificial Sequence
  MKO10124485_B_Ubxn2a
  gRNA
ccucaaugauaaucaacaaa

SEQ ID NO: 124486 - RNA, 20 nt, Artificial Sequence
  MKO10124486_B_Ubxn2b
  gRNA
auacucugaucgcuuguaga

SEQ ID NO: 124487 - RNA, 20 nt, Artificial Sequence
  MKO10124487_B_Ubxn2b
  gRNA
aaugguuucaguuuagacga

SEQ ID NO: 124488 - RNA, 20 nt, Artificial Sequence
  MKO10124488_B_Ubxn2b
  gRNA
cauauaguucaaccuccaac

SEQ ID NO: 124489 - RNA, 20 nt, Artificial Sequence
  MKO10124489_B_Ubxn4
  gRNA
aauuugugaaaacugcagac

SEQ ID NO: 124490 - RNA, 20 nt, Artificial Sequence
  MKO10124490_B_Ubxn4
  gRNA
acaaagucagauacugcaac

SEQ ID NO: 124491 - RNA, 20 nt, Artificial Sequence
  MKO10124491_B_Ubxn4
  gRNA
ugaugagcaaucuauacaaa

SEQ ID NO: 124492 - RNA, 20 nt, Artificial Sequence
  MKO10124492_B_Ubxn6
  gRNA
ccgucagggccccacugaug

SEQ ID NO: 124493 - RNA, 20 nt, Artificial Sequence
  MKO10124493_B_Ubxn6
  gRNA
acaggauggccugcuugaug

SEQ ID NO: 124494 - RNA, 20 nt, Artificial Sequence
  MKO10124494_B_Ubxn6
  gRNA
gccaccuccagcaacaaucc

SEQ ID NO: 124495 - RNA, 20 nt, Artificial Sequence
  MKO10124495_B_Ubxn7
  gRNA
ccagcacguucaauauuuga

SEQ ID NO: 124496 - RNA, 20 nt, Artificial Sequence
  MKO10124496_B_Ubxn7
  gRNA
ugaagcuuguaacaacaacc

SEQ ID NO: 124497 - RNA, 20 nt, Artificial Sequence
  MKO10124497_B_Ubxn7
  gRNA
aguagagacgcuugcugaac

SEQ ID NO: 124498 - RNA, 20 nt, Artificial Sequence
  MKO10124498_B_Ubxn8
  gRNA
guucucuaaccucuaggagu

SEQ ID NO: 124499 - RNA, 20 nt, Artificial Sequence
  MKO10124499_B_Ubxn8
  gRNA
gagaccuggaagcugaccgc

SEQ ID NO: 124500 - RNA, 20 nt, Artificial Sequence
  MKO10124500_B_Ubxn8
  gRNA
ugagccuuaccuucucaccc

SEQ ID NO: 124501 - RNA, 20 nt, Artificial Sequence
  MKO10124501_B_Uchl1
  gRNA
cuggccggcgacccccagcu

SEQ ID NO: 124502 - RNA, 20 nt, Artificial Sequence
  MKO10124502_B_Uchl1
  gRNA
caaguguuucgagaagaacg

SEQ ID NO: 124503 - RNA, 20 nt, Artificial Sequence
  MKO10124503_B_Uchl1
  gRNA
cucguucuucucgaaacacu

SEQ ID NO: 124504 - RNA, 20 nt, Artificial Sequence
  MKO10124504_B_Uchl3
  gRNA
uacugacgucauaguucucc

SEQ ID NO: 124505 - RNA, 20 nt, Artificial Sequence
  MKO10124505_B_Uchl3
  gRNA
gguaccaugcuaagaaguuc

SEQ ID NO: 124506 - RNA, 20 nt, Artificial Sequence
  MKO10124506_B_Uchl3
  gRNA
aacaaagacaagaugcacuu

SEQ ID NO: 124507 - RNA, 20 nt, Artificial Sequence
  MKO10124507_B_Uchl4
  gRNA
aucucuaugaauuagaugga

SEQ ID NO: 124508 - RNA, 20 nt, Artificial Sequence
  MKO10124508_B_Uchl4
  gRNA
ugaagagagagccaaauacc

SEQ ID NO: 124509 - RNA, 20 nt, Artificial Sequence
  MKO10124509_B_Uchl4
  gRNA
aggaguaacacugcgcacac

SEQ ID NO: 124510 - RNA, 20 nt, Artificial Sequence
  MKO10124510_B_Uchl5
  gRNA
agcuccauauuucuucuacu

SEQ ID NO: 124511 - RNA, 20 nt, Artificial Sequence
  MKO10124511_B_Uchl5
  gRNA
agaaaaauuaacccaugaac

SEQ ID NO: 124512 - RNA, 20 nt, Artificial Sequence
  MKO10124512_B_Uchl5
  gRNA
agaagaaccugcuggcucug

SEQ ID NO: 124513 - RNA, 20 nt, Artificial Sequence
  MKO10124513_B_Uck1
  gRNA
aacagugugugagaagauca

SEQ ID NO: 124514 - RNA, 20 nt, Artificial Sequence
  MKO10124514_B_Uck1
  gRNA
guacugucccuucaaagccu

SEQ ID NO: 124515 - RNA, 20 nt, Artificial Sequence
  MKO10124515_B_Uck1
  gRNA
acccugaaaaacauuguuga

SEQ ID NO: 124516 - RNA, 20 nt, Artificial Sequence
  MKO10124516_B_Uck2
  gRNA
ggacucgguagaagcuaucc

SEQ ID NO: 124517 - RNA, 20 nt, Artificial Sequence
  MKO10124517_B_Uck2
  gRNA
gugggagacaaagucguaca

SEQ ID NO: 124518 - RNA, 20 nt, Artificial Sequence
  MKO10124518_B_Uck2
  gRNA
gaagaugaguucguugucaa

SEQ ID NO: 124519 - RNA, 20 nt, Artificial Sequence
  MKO10124519_B_Uckl1
  gRNA
uugaggcacuagaugugccc

SEQ ID NO: 124520 - RNA, 20 nt, Artificial Sequence
  MKO10124520_B_Uckl1
  gRNA
caccuuauagaaggagucca

SEQ ID NO: 124521 - RNA, 20 nt, Artificial Sequence
  MKO10124521_B_Uckl1
  gRNA
aaugaugagaucgaagucaa

SEQ ID NO: 124522 - RNA, 20 nt, Artificial Sequence
  MKO10124522_B_Ucma
  gRNA
uuuaaugaggucagauguuu

SEQ ID NO: 124523 - RNA, 20 nt, Artificial Sequence
  MKO10124523_B_Ucma
  gRNA
acucacuacacaggagcacc

SEQ ID NO: 124524 - RNA, 20 nt, Artificial Sequence
  MKO10124524_B_Ucma
  gRNA
gccacugcuccacagccucc

SEQ ID NO: 124525 - RNA, 20 nt, Artificial Sequence
  MKO10124525_B_Ucn2
  gRNA
agucucagcggcggccaaca

SEQ ID NO: 124526 - RNA, 20 nt, Artificial Sequence
  MKO10124526_B_Ucn2
  gRNA
auaggauccuauccaacauc

SEQ ID NO: 124527 - RNA, 20 nt, Artificial Sequence
  MKO10124527_B_Ucn2
  gRNA
cauccagggagaguaugaca

SEQ ID NO: 124528 - RNA, 20 nt, Artificial Sequence
  MKO10124528_B_Ucn3
  gRNA
ucccacaaguucuacaacac

SEQ ID NO: 124529 - RNA, 20 nt, Artificial Sequence
  MKO10124529_B_Ucn3
  gRNA
gccgcgggugggaauggagc

SEQ ID NO: 124530 - RNA, 20 nt, Artificial Sequence
  MKO10124530_B_Ucn3
  gRNA
uccaguguuguagaacuugu

SEQ ID NO: 124531 - RNA, 20 nt, Artificial Sequence
  MKO10124531_B_Ucn
  gRNA
ccgcccugauuccgcacucc

SEQ ID NO: 124532 - RNA, 20 nt, Artificial Sequence
  MKO10124532_B_Ucn
  gRNA
agcgcuccgcuaacagcaag

SEQ ID NO: 124533 - RNA, 20 nt, Artificial Sequence
  MKO10124533_B_Ucn
  gRNA
caggcggcaccaugauacag

SEQ ID NO: 124534 - RNA, 20 nt, Artificial Sequence
  MKO10124534_B_Ucp1
  gRNA
aucucagccggcuuaaugac

SEQ ID NO: 124535 - RNA, 20 nt, Artificial Sequence
  MKO10124535_B_Ucp1
  gRNA
uccaguaccauuagguauaa

SEQ ID NO: 124536 - RNA, 20 nt, Artificial Sequence
  MKO10124536_B_Ucp1
  gRNA
guucauugggcagccuacag

SEQ ID NO: 124537 - RNA, 20 nt, Artificial Sequence
  MKO10124537_B_Ucp2
  gRNA
gggaccccgcgccuucuaca

SEQ ID NO: 124538 - RNA, 20 nt, Artificial Sequence
  MKO10124538_B_Ucp2
  gRNA
caucgccuccccuguugaug

SEQ ID NO: 124539 - RNA, 20 nt, Artificial Sequence
  MKO10124539_B_Ucp2
  gRNA
cucucgugcaauggucuugu

SEQ ID NO: 124540 - RNA, 20 nt, Artificial Sequence
  MKO10124540_B_Ucp3
  gRNA
cuuuaccacauccaccgggg

SEQ ID NO: 124541 - RNA, 20 nt, Artificial Sequence
  MKO10124541_B_Ucp3
  gRNA
gccagcgaccaguccgcugu

SEQ ID NO: 124542 - RNA, 20 nt, Artificial Sequence
  MKO10124542_B_Ucp3
  gRNA
ccucugugcgcaccauaguc

SEQ ID NO: 124543 - RNA, 20 nt, Artificial Sequence
  MKO10124543_B_Uevld
  gRNA
uacuuacccugauacaucac

SEQ ID NO: 124544 - RNA, 20 nt, Artificial Sequence
  MKO10124544_B_Uevld
  gRNA
acuugcccuaucuccaaaac

SEQ ID NO: 124545 - RNA, 20 nt, Artificial Sequence
  MKO10124545_B_Uevld
  gRNA
cagcccaaaucugccaucgu

SEQ ID NO: 124546 - RNA, 20 nt, Artificial Sequence
  MKO10124546_B_Ufc1
  gRNA
gcaggugguuuggaaaaugc

SEQ ID NO: 124547 - RNA, 20 nt, Artificial Sequence
  MKO10124547_B_Ufc1
  gRNA
guuccgacuggaguccaaca

SEQ ID NO: 124548 - RNA, 20 nt, Artificial Sequence
  MKO10124548_B_Ufc1
  gRNA
gccaggaaugugccuaaguu

SEQ ID NO: 124549 - RNA, 20 nt, Artificial Sequence
  MKO10124549_B_Ufd1l
  gRNA
aguacuuacugaguugaucg

SEQ ID NO: 124550 - RNA, 20 nt, Artificial Sequence
  MKO10124550_B_Ufd1l
  gRNA
uugguaauauccaggaaguc

SEQ ID NO: 124551 - RNA, 20 nt, Artificial Sequence
  MKO10124551_B_Ufd1l
  gRNA
cauccgaucugaauucuuau

SEQ ID NO: 124552 - RNA, 20 nt, Artificial Sequence
  MKO10124552_B_Ufl1
  gRNA
ucuggaucaguuaucagaag

SEQ ID NO: 124553 - RNA, 20 nt, Artificial Sequence
  MKO10124553_B_Ufl1
  gRNA
aaacauuguugacuuacaac

SEQ ID NO: 124554 - RNA, 20 nt, Artificial Sequence
  MKO10124554_B_Ufl1
  gRNA
accugugucagaaaaucccc

SEQ ID NO: 124555 - RNA, 20 nt, Artificial Sequence
  MKO10124555_B_Ufm1
  gRNA
acaagugcgauuauuacuaa

SEQ ID NO: 124556 - RNA, 20 nt, Artificial Sequence
  MKO10124556_B_Ufm1
  gRNA
cacucaccagcagucugugc

SEQ ID NO: 124557 - RNA, 20 nt, Artificial Sequence
  MKO10124557_B_Ufm1
  gRNA
aacuuuagcacugcugugaa

SEQ ID NO: 124558 - RNA, 20 nt, Artificial Sequence
  MKO10124558_B_Ufsp1
  gRNA
cguugugaacuacaagcugc

SEQ ID NO: 124559 - RNA, 20 nt, Artificial Sequence
  MKO10124559_B_Ufsp1
  gRNA
ggccaguccucgggcgugcc

SEQ ID NO: 124560 - RNA, 20 nt, Artificial Sequence
  MKO10124560_B_Ufsp1
  gRNA
ugcgauggacuggaugaccg

SEQ ID NO: 124561 - RNA, 20 nt, Artificial Sequence
  MKO10124561_B_Ufsp2
  gRNA
cagagugcgcaaacuucuag

SEQ ID NO: 124562 - RNA, 20 nt, Artificial Sequence
  MKO10124562_B_Ufsp2
  gRNA
cguuuaccuuucgauaggcu

SEQ ID NO: 124563 - RNA, 20 nt, Artificial Sequence
  MKO10124563_B_Ufsp2
  gRNA
gggagccguaacccccaucc

SEQ ID NO: 124564 - RNA, 20 nt, Artificial Sequence
  MKO10124564_B_Ugcg
  gRNA
ccuugucugucggcuacaua

SEQ ID NO: 124565 - RNA, 20 nt, Artificial Sequence
  MKO10124565_B_Ugcg
  gRNA
ccgguuacaccucaacaaga

SEQ ID NO: 124566 - RNA, 20 nt, Artificial Sequence
  MKO10124566_B_Ugcg
  gRNA
caucaugaucuuguacacaa

SEQ ID NO: 124567 - RNA, 20 nt, Artificial Sequence
  MKO10124567_B_Ugdh
  gRNA
augcuuucugcugcccgcac

SEQ ID NO: 124568 - RNA, 20 nt, Artificial Sequence
  MKO10124568_B_Ugdh
  gRNA
gaccagcuuggaaagcuccg

SEQ ID NO: 124569 - RNA, 20 nt, Artificial Sequence
  MKO10124569_B_Ugdh
  gRNA
ccaaugcauuucuugcgcag

SEQ ID NO: 124570 - RNA, 20 nt, Artificial Sequence
  MKO10124570_B_Uggu1
  gRNA
guugacgagccuccaccaga

SEQ ID NO: 124571 - RNA, 20 nt, Artificial Sequence
  MKO10124571_B_Uggu1
  gRNA
acgguaaggccagugcaauc

SEQ ID NO: 124572 - RNA, 20 nt, Artificial Sequence
  MKO10124572_B_Uggu1
  gRNA
caugagacuccugauugcac

SEQ ID NO: 124573 - RNA, 20 nt, Artificial Sequence
  MKO10124573_B_Uggu2
  gRNA
agaguaugcccuuauggaga

SEQ ID NO: 124574 - RNA, 20 nt, Artificial Sequence
  MKO10124574_B_Uggu2
  gRNA
ucugcauagagaacaaucac

SEQ ID NO: 124575 - RNA, 20 nt, Artificial Sequence
  MKO10124575_B_Uggu2
  gRNA
gauuaaaaagcugcugaaua

SEQ ID NO: 124576 - RNA, 20 nt, Artificial Sequence
  MKO10124576_B_Ugp2
  gRNA
aaaggcccuaaaagucugau

SEQ ID NO: 124577 - RNA, 20 nt, Artificial Sequence
  MKO10124577_B_Ugp2
  gRNA
ccuuaccucaaacucaugug

SEQ ID NO: 124578 - RNA, 20 nt, Artificial Sequence
  MKO10124578_B_Ugp2
  gRNA
ucuacaccuucaaucaaagc

SEQ ID NO: 124579 - RNA, 20 nt, Artificial Sequence
  MKO10124579_B_Ugu1a10
  gRNA
uguccaucugaucgccaaau

SEQ ID NO: 124580 - RNA, 20 nt, Artificial Sequence
  MKO10124580_B_Ugu1a10
  gRNA
gaagccuaugucaacgccuc

SEQ ID NO: 124581 - RNA, 20 nt, Artificial Sequence
  MKO10124581_B_Ugu1a10
  gRNA
guguucuuugcaagauucga

SEQ ID NO: 124582 - RNA, 20 nt, Artificial Sequence
  MKO10124582_B_Ugu1a1
  gRNA
uguccaucugaucgccaaau

SEQ ID NO: 124583 - RNA, 20 nt, Artificial Sequence
  MKO10124583_B_Ugu1a1
  gRNA
gaagccuaugucaacgccuc

SEQ ID NO: 124584 - RNA, 20 nt, Artificial Sequence
  MKO10124584_B_Ugu1a1
  gRNA
guguucuuugcaagauucga

SEQ ID NO: 124585 - RNA, 20 nt, Artificial Sequence
  MKO10124585_B_Ugu1a2
  gRNA
uguccaucugaucgccaaau

SEQ ID NO: 124586 - RNA, 20 nt, Artificial Sequence
  MKO10124586_B_Ugu1a2
  gRNA
gaagccuaugucaacgccuc

SEQ ID NO: 124587 - RNA, 20 nt, Artificial Sequence
  MKO10124587_B_Ugu1a2
  gRNA
guguucuuugcaagauucga

SEQ ID NO: 124588 - RNA, 20 nt, Artificial Sequence
  MKO10124588_B_Ugu1a5
  gRNA
uguccaucugaucgccaaau

SEQ ID NO: 124589 - RNA, 20 nt, Artificial Sequence
  MKO10124589_B_Ugu1a5
  gRNA
gaagccuaugucaacgccuc

SEQ ID NO: 124590 - RNA, 20 nt, Artificial Sequence
  MKO10124590_B_Ugu1a5
  gRNA
guguucuuugcaagauucga

SEQ ID NO: 124591 - RNA, 20 nt, Artificial Sequence
  MKO10124591_B_Ugu1a6a
  gRNA
uguccaucugaucgccaaau

SEQ ID NO: 124592 - RNA, 20 nt, Artificial Sequence
  MKO10124592_B_Ugu1a6a
  gRNA
gaagccuaugucaacgccuc

SEQ ID NO: 124593 - RNA, 20 nt, Artificial Sequence
  MKO10124593_B_Ugu1a6a
  gRNA
guguucuuugcaagauucga

SEQ ID NO: 124594 - RNA, 20 nt, Artificial Sequence
  MKO10124594_B_Ugu1a6b
  gRNA
uguccaucugaucgccaaau

SEQ ID NO: 124595 - RNA, 20 nt, Artificial Sequence
  MKO10124595_B_Ugu1a6b
  gRNA
gaagccuaugucaacgccuc

SEQ ID NO: 124596 - RNA, 20 nt, Artificial Sequence
  MKO10124596_B_Ugu1a6b
  gRNA
guguucuuugcaagauucga

SEQ ID NO: 124597 - RNA, 20 nt, Artificial Sequence
  MKO10124597_B_Ugu1a7c
  gRNA
uguccaucugaucgccaaau

SEQ ID NO: 124598 - RNA, 20 nt, Artificial Sequence
  MKO10124598_B_Ugu1a7c
  gRNA
gaagccuaugucaacgccuc

SEQ ID NO: 124599 - RNA, 20 nt, Artificial Sequence
  MKO10124599_B_Ugu1a7c
  gRNA
guguucuuugcaagauucga

SEQ ID NO: 124600 - RNA, 20 nt, Artificial Sequence
  MKO10124600_B_Ugu1a9
  gRNA
uguccaucugaucgccaaau

SEQ ID NO: 124601 - RNA, 20 nt, Artificial Sequence
  MKO10124601_B_Ugu1a9
  gRNA
gaagccuaugucaacgccuc

SEQ ID NO: 124602 - RNA, 20 nt, Artificial Sequence
  MKO10124602_B_Ugu1a9
  gRNA
guguucuuugcaagauucga

SEQ ID NO: 124603 - RNA, 20 nt, Artificial Sequence
  MKO10124603_B_Ugu2a1
  gRNA
uuuggcuaaugcgaaccuau

SEQ ID NO: 124604 - RNA, 20 nt, Artificial Sequence
  MKO10124604_B_Ugu2a1
  gRNA
ccccauagucucacacagug

SEQ ID NO: 124605 - RNA, 20 nt, Artificial Sequence
  MKO10124605_B_Ugu2a1
  gRNA
uggaacaaauggaaucuaug

SEQ ID NO: 124606 - RNA, 20 nt, Artificial Sequence
  MKO10124606_B_Ugu2a2
  gRNA
uuuggcuaaugcgaaccuau

SEQ ID NO: 124607 - RNA, 20 nt, Artificial Sequence
  MKO10124607_B_Ugu2a2
  gRNA
ccccauagucucacacagug

SEQ ID NO: 124608 - RNA, 20 nt, Artificial Sequence
  MKO10124608_B_Ugu2a2
  gRNA
uggaacaaauggaaucuaug

SEQ ID NO: 124609 - RNA, 20 nt, Artificial Sequence
  MKO10124609_B_Ugu2a3
  gRNA
uaccaaccuucuggggaauc

SEQ ID NO: 124610 - RNA, 20 nt, Artificial Sequence
  MKO10124610_B_Ugu2a3
  gRNA
ccacauuaggauccaauacu

SEQ ID NO: 124611 - RNA, 20 nt, Artificial Sequence
  MKO10124611_B_Ugu2a3
  gRNA
cacaacguucuguaagacug

SEQ ID NO: 124612 - RNA, 20 nt, Artificial Sequence
  MKO10124612_B_Ugu2b1
  gRNA
uguagaguuaccuuaggcag

SEQ ID NO: 124613 - RNA, 20 nt, Artificial Sequence
  MKO10124613_B_Ugu2b1
  gRNA
gucauuaaugacagucuuca

SEQ ID NO: 124614 - RNA, 20 nt, Artificial Sequence
  MKO10124614_B_Ugu2b1
  gRNA
auguuaccuucuguggaauc

SEQ ID NO: 124615 - RNA, 20 nt, Artificial Sequence
  MKO10124615_B_Ugu2b34
  gRNA
ccaacacucgucuguacaaa

SEQ ID NO: 124616 - RNA, 20 nt, Artificial Sequence
  MKO10124616_B_Ugu2b34
  gRNA
gaucuaccaugggauuccag

SEQ ID NO: 124617 - RNA, 20 nt, Artificial Sequence
  MKO10124617_B_Ugu2b34
  gRNA
agagccaaugugauugcagc

SEQ ID NO: 124618 - RNA, 20 nt, Artificial Sequence
  MKO10124618_B_Ugu2b35
  gRNA
uagguucuuuggcgauuuga

SEQ ID NO: 124619 - RNA, 20 nt, Artificial Sequence
  MKO10124619_B_Ugu2b35
  gRNA
cgcgccaccaugaguuacaa

SEQ ID NO: 124620 - RNA, 20 nt, Artificial Sequence
  MKO10124620_B_Ugu2b35
  gRNA
ucuuaccgagaaggucauuc

SEQ ID NO: 124621 - RNA, 20 nt, Artificial Sequence
  MKO10124621_B_Ugu2b36
  gRNA
cuuccccaaaaugaucuucu

SEQ ID NO: 124622 - RNA, 20 nt, Artificial Sequence
  MKO10124622_B_Ugu2b36
  gRNA
ucuuaccaagaagaucauuu

SEQ ID NO: 124623 - RNA, 20 nt, Artificial Sequence
  MKO10124623_B_Ugu2b36
  gRNA
aagagcccaugcaauugcau

SEQ ID NO: 124624 - RNA, 20 nt, Artificial Sequence
  MKO10124624_B_Ugu2b37
  gRNA
aaaaagucaacgcaauugca

SEQ ID NO: 124625 - RNA, 20 nt, Artificial Sequence
  MKO10124625_B_Ugu2b37
  gRNA
acaauacaagaguguacaag

SEQ ID NO: 124626 - RNA, 20 nt, Artificial Sequence
  MKO10124626_B_Ugu2b37
  gRNA
caccaccuuagcugagacaa

SEQ ID NO: 124627 - RNA, 20 nt, Artificial Sequence
  MKO10124627_B_Ugu2b38
  gRNA
aaaaagccaacacaauugca

SEQ ID NO: 124628 - RNA, 20 nt, Artificial Sequence
  MKO10124628_B_Ugu2b38
  gRNA
acaauacgagaguguacaag

SEQ ID NO: 124629 - RNA, 20 nt, Artificial Sequence
  MKO10124629_B_Ugu2b38
  gRNA
aguauauuuaccuuaggcaa

SEQ ID NO: 124630 - RNA, 20 nt, Artificial Sequence
  MKO10124630_B_Ugu2b5
  gRNA
aaaaagccaacgcaauugca

SEQ ID NO: 124631 - RNA, 20 nt, Artificial Sequence
  MKO10124631_B_Ugu2b5
  gRNA
aaccaccuuaguugagacaa

SEQ ID NO: 124632 - RNA, 20 nt, Artificial Sequence
  MKO10124632_B_Ugu2b5
  gRNA
acaauaccagaguguacaag

SEQ ID NO: 124633 - RNA, 20 nt, Artificial Sequence
  MKO10124633_B_Ugu3a1
  gRNA
uucauuucaccaagaagcga

SEQ ID NO: 124634 - RNA, 20 nt, Artificial Sequence
  MKO10124634_B_Ugu3a1
  gRNA
cuugcagaauuugcgacaca

SEQ ID NO: 124635 - RNA, 20 nt, Artificial Sequence
  MKO10124635_B_Ugu3a1
  gRNA
caucauaccagguuauuaau

SEQ ID NO: 124636 - RNA, 20 nt, Artificial Sequence
  MKO10124636_B_Ugu3a2
  gRNA
gugucgcaaguucuucauga

SEQ ID NO: 124637 - RNA, 20 nt, Artificial Sequence
  MKO10124637_B_Ugu3a2
  gRNA
uuaccuagaaggucagucug

SEQ ID NO: 124638 - RNA, 20 nt, Artificial Sequence
  MKO10124638_B_Ugu3a2
  gRNA
caucauaucaaguuauuaau

SEQ ID NO: 124639 - RNA, 20 nt, Artificial Sequence
  MKO10124639_B_Ugu8a
  gRNA
ugauacuaugacuagaguac

SEQ ID NO: 124640 - RNA, 20 nt, Artificial Sequence
  MKO10124640_B_Ugu8a
  gRNA
acaacacuaagcucauagaa

SEQ ID NO: 124641 - RNA, 20 nt, Artificial Sequence
  MKO10124641_B_Ugu8a
  gRNA
gauugccucaaaaagugauu

SEQ ID NO: 124642 - RNA, 20 nt, Artificial Sequence
  MKO10124642_B_Uhmk1
  gRNA
guaccucagcuguugaucug

SEQ ID NO: 124643 - RNA, 20 nt, Artificial Sequence
  MKO10124643_B_Uhmk1
  gRNA
uagcaugcuucaugaugacc

SEQ ID NO: 124644 - RNA, 20 nt, Artificial Sequence
  MKO10124644_B_Uhmk1
  gRNA
uauauuugccaguaaagcag

SEQ ID NO: 124645 - RNA, 20 nt, Artificial Sequence
  MKO10124645_B_Uhrf1bp1l
  gRNA
acggagaccugagauuuacu

SEQ ID NO: 124646 - RNA, 20 nt, Artificial Sequence
  MKO10124646_B_Uhrf1bp1l
  gRNA
auaaaccucagcacccuuaa

SEQ ID NO: 124647 - RNA, 20 nt, Artificial Sequence
  MKO10124647_B_Uhrf1bp1l
  gRNA
ucugcaauaaagccuccauc

SEQ ID NO: 124648 - RNA, 20 nt, Artificial Sequence
  MKO10124648_B_Uhrf1bp1
  gRNA
auugcaguagacccuaguga

SEQ ID NO: 124649 - RNA, 20 nt, Artificial Sequence
  MKO10124649_B_Uhrf1bp1
  gRNA
cugcaaucgggccuccaucc

SEQ ID NO: 124650 - RNA, 20 nt, Artificial Sequence
  MKO10124650_B_Uhrf1bp1
  gRNA
gucuccuaucgcccuugccu

SEQ ID NO: 124651 - RNA, 20 nt, Artificial Sequence
  MKO10124651_B_Uhrf1
  gRNA
gugcucgcacugugauacca

SEQ ID NO: 124652 - RNA, 20 nt, Artificial Sequence
  MKO10124652_B_Uhrf1
  gRNA
cuccagugccguuaagaccu

SEQ ID NO: 124653 - RNA, 20 nt, Artificial Sequence
  MKO10124653_B_Uhrf1
  gRNA
caucauaaucgaagagugug

SEQ ID NO: 124654 - RNA, 20 nt, Artificial Sequence
  MKO10124654_B_Uhrf2
  gRNA
accuuauauaguccaaagcc

SEQ ID NO: 124655 - RNA, 20 nt, Artificial Sequence
  MKO10124655_B_Uhrf2
  gRNA
aucucuaguauaccacuuuc

SEQ ID NO: 124656 - RNA, 20 nt, Artificial Sequence
  MKO10124656_B_Uhrf2
  gRNA
aucuucaagauugagaagcc

SEQ ID NO: 124657 - RNA, 20 nt, Artificial Sequence
  MKO10124657_B_Uimc1
  gRNA
gucgaacagaucaaaguguu

SEQ ID NO: 124658 - RNA, 20 nt, Artificial Sequence
  MKO10124658_B_Uimc1
  gRNA
gaagauaguucagcagccag

SEQ ID NO: 124659 - RNA, 20 nt, Artificial Sequence
  MKO10124659_B_Uimc1
  gRNA
uacauucaggcuuucagcaa

SEQ ID NO: 124660 - RNA, 20 nt, Artificial Sequence
  MKO10124660_B_Ulbp1
  gRNA
uacgccauuguuagccucaa

SEQ ID NO: 124661 - RNA, 20 nt, Artificial Sequence
  MKO10124661_B_Ulbp1
  gRNA
guccucaccaccaccucucu

SEQ ID NO: 124662 - RNA, 20 nt, Artificial Sequence
  MKO10124662_B_Ulbp1
  gRNA
gucaaagagucauccaagag

SEQ ID NO: 124663 - RNA, 20 nt, Artificial Sequence
  MKO10124663_B_Ulk1
  gRNA
gggaacucaccuccaugacc

SEQ ID NO: 124664 - RNA, 20 nt, Artificial Sequence
  MKO10124664_B_Ulk1
  gRNA
cuucuuguuaaugcauuuga

SEQ ID NO: 124665 - RNA, 20 nt, Artificial Sequence
  MKO10124665_B_Ulk1
  gRNA
ugccaagucccaaacacugc

SEQ ID NO: 124666 - RNA, 20 nt, Artificial Sequence
  MKO10124666_B_Ulk2
  gRNA
auugcccaacucugucuuuc

SEQ ID NO: 124667 - RNA, 20 nt, Artificial Sequence
  MKO10124667_B_Ulk2
  gRNA
ucaaaaucacaaauucugcu

SEQ ID NO: 124668 - RNA, 20 nt, Artificial Sequence
  MKO10124668_B_Ulk2
  gRNA
caucaccagaaagacagagu

SEQ ID NO: 124669 - RNA, 20 nt, Artificial Sequence
  MKO10124669_B_Ulk3
  gRNA
agugguagccauaaaaugcg

SEQ ID NO: 124670 - RNA, 20 nt, Artificial Sequence
  MKO10124670_B_Ulk3
  gRNA
cucgcuucauucauacccgc

SEQ ID NO: 124671 - RNA, 20 nt, Artificial Sequence
  MKO10124671_B_Ulk3
  gRNA
gagucucaacaaggcgucag

SEQ ID NO: 124672 - RNA, 20 nt, Artificial Sequence
  MKO10124672_B_Ulk4
  gRNA
acgagaccagcaaucaucuc

SEQ ID NO: 124673 - RNA, 20 nt, Artificial Sequence
  MKO10124673_B_Ulk4
  gRNA
caccaaccagagaugauugc

SEQ ID NO: 124674 - RNA, 20 nt, Artificial Sequence
  MKO10124674_B_Ulk4
  gRNA
guagacagcccaaagaccag

SEQ ID NO: 124675 - RNA, 20 nt, Artificial Sequence
  MKO10124675_B_Umodl1
  gRNA
cacgcgccugcucuacucuu

SEQ ID NO: 124676 - RNA, 20 nt, Artificial Sequence
  MKO10124676_B_Umodl1
  gRNA
cuucgaggaccugcagcgag

SEQ ID NO: 124677 - RNA, 20 nt, Artificial Sequence
  MKO10124677_B_Umodl1
  gRNA
acucagggacauccaucgcu

SEQ ID NO: 124678 - RNA, 20 nt, Artificial Sequence
  MKO10124678_B_Umod
  gRNA
gaaugaugaucgcauuugcc

SEQ ID NO: 124679 - RNA, 20 nt, Artificial Sequence
  MKO10124679_B_Umod
  gRNA
uucuucgcaaguccccucca

SEQ ID NO: 124680 - RNA, 20 nt, Artificial Sequence
  MKO10124680_B_Umod
  gRNA
acuccagccuguacuccaau

SEQ ID NO: 124681 - RNA, 20 nt, Artificial Sequence
  MKO10124681_B_Umps
  gRNA
gagcagauaacugucgccag

SEQ ID NO: 124682 - RNA, 20 nt, Artificial Sequence
  MKO10124682_B_Umps
  gRNA
uccuuauacagcguuaccac

SEQ ID NO: 124683 - RNA, 20 nt, Artificial Sequence
  MKO10124683_B_Umps
  gRNA
agcucauuucugcaaugagc

SEQ ID NO: 124684 - RNA, 20 nt, Artificial Sequence
  MKO10124684_B_Unc119b
  gRNA
ccgcuucaagauucgagauc

SEQ ID NO: 124685 - RNA, 20 nt, Artificial Sequence
  MKO10124685_B_Unc119b
  gRNA
auugccaagccgugcaucuc

SEQ ID NO: 124686 - RNA, 20 nt, Artificial Sequence
  MKO10124686_B_Unc119b
  gRNA
ugaacugauaucgaacgaaa

SEQ ID NO: 124687 - RNA, 20 nt, Artificial Sequence
  MKO10124687_B_Unc119
  gRNA
ucuacaagauugacuucguc

SEQ ID NO: 124688 - RNA, 20 nt, Artificial Sequence
  MKO10124688_B_Unc119
  gRNA
aucccacucacccgaaacag

SEQ ID NO: 124689 - RNA, 20 nt, Artificial Sequence
  MKO10124689_B_Unc119
  gRNA
aguagugccucucgaucaug

SEQ ID NO: 124690 - RNA, 20 nt, Artificial Sequence
  MKO10124690_B_Unc13a
  gRNA
cgcucauuucgagcugccgu

SEQ ID NO: 124691 - RNA, 20 nt, Artificial Sequence
  MKO10124691_B_Unc13a
  gRNA
acacagugagaucaaccgcc

SEQ ID NO: 124692 - RNA, 20 nt, Artificial Sequence
  MKO10124692_B_Unc13a
  gRNA
ugucacucaccucauuggac

SEQ ID NO: 124693 - RNA, 20 nt, Artificial Sequence
  MKO10124693_B_Unc13b
  gRNA
agcacaacuguagcaguucg

SEQ ID NO: 124694 - RNA, 20 nt, Artificial Sequence
  MKO10124694_B_Unc13b
  gRNA
augucgcugcucugugugcg

SEQ ID NO: 124695 - RNA, 20 nt, Artificial Sequence
  MKO10124695_B_Unc13b
  gRNA
cagacuuaccuggugaaccc

SEQ ID NO: 124696 - RNA, 20 nt, Artificial Sequence
  MKO10124696_B_Unc13c
  gRNA
cucaccacaucccgcacaau

SEQ ID NO: 124697 - RNA, 20 nt, Artificial Sequence
  MKO10124697_B_Unc13c
  gRNA
ucuuccagauagcagcucua

SEQ ID NO: 124698 - RNA, 20 nt, Artificial Sequence
  MKO10124698_B_Unc13c
  gRNA
uucaaggcucgaauaguaag

SEQ ID NO: 124699 - RNA, 20 nt, Artificial Sequence
  MKO10124699_B_Unc13d
  gRNA
ugacgcgccgcagcaucugc

SEQ ID NO: 124700 - RNA, 20 nt, Artificial Sequence
  MKO10124700_B_Unc13d
  gRNA
gucccaccauuucuccccag

SEQ ID NO: 124701 - RNA, 20 nt, Artificial Sequence
  MKO10124701_B_Unc13d
  gRNA
gaaacaggccaaggguauuc

SEQ ID NO: 124702 - RNA, 20 nt, Artificial Sequence
  MKO10124702_B_Unc45a
  gRNA
gaacauugggggccagauuc

SEQ ID NO: 124703 - RNA, 20 nt, Artificial Sequence
  MKO10124703_B_Unc45a
  gRNA
uuacagcaaagcagaaucag

SEQ ID NO: 124704 - RNA, 20 nt, Artificial Sequence
  MKO10124704_B_Unc45a
  gRNA
acagauguuucagauacugu

SEQ ID NO: 124705 - RNA, 20 nt, Artificial Sequence
  MKO10124705_B_Unc45b
  gRNA
ugugcagcgcugugcuaccc

SEQ ID NO: 124706 - RNA, 20 nt, Artificial Sequence
  MKO10124706_B_Unc45b
  gRNA
ugccaacaaccucauugucc

SEQ ID NO: 124707 - RNA, 20 nt, Artificial Sequence
  MKO10124707_B_Unc45b
  gRNA
ucucagcacccgcuucuuca

SEQ ID NO: 124708 - RNA, 20 nt, Artificial Sequence
  MKO10124708_B_Unc50
  gRNA
cagcacaaagccgaauccua

SEQ ID NO: 124709 - RNA, 20 nt, Artificial Sequence
  MKO10124709_B_Unc50
  gRNA
ggcguucagaugcacaucaa

SEQ ID NO: 124710 - RNA, 20 nt, Artificial Sequence
  MKO10124710_B_Unc50
  gRNA
uucugaucucaacguuaaug

SEQ ID NO: 124711 - RNA, 20 nt, Artificial Sequence
  MKO10124711_B_Unc5a
  gRNA
uugacaauguacacguccuc

SEQ ID NO: 124712 - RNA, 20 nt, Artificial Sequence
  MKO10124712_B_Unc5a
  gRNA
guucaaugacgugaucgacc

SEQ ID NO: 124713 - RNA, 20 nt, Artificial Sequence
  MKO10124713_B_Unc5a
  gRNA
gcugccuugauacguugauc

SEQ ID NO: 124714 - RNA, 20 nt, Artificial Sequence
  MKO10124714_B_Unc5b
  gRNA
ucuucgggcucgaggacuac

SEQ ID NO: 124715 - RNA, 20 nt, Artificial Sequence
  MKO10124715_B_Unc5b
  gRNA
uuuacgauguaggcguccug

SEQ ID NO: 124716 - RNA, 20 nt, Artificial Sequence
  MKO10124716_B_Unc5b
  gRNA
augauccaaggguaccuccu

SEQ ID NO: 124717 - RNA, 20 nt, Artificial Sequence
  MKO10124717_B_Unc5cl
  gRNA
cgagcacucuucauucccau

SEQ ID NO: 124718 - RNA, 20 nt, Artificial Sequence
  MKO10124718_B_Unc5cl
  gRNA
cccuccaggugcugugaccg

SEQ ID NO: 124719 - RNA, 20 nt, Artificial Sequence
  MKO10124719_B_Unc5cl
  gRNA
cuccacagguugggagaaug

SEQ ID NO: 124720 - RNA, 20 nt, Artificial Sequence
  MKO10124720_B_Unc5c
  gRNA
cauugagauuucacgccagc

SEQ ID NO: 124721 - RNA, 20 nt, Artificial Sequence
  MKO10124721_B_Unc5c
  gRNA
acagccacugucaucgugua

SEQ ID NO: 124722 - RNA, 20 nt, Artificial Sequence
  MKO10124722_B_Unc5c
  gRNA
cacuggcaccaguaaucuuc

SEQ ID NO: 124723 - RNA, 20 nt, Artificial Sequence
  MKO10124723_B_Unc5d
  gRNA
gguggcuccacgcuacacac

SEQ ID NO: 124724 - RNA, 20 nt, Artificial Sequence
  MKO10124724_B_Unc5d
  gRNA
ccuccucuuggccacgaugu

SEQ ID NO: 124725 - RNA, 20 nt, Artificial Sequence
  MKO10124725_B_Unc5d
  gRNA
accaguaguccucuggccca

SEQ ID NO: 124726 - RNA, 20 nt, Artificial Sequence
  MKO10124726_B_Unc79
  gRNA
uagcguugagaucaucgugu

SEQ ID NO: 124727 - RNA, 20 nt, Artificial Sequence
  MKO10124727_B_Unc79
  gRNA
uaugauauuccugcaaguac

SEQ ID NO: 124728 - RNA, 20 nt, Artificial Sequence
  MKO10124728_B_Unc79
  gRNA
uggaacuuacauauagccau

SEQ ID NO: 124729 - RNA, 20 nt, Artificial Sequence
  MKO10124729_B_Unc80
  gRNA
cugccauauaaccaacccac

SEQ ID NO: 124730 - RNA, 20 nt, Artificial Sequence
  MKO10124730_B_Unc80
  gRNA
gcaauaugaagccucuugug

SEQ ID NO: 124731 - RNA, 20 nt, Artificial Sequence
  MKO10124731_B_Unc80
  gRNA
uuccaccaacacucguucaa

SEQ ID NO: 124732 - RNA, 20 nt, Artificial Sequence
  MKO10124732_B_Unc93a
  gRNA
aggggcuguaccaguuggca

SEQ ID NO: 124733 - RNA, 20 nt, Artificial Sequence
  MKO10124733_B_Unc93a
  gRNA
gaucccuaccuccaucuugc

SEQ ID NO: 124734 - RNA, 20 nt, Artificial Sequence
  MKO10124734_B_Unc93a
  gRNA
caucuugccgaacaccagug

SEQ ID NO: 124735 - RNA, 20 nt, Artificial Sequence
  MKO10124735_B_Unc93b1
  gRNA
agcaucuugcuaucgauguc

SEQ ID NO: 124736 - RNA, 20 nt, Artificial Sequence
  MKO10124736_B_Unc93b1
  gRNA
ccggggccgcggguccucaa

SEQ ID NO: 124737 - RNA, 20 nt, Artificial Sequence
  MKO10124737_B_Unc93b1
  gRNA
ccuggugauauaguugccca

SEQ ID NO: 124738 - RNA, 20 nt, Artificial Sequence
  MKO10124738_B_Uncx
  gRNA
gggccaggcgacguuucgag

SEQ ID NO: 124739 - RNA, 20 nt, Artificial Sequence
  MKO10124739_B_Uncx
  gRNA
uucgggaccuuccccggacc

SEQ ID NO: 124740 - RNA, 20 nt, Artificial Sequence
  MKO10124740_B_Uncx
  gRNA
cguguuuaugcgcgaggcgc

SEQ ID NO: 124741 - RNA, 20 nt, Artificial Sequence
  MKO10124741_B_Ung
  gRNA
ccacaaggucuauccgcccc

SEQ ID NO: 124742 - RNA, 20 nt, Artificial Sequence
  MKO10124742_B_Ung
  gRNA
caucucggaugucgcacauc

SEQ ID NO: 124743 - RNA, 20 nt, Artificial Sequence
  MKO10124743_B_Ung
  gRNA
gagcugucuacagacaucga

SEQ ID NO: 124744 - RNA, 20 nt, Artificial Sequence
  MKO10124744_B_Unkl
  gRNA
aguccaagcgcagcuugcuc

SEQ ID NO: 124745 - RNA, 20 nt, Artificial Sequence
  MKO10124745_B_Unkl
  gRNA
agauaaagacuuagaagaac

SEQ ID NO: 124746 - RNA, 20 nt, Artificial Sequence
  MKO10124746_B_Unkl
  gRNA
ccauugccugaucuuccucu

SEQ ID NO: 124747 - RNA, 20 nt, Artificial Sequence
  MKO10124747_B_Unk
  gRNA
gccuaccugaugucguaaac

SEQ ID NO: 124748 - RNA, 20 nt, Artificial Sequence
  MKO10124748_B_Unk
  gRNA
gacgccgguccuugcuguug

SEQ ID NO: 124749 - RNA, 20 nt, Artificial Sequence
  MKO10124749_B_Unk
  gRNA
guccccggaagcacaaauac

SEQ ID NO: 124750 - RNA, 20 nt, Artificial Sequence
  MKO10124750_B_Uox
  gRNA
auaccccucugagcuucgcc

SEQ ID NO: 124751 - RNA, 20 nt, Artificial Sequence
  MKO10124751_B_Uox
  gRNA
ccacucaaguguacugcaag

SEQ ID NO: 124752 - RNA, 20 nt, Artificial Sequence
  MKO10124752_B_Uox
  gRNA
ucacagaagugcguucccgu

SEQ ID NO: 124753 - RNA, 20 nt, Artificial Sequence
  MKO10124753_B_Upb1
  gRNA
agaauuugcugagucggccg

SEQ ID NO: 124754 - RNA, 20 nt, Artificial Sequence
  MKO10124754_B_Upb1
  gRNA
ucucuaucacgcuccaagau

SEQ ID NO: 124755 - RNA, 20 nt, Artificial Sequence
  MKO10124755_B_Upb1
  gRNA
gcugagguggccgcaaugug

SEQ ID NO: 124756 - RNA, 20 nt, Artificial Sequence
  MKO10124756_B_Upf1
  gRNA
gcuagcugagcugaacuucg

SEQ ID NO: 124757 - RNA, 20 nt, Artificial Sequence
  MKO10124757_B_Upf1
  gRNA
cugccgcaacgucuuccugc

SEQ ID NO: 124758 - RNA, 20 nt, Artificial Sequence
  MKO10124758_B_Upf1
  gRNA
aggaccggugcuuucuguca

SEQ ID NO: 124759 - RNA, 20 nt, Artificial Sequence
  MKO10124759_B_Upf2
  gRNA
auuaguuucugucgccauug

SEQ ID NO: 124760 - RNA, 20 nt, Artificial Sequence
  MKO10124760_B_Upf2
  gRNA
auauuuacacccggcaaacc

SEQ ID NO: 124761 - RNA, 20 nt, Artificial Sequence
  MKO10124761_B_Upf2
  gRNA
aaauaugcccgaucuuccuc

SEQ ID NO: 124762 - RNA, 20 nt, Artificial Sequence
  MKO10124762_B_Upf3a
  gRNA
gcacgauuacuucgaggugg

SEQ ID NO: 124763 - RNA, 20 nt, Artificial Sequence
  MKO10124763_B_Upf3a
  gRNA
acccaggagcucucucgucu

SEQ ID NO: 124764 - RNA, 20 nt, Artificial Sequence
  MKO10124764_B_Upf3a
  gRNA
cugaacagcaggaugucauc

SEQ ID NO: 124765 - RNA, 20 nt, Artificial Sequence
  MKO10124765_B_Upf3b
  gRNA
auuaccucccacuuugacca

SEQ ID NO: 124766 - RNA, 20 nt, Artificial Sequence
  MKO10124766_B_Upf3b
  gRNA
aucuacuccagagacauugc

SEQ ID NO: 124767 - RNA, 20 nt, Artificial Sequence
  MKO10124767_B_Upf3b
  gRNA
cuauguauuccuugacaaua

SEQ ID NO: 124768 - RNA, 20 nt, Artificial Sequence
  MKO10124768_B_Upk1a
  gRNA
gagcugcgcucugucgucgu

SEQ ID NO: 124769 - RNA, 20 nt, Artificial Sequence
  MKO10124769_B_Upk1a
  gRNA
gccaggagcuaacccgacuc

SEQ ID NO: 124770 - RNA, 20 nt, Artificial Sequence
  MKO10124770_B_Upk1a
  gRNA
ccccggaagugguguucccg

SEQ ID NO: 124771 - RNA, 20 nt, Artificial Sequence
  MKO10124771_B_Upk1b
  gRNA
guucuuccauucgucgucau

SEQ ID NO: 124772 - RNA, 20 nt, Artificial Sequence
  MKO10124772_B_Upk1b
  gRNA
cccgaagauaucaucauugu

SEQ ID NO: 124773 - RNA, 20 nt, Artificial Sequence
  MKO10124773_B_Upk1b
  gRNA
agcuuggauaggcauguucg

SEQ ID NO: 124774 - RNA, 20 nt, Artificial Sequence
  MKO10124774_B_Upk2
  gRNA
augggggcaaggcaauuaac

SEQ ID NO: 124775 - RNA, 20 nt, Artificial Sequence
  MKO10124775_B_Upk2
  gRNA
cauauccuaccgaguacaga

SEQ ID NO: 124776 - RNA, 20 nt, Artificial Sequence
  MKO10124776_B_Upk2
  gRNA
caauaagacccacgaccaac

SEQ ID NO: 124777 - RNA, 20 nt, Artificial Sequence
  MKO10124777_B_Upk3a
  gRNA
caaucaugccuccacuccgc

SEQ ID NO: 124778 - RNA, 20 nt, Artificial Sequence
  MKO10124778_B_Upk3a
  gRNA
cguuguugcccacccugacu

SEQ ID NO: 124779 - RNA, 20 nt, Artificial Sequence
  MKO10124779_B_Upk3a
  gRNA
uccugaacgcauaccuaguc

SEQ ID NO: 124780 - RNA, 20 nt, Artificial Sequence
  MKO10124780_B_Upk3bl
  gRNA
ugcugcucaccuauaggggc

SEQ ID NO: 124781 - RNA, 20 nt, Artificial Sequence
  MKO10124781_B_Upk3bl
  gRNA
gcuuguggucuuccucguac

SEQ ID NO: 124782 - RNA, 20 nt, Artificial Sequence
  MKO10124782_B_Upk3bl
  gRNA
cacacaaucuaccuucacgc

SEQ ID NO: 124783 - RNA, 20 nt, Artificial Sequence
  MKO10124783_B_Upk3b
  gRNA
caucacuuacaaacgcguag

SEQ ID NO: 124784 - RNA, 20 nt, Artificial Sequence
  MKO10124784_B_Upk3b
  gRNA
ggccggcggcauccauuaca

SEQ ID NO: 124785 - RNA, 20 nt, Artificial Sequence
  MKO10124785_B_Upk3b
  gRNA
guggagguguccccgugcuu

SEQ ID NO: 124786 - RNA, 20 nt, Artificial Sequence
  MKO10124786_B_Upp1
  gRNA
cgcuacgccauguauaaagc

SEQ ID NO: 124787 - RNA, 20 nt, Artificial Sequence
  MKO10124787_B_Upp1
  gRNA
cucuguugucaucacgcagc

SEQ ID NO: 124788 - RNA, 20 nt, Artificial Sequence
  MKO10124788_B_Upp1
  gRNA
uucacgucuccaaacauagc

SEQ ID NO: 124789 - RNA, 20 nt, Artificial Sequence
  MKO10124789_B_Upp2
  gRNA
ugacguuccaauucugauga

SEQ ID NO: 124790 - RNA, 20 nt, Artificial Sequence
  MKO10124790_B_Upp2
  gRNA
ggaguaauuugaugaguucg

SEQ ID NO: 124791 - RNA, 20 nt, Artificial Sequence
  MKO10124791_B_Upp2
  gRNA
guauguuaagaauccauacc

SEQ ID NO: 124792 - RNA, 20 nt, Artificial Sequence
  MKO10124792_B_Uprt
  gRNA
aaacaugaaguccccucuac

SEQ ID NO: 124793 - RNA, 20 nt, Artificial Sequence
  MKO10124793_B_Uprt
  gRNA
ucaacagggcacaaguauga

SEQ ID NO: 124794 - RNA, 20 nt, Artificial Sequence
  MKO10124794_B_Uprt
  gRNA
gaacuuggcauaauauacuu

SEQ ID NO: 124795 - RNA, 20 nt, Artificial Sequence
  MKO10124795_B_Uqcc1
  gRNA
gaaucagucucgaguguguu

SEQ ID NO: 124796 - RNA, 20 nt, Artificial Sequence
  MKO10124796_B_Uqcc1
  gRNA
gacucaccuuacuuguguug

SEQ ID NO: 124797 - RNA, 20 nt, Artificial Sequence
  MKO10124797_B_Uqcc1
  gRNA
cccacugagagaugcuaguc

SEQ ID NO: 124798 - RNA, 20 nt, Artificial Sequence
  MKO10124798_B_Uqcc2
  gRNA
gcucucguacaucugaucac

SEQ ID NO: 124799 - RNA, 20 nt, Artificial Sequence
  MKO10124799_B_Uqcc2
  gRNA
cuuucagauugcagaacccg

SEQ ID NO: 124800 - RNA, 20 nt, Artificial Sequence
  MKO10124800_B_Uqcc2
  gRNA
gaucagcuuguacucuucca

SEQ ID NO: 124801 - RNA, 20 nt, Artificial Sequence
  MKO10124801_B_Uqcr10
  gRNA
agcaaggaguacaggcgcga

SEQ ID NO: 124802 - RNA, 20 nt, Artificial Sequence
  MKO10124802_B_Uqcr10
  gRNA
gaucuacgagcacaucaacg

SEQ ID NO: 124803 - RNA, 20 nt, Artificial Sequence
  MKO10124803_B_Uqcr10
  gRNA
cuuugcccucaccaucgcag

SEQ ID NO: 124804 - RNA, 20 nt, Artificial Sequence
  MKO10124804_B_Uqcr11
  gRNA
acccugcagcgaugcugagc

SEQ ID NO: 124805 - RNA, 20 nt, Artificial Sequence
  MKO10124805_B_Uqcr11
  gRNA
guggggcacugugggugccg

SEQ ID NO: 124806 - RNA, 20 nt, Artificial Sequence
  MKO10124806_B_Uqcr11
  gRNA
aggcccgcgcuaccgggaac

SEQ ID NO: 124807 - RNA, 20 nt, Artificial Sequence
  MKO10124807_B_Uqcrb
  gRNA
aagugguauuauaaugcugc

SEQ ID NO: 124808 - RNA, 20 nt, Artificial Sequence
  MKO10124808_B_Uqcrb
  gRNA
auguaaaagaagccauaaga

SEQ ID NO: 124809 - RNA, 20 nt, Artificial Sequence
  MKO10124809_B_Uqcrb
  gRNA
ccuugaacccuaucuaaaag

SEQ ID NO: 124810 - RNA, 20 nt, Artificial Sequence
  MKO10124810_B_Uqcrc1
  gRNA
uaucgugcagaacaguaguc

SEQ ID NO: 124811 - RNA, 20 nt, Artificial Sequence
  MKO10124811_B_Uqcrc1
  gRNA
cuguccaaggaccugccaaa

SEQ ID NO: 124812 - RNA, 20 nt, Artificial Sequence
  MKO10124812_B_Uqcrc1
  gRNA
agugugcucucgagugcugu

SEQ ID NO: 124813 - RNA, 20 nt, Artificial Sequence
  MKO10124813_B_Uqcrc2
  gRNA
ggacuaaccucaagauccug

SEQ ID NO: 124814 - RNA, 20 nt, Artificial Sequence
  MKO10124814_B_Uqcrc2
  gRNA
uucccucaaaguugccccga

SEQ ID NO: 124815 - RNA, 20 nt, Artificial Sequence
  MKO10124815_B_Uqcrc2
  gRNA
ucaucuuucaagauaacccg

SEQ ID NO: 124816 - RNA, 20 nt, Artificial Sequence
  MKO10124816_B_Uqcrfs1
  gRNA
acgacgauagucagagaagu

SEQ ID NO: 124817 - RNA, 20 nt, Artificial Sequence
  MKO10124817_B_Uqcrfs1
  gRNA
gccgauaggacgggcgcgaa

SEQ ID NO: 124818 - RNA, 20 nt, Artificial Sequence
  MKO10124818_B_Uqcrfs1
  gRNA
gcgggcggcgaccgacaaca

SEQ ID NO: 124819 - RNA, 20 nt, Artificial Sequence
  MKO10124819_B_Uqcrh
  gRNA
ggcucccgacaugggacuag

SEQ ID NO: 124820 - RNA, 20 nt, Artificial Sequence
  MKO10124820_B_Uqcrh
  gRNA
cgaaagaugcucacuggauc

SEQ ID NO: 124821 - RNA, 20 nt, Artificial Sequence
  MKO10124821_B_Uqcrh
  gRNA
ucuuugacuucuugcaugca

SEQ ID NO: 124822 - RNA, 20 nt, Artificial Sequence
  MKO10124822_B_Uqcrq
  gRNA
gaucuacacauggggcaacc

SEQ ID NO: 124823 - RNA, 20 nt, Artificial Sequence
  MKO10124823_B_Uqcrq
  gRNA
acucacgcggcgccacgcgc

SEQ ID NO: 124824 - RNA, 20 nt, Artificial Sequence
  MKO10124824_B_Uqcrq
  gRNA
ucgcgagcgcauccugcgcg

SEQ ID NO: 124825 - RNA, 20 nt, Artificial Sequence
  MKO10124825_B_Urad
  gRNA
cacaaauucuccgaagucca

SEQ ID NO: 124826 - RNA, 20 nt, Artificial Sequence
  MKO10124826_B_Urad
  gRNA
gcggugcgcagcucggauuc

SEQ ID NO: 124827 - RNA, 20 nt, Artificial Sequence
  MKO10124827_B_Urad
  gRNA
acggaaagccgaagcgcuca

SEQ ID NO: 124828 - RNA, 20 nt, Artificial Sequence
  MKO10124828_B_Urah
  gRNA
acacaucacuuuaacucccc

SEQ ID NO: 124829 - RNA, 20 nt, Artificial Sequence
  MKO10124829_B_Urah
  gRNA
uggaggcccccugccagcag

SEQ ID NO: 124830 - RNA, 20 nt, Artificial Sequence
  MKO10124830_B_Urah
  gRNA
uaccucugcugcugagccca

SEQ ID NO: 124831 - RNA, 20 nt, Artificial Sequence
  MKO10124831_B_Urb1
  gRNA
guggaaaugcguaagaucac

SEQ ID NO: 124832 - RNA, 20 nt, Artificial Sequence
  MKO10124832_B_Urb1
  gRNA
ugcugccaagaagcuaccgc

SEQ ID NO: 124833 - RNA, 20 nt, Artificial Sequence
  MKO10124833_B_Urb1
  gRNA
aaacaaccuacuucacucuc

SEQ ID NO: 124834 - RNA, 20 nt, Artificial Sequence
  MKO10124834_B_Urb2
  gRNA
uagcaguuugaguagucuaa

SEQ ID NO: 124835 - RNA, 20 nt, Artificial Sequence
  MKO10124835_B_Urb2
  gRNA
gguacugcagucuauucuuc

SEQ ID NO: 124836 - RNA, 20 nt, Artificial Sequence
  MKO10124836_B_Urb2
  gRNA
uuacagucuucccauccuua

SEQ ID NO: 124837 - RNA, 20 nt, Artificial Sequence
  MKO10124837_B_Urgcp
  gRNA
uaggauagaaguggaauuac

SEQ ID NO: 124838 - RNA, 20 nt, Artificial Sequence
  MKO10124838_B_Urgcp
  gRNA
caggacaaugacuuccccac

SEQ ID NO: 124839 - RNA, 20 nt, Artificial Sequence
  MKO10124839_B_Urgcp
  gRNA
gaaauggaaggagaugacug

SEQ ID NO: 124840 - RNA, 20 nt, Artificial Sequence
  MKO10124840_B_Uri1
  gRNA
ugcaaagugcucagccaagc

SEQ ID NO: 124841 - RNA, 20 nt, Artificial Sequence
  MKO10124841_B_Uri1
  gRNA
gccaagagaaaauccagcau

SEQ ID NO: 124842 - RNA, 20 nt, Artificial Sequence
  MKO10124842_B_Uri1
  gRNA
aucuucugugaauucaacuc

SEQ ID NO: 124843 - RNA, 20 nt, Artificial Sequence
  MKO10124843_B_Urm1
  gRNA
gcgaccagagcuguucaucc

SEQ ID NO: 124844 - RNA, 20 nt, Artificial Sequence
  MKO10124844_B_Urm1
  gRNA
aagcaucaagucgccuugcc

SEQ ID NO: 124845 - RNA, 20 nt, Artificial Sequence
  MKO10124845_B_Urm1
  gRNA
ggagcuggacuaccagcugc

SEQ ID NO: 124846 - RNA, 20 nt, Artificial Sequence
  MKO10124846_B_Uroc1
  gRNA
aucaggugggaaauagcgca

SEQ ID NO: 124847 - RNA, 20 nt, Artificial Sequence
  MKO10124847_B_Uroc1
  gRNA
gcagcugcccguguccggca

SEQ ID NO: 124848 - RNA, 20 nt, Artificial Sequence
  MKO10124848_B_Uroc1
  gRNA
caauugaucaguacccaugc

SEQ ID NO: 124849 - RNA, 20 nt, Artificial Sequence
  MKO10124849_B_Urod
  gRNA
cagcaccugccgaucucccg

SEQ ID NO: 124850 - RNA, 20 nt, Artificial Sequence
  MKO10124850_B_Urod
  gRNA
auucccugcagccacuacga

SEQ ID NO: 124851 - RNA, 20 nt, Artificial Sequence
  MKO10124851_B_Urod
  gRNA
caggcaggccgcuacuuacc

SEQ ID NO: 124852 - RNA, 20 nt, Artificial Sequence
  MKO10124852_B_Uros
  gRNA
gugcagcugucucauccuga

SEQ ID NO: 124853 - RNA, 20 nt, Artificial Sequence
  MKO10124853_B_Uros
  gRNA
ucuccccaguuugucagaaa

SEQ ID NO: 124854 - RNA, 20 nt, Artificial Sequence
  MKO10124854_B_Uros
  gRNA
augaguccuccaaagccuuc

SEQ ID NO: 124855 - RNA, 20 nt, Artificial Sequence
  MKO10124855_B_Usb1
  gRNA
uggcccaguugccccgcuca

SEQ ID NO: 124856 - RNA, 20 nt, Artificial Sequence
  MKO10124856_B_Usb1
  gRNA
acugaccuccagcccgauga

SEQ ID NO: 124857 - RNA, 20 nt, Artificial Sequence
  MKO10124857_B_Usb1
  gRNA
uuaccugguagaaaguagua

SEQ ID NO: 124858 - RNA, 20 nt, Artificial Sequence
  MKO10124858_B_Use1
  gRNA
cacguuacaccagugagaug

SEQ ID NO: 124859 - RNA, 20 nt, Artificial Sequence
  MKO10124859_B_Use1
  gRNA
cagcucacuccgcaucucac

SEQ ID NO: 124860 - RNA, 20 nt, Artificial Sequence
  MKO10124860_B_Use1
  gRNA
guacucgcugaucacuucug

SEQ ID NO: 124861 - RNA, 20 nt, Artificial Sequence
  MKO10124861_B_Usf1
  gRNA
agcugcucccuccgugucaa

SEQ ID NO: 124862 - RNA, 20 nt, Artificial Sequence
  MKO10124862_B_Usf1
  gRNA
ccugcuuccaggugauguac

SEQ ID NO: 124863 - RNA, 20 nt, Artificial Sequence
  MKO10124863_B_Usf1
  gRNA
ccagcugccccucugacacc

SEQ ID NO: 124864 - RNA, 20 nt, Artificial Sequence
  MKO10124864_B_Usf2
  gRNA
ccggcggccgaagcugucag

SEQ ID NO: 124865 - RNA, 20 nt, Artificial Sequence
  MKO10124865_B_Usf2
  gRNA
ccccacaggcggggacggcc

SEQ ID NO: 124866 - RNA, 20 nt, Artificial Sequence
  MKO10124866_B_Usf2
  gRNA
ugcccccgcagccacgacaa

SEQ ID NO: 124867 - RNA, 20 nt, Artificial Sequence
  MKO10124867_B_Ush1c
  gRNA
ucagcuggucauacuccacc

SEQ ID NO: 124868 - RNA, 20 nt, Artificial Sequence
  MKO10124868_B_Ush1c
  gRNA
acgcugaggccgagaccuuc

SEQ ID NO: 124869 - RNA, 20 nt, Artificial Sequence
  MKO10124869_B_Ush1c
  gRNA
aggcucagucauggaccgga

SEQ ID NO: 124870 - RNA, 20 nt, Artificial Sequence
  MKO10124870_B_Ush1g
  gRNA
ggagcugaaugccccugacg

SEQ ID NO: 124871 - RNA, 20 nt, Artificial Sequence
  MKO10124871_B_Ush1g
  gRNA
agacgcuguccucguccgag

SEQ ID NO: 124872 - RNA, 20 nt, Artificial Sequence
  MKO10124872_B_Ush1g
  gRNA
gauagcguacgcacuccaug

SEQ ID NO: 124873 - RNA, 20 nt, Artificial Sequence
  MKO10124873_B_Ush2a
  gRNA
cagcuucuuuguggacgguc

SEQ ID NO: 124874 - RNA, 20 nt, Artificial Sequence
  MKO10124874_B_Ush2a
  gRNA
ccaauaaaaguaaugacacc

SEQ ID NO: 124875 - RNA, 20 nt, Artificial Sequence
  MKO10124875_B_Ush2a
  gRNA
acaaugugucacuuacaaac

SEQ ID NO: 124876 - RNA, 20 nt, Artificial Sequence
  MKO10124876_B_Ushbp1
  gRNA
gcacagggcuagccgcagcc

SEQ ID NO: 124877 - RNA, 20 nt, Artificial Sequence
  MKO10124877_B_Ushbp1
  gRNA
agccccagagacguaccuca

SEQ ID NO: 124878 - RNA, 20 nt, Artificial Sequence
  MKO10124878_B_Ushbp1
  gRNA
gacuaaaccugagcugcauc

SEQ ID NO: 124879 - RNA, 20 nt, Artificial Sequence
  MKO10124879_B_Usmg5
  gRNA
auuuauguugcuuucacagc

SEQ ID NO: 124880 - RNA, 20 nt, Artificial Sequence
  MKO10124880_B_Usmg5
  gRNA
uucaacucuuauacccucac

SEQ ID NO: 124881 - RNA, 20 nt, Artificial Sequence
  MKO10124881_B_Usmg5
  gRNA
uggucuuauacuucaaguua

SEQ ID NO: 124882 - RNA, 20 nt, Artificial Sequence
  MKO10124882_B_Uso1
  gRNA
gcagaaauaccgcuuagaag

SEQ ID NO: 124883 - RNA, 20 nt, Artificial Sequence
  MKO10124883_B_Uso1
  gRNA
ugaaauaauagcauaugcuu

SEQ ID NO: 124884 - RNA, 20 nt, Artificial Sequence
  MKO10124884_B_Uso1
  gRNA
uuaccuccaacaaagauaac

SEQ ID NO: 124885 - RNA, 20 nt, Artificial Sequence
  MKO10124885_B_Usp10
  gRNA
ccagugucauugcaaccccg

SEQ ID NO: 124886 - RNA, 20 nt, Artificial Sequence
  MKO10124886_B_Usp10
  gRNA
gacuccccgcucuucuguug

SEQ ID NO: 124887 - RNA, 20 nt, Artificial Sequence
  MKO10124887_B_Usp10
  gRNA
augacacuggcuuauguauu

SEQ ID NO: 124888 - RNA, 20 nt, Artificial Sequence
  MKO10124888_B_Usp11
  gRNA
ccagcauuguugauacagcc

SEQ ID NO: 124889 - RNA, 20 nt, Artificial Sequence
  MKO10124889_B_Usp11
  gRNA
acagugggagguguacguga

SEQ ID NO: 124890 - RNA, 20 nt, Artificial Sequence
  MKO10124890_B_Usp11
  gRNA
ucacagguaauagaacuucc

SEQ ID NO: 124891 - RNA, 20 nt, Artificial Sequence
  MKO10124891_B_Usp12
  gRNA
caucaauuacucacugcuua

SEQ ID NO: 124892 - RNA, 20 nt, Artificial Sequence
  MKO10124892_B_Usp12
  gRNA
cgcccaagaaguucaucaca

SEQ ID NO: 124893 - RNA, 20 nt, Artificial Sequence
  MKO10124893_B_Usp12
  gRNA
acagcacaccagacccaacc

SEQ ID NO: 124894 - RNA, 20 nt, Artificial Sequence
  MKO10124894_B_Usp13
  gRNA
ugccaacaaccuugugcaac

SEQ ID NO: 124895 - RNA, 20 nt, Artificial Sequence
  MKO10124895_B_Usp13
  gRNA
gaaagacacuuucgaaaaac

SEQ ID NO: 124896 - RNA, 20 nt, Artificial Sequence
  MKO10124896_B_Usp13
  gRNA
uuuggguaaagcuccaccag

SEQ ID NO: 124897 - RNA, 20 nt, Artificial Sequence
  MKO10124897_B_Usp14
  gRNA
cuuugaaauaggaugaugac

SEQ ID NO: 124898 - RNA, 20 nt, Artificial Sequence
  MKO10124898_B_Usp14
  gRNA
gccagccagacaaaaaguua

SEQ ID NO: 124899 - RNA, 20 nt, Artificial Sequence
  MKO10124899_B_Usp14
  gRNA
ucauguaacaaguguuacca

SEQ ID NO: 124900 - RNA, 20 nt, Artificial Sequence
  MKO10124900_B_Usp15
  gRNA
cauauacuuguuccacaguc

SEQ ID NO: 124901 - RNA, 20 nt, Artificial Sequence
  MKO10124901_B_Usp15
  gRNA
ccuggacccaucgauaacuc

SEQ ID NO: 124902 - RNA, 20 nt, Artificial Sequence
  MKO10124902_B_Usp15
  gRNA
gcuggaauaaacuugucagc

SEQ ID NO: 124903 - RNA, 20 nt, Artificial Sequence
  MKO10124903_B_Usp16
  gRNA
gucuggacaacuggagcguc

SEQ ID NO: 124904 - RNA, 20 nt, Artificial Sequence
  MKO10124904_B_Usp16
  gRNA
aagcagaagacccuucgguu

SEQ ID NO: 124905 - RNA, 20 nt, Artificial Sequence
  MKO10124905_B_Usp16
  gRNA
uuaagacagagccaaaccga

SEQ ID NO: 124906 - RNA, 20 nt, Artificial Sequence
  MKO10124906_B_Usp17la
  gRNA
guugcucuuuccuucccaga

SEQ ID NO: 124907 - RNA, 20 nt, Artificial Sequence
  MKO10124907_B_Usp17la
  gRNA
ucuccuaaaucuucugugaa

SEQ ID NO: 124908 - RNA, 20 nt, Artificial Sequence
  MKO10124908_B_Usp17la
  gRNA
gauggugcgacuucucacag

SEQ ID NO: 124909 - RNA, 20 nt, Artificial Sequence
  MKO10124909_B_Usp17lb
  gRNA
augagacuuaccuucuggga

SEQ ID NO: 124910 - RNA, 20 nt, Artificial Sequence
  MKO10124910_B_Usp17lb
  gRNA
ucgacucaguggugcaauug

SEQ ID NO: 124911 - RNA, 20 nt, Artificial Sequence
  MKO10124911_B_Usp17lb
  gRNA
acuauaaagcuuuagggucu

SEQ ID NO: 124912 - RNA, 20 nt, Artificial Sequence
  MKO10124912_B_Usp17lc
  gRNA
guuucucuuuccuucccaga

SEQ ID NO: 124913 - RNA, 20 nt, Artificial Sequence
  MKO10124913_B_Usp17lc
  gRNA
uguguuucugcccaaguuuc

SEQ ID NO: 124914 - RNA, 20 nt, Artificial Sequence
  MKO10124914_B_Usp17lc
  gRNA
gaauaccaaacuugugccuc

SEQ ID NO: 124915 - RNA, 20 nt, Artificial Sequence
  MKO10124915_B_Usp17ld
  gRNA
gugagacuuaccuucuggga

SEQ ID NO: 124916 - RNA, 20 nt, Artificial Sequence
  MKO10124916_B_Usp17ld
  gRNA
uguguuucugccccaguuuc

SEQ ID NO: 124917 - RNA, 20 nt, Artificial Sequence
  MKO10124917_B_Usp17ld
  gRNA
ugucaauacugaccucuuug

SEQ ID NO: 124918 - RNA, 20 nt, Artificial Sequence
  MKO10124918_B_Usp17le
  gRNA
guuucucuuuccuucccaga

SEQ ID NO: 124919 - RNA, 20 nt, Artificial Sequence
  MKO10124919_B_Usp17le
  gRNA
ccuuacuugcagagacugga

SEQ ID NO: 124920 - RNA, 20 nt, Artificial Sequence
  MKO10124920_B_Usp17le
  gRNA
gugagacuuaccuucuggga

SEQ ID NO: 124921 - RNA, 20 nt, Artificial Sequence
  MKO10124921_B_Usp18
  gRNA
uagucagguuccagauugua

SEQ ID NO: 124922 - RNA, 20 nt, Artificial Sequence
  MKO10124922_B_Usp18
  gRNA
cugguugguuuacacaacau

SEQ ID NO: 124923 - RNA, 20 nt, Artificial Sequence
  MKO10124923_B_Usp18
  gRNA
cuugcagacagagcggcugc

SEQ ID NO: 124924 - RNA, 20 nt, Artificial Sequence
  MKO10124924_B_Usp19
  gRNA
acccuugcgagccugcacuu

SEQ ID NO: 124925 - RNA, 20 nt, Artificial Sequence
  MKO10124925_B_Usp19
  gRNA
agcggcucaagaugucugca

SEQ ID NO: 124926 - RNA, 20 nt, Artificial Sequence
  MKO10124926_B_Usp19
  gRNA
aaguucuugcaccaaagugc

SEQ ID NO: 124927 - RNA, 20 nt, Artificial Sequence
  MKO10124927_B_Usp1
  gRNA
ucagauaacaaguguugcca

SEQ ID NO: 124928 - RNA, 20 nt, Artificial Sequence
  MKO10124928_B_Usp1
  gRNA
gaaggaugacucuaaucaga

SEQ ID NO: 124929 - RNA, 20 nt, Artificial Sequence
  MKO10124929_B_Usp1
  gRNA
uucacuccagucuuaaagcc

SEQ ID NO: 124930 - RNA, 20 nt, Artificial Sequence
  MKO10124930_B_Usp20
  gRNA
gacucuccacagccaacgua

SEQ ID NO: 124931 - RNA, 20 nt, Artificial Sequence
  MKO10124931_B_Usp20
  gRNA
caggucaccugcccuuacgu

SEQ ID NO: 124932 - RNA, 20 nt, Artificial Sequence
  MKO10124932_B_Usp20
  gRNA
cagaaagacuucacgcucac

SEQ ID NO: 124933 - RNA, 20 nt, Artificial Sequence
  MKO10124933_B_Usp21
  gRNA
uucgagacuucugucugcga

SEQ ID NO: 124934 - RNA, 20 nt, Artificial Sequence
  MKO10124934_B_Usp21
  gRNA
cgcagacagaagucucgaag

SEQ ID NO: 124935 - RNA, 20 nt, Artificial Sequence
  MKO10124935_B_Usp21
  gRNA
cauguuggccuccgaaaucu

SEQ ID NO: 124936 - RNA, 20 nt, Artificial Sequence
  MKO10124936_B_Usp22
  gRNA
ucaccuaccuaugguacaau

SEQ ID NO: 124937 - RNA, 20 nt, Artificial Sequence
  MKO10124937_B_Usp22
  gRNA
aguaaauaccuccguacauc

SEQ ID NO: 124938 - RNA, 20 nt, Artificial Sequence
  MKO10124938_B_Usp22
  gRNA
caagucaaagcgacacaacc

SEQ ID NO: 124939 - RNA, 20 nt, Artificial Sequence
  MKO10124939_B_Usp24
  gRNA
guugaugcuacuaauagaau

SEQ ID NO: 124940 - RNA, 20 nt, Artificial Sequence
  MKO10124940_B_Usp24
  gRNA
aaacaggauccaauucccau

SEQ ID NO: 124941 - RNA, 20 nt, Artificial Sequence
  MKO10124941_B_Usp24
  gRNA
ccuuaccuucuuaaaugccu

SEQ ID NO: 124942 - RNA, 20 nt, Artificial Sequence
  MKO10124942_B_Usp25
  gRNA
guuugacuccgccaaacuca

SEQ ID NO: 124943 - RNA, 20 nt, Artificial Sequence
  MKO10124943_B_Usp25
  gRNA
gggcauaaccgaugaagagc

SEQ ID NO: 124944 - RNA, 20 nt, Artificial Sequence
  MKO10124944_B_Usp25
  gRNA
gaaucccuccaaacuucuau

SEQ ID NO: 124945 - RNA, 20 nt, Artificial Sequence
  MKO10124945_B_Usp26
  gRNA
ggucuucgccauagguuuga

SEQ ID NO: 124946 - RNA, 20 nt, Artificial Sequence
  MKO10124946_B_Usp26
  gRNA
guuuauaguuucgaaacccu

SEQ ID NO: 124947 - RNA, 20 nt, Artificial Sequence
  MKO10124947_B_Usp26
  gRNA
ggaggcccaaaaguaccaac

SEQ ID NO: 124948 - RNA, 20 nt, Artificial Sequence
  MKO10124948_B_Usp27x
  gRNA
aauuaguccucguaagccga

SEQ ID NO: 124949 - RNA, 20 nt, Artificial Sequence
  MKO10124949_B_Usp27x
  gRNA
gacgagcguguauccacacc

SEQ ID NO: 124950 - RNA, 20 nt, Artificial Sequence
  MKO10124950_B_Usp27x
  gRNA
acaagcguccaccucgacag

SEQ ID NO: 124951 - RNA, 20 nt, Artificial Sequence
  MKO10124951_B_Usp28
  gRNA
cgacaacaaagaugaccugc

SEQ ID NO: 124952 - RNA, 20 nt, Artificial Sequence
  MKO10124952_B_Usp28
  gRNA
auccacucuccuccaguuau

SEQ ID NO: 124953 - RNA, 20 nt, Artificial Sequence
  MKO10124953_B_Usp28
  gRNA
aaucagcugcgagaaaucac

SEQ ID NO: 124954 - RNA, 20 nt, Artificial Sequence
  MKO10124954_B_Usp29
  gRNA
cguagugguuaguggugagc

SEQ ID NO: 124955 - RNA, 20 nt, Artificial Sequence
  MKO10124955_B_Usp29
  gRNA
cauacacaucacuuacguaa

SEQ ID NO: 124956 - RNA, 20 nt, Artificial Sequence
  MKO10124956_B_Usp29
  gRNA
ccuucuuagauaacauugac

SEQ ID NO: 124957 - RNA, 20 nt, Artificial Sequence
  MKO10124957_B_Usp2
  gRNA
ggucccgcauguacagccuc

SEQ ID NO: 124958 - RNA, 20 nt, Artificial Sequence
  MKO10124958_B_Usp2
  gRNA
uuacuuacgggagaugauca

SEQ ID NO: 124959 - RNA, 20 nt, Artificial Sequence
  MKO10124959_B_Usp2
  gRNA
cuggcuggucuucgaaaccu

SEQ ID NO: 124960 - RNA, 20 nt, Artificial Sequence
  MKO10124960_B_Usp30
  gRNA
ccugcccugcguuugucaag

SEQ ID NO: 124961 - RNA, 20 nt, Artificial Sequence
  MKO10124961_B_Usp30
  gRNA
cuuguuugaugugcauuccc

SEQ ID NO: 124962 - RNA, 20 nt, Artificial Sequence
  MKO10124962_B_Usp30
  gRNA
cagcagggaucuauguuauu

SEQ ID NO: 124963 - RNA, 20 nt, Artificial Sequence
  MKO10124963_B_Usp31
  gRNA
aagaaugcguugcaguaucg

SEQ ID NO: 124964 - RNA, 20 nt, Artificial Sequence
  MKO10124964_B_Usp31
  gRNA
ucuuaccuuguaugggguag

SEQ ID NO: 124965 - RNA, 20 nt, Artificial Sequence
  MKO10124965_B_Usp31
  gRNA
ggcaucauaucugucucuga

SEQ ID NO: 124966 - RNA, 20 nt, Artificial Sequence
  MKO10124966_B_Usp32
  gRNA
uccuacuuucuaccaaacuc

SEQ ID NO: 124967 - RNA, 20 nt, Artificial Sequence
  MKO10124967_B_Usp32
  gRNA
cauuucaauaacuuaauagu

SEQ ID NO: 124968 - RNA, 20 nt, Artificial Sequence
  MKO10124968_B_Usp32
  gRNA
guuauugaaaugcagcccuu

SEQ ID NO: 124969 - RNA, 20 nt, Artificial Sequence
  MKO10124969_B_Usp33
  gRNA
cgacuccccgcagccaacau

SEQ ID NO: 124970 - RNA, 20 nt, Artificial Sequence
  MKO10124970_B_Usp33
  gRNA
aguuggugaaauaacgaaag

SEQ ID NO: 124971 - RNA, 20 nt, Artificial Sequence
  MKO10124971_B_Usp33
  gRNA
auaccuccaggcacgcccac

SEQ ID NO: 124972 - RNA, 20 nt, Artificial Sequence
  MKO10124972_B_Usp34
  gRNA
aacugcauaccucugagucc

SEQ ID NO: 124973 - RNA, 20 nt, Artificial Sequence
  MKO10124973_B_Usp34
  gRNA
agcaauccuucaugagagaa

SEQ ID NO: 124974 - RNA, 20 nt, Artificial Sequence
  MKO10124974_B_Usp34
  gRNA
gacauaacgaagcaaaugca

SEQ ID NO: 124975 - RNA, 20 nt, Artificial Sequence
  MKO10124975_B_Usp35
  gRNA
agcugcuguaccccaucgug

SEQ ID NO: 124976 - RNA, 20 nt, Artificial Sequence
  MKO10124976_B_Usp35
  gRNA
cgugguccagcaccucccau

SEQ ID NO: 124977 - RNA, 20 nt, Artificial Sequence
  MKO10124977_B_Usp35
  gRNA
ggagccaccguccagcgccu

SEQ ID NO: 124978 - RNA, 20 nt, Artificial Sequence
  MKO10124978_B_Usp36
  gRNA
acagcuccgugcgugcuccu

SEQ ID NO: 124979 - RNA, 20 nt, Artificial Sequence
  MKO10124979_B_Usp36
  gRNA
ucgcaucaaugguguaccgc

SEQ ID NO: 124980 - RNA, 20 nt, Artificial Sequence
  MKO10124980_B_Usp36
  gRNA
uagguuggaucggcagacac

SEQ ID NO: 124981 - RNA, 20 nt, Artificial Sequence
  MKO10124981_B_Usp37
  gRNA
ccagcuaugaaagcuucuca

SEQ ID NO: 124982 - RNA, 20 nt, Artificial Sequence
  MKO10124982_B_Usp37
  gRNA
gcuuucuuacucagacaauc

SEQ ID NO: 124983 - RNA, 20 nt, Artificial Sequence
  MKO10124983_B_Usp37
  gRNA
uauugacaaaguaccaagua

SEQ ID NO: 124984 - RNA, 20 nt, Artificial Sequence
  MKO10124984_B_Usp38
  gRNA
uggcucagcauguagauacg

SEQ ID NO: 124985 - RNA, 20 nt, Artificial Sequence
  MKO10124985_B_Usp38
  gRNA
caaggcaaccgagggcucaa

SEQ ID NO: 124986 - RNA, 20 nt, Artificial Sequence
  MKO10124986_B_Usp38
  gRNA
cuuaccacauggaaugccuc

SEQ ID NO: 124987 - RNA, 20 nt, Artificial Sequence
  MKO10124987_B_Usp39
  gRNA
aaguggugccaucauaugcc

SEQ ID NO: 124988 - RNA, 20 nt, Artificial Sequence
  MKO10124988_B_Usp39
  gRNA
cacagcauuugcauagucgu

SEQ ID NO: 124989 - RNA, 20 nt, Artificial Sequence
  MKO10124989_B_Usp39
  gRNA
ugaaaucauugauuccucgc

SEQ ID NO: 124990 - RNA, 20 nt, Artificial Sequence
  MKO10124990_B_Usp3
  gRNA
gcaguagcuacagcacauac

SEQ ID NO: 124991 - RNA, 20 nt, Artificial Sequence
  MKO10124991_B_Usp3
  gRNA
caauagcucagccuuuacag

SEQ ID NO: 124992 - RNA, 20 nt, Artificial Sequence
  MKO10124992_B_Usp3
  gRNA
acuuguucaaguguccacug

SEQ ID NO: 124993 - RNA, 20 nt, Artificial Sequence
  MKO10124993_B_Usp40
  gRNA
uacacucuuugcaaacaauc

SEQ ID NO: 124994 - RNA, 20 nt, Artificial Sequence
  MKO10124994_B_Usp40
  gRNA
cacagguuccacagugguac

SEQ ID NO: 124995 - RNA, 20 nt, Artificial Sequence
  MKO10124995_B_Usp40
  gRNA
ccuuugcugcuuuaaccagu

SEQ ID NO: 124996 - RNA, 20 nt, Artificial Sequence
  MKO10124996_B_Usp42
  gRNA
uaucuugcaggccacgcaga

SEQ ID NO: 124997 - RNA, 20 nt, Artificial Sequence
  MKO10124997_B_Usp42
  gRNA
auagcuagacacuuccguuu

SEQ ID NO: 124998 - RNA, 20 nt, Artificial Sequence
  MKO10124998_B_Usp42
  gRNA
ucauacaaaauccuucugcg

SEQ ID NO: 124999 - RNA, 20 nt, Artificial Sequence
  MKO10124999_B_Usp43
  gRNA
gcuucuggaucguguccacg

SEQ ID NO: 125000 - RNA, 20 nt, Artificial Sequence
  MKO10125000_B_Usp43
  gRNA
caauucccagcacgaugccc

SEQ ID NO: 125001 - RNA, 20 nt, Artificial Sequence
  MKO10125001_B_Usp43
  gRNA
gccacuuucaagcacaguac

SEQ ID NO: 125002 - RNA, 20 nt, Artificial Sequence
  MKO10125002_B_Usp44
  gRNA
uauucuguauggaucgagcg

SEQ ID NO: 125003 - RNA, 20 nt, Artificial Sequence
  MKO10125003_B_Usp44
  gRNA
guucuaaacgauaacgcagc

SEQ ID NO: 125004 - RNA, 20 nt, Artificial Sequence
  MKO10125004_B_Usp44
  gRNA
guacaugucguucaccucga

SEQ ID NO: 125005 - RNA, 20 nt, Artificial Sequence
  MKO10125005_B_Usp45
  gRNA
accauaugacccauguacuc

SEQ ID NO: 125006 - RNA, 20 nt, Artificial Sequence
  MKO10125006_B_Usp45
  gRNA
uugucaucagccugaguaca

SEQ ID NO: 125007 - RNA, 20 nt, Artificial Sequence
  MKO10125007_B_Usp45
  gRNA
acauugcaacaagaaaguuu

SEQ ID NO: 125008 - RNA, 20 nt, Artificial Sequence
  MKO10125008_B_Usp46
  gRNA
ucuugaccucucugucgaug

SEQ ID NO: 125009 - RNA, 20 nt, Artificial Sequence
  MKO10125009_B_Usp46
  gRNA
gaaguacagcgcuugaagca

SEQ ID NO: 125010 - RNA, 20 nt, Artificial Sequence
  MKO10125010_B_Usp46
  gRNA
ggagaauguguuggcauaca

SEQ ID NO: 125011 - RNA, 20 nt, Artificial Sequence
  MKO10125011_B_Usp47
  gRNA
uuaggaggacuccaauaacg

SEQ ID NO: 125012 - RNA, 20 nt, Artificial Sequence
  MKO10125012_B_Usp47
  gRNA
uuaugugggauuaguaaacc

SEQ ID NO: 125013 - RNA, 20 nt, Artificial Sequence
  MKO10125013_B_Usp47
  gRNA
auuuauguagccuacuuugu

SEQ ID NO: 125014 - RNA, 20 nt, Artificial Sequence
  MKO10125014_B_Usp48
  gRNA
ccgaauugcuugguuggcau

SEQ ID NO: 125015 - RNA, 20 nt, Artificial Sequence
  MKO10125015_B_Usp48
  gRNA
ugcacaacauuccgaacauc

SEQ ID NO: 125016 - RNA, 20 nt, Artificial Sequence
  MKO10125016_B_Usp48
  gRNA
ccaaugccaaccaagcaauu

SEQ ID NO: 125017 - RNA, 20 nt, Artificial Sequence
  MKO10125017_B_Usp49
  gRNA
ccaauaccauugagcccuuu

SEQ ID NO: 125018 - RNA, 20 nt, Artificial Sequence
  MKO10125018_B_Usp49
  gRNA
ggcuacaccuuaaaagauuc

SEQ ID NO: 125019 - RNA, 20 nt, Artificial Sequence
  MKO10125019_B_Usp49
  gRNA
aaugaucuacagacuaccuc

SEQ ID NO: 125020 - RNA, 20 nt, Artificial Sequence
  MKO10125020_B_Usp4
  gRNA
cgaugagcuggacuaugugc

SEQ ID NO: 125021 - RNA, 20 nt, Artificial Sequence
  MKO10125021_B_Usp4
  gRNA
uagcuugcucaacugcucau

SEQ ID NO: 125022 - RNA, 20 nt, Artificial Sequence
  MKO10125022_B_Usp4
  gRNA
ccuggaccuauugacaacuc

SEQ ID NO: 125023 - RNA, 20 nt, Artificial Sequence
  MKO10125023_B_Usp50
  gRNA
ugugaggaccacgauuucca

SEQ ID NO: 125024 - RNA, 20 nt, Artificial Sequence
  MKO10125024_B_Usp50
  gRNA
ccuaccugaugacagauaug

SEQ ID NO: 125025 - RNA, 20 nt, Artificial Sequence
  MKO10125025_B_Usp50
  gRNA
acaauagauuugguugcucc

SEQ ID NO: 125026 - RNA, 20 nt, Artificial Sequence
  MKO10125026_B_Usp51
  gRNA
cuaguaguagcacaucgagu

SEQ ID NO: 125027 - RNA, 20 nt, Artificial Sequence
  MKO10125027_B_Usp51
  gRNA
gggucuaauaagggucccac

SEQ ID NO: 125028 - RNA, 20 nt, Artificial Sequence
  MKO10125028_B_Usp51
  gRNA
gcuggacaugaccccguucu

SEQ ID NO: 125029 - RNA, 20 nt, Artificial Sequence
  MKO10125029_B_Usp53
  gRNA
augagucacacaagacuuag

SEQ ID NO: 125030 - RNA, 20 nt, Artificial Sequence
  MKO10125030_B_Usp53
  gRNA
ugccaugacucuguaugagc

SEQ ID NO: 125031 - RNA, 20 nt, Artificial Sequence
  MKO10125031_B_Usp53
  gRNA
ucagagcucucaagcuucuu

SEQ ID NO: 125032 - RNA, 20 nt, Artificial Sequence
  MKO10125032_B_Usp54
  gRNA
cccgcugcccuuuauccaga

SEQ ID NO: 125033 - RNA, 20 nt, Artificial Sequence
  MKO10125033_B_Usp54
  gRNA
aaagggcagcgggucggacg

SEQ ID NO: 125034 - RNA, 20 nt, Artificial Sequence
  MKO10125034_B_Usp54
  gRNA
uuguaagcugccgaaagcua

SEQ ID NO: 125035 - RNA, 20 nt, Artificial Sequence
  MKO10125035_B_Usp5
  gRNA
agaucgcucgggauggguug

SEQ ID NO: 125036 - RNA, 20 nt, Artificial Sequence
  MKO10125036_B_Usp5
  gRNA
uugggauggggaaguccguc

SEQ ID NO: 125037 - RNA, 20 nt, Artificial Sequence
  MKO10125037_B_Usp5
  gRNA
caccucggaagaagcccacc

SEQ ID NO: 125038 - RNA, 20 nt, Artificial Sequence
  MKO10125038_B_Usp6nl
  gRNA
cccauaccauaaugcagcug

SEQ ID NO: 125039 - RNA, 20 nt, Artificial Sequence
  MKO10125039_B_Usp6nl
  gRNA
aaaucgaaaggacuuccaag

SEQ ID NO: 125040 - RNA, 20 nt, Artificial Sequence
  MKO10125040_B_Usp6nl
  gRNA
ucucuccacagauuccgacc

SEQ ID NO: 125041 - RNA, 20 nt, Artificial Sequence
  MKO10125041_B_Usp7
  gRNA
agaacaaguggcugauucgc

SEQ ID NO: 125042 - RNA, 20 nt, Artificial Sequence
  MKO10125042_B_Usp7
  gRNA
ucuucagcacugcuugugcg

SEQ ID NO: 125043 - RNA, 20 nt, Artificial Sequence
  MKO10125043_B_Usp7
  gRNA
ugccuguacaaaaacuucaa

SEQ ID NO: 125044 - RNA, 20 nt, Artificial Sequence
  MKO10125044_B_Usp8
  gRNA
accugcuguugcuugaaauc

SEQ ID NO: 125045 - RNA, 20 nt, Artificial Sequence
  MKO10125045_B_Usp8
  gRNA
uugcaauacccuuuggguuu

SEQ ID NO: 125046 - RNA, 20 nt, Artificial Sequence
  MKO10125046_B_Usp8
  gRNA
ucuccgaaagccuuaaacua

SEQ ID NO: 125047 - RNA, 20 nt, Artificial Sequence
  MKO10125047_B_Usp9x
  gRNA
aaaacuggaacaacccaucg

SEQ ID NO: 125048 - RNA, 20 nt, Artificial Sequence
  MKO10125048_B_Usp9x
  gRNA
gcuauugaucuuaguaagaa

SEQ ID NO: 125049 - RNA, 20 nt, Artificial Sequence
  MKO10125049_B_Usp9x
  gRNA
aguuagaugauaugaucaac

SEQ ID NO: 125050 - RNA, 20 nt, Artificial Sequence
  MKO10125050_B_Usp9y
  gRNA
uuguguggccaaauugucuc

SEQ ID NO: 125051 - RNA, 20 nt, Artificial Sequence
  MKO10125051_B_Usp9y
  gRNA
cacaaagcuccaccaggcga

SEQ ID NO: 125052 - RNA, 20 nt, Artificial Sequence
  MKO10125052_B_Usp9y
  gRNA
ucaccuuggccuuguucaua

SEQ ID NO: 125053 - RNA, 20 nt, Artificial Sequence
  MKO10125053_B_Uspl1
  gRNA
ucaacaccuccaagugcacc

SEQ ID NO: 125054 - RNA, 20 nt, Artificial Sequence
  MKO10125054_B_Uspl1
  gRNA
uuaccaauauuguuccugag

SEQ ID NO: 125055 - RNA, 20 nt, Artificial Sequence
  MKO10125055_B_Uspl1
  gRNA
gguucaagcuuuaacaguac

SEQ ID NO: 125056 - RNA, 20 nt, Artificial Sequence
  MKO10125056_B_Ust
  gRNA
ccauggaccaccuccuagua

SEQ ID NO: 125057 - RNA, 20 nt, Artificial Sequence
  MKO10125057_B_Ust
  gRNA
uacaacagaguuggcaagug

SEQ ID NO: 125058 - RNA, 20 nt, Artificial Sequence
  MKO10125058_B_Ust
  gRNA
gacaugucucgugaauaaau

SEQ ID NO: 125059 - RNA, 20 nt, Artificial Sequence
  MKO10125059_B_uuf1
  gRNA
gaugucgcccaagugcguca

SEQ ID NO: 125060 - RNA, 20 nt, Artificial Sequence
  MKO10125060_B_uuf1
  gRNA
ggcgugcgcugcgccgaguc

SEQ ID NO: 125061 - RNA, 20 nt, Artificial Sequence
  MKO10125061_B_uuf1
  gRNA
acucggcgcagcgcacgccc

SEQ ID NO: 125062 - RNA, 20 nt, Artificial Sequence
  MKO10125062_B_uup11l
  gRNA
gaaaucagagcuccaucugc

SEQ ID NO: 125063 - RNA, 20 nt, Artificial Sequence
  MKO10125063_B_uup11l
  gRNA
aauucuacuauaaaaugacu

SEQ ID NO: 125064 - RNA, 20 nt, Artificial Sequence
  MKO10125064_B_uup11l
  gRNA
gcuucuucuguugcuucccc

SEQ ID NO: 125065 - RNA, 20 nt, Artificial Sequence
  MKO10125065_B_uup14a
  gRNA
gaaauugccugagagaucug

SEQ ID NO: 125066 - RNA, 20 nt, Artificial Sequence
  MKO10125066_B_uup14a
  gRNA
aauccauuagaucauccugc

SEQ ID NO: 125067 - RNA, 20 nt, Artificial Sequence
  MKO10125067_B_uup14a
  gRNA
gagguccaagcagaucagaa

SEQ ID NO: 125068 - RNA, 20 nt, Artificial Sequence
  MKO10125068_B_uup14b
  gRNA
aaaacccuauuggguacaug

SEQ ID NO: 125069 - RNA, 20 nt, Artificial Sequence
  MKO10125069_B_uup14b
  gRNA
guguuccacauguacccaau

SEQ ID NO: 125070 - RNA, 20 nt, Artificial Sequence
  MKO10125070_B_uup14b
  gRNA
gucugcuacagcauuaucuu

SEQ ID NO: 125071 - RNA, 20 nt, Artificial Sequence
  MKO10125071_B_uup15
  gRNA
aagaacauucugauuacgug

SEQ ID NO: 125072 - RNA, 20 nt, Artificial Sequence
  MKO10125072_B_uup15
  gRNA
ccaaauuccuuaaucugaac

SEQ ID NO: 125073 - RNA, 20 nt, Artificial Sequence
  MKO10125073_B_uup15
  gRNA
uuacaggcucuugagaguac

SEQ ID NO: 125074 - RNA, 20 nt, Artificial Sequence
  MKO10125074_B_uup18
  gRNA
aagcggaggacaucuucaga

SEQ ID NO: 125075 - RNA, 20 nt, Artificial Sequence
  MKO10125075_B_uup18
  gRNA
ucaucuucauccacccaaac

SEQ ID NO: 125076 - RNA, 20 nt, Artificial Sequence
  MKO10125076_B_uup18
  gRNA
ucuuagauuccagcaugcca

SEQ ID NO: 125077 - RNA, 20 nt, Artificial Sequence
  MKO10125077_B_uup20
  gRNA
agcuugcaguucugucgaua

SEQ ID NO: 125078 - RNA, 20 nt, Artificial Sequence
  MKO10125078_B_uup20
  gRNA
cguaucuuuacaaguaccug

SEQ ID NO: 125079 - RNA, 20 nt, Artificial Sequence
  MKO10125079_B_uup20
  gRNA
uuuggccuaccaaccucuuu

SEQ ID NO: 125080 - RNA, 20 nt, Artificial Sequence
  MKO10125080_B_uup23
  gRNA
ugcgaccccgcagcgccgcc

SEQ ID NO: 125081 - RNA, 20 nt, Artificial Sequence
  MKO10125081_B_uup23
  gRNA
ucuccccagauguguguuaa

SEQ ID NO: 125082 - RNA, 20 nt, Artificial Sequence
  MKO10125082_B_uup23
  gRNA
acugauugcacagaaaugcc

SEQ ID NO: 125083 - RNA, 20 nt, Artificial Sequence
  MKO10125083_B_uup3
  gRNA
cggcucagugggccgccgug

SEQ ID NO: 125084 - RNA, 20 nt, Artificial Sequence
  MKO10125084_B_uup3
  gRNA
uugucucagcuucgucuacc

SEQ ID NO: 125085 - RNA, 20 nt, Artificial Sequence
  MKO10125085_B_uup3
  gRNA
acgaaaaugaggacgacuug

SEQ ID NO: 125086 - RNA, 20 nt, Artificial Sequence
  MKO10125086_B_uup6
  gRNA
ugauaaagucuuccuugaga

SEQ ID NO: 125087 - RNA, 20 nt, Artificial Sequence
  MKO10125087_B_uup6
  gRNA
cugcagggcuaucaucaaga

SEQ ID NO: 125088 - RNA, 20 nt, Artificial Sequence
  MKO10125088_B_uup6
  gRNA
aacuuacugcucuucuucuc

SEQ ID NO: 125089 - RNA, 20 nt, Artificial Sequence
  MKO10125089_B_uurn
  gRNA
cagguggacuuggugaauau

SEQ ID NO: 125090 - RNA, 20 nt, Artificial Sequence
  MKO10125090_B_uurn
  gRNA
gaguaacccuaaagucagcu

SEQ ID NO: 125091 - RNA, 20 nt, Artificial Sequence
  MKO10125091_B_uurn
  gRNA
guuuaaggcaugcacccuug

SEQ ID NO: 125092 - RNA, 20 nt, Artificial Sequence
  MKO10125092_B_uus2b
  gRNA
uggagaucuucccagcaaac

SEQ ID NO: 125093 - RNA, 20 nt, Artificial Sequence
  MKO10125093_B_uus2b
  gRNA
ucuaaguucuuccaguuugc

SEQ ID NO: 125094 - RNA, 20 nt, Artificial Sequence
  MKO10125094_B_uus2b
  gRNA
agauaaauugucuaaagcau

SEQ ID NO: 125095 - RNA, 20 nt, Artificial Sequence
  MKO10125095_B_uus2r
  gRNA
gugagcggcccgaguccugc

SEQ ID NO: 125096 - RNA, 20 nt, Artificial Sequence
  MKO10125096_B_uus2r
  gRNA
ugcagcuguugccguaagug

SEQ ID NO: 125097 - RNA, 20 nt, Artificial Sequence
  MKO10125097_B_uus2r
  gRNA
uggagcgcuggacggugucc

SEQ ID NO: 125098 - RNA, 20 nt, Artificial Sequence
  MKO10125098_B_uus2
  gRNA
ccucucaccaguguccguga

SEQ ID NO: 125099 - RNA, 20 nt, Artificial Sequence
  MKO10125099_B_uus2
  gRNA
gcagacccugcgucagacca

SEQ ID NO: 125100 - RNA, 20 nt, Artificial Sequence
  MKO10125100_B_uus2
  gRNA
acugcugucccuucccguca

SEQ ID NO: 125101 - RNA, 20 nt, Artificial Sequence
  MKO10125101_B_uuy
  gRNA
uuacuggaagauuauucaaa

SEQ ID NO: 125102 - RNA, 20 nt, Artificial Sequence
  MKO10125102_B_uuy
  gRNA
ucuacuacaaugcauuucag

SEQ ID NO: 125103 - RNA, 20 nt, Artificial Sequence
  MKO10125103_B_uuy
  gRNA
ucuuuaauaguaaaagcuga

SEQ ID NO: 125104 - RNA, 20 nt, Artificial Sequence
  MKO10125104_B_Uvrag
  gRNA
acagauguauccagacgauc

SEQ ID NO: 125105 - RNA, 20 nt, Artificial Sequence
  MKO10125105_B_Uvrag
  gRNA
cccucuuaccuuguguucac

SEQ ID NO: 125106 - RNA, 20 nt, Artificial Sequence
  MKO10125106_B_Uvrag
  gRNA
cggugcucccugugaacaca

SEQ ID NO: 125107 - RNA, 20 nt, Artificial Sequence
  MKO10125107_B_Uvssa
  gRNA
ugaggacgaacccagcgacc

SEQ ID NO: 125108 - RNA, 20 nt, Artificial Sequence
  MKO10125108_B_Uvssa
  gRNA
aacccaguccauggcuccgc

SEQ ID NO: 125109 - RNA, 20 nt, Artificial Sequence
  MKO10125109_B_Uvssa
  gRNA
cuuccauuucccucuuagcc

SEQ ID NO: 125110 - RNA, 20 nt, Artificial Sequence
  MKO10125110_B_Uxs1
  gRNA
aacaggucuauccaggaaaa

SEQ ID NO: 125111 - RNA, 20 nt, Artificial Sequence
  MKO10125111_B_Uxs1
  gRNA
aagagagaaaaucagagauu

SEQ ID NO: 125112 - RNA, 20 nt, Artificial Sequence
  MKO10125112_B_Uxt
  gRNA
guuauauaugcagguggauu

SEQ ID NO: 125113 - RNA, 20 nt, Artificial Sequence
  MKO10125113_B_Uxt
  gRNA
agauacuucacgcaucuaug

SEQ ID NO: 125114 - RNA, 20 nt, Artificial Sequence
  MKO10125114_B_Uxt
  gRNA
cugugaggagagaacucuuu

SEQ ID NO: 125115 - RNA, 20 nt, Artificial Sequence
  MKO10125115_B_V1ra8
  gRNA
auuccugaaagucaacagug

SEQ ID NO: 125116 - RNA, 20 nt, Artificial Sequence
  MKO10125116_B_V1ra8
  gRNA
uuuccacacuguugacuuuc

SEQ ID NO: 125117 - RNA, 20 nt, Artificial Sequence
  MKO10125117_B_V1ra8
  gRNA
agcuaugagcgacaagaauc

SEQ ID NO: 125118 - RNA, 20 nt, Artificial Sequence
  MKO10125118_B_V1rd18
  gRNA
gcuauacuuauaaaagagua

SEQ ID NO: 125119 - RNA, 20 nt, Artificial Sequence
  MKO10125119_B_V1rd18
  gRNA
aguuauauaccagagaaugg

SEQ ID NO: 125120 - RNA, 20 nt, Artificial Sequence
  MKO10125120_B_V1rd18
  gRNA
auuccuuuaccugaauuaac

SEQ ID NO: 125121 - RNA, 20 nt, Artificial Sequence
  MKO10125121_B_V1rd19
  gRNA
auuccuuuaccugaauuaac

SEQ ID NO: 125122 - RNA, 20 nt, Artificial Sequence
  MKO10125122_B_V1rd19
  gRNA
acacuuguuccuguuaauuc

SEQ ID NO: 125123 - RNA, 20 nt, Artificial Sequence
  MKO10125123_B_V1rd19
  gRNA
uauauucucaucauucccug

SEQ ID NO: 125124 - RNA, 20 nt, Artificial Sequence
  MKO10125124_B_Vac14
  gRNA
gcuccuggaccgccucuuaa

SEQ ID NO: 125125 - RNA, 20 nt, Artificial Sequence
  MKO10125125_B_Vac14
  gRNA
gaucacgugcuugauuugca

SEQ ID NO: 125126 - RNA, 20 nt, Artificial Sequence
  MKO10125126_B_Vac14
  gRNA
gaccgaugaggcccccuuuc

SEQ ID NO: 125127 - RNA, 20 nt, Artificial Sequence
  MKO10125127_B_Vamp1
  gRNA
gcagugcugccaagcuaaaa

SEQ ID NO: 125128 - RNA, 20 nt, Artificial Sequence
  MKO10125128_B_Vamp1
  gRNA
agcuaucugugccaucaucg

SEQ ID NO: 125129 - RNA, 20 nt, Artificial Sequence
  MKO10125129_B_Vamp1
  gRNA
cucccaacaugaccaguaac

SEQ ID NO: 125130 - RNA, 20 nt, Artificial Sequence
  MKO10125130_B_Vamp2
  gRNA
ccaguauuugcgcuugagcu

SEQ ID NO: 125131 - RNA, 20 nt, Artificial Sequence
  MKO10125131_B_Vamp2
  gRNA
acucaccgaugaugaugaug

SEQ ID NO: 125132 - RNA, 20 nt, Artificial Sequence
  MKO10125132_B_Vamp2
  gRNA
cucuuagaugaugaucaucu

SEQ ID NO: 125133 - RNA, 20 nt, Artificial Sequence
  MKO10125133_B_Vamp3
  gRNA
cugccugcagugcaucugcg

SEQ ID NO: 125134 - RNA, 20 nt, Artificial Sequence
  MKO10125134_B_Vamp3
  gRNA
caggucuacaggugugccuu

SEQ ID NO: 125135 - RNA, 20 nt, Artificial Sequence
  MKO10125135_B_Vamp3
  gRNA
ugaugaugacaaugaucacc

SEQ ID NO: 125136 - RNA, 20 nt, Artificial Sequence
  MKO10125136_B_Vamp4
  gRNA
aaugcaagagaauauuacaa

SEQ ID NO: 125137 - RNA, 20 nt, Artificial Sequence
  MKO10125137_B_Vamp4
  gRNA
uucuuaacagagaaaucuuu

SEQ ID NO: 125138 - RNA, 20 nt, Artificial Sequence
  MKO10125138_B_Vamp4
  gRNA
agaugauucagaugaagaag

SEQ ID NO: 125139 - RNA, 20 nt, Artificial Sequence
  MKO10125139_B_Vamp5
  gRNA
agacgaccagcaacacaauc

SEQ ID NO: 125140 - RNA, 20 nt, Artificial Sequence
  MKO10125140_B_Vamp5
  gRNA
caugcucaacaauuucgaca

SEQ ID NO: 125141 - RNA, 20 nt, Artificial Sequence
  MKO10125141_B_Vamp5
  gRNA
cuuuagcccagcagaagcgc

SEQ ID NO: 125142 - RNA, 20 nt, Artificial Sequence
  MKO10125142_B_Vamp7
  gRNA
gagucuccaucacuuugucu

SEQ ID NO: 125143 - RNA, 20 nt, Artificial Sequence
  MKO10125143_B_Vamp7
  gRNA
aaagauacacaauccugucu

SEQ ID NO: 125144 - RNA, 20 nt, Artificial Sequence
  MKO10125144_B_Vamp7
  gRNA
cucuugaaccguaaguuguc

SEQ ID NO: 125145 - RNA, 20 nt, Artificial Sequence
  MKO10125145_B_Vamp8
  gRNA
caguggcaaaaaguauaaug

SEQ ID NO: 125146 - RNA, 20 nt, Artificial Sequence
  MKO10125146_B_Vamp8
  gRNA
ccaccuccgaaacaagacag

SEQ ID NO: 125147 - RNA, 20 nt, Artificial Sequence
  MKO10125147_B_Vamp8
  gRNA
gugguccagguucuccccuc

SEQ ID NO: 125148 - RNA, 20 nt, Artificial Sequence
  MKO10125148_B_Vangl1
  gRNA
guaggaauauccagaauacg

SEQ ID NO: 125149 - RNA, 20 nt, Artificial Sequence
  MKO10125149_B_Vangl1
  gRNA
cucugcccgcacaggcgcag

SEQ ID NO: 125150 - RNA, 20 nt, Artificial Sequence
  MKO10125150_B_Vangl1
  gRNA
gaacuuccucugcgccugug

SEQ ID NO: 125151 - RNA, 20 nt, Artificial Sequence
  MKO10125151_B_Vangl2
  gRNA
ugaccucacgcgcaucgcca

SEQ ID NO: 125152 - RNA, 20 nt, Artificial Sequence
  MKO10125152_B_Vangl2
  gRNA
ggauccacacugccacucgc

SEQ ID NO: 125153 - RNA, 20 nt, Artificial Sequence
  MKO10125153_B_Vangl2
  gRNA
ccacaaugaguacuacuacg

SEQ ID NO: 125154 - RNA, 20 nt, Artificial Sequence
  MKO10125154_B_Vapa
  gRNA
gggucaauugugacuguuuc

SEQ ID NO: 125155 - RNA, 20 nt, Artificial Sequence
  MKO10125155_B_Vapa
  gRNA
gccgaaugaaaaugauaagc

SEQ ID NO: 125156 - RNA, 20 nt, Artificial Sequence
  MKO10125156_B_Vapa
  gRNA
uuagaauccauuaauucauc

SEQ ID NO: 125157 - RNA, 20 nt, Artificial Sequence
  MKO10125157_B_Vapb
  gRNA
ggggccucucucaauguguc

SEQ ID NO: 125158 - RNA, 20 nt, Artificial Sequence
  MKO10125158_B_Vapb
  gRNA
ggcaucaaugaccccacugu

SEQ ID NO: 125159 - RNA, 20 nt, Artificial Sequence
  MKO10125159_B_Vapb
  gRNA
gccuccauaucagaaguguc

SEQ ID NO: 125160 - RNA, 20 nt, Artificial Sequence
  MKO10125160_B_Vars2
  gRNA
accagcgcacaagugcgucc

SEQ ID NO: 125161 - RNA, 20 nt, Artificial Sequence
  MKO10125161_B_Vars2
  gRNA
cgcgcacugaccugauacuc

SEQ ID NO: 125162 - RNA, 20 nt, Artificial Sequence
  MKO10125162_B_Vars2
  gRNA
uccaggacgcacuugugcgc

SEQ ID NO: 125163 - RNA, 20 nt, Artificial Sequence
  MKO10125163_B_Vars
  gRNA
gcugcggcugcacaccuacc

SEQ ID NO: 125164 - RNA, 20 nt, Artificial Sequence
  MKO10125164_B_Vars
  gRNA
uucuggacccuucugcccgc

SEQ ID NO: 125165 - RNA, 20 nt, Artificial Sequence
  MKO10125165_B_Vars
  gRNA
acccagcagcagcccccgca

SEQ ID NO: 125166 - RNA, 20 nt, Artificial Sequence
  MKO10125166_B_Vash1
  gRNA
gacgcccgucccugagcgcc

SEQ ID NO: 125167 - RNA, 20 nt, Artificial Sequence
  MKO10125167_B_Vash1
  gRNA
uucucauaggcugauggacc

SEQ ID NO: 125168 - RNA, 20 nt, Artificial Sequence
  MKO10125168_B_Vash1
  gRNA
guccccagguacaaucacac

SEQ ID NO: 125169 - RNA, 20 nt, Artificial Sequence
  MKO10125169_B_Vash2
  gRNA
acaaccuguaguuugggacc

SEQ ID NO: 125170 - RNA, 20 nt, Artificial Sequence
  MKO10125170_B_Vash2
  gRNA
cagguuaauggagacagcga

SEQ ID NO: 125171 - RNA, 20 nt, Artificial Sequence
  MKO10125171_B_Vash2
  gRNA
ucgcacagauacaaccacac

SEQ ID NO: 125172 - RNA, 20 nt, Artificial Sequence
  MKO10125172_B_Vasn
  gRNA
caggccacggaaggucucgu

SEQ ID NO: 125173 - RNA, 20 nt, Artificial Sequence
  MKO10125173_B_Vasn
  gRNA
ucgauaguacgguggaggcc

SEQ ID NO: 125174 - RNA, 20 nt, Artificial Sequence
  MKO10125174_B_Vasn
  gRNA
ccgguuggauguggcgaauu

SEQ ID NO: 125175 - RNA, 20 nt, Artificial Sequence
  MKO10125175_B_Vasp
  gRNA
ccucaacuucggcagcaagg

SEQ ID NO: 125176 - RNA, 20 nt, Artificial Sequence
  MKO10125176_B_Vasp
  gRNA
gggaccauucugggcagacc

SEQ ID NO: 125177 - RNA, 20 nt, Artificial Sequence
  MKO10125177_B_Vasp
  gRNA
caucaccugcauuggagacc

SEQ ID NO: 125178 - RNA, 20 nt, Artificial Sequence
  MKO10125178_B_Vau1l
  gRNA
ugccaggauucgaauguucu

SEQ ID NO: 125179 - RNA, 20 nt, Artificial Sequence
  MKO10125179_B_Vau1l
  gRNA
guccccaaugugaccgucuu

SEQ ID NO: 125180 - RNA, 20 nt, Artificial Sequence
  MKO10125180_B_Vau1l
  gRNA
cagaaaugcagacuacgugc

SEQ ID NO: 125181 - RNA, 20 nt, Artificial Sequence
  MKO10125181_B_Vau1
  gRNA
cuaccacacgacugacuaug

SEQ ID NO: 125182 - RNA, 20 nt, Artificial Sequence
  MKO10125182_B_Vau1
  gRNA
cguccacauagucagucgug

SEQ ID NO: 125183 - RNA, 20 nt, Artificial Sequence
  MKO10125183_B_Vau1
  gRNA
aaccucgaauugacucaguc

SEQ ID NO: 125184 - RNA, 20 nt, Artificial Sequence
  MKO10125184_B_Vav1
  gRNA
cucccagccaccgugugacc

SEQ ID NO: 125185 - RNA, 20 nt, Artificial Sequence
  MKO10125185_B_Vav1
  gRNA
cucacucaaucuggucugaa

SEQ ID NO: 125186 - RNA, 20 nt, Artificial Sequence
  MKO10125186_B_Vav1
  gRNA
gcacugucgccagagcucca

SEQ ID NO: 125187 - RNA, 20 nt, Artificial Sequence
  MKO10125187_B_Vav2
  gRNA
agucguagauguccucaccc

SEQ ID NO: 125188 - RNA, 20 nt, Artificial Sequence
  MKO10125188_B_Vav2
  gRNA
cucuuugauguccgagacuu

SEQ ID NO: 125189 - RNA, 20 nt, Artificial Sequence
  MKO10125189_B_Vav2
  gRNA
cacucaccuucccgaagucu

SEQ ID NO: 125190 - RNA, 20 nt, Artificial Sequence
  MKO10125190_B_Vav3
  gRNA
acuucggagagcuuccagac

SEQ ID NO: 125191 - RNA, 20 nt, Artificial Sequence
  MKO10125191_B_Vav3
  gRNA
uucuuacagaaacggaccaa

SEQ ID NO: 125192 - RNA, 20 nt, Artificial Sequence
  MKO10125192_B_Vav3
  gRNA
agggccauucaaaccaccag

SEQ ID NO: 125193 - RNA, 20 nt, Artificial Sequence
  MKO10125193_B_Vax1
  gRNA
guuccagcguugccaauacg

SEQ ID NO: 125194 - RNA, 20 nt, Artificial Sequence
  MKO10125194_B_Vax1
  gRNA
gagccgcagcacgcugcacg

SEQ ID NO: 125195 - RNA, 20 nt, Artificial Sequence
  MKO10125195_B_Vax1
  gRNA
ucucccggcccaccacguau

SEQ ID NO: 125196 - RNA, 20 nt, Artificial Sequence
  MKO10125196_B_Vax2
  gRNA
uggcagaggggacgacgccg

SEQ ID NO: 125197 - RNA, 20 nt, Artificial Sequence
  MKO10125197_B_Vax2
  gRNA
acgccucaauccaaugcccu

SEQ ID NO: 125198 - RNA, 20 nt, Artificial Sequence
  MKO10125198_B_Vax2
  gRNA
gggcaagacaauuucccgaa

SEQ ID NO: 125199 - RNA, 20 nt, Artificial Sequence
  MKO10125199_B_Vbp1
  gRNA
guuccauaaacuuauacuuc

SEQ ID NO: 125200 - RNA, 20 nt, Artificial Sequence
  MKO10125200_B_Vbp1
  gRNA
auaugauauugaugaagcuc

SEQ ID NO: 125201 - RNA, 20 nt, Artificial Sequence
  MKO10125201_B_Vbp1
  gRNA
uaaaaggauacugacuucug

SEQ ID NO: 125202 - RNA, 20 nt, Artificial Sequence
  MKO10125202_B_Vcam1
  gRNA
ugguagacccucgcuggaac

SEQ ID NO: 125203 - RNA, 20 nt, Artificial Sequence
  MKO10125203_B_Vcam1
  gRNA
aaccuuuacucccgucauug

SEQ ID NO: 125204 - RNA, 20 nt, Artificial Sequence
  MKO10125204_B_Vcam1
  gRNA
gacaaugaccuguuccagcg

SEQ ID NO: 125205 - RNA, 20 nt, Artificial Sequence
  MKO10125205_B_Vcan
  gRNA
cuggggagagcggaauccau

SEQ ID NO: 125206 - RNA, 20 nt, Artificial Sequence
  MKO10125206_B_Vcan
  gRNA
gcagcuguuugccgccuaug

SEQ ID NO: 125207 - RNA, 20 nt, Artificial Sequence
  MKO10125207_B_Vcan
  gRNA
gcuccccgagagggcuguua

SEQ ID NO: 125208 - RNA, 20 nt, Artificial Sequence
  MKO10125208_B_Vcl
  gRNA
uucagguucguaaaauuauu

SEQ ID NO: 125209 - RNA, 20 nt, Artificial Sequence
  MKO10125209_B_Vcl
  gRNA
guuacucacuuaauaaaggc

SEQ ID NO: 125210 - RNA, 20 nt, Artificial Sequence
  MKO10125210_B_Vcl
  gRNA
ugccccaggaaugacuaaga

SEQ ID NO: 125211 - RNA, 20 nt, Artificial Sequence
  MKO10125211_B_Vcpip1
  gRNA
gagcuuauucgaauagcucc

SEQ ID NO: 125212 - RNA, 20 nt, Artificial Sequence
  MKO10125212_B_Vcpip1
  gRNA
uguagaauacaccacccugc

SEQ ID NO: 125213 - RNA, 20 nt, Artificial Sequence
  MKO10125213_B_Vcpip1
  gRNA
acuuccucacauguuccagc

SEQ ID NO: 125214 - RNA, 20 nt, Artificial Sequence
  MKO10125214_B_Vcpkmt
  gRNA
augaacaagcaucuugugac

SEQ ID NO: 125215 - RNA, 20 nt, Artificial Sequence
  MKO10125215_B_Vcpkmt
  gRNA
caaagucaaagucuagcugc

SEQ ID NO: 125216 - RNA, 20 nt, Artificial Sequence
  MKO10125216_B_Vcpkmt
  gRNA
cacugaucuugaagagcugc

SEQ ID NO: 125217 - RNA, 20 nt, Artificial Sequence
  MKO10125217_B_Vcp
  gRNA
aacagaagaaccgacccaau

SEQ ID NO: 125218 - RNA, 20 nt, Artificial Sequence
  MKO10125218_B_Vcp
  gRNA
cacgcuguuaucuucauuga

SEQ ID NO: 125219 - RNA, 20 nt, Artificial Sequence
  MKO10125219_B_Vcp
  gRNA
gaugaacugcaguuguuccg

SEQ ID NO: 125220 - RNA, 20 nt, Artificial Sequence
  MKO10125220_B_Vdac1
  gRNA
agccaagcaccagagcgccc

SEQ ID NO: 125221 - RNA, 20 nt, Artificial Sequence
  MKO10125221_B_Vdac1
  gRNA
uuuaaggaauuuaccagcuc

SEQ ID NO: 125222 - RNA, 20 nt, Artificial Sequence
  MKO10125222_B_Vdac1
  gRNA
uuccaggcugccguucacuu

SEQ ID NO: 125223 - RNA, 20 nt, Artificial Sequence
  MKO10125223_B_Vdac2
  gRNA
gugaagacgaagucaugcag

SEQ ID NO: 125224 - RNA, 20 nt, Artificial Sequence
  MKO10125224_B_Vdac2
  gRNA
ccuccacccuaugcugaccu

SEQ ID NO: 125225 - RNA, 20 nt, Artificial Sequence
  MKO10125225_B_Vdac2
  gRNA
agagauugcaauugaagacc

SEQ ID NO: 125226 - RNA, 20 nt, Artificial Sequence
  MKO10125226_B_Vdac3
  gRNA
uauugucuguauuccacuuu

SEQ ID NO: 125227 - RNA, 20 nt, Artificial Sequence
  MKO10125227_B_Vdac3
  gRNA
cccuguguuugguacaaaua

SEQ ID NO: 125228 - RNA, 20 nt, Artificial Sequence
  MKO10125228_B_Vdac3
  gRNA
acugauacagggaaagcauc

SEQ ID NO: 125229 - RNA, 20 nt, Artificial Sequence
  MKO10125229_B_Vdr
  gRNA
ucuuguggugggcaucgagc

SEQ ID NO: 125230 - RNA, 20 nt, Artificial Sequence
  MKO10125230_B_Vdr
  gRNA
accccaccuaugccgacuuc

SEQ ID NO: 125231 - RNA, 20 nt, Artificial Sequence
  MKO10125231_B_Vdr
  gRNA
auucgugcagacguaaguac

SEQ ID NO: 125232 - RNA, 20 nt, Artificial Sequence
  MKO10125232_B_Vegfa
  gRNA
uucggaggcccguccggggc

SEQ ID NO: 125233 - RNA, 20 nt, Artificial Sequence
  MKO10125233_B_Vegfa
  gRNA
caggcugcacccacgacaga

SEQ ID NO: 125234 - RNA, 20 nt, Artificial Sequence
  MKO10125234_B_Vegfa
  gRNA
cuucugcucuccuucugucg

SEQ ID NO: 125235 - RNA, 20 nt, Artificial Sequence
  MKO10125235_B_Vegfb
  gRNA
gggccaucaaacugggacac

SEQ ID NO: 125236 - RNA, 20 nt, Artificial Sequence
  MKO10125236_B_Vegfb
  gRNA
gccccugugucccaguuuga

SEQ ID NO: 125237 - RNA, 20 nt, Artificial Sequence
  MKO10125237_B_Vegfb
  gRNA
gcuggcaccugcauucacau

SEQ ID NO: 125238 - RNA, 20 nt, Artificial Sequence
  MKO10125238_B_Vegfc
  gRNA
uaacuacaugugccgaugcc

SEQ ID NO: 125239 - RNA, 20 nt, Artificial Sequence
  MKO10125239_B_Vegfc
  gRNA
acaucuauacacaccucacg

SEQ ID NO: 125240 - RNA, 20 nt, Artificial Sequence
  MKO10125240_B_Vegfc
  gRNA
acucacugugguaauguugc

SEQ ID NO: 125241 - RNA, 20 nt, Artificial Sequence
  MKO10125241_B_Veph1
  gRNA
cagcagauccgccuugguga

SEQ ID NO: 125242 - RNA, 20 nt, Artificial Sequence
  MKO10125242_B_Veph1
  gRNA
uacagauuucaaccaccgcc

SEQ ID NO: 125243 - RNA, 20 nt, Artificial Sequence
  MKO10125243_B_Veph1
  gRNA
ccuggccuugaugucucaau

SEQ ID NO: 125244 - RNA, 20 nt, Artificial Sequence
  MKO10125244_B_Vezf1
  gRNA
uggaauagcgugcaugagug

SEQ ID NO: 125245 - RNA, 20 nt, Artificial Sequence
  MKO10125245_B_Vezf1
  gRNA
acguguuacaguugauacuu

SEQ ID NO: 125246 - RNA, 20 nt, Artificial Sequence
  MKO10125246_B_Vezf1
  gRNA
aacaacaacaugugacaagc

SEQ ID NO: 125247 - RNA, 20 nt, Artificial Sequence
  MKO10125247_B_Vezt
  gRNA
ucaucauguuucccacgugc

SEQ ID NO: 125248 - RNA, 20 nt, Artificial Sequence
  MKO10125248_B_Vezt
  gRNA
aacucacagaguaaaucccc

SEQ ID NO: 125249 - RNA, 20 nt, Artificial Sequence
  MKO10125249_B_Vezt
  gRNA
agaugacuuacuccauaagu

SEQ ID NO: 125250 - RNA, 20 nt, Artificial Sequence
  MKO10125250_B_Vgf
  gRNA
cagccgcucuucuugcgccg

SEQ ID NO: 125251 - RNA, 20 nt, Artificial Sequence
  MKO10125251_B_Vgf
  gRNA
gaagaacgccccucccgagc

SEQ ID NO: 125252 - RNA, 20 nt, Artificial Sequence
  MKO10125252_B_Vgf
  gRNA
cccucgagccggcgcaccuu

SEQ ID NO: 125253 - RNA, 20 nt, Artificial Sequence
  MKO10125253_B_Vgll1
  gRNA
acuccagaggucuacccuga

SEQ ID NO: 125254 - RNA, 20 nt, Artificial Sequence
  MKO10125254_B_Vgll1
  gRNA
ccuacuuucaucaucaagac

SEQ ID NO: 125255 - RNA, 20 nt, Artificial Sequence
  MKO10125255_B_Vgll1
  gRNA
agaacugaaagacgugccug

SEQ ID NO: 125256 - RNA, 20 nt, Artificial Sequence
  MKO10125256_B_Vgll2
  gRNA
cccgcaccaucccuaugcgc

SEQ ID NO: 125257 - RNA, 20 nt, Artificial Sequence
  MKO10125257_B_Vgll2
  gRNA
agccuacuacucaaaaaugc

SEQ ID NO: 125258 - RNA, 20 nt, Artificial Sequence
  MKO10125258_B_Vgll2
  gRNA
uugauguacucagcuucggg

SEQ ID NO: 125259 - RNA, 20 nt, Artificial Sequence
  MKO10125259_B_Vgll3
  gRNA
cucgcacugauggcauuagc

SEQ ID NO: 125260 - RNA, 20 nt, Artificial Sequence
  MKO10125260_B_Vgll3
  gRNA
caaauucuuaccucgccaua

SEQ ID NO: 125261 - RNA, 20 nt, Artificial Sequence
  MKO10125261_B_Vgll3
  gRNA
gaaagaccagccugccgaga

SEQ ID NO: 125262 - RNA, 20 nt, Artificial Sequence
  MKO10125262_B_Vgll4
  gRNA
ugugauuaccugugcauccg

SEQ ID NO: 125263 - RNA, 20 nt, Artificial Sequence
  MKO10125263_B_Vgll4
  gRNA
ggagccgcagucccauugaa

SEQ ID NO: 125264 - RNA, 20 nt, Artificial Sequence
  MKO10125264_B_Vgll4
  gRNA
cacugucccaucgcacacag

SEQ ID NO: 125265 - RNA, 20 nt, Artificial Sequence
  MKO10125265_B_Vhl
  gRNA
gugccaucccucaaugucga

SEQ ID NO: 125266 - RNA, 20 nt, Artificial Sequence
  MKO10125266_B_Vhl
  gRNA
uguauguccuuccgcacacu

SEQ ID NO: 125267 - RNA, 20 nt, Artificial Sequence
  MKO10125267_B_Vhl
  gRNA
caucgucaggucacucuaug

SEQ ID NO: 125268 - RNA, 20 nt, Artificial Sequence
  MKO10125268_B_Vil1
  gRNA
uuacccgaagucucuccaug

SEQ ID NO: 125269 - RNA, 20 nt, Artificial Sequence
  MKO10125269_B_Vil1
  gRNA
ugggccagagaguaaccgca

SEQ ID NO: 125270 - RNA, 20 nt, Artificial Sequence
  MKO10125270_B_Vil1
  gRNA
ucucguugccuugaaccucg

SEQ ID NO: 125271 - RNA, 20 nt, Artificial Sequence
  MKO10125271_B_Vill
  gRNA
gauucagugaccugcacuac

SEQ ID NO: 125272 - RNA, 20 nt, Artificial Sequence
  MKO10125272_B_Vill
  gRNA
cucaguaauccauauuugca

SEQ ID NO: 125273 - RNA, 20 nt, Artificial Sequence
  MKO10125273_B_Vill
  gRNA
aaauucccaugagcccuuuc

SEQ ID NO: 125274 - RNA, 20 nt, Artificial Sequence
  MKO10125274_B_Vimp
  gRNA
agcugcucguuugagaaugc

SEQ ID NO: 125275 - RNA, 20 nt, Artificial Sequence
  MKO10125275_B_Vimp
  gRNA
cccuucgacugagggcuuug

SEQ ID NO: 125276 - RNA, 20 nt, Artificial Sequence
  MKO10125276_B_Vimp
  gRNA
uucuuaccaccuccucgcaa

SEQ ID NO: 125277 - RNA, 20 nt, Artificial Sequence
  MKO10125277_B_Vim
  gRNA
uggaaacguccacaucgauc

SEQ ID NO: 125278 - RNA, 20 nt, Artificial Sequence
  MKO10125278_B_Vim
  gRNA
ucuugaccuugaacggaaag

SEQ ID NO: 125279 - RNA, 20 nt, Artificial Sequence
  MKO10125279_B_Vim
  gRNA
aggauuccacuuuccguuca

SEQ ID NO: 125280 - RNA, 20 nt, Artificial Sequence
  MKO10125280_B_Vipas39
  gRNA
cuccagaugaaccggacaaa

SEQ ID NO: 125281 - RNA, 20 nt, Artificial Sequence
  MKO10125281_B_Vipas39
  gRNA
gaguagcgggucaaccccug

SEQ ID NO: 125282 - RNA, 20 nt, Artificial Sequence
  MKO10125282_B_Vipas39
  gRNA
gaauagccuucgagacaucg

SEQ ID NO: 125283 - RNA, 20 nt, Artificial Sequence
  MKO10125283_B_Vipr1
  gRNA
agccguaacugcacugaaga

SEQ ID NO: 125284 - RNA, 20 nt, Artificial Sequence
  MKO10125284_B_Vipr1
  gRNA
agccuucuucagugcaguua

SEQ ID NO: 125285 - RNA, 20 nt, Artificial Sequence
  MKO10125285_B_Vipr1
  gRNA
gaacaggcucaagauagcca

SEQ ID NO: 125286 - RNA, 20 nt, Artificial Sequence
  MKO10125286_B_Vipr2
  gRNA
ccacacgcaucuaugaaauc

SEQ ID NO: 125287 - RNA, 20 nt, Artificial Sequence
  MKO10125287_B_Vipr2
  gRNA
uucuagccugcagcgguguc

SEQ ID NO: 125288 - RNA, 20 nt, Artificial Sequence
  MKO10125288_B_Vipr2
  gRNA
gcauaauuaucugccucuuc

SEQ ID NO: 125289 - RNA, 20 nt, Artificial Sequence
  MKO10125289_B_Vip
  gRNA
gggucaccugcuccuucaaa

SEQ ID NO: 125290 - RNA, 20 nt, Artificial Sequence
  MKO10125290_B_Vip
  gRNA
uaccugaacuccauccugaa

SEQ ID NO: 125291 - RNA, 20 nt, Artificial Sequence
  MKO10125291_B_Vip
  gRNA
cacccuauuaugauguguca

SEQ ID NO: 125292 - RNA, 20 nt, Artificial Sequence
  MKO10125292_B_Vit
  gRNA
aaauaccauguuuacggcac

SEQ ID NO: 125293 - RNA, 20 nt, Artificial Sequence
  MKO10125293_B_Vit
  gRNA
gaugaauauguaagagucga

SEQ ID NO: 125294 - RNA, 20 nt, Artificial Sequence
  MKO10125294_B_Vit
  gRNA
aaaacugcagcugcuaaagc

SEQ ID NO: 125295 - RNA, 20 nt, Artificial Sequence
  MKO10125295_B_Vkorc1l1
  gRNA
auaaguccaaagacacuguu

SEQ ID NO: 125296 - RNA, 20 nt, Artificial Sequence
  MKO10125296_B_Vkorc1l1
  gRNA
aaccagccaaacagugucuu

SEQ ID NO: 125297 - RNA, 20 nt, Artificial Sequence
  MKO10125297_B_Vkorc1l1
  gRNA
agccagcgcaguugcagcuc

SEQ ID NO: 125298 - RNA, 20 nt, Artificial Sequence
  MKO10125298_B_Vkorc1
  gRNA
cagguacacggaaccagcga

SEQ ID NO: 125299 - RNA, 20 nt, Artificial Sequence
  MKO10125299_B_Vkorc1
  gRNA
cucaccuaacaacagcugua

SEQ ID NO: 125300 - RNA, 20 nt, Artificial Sequence
  MKO10125300_B_Vkorc1
  gRNA
uacaccuuacagcuguuguu

SEQ ID NO: 125301 - RNA, 20 nt, Artificial Sequence
  MKO10125301_B_Vldlr
  gRNA
gcaugggcacguccgcgcgc

SEQ ID NO: 125302 - RNA, 20 nt, Artificial Sequence
  MKO10125302_B_Vldlr
  gRNA
ggccauuugugcacugaaac

SEQ ID NO: 125303 - RNA, 20 nt, Artificial Sequence
  MKO10125303_B_Vldlr
  gRNA
cggggauacacugaguagaa

SEQ ID NO: 125304 - RNA, 20 nt, Artificial Sequence
  MKO10125304_B_Vma21
  gRNA
cuucacagcuuuaaugauca

SEQ ID NO: 125305 - RNA, 20 nt, Artificial Sequence
  MKO10125305_B_Vma21
  gRNA
cugucgugagccuucauucc

SEQ ID NO: 125306 - RNA, 20 nt, Artificial Sequence
  MKO10125306_B_Vma21
  gRNA
ugcuguuguugcuguucaug

SEQ ID NO: 125307 - RNA, 20 nt, Artificial Sequence
  MKO10125307_B_Vmac
  gRNA
cacucgccaccgaccacccc

SEQ ID NO: 125308 - RNA, 20 nt, Artificial Sequence
  MKO10125308_B_Vmac
  gRNA
ucuccagcuccgcugcgcgu

SEQ ID NO: 125309 - RNA, 20 nt, Artificial Sequence
  MKO10125309_B_Vmac
  gRNA
agcugggucgcgccaaggac

SEQ ID NO: 125310 - RNA, 20 nt, Artificial Sequence
  MKO10125310_B_Vmn1r-ps103
  gRNA
cccaaggcaauagaaacuuu

SEQ ID NO: 125311 - RNA, 20 nt, Artificial Sequence
  MKO10125311_B_Vmn1r-ps103
  gRNA
uacuuaugauagaauguauu

SEQ ID NO: 125312 - RNA, 20 nt, Artificial Sequence
  MKO10125312_B_Vmn1r-ps103
  gRNA
uugaguuugaaaagcaguca

SEQ ID NO: 125313 - RNA, 20 nt, Artificial Sequence
  MKO10125313_B_Vmn1r100
  gRNA
uaacauccacauuccaauua

SEQ ID NO: 125314 - RNA, 20 nt, Artificial Sequence
  MKO10125314_B_Vmn1r100
  gRNA
guguuauugucuauuaucug

SEQ ID NO: 125315 - RNA, 20 nt, Artificial Sequence
  MKO10125315_B_Vmn1r100
  gRNA
aacuuguucuguuccacuuc

SEQ ID NO: 125316 - RNA, 20 nt, Artificial Sequence
  MKO10125316_B_Vmn1r101
  gRNA
caucauaggcaaacugcaag

SEQ ID NO: 125317 - RNA, 20 nt, Artificial Sequence
  MKO10125317_B_Vmn1r101
  gRNA
guuauucuucuuacaguugu

SEQ ID NO: 125318 - RNA, 20 nt, Artificial Sequence
  MKO10125318_B_Vmn1r101
  gRNA
gccuacacugaauccagaag

SEQ ID NO: 125319 - RNA, 20 nt, Artificial Sequence
  MKO10125319_B_Vmn1r103
  gRNA
guguuauugucuguuaucug

SEQ ID NO: 125320 - RNA, 20 nt, Artificial Sequence
  MKO10125320_B_Vmn1r103
  gRNA
aacuuguucuguuccacuuc

SEQ ID NO: 125321 - RNA, 20 nt, Artificial Sequence
  MKO10125321_B_Vmn1r103
  gRNA
cagugaccuuaauugaaaug

SEQ ID NO: 125322 - RNA, 20 nt, Artificial Sequence
  MKO10125322_B_Vmn1r104
  gRNA
auuauuccugcuacaguugu

SEQ ID NO: 125323 - RNA, 20 nt, Artificial Sequence
  MKO10125323_B_Vmn1r104
  gRNA
guguuauugucuguuaucug

SEQ ID NO: 125324 - RNA, 20 nt, Artificial Sequence
  MKO10125324_B_Vmn1r104
  gRNA
uaacauccacauuccaauua

SEQ ID NO: 125325 - RNA, 20 nt, Artificial Sequence
  MKO10125325_B_Vmn1r107
  gRNA
auuauuccugcuacaguugu

SEQ ID NO: 125326 - RNA, 20 nt, Artificial Sequence
  MKO10125326_B_Vmn1r107
  gRNA
guguuauugucuguuaucug

SEQ ID NO: 125327 - RNA, 20 nt, Artificial Sequence
  MKO10125327_B_Vmn1r107
  gRNA
uaacauccacauuccaauua

SEQ ID NO: 125328 - RNA, 20 nt, Artificial Sequence
  MKO10125328_B_Vmn1r10
  gRNA
ccaaaugcauaagaaaacac

SEQ ID NO: 125329 - RNA, 20 nt, Artificial Sequence
  MKO10125329_B_Vmn1r10
  gRNA
cacccagaccaucgugcugc

SEQ ID NO: 125330 - RNA, 20 nt, Artificial Sequence
  MKO10125330_B_Vmn1r10
  gRNA
cagucccaauaccucuuuga

SEQ ID NO: 125331 - RNA, 20 nt, Artificial Sequence
  MKO10125331_B_Vmn1r111
  gRNA
guguuauugucuguuaucug

SEQ ID NO: 125332 - RNA, 20 nt, Artificial Sequence
  MKO10125332_B_Vmn1r111
  gRNA
guaacauccacauuccaauu

SEQ ID NO: 125333 - RNA, 20 nt, Artificial Sequence
  MKO10125333_B_Vmn1r111
  gRNA
cagugacccuaauuggaaug

SEQ ID NO: 125334 - RNA, 20 nt, Artificial Sequence
  MKO10125334_B_Vmn1r112
  gRNA
auuauucuugcuacaguugu

SEQ ID NO: 125335 - RNA, 20 nt, Artificial Sequence
  MKO10125335_B_Vmn1r112
  gRNA
cagugaccuuaauuggaaug

SEQ ID NO: 125336 - RNA, 20 nt, Artificial Sequence
  MKO10125336_B_Vmn1r112
  gRNA
uaacauccacauuccaauua

SEQ ID NO: 125337 - RNA, 20 nt, Artificial Sequence
  MKO10125337_B_Vmn1r113
  gRNA
ugacaaacugguggacacuc

SEQ ID NO: 125338 - RNA, 20 nt, Artificial Sequence
  MKO10125338_B_Vmn1r113
  gRNA
agaaaugaguaugcauaaaa

SEQ ID NO: 125339 - RNA, 20 nt, Artificial Sequence
  MKO10125339_B_Vmn1r113
  gRNA
gcccucuccaugucuguuca

SEQ ID NO: 125340 - RNA, 20 nt, Artificial Sequence
  MKO10125340_B_Vmn1r114
  gRNA
guuauucuuguuacgguugu

SEQ ID NO: 125341 - RNA, 20 nt, Artificial Sequence
  MKO10125341_B_Vmn1r114
  gRNA
ucuuacagugaauccagaag

SEQ ID NO: 125342 - RNA, 20 nt, Artificial Sequence
  MKO10125342_B_Vmn1r114
  gRNA
uaacauccacauuccaauua

SEQ ID NO: 125343 - RNA, 20 nt, Artificial Sequence
  MKO10125343_B_Vmn1r115
  gRNA
acccucucaaugucugauca

SEQ ID NO: 125344 - RNA, 20 nt, Artificial Sequence
  MKO10125344_B_Vmn1r115
  gRNA
ugaguaguacuccauugugu

SEQ ID NO: 125345 - RNA, 20 nt, Artificial Sequence
  MKO10125345_B_Vmn1r115
  gRNA
uaacauccacauuccaauua

SEQ ID NO: 125346 - RNA, 20 nt, Artificial Sequence
  MKO10125346_B_Vmn1r116
  gRNA
gccuacaaugaauccagaag

SEQ ID NO: 125347 - RNA, 20 nt, Artificial Sequence
  MKO10125347_B_Vmn1r116
  gRNA
auuauuccugcuacaguugu

SEQ ID NO: 125348 - RNA, 20 nt, Artificial Sequence
  MKO10125348_B_Vmn1r116
  gRNA
guguuauugucuguuaucug

SEQ ID NO: 125349 - RNA, 20 nt, Artificial Sequence
  MKO10125349_B_Vmn1r117
  gRNA
gcccacacugaauccagaag

SEQ ID NO: 125350 - RNA, 20 nt, Artificial Sequence
  MKO10125350_B_Vmn1r117
  gRNA
guuauucuucuuacaguugu

SEQ ID NO: 125351 - RNA, 20 nt, Artificial Sequence
  MKO10125351_B_Vmn1r117
  gRNA
guguuauugucuguuaucug

SEQ ID NO: 125352 - RNA, 20 nt, Artificial Sequence
  MKO10125352_B_Vmn1r118
  gRNA
guguuauugucuguuaucug

SEQ ID NO: 125353 - RNA, 20 nt, Artificial Sequence
  MKO10125353_B_Vmn1r118
  gRNA
guaacauccacauuccaauu

SEQ ID NO: 125354 - RNA, 20 nt, Artificial Sequence
  MKO10125354_B_Vmn1r118
  gRNA
cagugacccuaauuggaaug

SEQ ID NO: 125355 - RNA, 20 nt, Artificial Sequence
  MKO10125355_B_Vmn1r119
  gRNA
caguugaagagcacagaaca

SEQ ID NO: 125356 - RNA, 20 nt, Artificial Sequence
  MKO10125356_B_Vmn1r119
  gRNA
uguccaucaguuugucacuc

SEQ ID NO: 125357 - RNA, 20 nt, Artificial Sequence
  MKO10125357_B_Vmn1r119
  gRNA
gccuacacugaauccagaag

SEQ ID NO: 125358 - RNA, 20 nt, Artificial Sequence
  MKO10125358_B_Vmn1r11
  gRNA
aguauuuagugacuuucauc

SEQ ID NO: 125359 - RNA, 20 nt, Artificial Sequence
  MKO10125359_B_Vmn1r11
  gRNA
ucccaaugaacuauauuauc

SEQ ID NO: 125360 - RNA, 20 nt, Artificial Sequence
  MKO10125360_B_Vmn1r11
  gRNA
ccucucacuuauguucucau

SEQ ID NO: 125361 - RNA, 20 nt, Artificial Sequence
  MKO10125361_B_Vmn1r120
  gRNA
uauagugaggaauauaguca

SEQ ID NO: 125362 - RNA, 20 nt, Artificial Sequence
  MKO10125362_B_Vmn1r120
  gRNA
uaaaucccugaaaagcacug

SEQ ID NO: 125363 - RNA, 20 nt, Artificial Sequence
  MKO10125363_B_Vmn1r120
  gRNA
aacuuguucuguuccacuuc

SEQ ID NO: 125364 - RNA, 20 nt, Artificial Sequence
  MKO10125364_B_Vmn1r121
  gRNA
gaccaugaugcucaugaaug

SEQ ID NO: 125365 - RNA, 20 nt, Artificial Sequence
  MKO10125365_B_Vmn1r121
  gRNA
guuauucuuguuacgguugu

SEQ ID NO: 125366 - RNA, 20 nt, Artificial Sequence
  MKO10125366_B_Vmn1r121
  gRNA
ucuuacagugaauccagaag

SEQ ID NO: 125367 - RNA, 20 nt, Artificial Sequence
  MKO10125367_B_Vmn1r122
  gRNA
gccuacaaugaauccagaag

SEQ ID NO: 125368 - RNA, 20 nt, Artificial Sequence
  MKO10125368_B_Vmn1r122
  gRNA
aacuuguucuguuccacuuc

SEQ ID NO: 125369 - RNA, 20 nt, Artificial Sequence
  MKO10125369_B_Vmn1r122
  gRNA
guguuauugucuguuaucug

SEQ ID NO: 125370 - RNA, 20 nt, Artificial Sequence
  MKO10125370_B_Vmn1r123
  gRNA
gccuacaaugaauccagaag

SEQ ID NO: 125371 - RNA, 20 nt, Artificial Sequence
  MKO10125371_B_Vmn1r123
  gRNA
auuauucuugcuacaauugu

SEQ ID NO: 125372 - RNA, 20 nt, Artificial Sequence
  MKO10125372_B_Vmn1r123
  gRNA
guguuauugucuguuaucug

SEQ ID NO: 125373 - RNA, 20 nt, Artificial Sequence
  MKO10125373_B_Vmn1r124
  gRNA
aaaccguacuauccugaugc

SEQ ID NO: 125374 - RNA, 20 nt, Artificial Sequence
  MKO10125374_B_Vmn1r124
  gRNA
ccagggucccaaccccaaac

SEQ ID NO: 125375 - RNA, 20 nt, Artificial Sequence
  MKO10125375_B_Vmn1r124
  gRNA
uguagugaggaauagaguca

SEQ ID NO: 125376 - RNA, 20 nt, Artificial Sequence
  MKO10125376_B_Vmn1r125
  gRNA
gccuacaaugaauccagaag

SEQ ID NO: 125377 - RNA, 20 nt, Artificial Sequence
  MKO10125377_B_Vmn1r125
  gRNA
uaacauccauauuccaauua

SEQ ID NO: 125378 - RNA, 20 nt, Artificial Sequence
  MKO10125378_B_Vmn1r125
  gRNA
guguuauugucuguuaucug

SEQ ID NO: 125379 - RNA, 20 nt, Artificial Sequence
  MKO10125379_B_Vmn1r126
  gRNA
guuauucuuguuaugguugu

SEQ ID NO: 125380 - RNA, 20 nt, Artificial Sequence
  MKO10125380_B_Vmn1r126
  gRNA
ucuuacagugaauccagaag

SEQ ID NO: 125381 - RNA, 20 nt, Artificial Sequence
  MKO10125381_B_Vmn1r126
  gRNA
uaacauccacauuccaauua

SEQ ID NO: 125382 - RNA, 20 nt, Artificial Sequence
  MKO10125382_B_Vmn1r127
  gRNA
gccuacaaugaauccagaag

SEQ ID NO: 125383 - RNA, 20 nt, Artificial Sequence
  MKO10125383_B_Vmn1r127
  gRNA
aacuuguucuguuccacuuc

SEQ ID NO: 125384 - RNA, 20 nt, Artificial Sequence
  MKO10125384_B_Vmn1r127
  gRNA
guguuauugucuguuaucug

SEQ ID NO: 125385 - RNA, 20 nt, Artificial Sequence
  MKO10125385_B_Vmn1r128
  gRNA
guguuauugucuguuaucug

SEQ ID NO: 125386 - RNA, 20 nt, Artificial Sequence
  MKO10125386_B_Vmn1r128
  gRNA
auuauuccugcuacaguugu

SEQ ID NO: 125387 - RNA, 20 nt, Artificial Sequence
  MKO10125387_B_Vmn1r128
  gRNA
cagugaccuuaauuggaaug

SEQ ID NO: 125388 - RNA, 20 nt, Artificial Sequence
  MKO10125388_B_Vmn1r129
  gRNA
cagagcaagugucacaaaca

SEQ ID NO: 125389 - RNA, 20 nt, Artificial Sequence
  MKO10125389_B_Vmn1r129
  gRNA
gcccacacugaauccagaag

SEQ ID NO: 125390 - RNA, 20 nt, Artificial Sequence
  MKO10125390_B_Vmn1r129
  gRNA
guuauucuucuugcaguugu

SEQ ID NO: 125391 - RNA, 20 nt, Artificial Sequence
  MKO10125391_B_Vmn1r12
  gRNA
cucuaauaaugaaggcauaa

SEQ ID NO: 125392 - RNA, 20 nt, Artificial Sequence
  MKO10125392_B_Vmn1r12
  gRNA
uucugaacaaucaagaugac

SEQ ID NO: 125393 - RNA, 20 nt, Artificial Sequence
  MKO10125393_B_Vmn1r12
  gRNA
guucugauaaaagaauuacu

SEQ ID NO: 125394 - RNA, 20 nt, Artificial Sequence
  MKO10125394_B_Vmn1r130
  gRNA
auuauuccugcuacaguugu

SEQ ID NO: 125395 - RNA, 20 nt, Artificial Sequence
  MKO10125395_B_Vmn1r130
  gRNA
guguuauugucuguuaucug

SEQ ID NO: 125396 - RNA, 20 nt, Artificial Sequence
  MKO10125396_B_Vmn1r130
  gRNA
uaacauccacauuccaauua

SEQ ID NO: 125397 - RNA, 20 nt, Artificial Sequence
  MKO10125397_B_Vmn1r131
  gRNA
guguuauugucuguuaucug

SEQ ID NO: 125398 - RNA, 20 nt, Artificial Sequence
  MKO10125398_B_Vmn1r131
  gRNA
guaacauccacauuccaauu

SEQ ID NO: 125399 - RNA, 20 nt, Artificial Sequence
  MKO10125399_B_Vmn1r131
  gRNA
cagugacccuaauuggaaug

SEQ ID NO: 125400 - RNA, 20 nt, Artificial Sequence
  MKO10125400_B_Vmn1r132
  gRNA
gagcaagugucccaaauuug

SEQ ID NO: 125401 - RNA, 20 nt, Artificial Sequence
  MKO10125401_B_Vmn1r132
  gRNA
cagugaccuuaauuggaaug

SEQ ID NO: 125402 - RNA, 20 nt, Artificial Sequence
  MKO10125402_B_Vmn1r132
  gRNA
auuauucuugcuacaguugu

SEQ ID NO: 125403 - RNA, 20 nt, Artificial Sequence
  MKO10125403_B_Vmn1r135
  gRNA
auuauuccugcuacaguugu

SEQ ID NO: 125404 - RNA, 20 nt, Artificial Sequence
  MKO10125404_B_Vmn1r135
  gRNA
cagugaccuuaauuggaaug

SEQ ID NO: 125405 - RNA, 20 nt, Artificial Sequence
  MKO10125405_B_Vmn1r135
  gRNA
uaacauccacauuccaauua

SEQ ID NO: 125406 - RNA, 20 nt, Artificial Sequence
  MKO10125406_B_Vmn1r137
  gRNA
auuauuccugcuacaguugu

SEQ ID NO: 125407 - RNA, 20 nt, Artificial Sequence
  MKO10125407_B_Vmn1r137
  gRNA
guguuauugucuguuaucug

SEQ ID NO: 125408 - RNA, 20 nt, Artificial Sequence
  MKO10125408_B_Vmn1r137
  gRNA
uaacauccacauuccaauua

SEQ ID NO: 125409 - RNA, 20 nt, Artificial Sequence
  MKO10125409_B_Vmn1r138
  gRNA
guguuauugucuguuaucug

SEQ ID NO: 125410 - RNA, 20 nt, Artificial Sequence
  MKO10125410_B_Vmn1r138
  gRNA
guaacauccacauuccaauu

SEQ ID NO: 125411 - RNA, 20 nt, Artificial Sequence
  MKO10125411_B_Vmn1r138
  gRNA
cagugacccuaauuggaaug

SEQ ID NO: 125412 - RNA, 20 nt, Artificial Sequence
  MKO10125412_B_Vmn1r139
  gRNA
gagcaagugucccaaauuug

SEQ ID NO: 125413 - RNA, 20 nt, Artificial Sequence
  MKO10125413_B_Vmn1r139
  gRNA
cagugaccuuaauuggaaug

SEQ ID NO: 125414 - RNA, 20 nt, Artificial Sequence
  MKO10125414_B_Vmn1r139
  gRNA
auuauucuugcuacaguugu

SEQ ID NO: 125415 - RNA, 20 nt, Artificial Sequence
  MKO10125415_B_Vmn1r13
  gRNA
cauccaccucagucacguua

SEQ ID NO: 125416 - RNA, 20 nt, Artificial Sequence
  MKO10125416_B_Vmn1r13
  gRNA
gcaugacauuuccuccagug

SEQ ID NO: 125417 - RNA, 20 nt, Artificial Sequence
  MKO10125417_B_Vmn1r13
  gRNA
cuuagugaucuucaucugcu

SEQ ID NO: 125418 - RNA, 20 nt, Artificial Sequence
  MKO10125418_B_Vmn1r142
  gRNA
gccuacaaugaauccagaag

SEQ ID NO: 125419 - RNA, 20 nt, Artificial Sequence
  MKO10125419_B_Vmn1r142
  gRNA
aacuuguucuguuccacuuc

SEQ ID NO: 125420 - RNA, 20 nt, Artificial Sequence
  MKO10125420_B_Vmn1r142
  gRNA
guguuauugucuguuaucug

SEQ ID NO: 125421 - RNA, 20 nt, Artificial Sequence
  MKO10125421_B_Vmn1r143
  gRNA
auuauuccugcuacaguugu

SEQ ID NO: 125422 - RNA, 20 nt, Artificial Sequence
  MKO10125422_B_Vmn1r143
  gRNA
guguuauugucuguuaucug

SEQ ID NO: 125423 - RNA, 20 nt, Artificial Sequence
  MKO10125423_B_Vmn1r143
  gRNA
uaacauccacauuccaauua

SEQ ID NO: 125424 - RNA, 20 nt, Artificial Sequence
  MKO10125424_B_Vmn1r148
  gRNA
uaacauccacauuccaauua

SEQ ID NO: 125425 - RNA, 20 nt, Artificial Sequence
  MKO10125425_B_Vmn1r148
  gRNA
guguuauugucuauuaucug

SEQ ID NO: 125426 - RNA, 20 nt, Artificial Sequence
  MKO10125426_B_Vmn1r148
  gRNA
aacuuguucuguuccacuuc

SEQ ID NO: 125427 - RNA, 20 nt, Artificial Sequence
  MKO10125427_B_Vmn1r149
  gRNA
uagagcaagugucacaaaca

SEQ ID NO: 125428 - RNA, 20 nt, Artificial Sequence
  MKO10125428_B_Vmn1r149
  gRNA
caucauaggcaaacugcaag

SEQ ID NO: 125429 - RNA, 20 nt, Artificial Sequence
  MKO10125429_B_Vmn1r149
  gRNA
guuauucuucuuacaguugu

SEQ ID NO: 125430 - RNA, 20 nt, Artificial Sequence
  MKO10125430_B_Vmn1r14
  gRNA
aguccaugggcuuaggucug

SEQ ID NO: 125431 - RNA, 20 nt, Artificial Sequence
  MKO10125431_B_Vmn1r14
  gRNA
cucuaauaaugaagacauaa

SEQ ID NO: 125432 - RNA, 20 nt, Artificial Sequence
  MKO10125432_B_Vmn1r14
  gRNA
caugauuguccagaaguuug

SEQ ID NO: 125433 - RNA, 20 nt, Artificial Sequence
  MKO10125433_B_Vmn1r151
  gRNA
guguuauugucuguuaucug

SEQ ID NO: 125434 - RNA, 20 nt, Artificial Sequence
  MKO10125434_B_Vmn1r151
  gRNA
aacuuguucuguuccacuuc

SEQ ID NO: 125435 - RNA, 20 nt, Artificial Sequence
  MKO10125435_B_Vmn1r151
  gRNA
cagugaccuuaauugaaaug

SEQ ID NO: 125436 - RNA, 20 nt, Artificial Sequence
  MKO10125436_B_Vmn1r152
  gRNA
auuauuccugcuacaguugu

SEQ ID NO: 125437 - RNA, 20 nt, Artificial Sequence
  MKO10125437_B_Vmn1r152
  gRNA
guguuauugucuguuaucug

SEQ ID NO: 125438 - RNA, 20 nt, Artificial Sequence
  MKO10125438_B_Vmn1r152
  gRNA
uaacauccacauuccaauua

SEQ ID NO: 125439 - RNA, 20 nt, Artificial Sequence
  MKO10125439_B_Vmn1r155
  gRNA
auuauuccugcuacaguugu

SEQ ID NO: 125440 - RNA, 20 nt, Artificial Sequence
  MKO10125440_B_Vmn1r155
  gRNA
guguuauugucuguuaucug

SEQ ID NO: 125441 - RNA, 20 nt, Artificial Sequence
  MKO10125441_B_Vmn1r155
  gRNA
uaacauccacauuccaauua

SEQ ID NO: 125442 - RNA, 20 nt, Artificial Sequence
  MKO10125442_B_Vmn1r157
  gRNA
ggccucuccaugucugcuca

SEQ ID NO: 125443 - RNA, 20 nt, Artificial Sequence
  MKO10125443_B_Vmn1r157
  gRNA
guguuauugucuauuaucug

SEQ ID NO: 125444 - RNA, 20 nt, Artificial Sequence
  MKO10125444_B_Vmn1r157
  gRNA
auuauucuugcuacaguugu

SEQ ID NO: 125445 - RNA, 20 nt, Artificial Sequence
  MKO10125445_B_Vmn1r158
  gRNA
gcccucuccaugucugcuca

SEQ ID NO: 125446 - RNA, 20 nt, Artificial Sequence
  MKO10125446_B_Vmn1r158
  gRNA
caguugaagagcacagaaca

SEQ ID NO: 125447 - RNA, 20 nt, Artificial Sequence
  MKO10125447_B_Vmn1r158
  gRNA
uagagcaagugucacaaaca

SEQ ID NO: 125448 - RNA, 20 nt, Artificial Sequence
  MKO10125448_B_Vmn1r159
  gRNA
caguugaagagcacagaaca

SEQ ID NO: 125449 - RNA, 20 nt, Artificial Sequence
  MKO10125449_B_Vmn1r159
  gRNA
guuauucuuguuacgguugu

SEQ ID NO: 125450 - RNA, 20 nt, Artificial Sequence
  MKO10125450_B_Vmn1r159
  gRNA
gccuacaaugaauccagaag

SEQ ID NO: 125451 - RNA, 20 nt, Artificial Sequence
  MKO10125451_B_Vmn1r15
  gRNA
uuugcagucaaagugccacu

SEQ ID NO: 125452 - RNA, 20 nt, Artificial Sequence
  MKO10125452_B_Vmn1r15
  gRNA
gaucuccugucaacugacuu

SEQ ID NO: 125453 - RNA, 20 nt, Artificial Sequence
  MKO10125453_B_Vmn1r15
  gRNA
acaaugcauuguucuauauu

SEQ ID NO: 125454 - RNA, 20 nt, Artificial Sequence
  MKO10125454_B_Vmn1r160
  gRNA
cauuugaagagcacagaaca

SEQ ID NO: 125455 - RNA, 20 nt, Artificial Sequence
  MKO10125455_B_Vmn1r160
  gRNA
gcccucuccaugucugcuca

SEQ ID NO: 125456 - RNA, 20 nt, Artificial Sequence
  MKO10125456_B_Vmn1r160
  gRNA
gccuacaaugaauccagaag

SEQ ID NO: 125457 - RNA, 20 nt, Artificial Sequence
  MKO10125457_B_Vmn1r163
  gRNA
auuauuccugcuacaguugu

SEQ ID NO: 125458 - RNA, 20 nt, Artificial Sequence
  MKO10125458_B_Vmn1r163
  gRNA
cagugaccuuaauuggaaug

SEQ ID NO: 125459 - RNA, 20 nt, Artificial Sequence
  MKO10125459_B_Vmn1r163
  gRNA
uaacauccacauuccaauua

SEQ ID NO: 125460 - RNA, 20 nt, Artificial Sequence
  MKO10125460_B_Vmn1r165
  gRNA
auuauuccugcuacaguugu

SEQ ID NO: 125461 - RNA, 20 nt, Artificial Sequence
  MKO10125461_B_Vmn1r165
  gRNA
guguuauugucuguuaucug

SEQ ID NO: 125462 - RNA, 20 nt, Artificial Sequence
  MKO10125462_B_Vmn1r165
  gRNA
uaacauccacauuccaauua

SEQ ID NO: 125463 - RNA, 20 nt, Artificial Sequence
  MKO10125463_B_Vmn1r166
  gRNA
guguuauugucuguuaucug

SEQ ID NO: 125464 - RNA, 20 nt, Artificial Sequence
  MKO10125464_B_Vmn1r166
  gRNA
guaacauccacauuccaauu

SEQ ID NO: 125465 - RNA, 20 nt, Artificial Sequence
  MKO10125465_B_Vmn1r166
  gRNA
cagugacccuaauuggaaug

SEQ ID NO: 125466 - RNA, 20 nt, Artificial Sequence
  MKO10125466_B_Vmn1r167
  gRNA
ucuguucaggagaauuacca

SEQ ID NO: 125467 - RNA, 20 nt, Artificial Sequence
  MKO10125467_B_Vmn1r167
  gRNA
auugaauauacugcagucuu

SEQ ID NO: 125468 - RNA, 20 nt, Artificial Sequence
  MKO10125468_B_Vmn1r167
  gRNA
ugcugaugaacacuccauca

SEQ ID NO: 125469 - RNA, 20 nt, Artificial Sequence
  MKO10125469_B_Vmn1r168
  gRNA
ccacaagcaacacaaugcua

SEQ ID NO: 125470 - RNA, 20 nt, Artificial Sequence
  MKO10125470_B_Vmn1r168
  gRNA
cuuucaaugucuucucagaa

SEQ ID NO: 125471 - RNA, 20 nt, Artificial Sequence
  MKO10125471_B_Vmn1r168
  gRNA
gcuauuccuguuguaguugu

SEQ ID NO: 125472 - RNA, 20 nt, Artificial Sequence
  MKO10125472_B_Vmn1r169
  gRNA
ugucauucucagcagcugaa

SEQ ID NO: 125473 - RNA, 20 nt, Artificial Sequence
  MKO10125473_B_Vmn1r169
  gRNA
ugggguagggugaugcucca

SEQ ID NO: 125474 - RNA, 20 nt, Artificial Sequence
  MKO10125474_B_Vmn1r169
  gRNA
ugaaaucugagcuucugauu

SEQ ID NO: 125475 - RNA, 20 nt, Artificial Sequence
  MKO10125475_B_Vmn1r16
  gRNA
gagugaaaaccaccagauga

SEQ ID NO: 125476 - RNA, 20 nt, Artificial Sequence
  MKO10125476_B_Vmn1r16
  gRNA
cuaagaguccaaauccagcu

SEQ ID NO: 125477 - RNA, 20 nt, Artificial Sequence
  MKO10125477_B_Vmn1r16
  gRNA
auaaagaacauuauugaaua

SEQ ID NO: 125478 - RNA, 20 nt, Artificial Sequence
  MKO10125478_B_Vmn1r170
  gRNA
uguugagauccauucaaguu

SEQ ID NO: 125479 - RNA, 20 nt, Artificial Sequence
  MKO10125479_B_Vmn1r170
  gRNA
aauacaguccagaugauaac

SEQ ID NO: 125480 - RNA, 20 nt, Artificial Sequence
  MKO10125480_B_Vmn1r170
  gRNA
aucccacaccauccugaugc

SEQ ID NO: 125481 - RNA, 20 nt, Artificial Sequence
  MKO10125481_B_Vmn1r171
  gRNA
ucuguucaggagaauaacca

SEQ ID NO: 125482 - RNA, 20 nt, Artificial Sequence
  MKO10125482_B_Vmn1r171
  gRNA
ccagagccgagaguccacaa

SEQ ID NO: 125483 - RNA, 20 nt, Artificial Sequence
  MKO10125483_B_Vmn1r171
  gRNA
acugaauaugcugcaaucuu

SEQ ID NO: 125484 - RNA, 20 nt, Artificial Sequence
  MKO10125484_B_Vmn1r172
  gRNA
acacugacccgaacagcaaa

SEQ ID NO: 125485 - RNA, 20 nt, Artificial Sequence
  MKO10125485_B_Vmn1r172
  gRNA
cauucuugcccacauugcug

SEQ ID NO: 125486 - RNA, 20 nt, Artificial Sequence
  MKO10125486_B_Vmn1r172
  gRNA
gaacauacccauuugcuguu

SEQ ID NO: 125487 - RNA, 20 nt, Artificial Sequence
  MKO10125487_B_Vmn1r173
  gRNA
gaggcaugucaaugaaauuu

SEQ ID NO: 125488 - RNA, 20 nt, Artificial Sequence
  MKO10125488_B_Vmn1r173
  gRNA
uaccauguucaucagcauca

SEQ ID NO: 125489 - RNA, 20 nt, Artificial Sequence
  MKO10125489_B_Vmn1r173
  gRNA
gucugguuucgaguuaguca

SEQ ID NO: 125490 - RNA, 20 nt, Artificial Sequence
  MKO10125490_B_Vmn1r174
  gRNA
gcuugaguacuucauucgcc

SEQ ID NO: 125491 - RNA, 20 nt, Artificial Sequence
  MKO10125491_B_Vmn1r174
  gRNA
agagauugcccacaguaaug

SEQ ID NO: 125492 - RNA, 20 nt, Artificial Sequence
  MKO10125492_B_Vmn1r174
  gRNA
accccuaacgaucaacauua

SEQ ID NO: 125493 - RNA, 20 nt, Artificial Sequence
  MKO10125493_B_Vmn1r175
  gRNA
uggggaccauugacuuucau

SEQ ID NO: 125494 - RNA, 20 nt, Artificial Sequence
  MKO10125494_B_Vmn1r175
  gRNA
uaaaucugugaaaaccacag

SEQ ID NO: 125495 - RNA, 20 nt, Artificial Sequence
  MKO10125495_B_Vmn1r175
  gRNA
cagcagaauagcagagaaca

SEQ ID NO: 125496 - RNA, 20 nt, Artificial Sequence
  MKO10125496_B_Vmn1r176
  gRNA
cugaagagucacuuccacug

SEQ ID NO: 125497 - RNA, 20 nt, Artificial Sequence
  MKO10125497_B_Vmn1r176
  gRNA
auagcaauucuaaaagcaag

SEQ ID NO: 125498 - RNA, 20 nt, Artificial Sequence
  MKO10125498_B_Vmn1r176
  gRNA
uccaccucugguuucaguau

SEQ ID NO: 125499 - RNA, 20 nt, Artificial Sequence
  MKO10125499_B_Vmn1r177
  gRNA
guuaguacaaaucacuucuu

SEQ ID NO: 125500 - RNA, 20 nt, Artificial Sequence
  MKO10125500_B_Vmn1r177
  gRNA
uucaaugagcugauggucag

SEQ ID NO: 125501 - RNA, 20 nt, Artificial Sequence
  MKO10125501_B_Vmn1r177
  gRNA
ggaaaauauacugcagucuc

SEQ ID NO: 125502 - RNA, 20 nt, Artificial Sequence
  MKO10125502_B_Vmn1r178
  gRNA
uugaagagucaugucaucag

SEQ ID NO: 125503 - RNA, 20 nt, Artificial Sequence
  MKO10125503_B_Vmn1r178
  gRNA
uaauaucuacauugcaauua

SEQ ID NO: 125504 - RNA, 20 nt, Artificial Sequence
  MKO10125504_B_Vmn1r178
  gRNA
ugaagugaggaagagaauca

SEQ ID NO: 125505 - RNA, 20 nt, Artificial Sequence
  MKO10125505_B_Vmn1r179
  gRNA
uggagcaaaagucaucacau

SEQ ID NO: 125506 - RNA, 20 nt, Artificial Sequence
  MKO10125506_B_Vmn1r179
  gRNA
caagaauaccuugccaaacu

SEQ ID NO: 125507 - RNA, 20 nt, Artificial Sequence
  MKO10125507_B_Vmn1r179
  gRNA
uggagugaagcuuuggucac

SEQ ID NO: 125508 - RNA, 20 nt, Artificial Sequence
  MKO10125508_B_Vmn1r17
  gRNA
ucacaaacuucugaaccugc

SEQ ID NO: 125509 - RNA, 20 nt, Artificial Sequence
  MKO10125509_B_Vmn1r17
  gRNA
uccagagauguauuucucgu

SEQ ID NO: 125510 - RNA, 20 nt, Artificial Sequence
  MKO10125510_B_Vmn1r17
  gRNA
cagucccaaaaccucagugu

SEQ ID NO: 125511 - RNA, 20 nt, Artificial Sequence
  MKO10125511_B_Vmn1r180
  gRNA
gcauuugcuguugaugucua

SEQ ID NO: 125512 - RNA, 20 nt, Artificial Sequence
  MKO10125512_B_Vmn1r180
  gRNA
ccugaaaaacacugaagaag

SEQ ID NO: 125513 - RNA, 20 nt, Artificial Sequence
  MKO10125513_B_Vmn1r180
  gRNA
caguugaagagcauagaaca

SEQ ID NO: 125514 - RNA, 20 nt, Artificial Sequence
  MKO10125514_B_Vmn1r181
  gRNA
ggagcaaaagccauguuguu

SEQ ID NO: 125515 - RNA, 20 nt, Artificial Sequence
  MKO10125515_B_Vmn1r181
  gRNA
cacuacauuuccaaacaaca

SEQ ID NO: 125516 - RNA, 20 nt, Artificial Sequence
  MKO10125516_B_Vmn1r181
  gRNA
cgcaugguggcaagaagcac

SEQ ID NO: 125517 - RNA, 20 nt, Artificial Sequence
  MKO10125517_B_Vmn1r183
  gRNA
ggauuuacuaugagcagaca

SEQ ID NO: 125518 - RNA, 20 nt, Artificial Sequence
  MKO10125518_B_Vmn1r183
  gRNA
guggcuuaaaagcaccuguc

SEQ ID NO: 125519 - RNA, 20 nt, Artificial Sequence
  MKO10125519_B_Vmn1r183
  gRNA
cagcugaagagcacagaaca

SEQ ID NO: 125520 - RNA, 20 nt, Artificial Sequence
  MKO10125520_B_Vmn1r184
  gRNA
ccaaauugcaucuagacaug

SEQ ID NO: 125521 - RNA, 20 nt, Artificial Sequence
  MKO10125521_B_Vmn1r184
  gRNA
ccucaugucuagaugcaauu

SEQ ID NO: 125522 - RNA, 20 nt, Artificial Sequence
  MKO10125522_B_Vmn1r184
  gRNA
uucuauuuaaacacaagcag

SEQ ID NO: 125523 - RNA, 20 nt, Artificial Sequence
  MKO10125523_B_Vmn1r185
  gRNA
ccaaguugaaucuagacaug

SEQ ID NO: 125524 - RNA, 20 nt, Artificial Sequence
  MKO10125524_B_Vmn1r185
  gRNA
ccagaauuccaacuguaguu

SEQ ID NO: 125525 - RNA, 20 nt, Artificial Sequence
  MKO10125525_B_Vmn1r185
  gRNA
gucaaagcuauaaugcacaa

SEQ ID NO: 125526 - RNA, 20 nt, Artificial Sequence
  MKO10125526_B_Vmn1r186
  gRNA
gucuacacugaccccagaga

SEQ ID NO: 125527 - RNA, 20 nt, Artificial Sequence
  MKO10125527_B_Vmn1r186
  gRNA
aauucgauaugcuccaucuc

SEQ ID NO: 125528 - RNA, 20 nt, Artificial Sequence
  MKO10125528_B_Vmn1r186
  gRNA
gagucauugugugauuucug

SEQ ID NO: 125529 - RNA, 20 nt, Artificial Sequence
  MKO10125529_B_Vmn1r187
  gRNA
gucuacacugaccccagaga

SEQ ID NO: 125530 - RNA, 20 nt, Artificial Sequence
  MKO10125530_B_Vmn1r187
  gRNA
cacaaugacucugauucuaa

SEQ ID NO: 125531 - RNA, 20 nt, Artificial Sequence
  MKO10125531_B_Vmn1r187
  gRNA
gagucauugugugauuucug

SEQ ID NO: 125532 - RNA, 20 nt, Artificial Sequence
  MKO10125532_B_Vmn1r188
  gRNA
aauauaucacagcuuaggaa

SEQ ID NO: 125533 - RNA, 20 nt, Artificial Sequence
  MKO10125533_B_Vmn1r188
  gRNA
uuauauuaugcuagaaaguc

SEQ ID NO: 125534 - RNA, 20 nt, Artificial Sequence
  MKO10125534_B_Vmn1r188
  gRNA
ucuuacagccuauaucaucc

SEQ ID NO: 125535 - RNA, 20 nt, Artificial Sequence
  MKO10125535_B_Vmn1r189
  gRNA
acucuagaauuucugacccu

SEQ ID NO: 125536 - RNA, 20 nt, Artificial Sequence
  MKO10125536_B_Vmn1r189
  gRNA
aggaugugccuugcagacuu

SEQ ID NO: 125537 - RNA, 20 nt, Artificial Sequence
  MKO10125537_B_Vmn1r189
  gRNA
caccagaagucuccucacug

SEQ ID NO: 125538 - RNA, 20 nt, Artificial Sequence
  MKO10125538_B_Vmn1r18
  gRNA
uuagaaaaucuaguggaacu

SEQ ID NO: 125539 - RNA, 20 nt, Artificial Sequence
  MKO10125539_B_Vmn1r18
  gRNA
uuugaguggcccuuuccuca

SEQ ID NO: 125540 - RNA, 20 nt, Artificial Sequence
  MKO10125540_B_Vmn1r18
  gRNA
aguugacagaccuaagccca

SEQ ID NO: 125541 - RNA, 20 nt, Artificial Sequence
  MKO10125541_B_Vmn1r191
  gRNA
aucauacuacuucuugcaaa

SEQ ID NO: 125542 - RNA, 20 nt, Artificial Sequence
  MKO10125542_B_Vmn1r191
  gRNA
uucuugaauauuuacuauca

SEQ ID NO: 125543 - RNA, 20 nt, Artificial Sequence
  MKO10125543_B_Vmn1r191
  gRNA
gacugcuagugcaaauggag

SEQ ID NO: 125544 - RNA, 20 nt, Artificial Sequence
  MKO10125544_B_Vmn1r192
  gRNA
auaaucauuauuuguagcac

SEQ ID NO: 125545 - RNA, 20 nt, Artificial Sequence
  MKO10125545_B_Vmn1r192
  gRNA
agcagaguuguuugcagacc

SEQ ID NO: 125546 - RNA, 20 nt, Artificial Sequence
  MKO10125546_B_Vmn1r192
  gRNA
uuauauuagaaaaagccaag

SEQ ID NO: 125547 - RNA, 20 nt, Artificial Sequence
  MKO10125547_B_Vmn1r193
  gRNA
acauuuguaugcagucauca

SEQ ID NO: 125548 - RNA, 20 nt, Artificial Sequence
  MKO10125548_B_Vmn1r193
  gRNA
agcucaaaccacagaccaca

SEQ ID NO: 125549 - RNA, 20 nt, Artificial Sequence
  MKO10125549_B_Vmn1r193
  gRNA
cacgaagagccaugaaagaa

SEQ ID NO: 125550 - RNA, 20 nt, Artificial Sequence
  MKO10125550_B_Vmn1r194
  gRNA
uuguguacacuucagccuuc

SEQ ID NO: 125551 - RNA, 20 nt, Artificial Sequence
  MKO10125551_B_Vmn1r194
  gRNA
ugacagccuggacuguacug

SEQ ID NO: 125552 - RNA, 20 nt, Artificial Sequence
  MKO10125552_B_Vmn1r194
  gRNA
aaauucuaggauuuagcaac

SEQ ID NO: 125553 - RNA, 20 nt, Artificial Sequence
  MKO10125553_B_Vmn1r195
  gRNA
cacuuaacuguguaccuaga

SEQ ID NO: 125554 - RNA, 20 nt, Artificial Sequence
  MKO10125554_B_Vmn1r195
  gRNA
aguuugaauagaucuagagc

SEQ ID NO: 125555 - RNA, 20 nt, Artificial Sequence
  MKO10125555_B_Vmn1r195
  gRNA
gcuggcauuauuugcaagcc

SEQ ID NO: 125556 - RNA, 20 nt, Artificial Sequence
  MKO10125556_B_Vmn1r196
  gRNA
acguuauuguuuaucuagaa

SEQ ID NO: 125557 - RNA, 20 nt, Artificial Sequence
  MKO10125557_B_Vmn1r196
  gRNA
uggggcucaugauaacugcu

SEQ ID NO: 125558 - RNA, 20 nt, Artificial Sequence
  MKO10125558_B_Vmn1r196
  gRNA
cuacagacaccuuacaacug

SEQ ID NO: 125559 - RNA, 20 nt, Artificial Sequence
  MKO10125559_B_Vmn1r197
  gRNA
agcgagaaaagagugugcug

SEQ ID NO: 125560 - RNA, 20 nt, Artificial Sequence
  MKO10125560_B_Vmn1r197
  gRNA
uucuacaguacuauauguuc

SEQ ID NO: 125561 - RNA, 20 nt, Artificial Sequence
  MKO10125561_B_Vmn1r197
  gRNA
aucucuaugaaucagcauga

SEQ ID NO: 125562 - RNA, 20 nt, Artificial Sequence
  MKO10125562_B_Vmn1r198
  gRNA
aacuuacucucuuacauuaa

SEQ ID NO: 125563 - RNA, 20 nt, Artificial Sequence
  MKO10125563_B_Vmn1r198
  gRNA
cauccagacacauuaucaag

SEQ ID NO: 125564 - RNA, 20 nt, Artificial Sequence
  MKO10125564_B_Vmn1r198
  gRNA
uuuaauguaagagaguaagu

SEQ ID NO: 125565 - RNA, 20 nt, Artificial Sequence
  MKO10125565_B_Vmn1r199
  gRNA
ugacaguguuuguaaaagcc

SEQ ID NO: 125566 - RNA, 20 nt, Artificial Sequence
  MKO10125566_B_Vmn1r199
  gRNA
acugucauccuucuugcaaa

SEQ ID NO: 125567 - RNA, 20 nt, Artificial Sequence
  MKO10125567_B_Vmn1r199
  gRNA
agaaauuuccuagaugacuc

SEQ ID NO: 125568 - RNA, 20 nt, Artificial Sequence
  MKO10125568_B_Vmn1r19
  gRNA
ucagaacugaucugcaccaa

SEQ ID NO: 125569 - RNA, 20 nt, Artificial Sequence
  MKO10125569_B_Vmn1r19
  gRNA
auaaaggacauucucaaaug

SEQ ID NO: 125570 - RNA, 20 nt, Artificial Sequence
  MKO10125570_B_Vmn1r19
  gRNA
guaggaguccaaguccagcu

SEQ ID NO: 125571 - RNA, 20 nt, Artificial Sequence
  MKO10125571_B_Vmn1r1
  gRNA
uggccagcagcaucacgaug

SEQ ID NO: 125572 - RNA, 20 nt, Artificial Sequence
  MKO10125572_B_Vmn1r1
  gRNA
acugaacguggcauaaccac

SEQ ID NO: 125573 - RNA, 20 nt, Artificial Sequence
  MKO10125573_B_Vmn1r1
  gRNA
cacauugugggcggccacaa

SEQ ID NO: 125574 - RNA, 20 nt, Artificial Sequence
  MKO10125574_B_Vmn1r200
  gRNA
cuguaagagcauugucuacc

SEQ ID NO: 125575 - RNA, 20 nt, Artificial Sequence
  MKO10125575_B_Vmn1r200
  gRNA
gguaaauacucaagaauuuc

SEQ ID NO: 125576 - RNA, 20 nt, Artificial Sequence
  MKO10125576_B_Vmn1r200
  gRNA
ugcaguguuucagagugccc

SEQ ID NO: 125577 - RNA, 20 nt, Artificial Sequence
  MKO10125577_B_Vmn1r201
  gRNA
agaauauuuccuacaauucc

SEQ ID NO: 125578 - RNA, 20 nt, Artificial Sequence
  MKO10125578_B_Vmn1r201
  gRNA
gccacuaccugcuuugaugu

SEQ ID NO: 125579 - RNA, 20 nt, Artificial Sequence
  MKO10125579_B_Vmn1r201
  gRNA
aggggaguuauuugcagacc

SEQ ID NO: 125580 - RNA, 20 nt, Artificial Sequence
  MKO10125580_B_Vmn1r202
  gRNA
agaaacuuucuagaugaugu

SEQ ID NO: 125581 - RNA, 20 nt, Artificial Sequence
  MKO10125581_B_Vmn1r202
  gRNA
guggauguucaucucucuca

SEQ ID NO: 125582 - RNA, 20 nt, Artificial Sequence
  MKO10125582_B_Vmn1r202
  gRNA
cauccacuuaacuguguucc

SEQ ID NO: 125583 - RNA, 20 nt, Artificial Sequence
  MKO10125583_B_Vmn1r203
  gRNA
gcaugccaaaauuuaaccaa

SEQ ID NO: 125584 - RNA, 20 nt, Artificial Sequence
  MKO10125584_B_Vmn1r203
  gRNA
auaccucauucugauccaca

SEQ ID NO: 125585 - RNA, 20 nt, Artificial Sequence
  MKO10125585_B_Vmn1r203
  gRNA
gaugcuuauaauuagagaua

SEQ ID NO: 125586 - RNA, 20 nt, Artificial Sequence
  MKO10125586_B_Vmn1r204
  gRNA
cauuuauauguagucaucau

SEQ ID NO: 125587 - RNA, 20 nt, Artificial Sequence
  MKO10125587_B_Vmn1r204
  gRNA
cagccauuuaacuauguucc

SEQ ID NO: 125588 - RNA, 20 nt, Artificial Sequence
  MKO10125588_B_Vmn1r204
  gRNA
cuccaaguaaaauaagugaa

SEQ ID NO: 125589 - RNA, 20 nt, Artificial Sequence
  MKO10125589_B_Vmn1r205
  gRNA
augggcuucugaauaaauuu

SEQ ID NO: 125590 - RNA, 20 nt, Artificial Sequence
  MKO10125590_B_Vmn1r205
  gRNA
accaaaaacuaaaauagucu

SEQ ID NO: 125591 - RNA, 20 nt, Artificial Sequence
  MKO10125591_B_Vmn1r205
  gRNA
ucuuacacccuauaucaucu

SEQ ID NO: 125592 - RNA, 20 nt, Artificial Sequence
  MKO10125592_B_Vmn1r206
  gRNA
uucaucuuuauaacugugau

SEQ ID NO: 125593 - RNA, 20 nt, Artificial Sequence
  MKO10125593_B_Vmn1r206
  gRNA
agcaaauacucaagaauuuc

SEQ ID NO: 125594 - RNA, 20 nt, Artificial Sequence
  MKO10125594_B_Vmn1r206
  gRNA
cuauuuaaugcaagaaaguc

SEQ ID NO: 125595 - RNA, 20 nt, Artificial Sequence
  MKO10125595_B_Vmn1r207-ps
  gRNA
acucaagaauuucugacccu

SEQ ID NO: 125596 - RNA, 20 nt, Artificial Sequence
  MKO10125596_B_Vmn1r207-ps
  gRNA
uagaaaaucaagaaguaaaa

SEQ ID NO: 125597 - RNA, 20 nt, Artificial Sequence
  MKO10125597_B_Vmn1r207-ps
  gRNA
ucugaagguagaagacaugc

SEQ ID NO: 125598 - RNA, 20 nt, Artificial Sequence
  MKO10125598_B_Vmn1r208
  gRNA
ccugaaacaaugcaucucuc

SEQ ID NO: 125599 - RNA, 20 nt, Artificial Sequence
  MKO10125599_B_Vmn1r208
  gRNA
gucccugugaaucagcacaa

SEQ ID NO: 125600 - RNA, 20 nt, Artificial Sequence
  MKO10125600_B_Vmn1r208
  gRNA
aucaucagucccagagcauc

SEQ ID NO: 125601 - RNA, 20 nt, Artificial Sequence
  MKO10125601_B_Vmn1r209
  gRNA
gaucuguacuugugauagaa

SEQ ID NO: 125602 - RNA, 20 nt, Artificial Sequence
  MKO10125602_B_Vmn1r209
  gRNA
acugaagaauuucugacccu

SEQ ID NO: 125603 - RNA, 20 nt, Artificial Sequence
  MKO10125603_B_Vmn1r209
  gRNA
aaacgaaacauagcaucaga

SEQ ID NO: 125604 - RNA, 20 nt, Artificial Sequence
  MKO10125604_B_Vmn1r20
  gRNA
gguaugacacagucauccug

SEQ ID NO: 125605 - RNA, 20 nt, Artificial Sequence
  MKO10125605_B_Vmn1r20
  gRNA
cagucccaguacuucuuguu

SEQ ID NO: 125606 - RNA, 20 nt, Artificial Sequence
  MKO10125606_B_Vmn1r20
  gRNA
ucacuagcagcaagauaguc

SEQ ID NO: 125607 - RNA, 20 nt, Artificial Sequence
  MKO10125607_B_Vmn1r210
  gRNA
augggcuucugguuaaauuu

SEQ ID NO: 125608 - RNA, 20 nt, Artificial Sequence
  MKO10125608_B_Vmn1r210
  gRNA
agaucauuguuuaccuagaa

SEQ ID NO: 125609 - RNA, 20 nt, Artificial Sequence
  MKO10125609_B_Vmn1r210
  gRNA
uaauuauaagcaucucuuca

SEQ ID NO: 125610 - RNA, 20 nt, Artificial Sequence
  MKO10125610_B_Vmn1r211
  gRNA
aauugaguauccacaggcag

SEQ ID NO: 125611 - RNA, 20 nt, Artificial Sequence
  MKO10125611_B_Vmn1r211
  gRNA
uaguaaguucaugcugauca

SEQ ID NO: 125612 - RNA, 20 nt, Artificial Sequence
  MKO10125612_B_Vmn1r211
  gRNA
aucucuaugaaucaguauga

SEQ ID NO: 125613 - RNA, 20 nt, Artificial Sequence
  MKO10125613_B_Vmn1r212
  gRNA
cacagggauggaguucugac

SEQ ID NO: 125614 - RNA, 20 nt, Artificial Sequence
  MKO10125614_B_Vmn1r212
  gRNA
aaauagauucuuaaccuucu

SEQ ID NO: 125615 - RNA, 20 nt, Artificial Sequence
  MKO10125615_B_Vmn1r212
  gRNA
cauccucuccagguaaacaa

SEQ ID NO: 125616 - RNA, 20 nt, Artificial Sequence
  MKO10125616_B_Vmn1r213
  gRNA
gggaggggccagugguuaug

SEQ ID NO: 125617 - RNA, 20 nt, Artificial Sequence
  MKO10125617_B_Vmn1r213
  gRNA
auaauaauccuucuuguaaa

SEQ ID NO: 125618 - RNA, 20 nt, Artificial Sequence
  MKO10125618_B_Vmn1r213
  gRNA
guuucuaacucucucuucag

SEQ ID NO: 125619 - RNA, 20 nt, Artificial Sequence
  MKO10125619_B_Vmn1r214
  gRNA
agaaacuuccuaaauaacuu

SEQ ID NO: 125620 - RNA, 20 nt, Artificial Sequence
  MKO10125620_B_Vmn1r214
  gRNA
uuucucuucaugaccaugcu

SEQ ID NO: 125621 - RNA, 20 nt, Artificial Sequence
  MKO10125621_B_Vmn1r214
  gRNA
guuccccagaaugccaagca

SEQ ID NO: 125622 - RNA, 20 nt, Artificial Sequence
  MKO10125622_B_Vmn1r215
  gRNA
auaauuuggcaugcuguuug

SEQ ID NO: 125623 - RNA, 20 nt, Artificial Sequence
  MKO10125623_B_Vmn1r215
  gRNA
cuuuguccaaagggaaguuc

SEQ ID NO: 125624 - RNA, 20 nt, Artificial Sequence
  MKO10125624_B_Vmn1r215
  gRNA
agcauauuucccacaauucc

SEQ ID NO: 125625 - RNA, 20 nt, Artificial Sequence
  MKO10125625_B_Vmn1r216
  gRNA
aucccagauaaucaggauaa

SEQ ID NO: 125626 - RNA, 20 nt, Artificial Sequence
  MKO10125626_B_Vmn1r216
  gRNA
acaaucauuauuuacuguau

SEQ ID NO: 125627 - RNA, 20 nt, Artificial Sequence
  MKO10125627_B_Vmn1r216
  gRNA
agcaugaauaggucugaaau

SEQ ID NO: 125628 - RNA, 20 nt, Artificial Sequence
  MKO10125628_B_Vmn1r217
  gRNA
cacugagcaugccaacaugc

SEQ ID NO: 125629 - RNA, 20 nt, Artificial Sequence
  MKO10125629_B_Vmn1r217
  gRNA
cagaaagucgagaaauaaaa

SEQ ID NO: 125630 - RNA, 20 nt, Artificial Sequence
  MKO10125630_B_Vmn1r217
  gRNA
cuugaugauaaauauucaaa

SEQ ID NO: 125631 - RNA, 20 nt, Artificial Sequence
  MKO10125631_B_Vmn1r218
  gRNA
auauguguacacuucugccu

SEQ ID NO: 125632 - RNA, 20 nt, Artificial Sequence
  MKO10125632_B_Vmn1r218
  gRNA
agauauuggcuguaaaauga

SEQ ID NO: 125633 - RNA, 20 nt, Artificial Sequence
  MKO10125633_B_Vmn1r218
  gRNA
gaagaugaauaaaauuacuc

SEQ ID NO: 125634 - RNA, 20 nt, Artificial Sequence
  MKO10125634_B_Vmn1r219
  gRNA
auccauucgauuagaaguau

SEQ ID NO: 125635 - RNA, 20 nt, Artificial Sequence
  MKO10125635_B_Vmn1r219
  gRNA
ggcuggaaacugcauaacca

SEQ ID NO: 125636 - RNA, 20 nt, Artificial Sequence
  MKO10125636_B_Vmn1r219
  gRNA
auucaugaaucugugacccu

SEQ ID NO: 125637 - RNA, 20 nt, Artificial Sequence
  MKO10125637_B_Vmn1r21
  gRNA
auguauuauucaguaguaga

SEQ ID NO: 125638 - RNA, 20 nt, Artificial Sequence
  MKO10125638_B_Vmn1r21
  gRNA
cauagcaucagcaaccugag

SEQ ID NO: 125639 - RNA, 20 nt, Artificial Sequence
  MKO10125639_B_Vmn1r21
  gRNA
cauauaaugaugauucucac

SEQ ID NO: 125640 - RNA, 20 nt, Artificial Sequence
  MKO10125640_B_Vmn1r220
  gRNA
cccuugaauauuuaucauca

SEQ ID NO: 125641 - RNA, 20 nt, Artificial Sequence
  MKO10125641_B_Vmn1r220
  gRNA
cacugagcaugccaacauac

SEQ ID NO: 125642 - RNA, 20 nt, Artificial Sequence
  MKO10125642_B_Vmn1r220
  gRNA
uccuugaugauaaauauuca

SEQ ID NO: 125643 - RNA, 20 nt, Artificial Sequence
  MKO10125643_B_Vmn1r221
  gRNA
gauucacagggauagaauuc

SEQ ID NO: 125644 - RNA, 20 nt, Artificial Sequence
  MKO10125644_B_Vmn1r221
  gRNA
uaucccugugaaucagcacc

SEQ ID NO: 125645 - RNA, 20 nt, Artificial Sequence
  MKO10125645_B_Vmn1r221
  gRNA
cuuccuccacccagaugcuc

SEQ ID NO: 125646 - RNA, 20 nt, Artificial Sequence
  MKO10125646_B_Vmn1r222
  gRNA
ggcucaggccaaaguaugca

SEQ ID NO: 125647 - RNA, 20 nt, Artificial Sequence
  MKO10125647_B_Vmn1r222
  gRNA
acaccucauucuuauccacu

SEQ ID NO: 125648 - RNA, 20 nt, Artificial Sequence
  MKO10125648_B_Vmn1r222
  gRNA
cuguaagagcauuguuuacc

SEQ ID NO: 125649 - RNA, 20 nt, Artificial Sequence
  MKO10125649_B_Vmn1r223
  gRNA
uguucuuuguuccauugaca

SEQ ID NO: 125650 - RNA, 20 nt, Artificial Sequence
  MKO10125650_B_Vmn1r223
  gRNA
acauuuauauacuuucauca

SEQ ID NO: 125651 - RNA, 20 nt, Artificial Sequence
  MKO10125651_B_Vmn1r223
  gRNA
ggaaaaaccugagaaacaca

SEQ ID NO: 125652 - RNA, 20 nt, Artificial Sequence
  MKO10125652_B_Vmn1r224
  gRNA
auaccaaggccaguauccug

SEQ ID NO: 125653 - RNA, 20 nt, Artificial Sequence
  MKO10125653_B_Vmn1r224
  gRNA
uaccuauuaucaaauccuug

SEQ ID NO: 125654 - RNA, 20 nt, Artificial Sequence
  MKO10125654_B_Vmn1r224
  gRNA
guuuacuauaguaauugaau

SEQ ID NO: 125655 - RNA, 20 nt, Artificial Sequence
  MKO10125655_B_Vmn1r225
  gRNA
auacaguguacauagcauuu

SEQ ID NO: 125656 - RNA, 20 nt, Artificial Sequence
  MKO10125656_B_Vmn1r225
  gRNA
cuuugaaugcauccaccaaa

SEQ ID NO: 125657 - RNA, 20 nt, Artificial Sequence
  MKO10125657_B_Vmn1r225
  gRNA
uaaacgacagaauggagucc

SEQ ID NO: 125658 - RNA, 20 nt, Artificial Sequence
  MKO10125658_B_Vmn1r226
  gRNA
gagcacuauuccaacuauca

SEQ ID NO: 125659 - RNA, 20 nt, Artificial Sequence
  MKO10125659_B_Vmn1r226
  gRNA
ccauuuauacagcuaccaau

SEQ ID NO: 125660 - RNA, 20 nt, Artificial Sequence
  MKO10125660_B_Vmn1r226
  gRNA
ggugcugauggacauacucc

SEQ ID NO: 125661 - RNA, 20 nt, Artificial Sequence
  MKO10125661_B_Vmn1r227
  gRNA
agcaauauagccuaguaaaa

SEQ ID NO: 125662 - RNA, 20 nt, Artificial Sequence
  MKO10125662_B_Vmn1r227
  gRNA
ugauuacccaaaagacacuc

SEQ ID NO: 125663 - RNA, 20 nt, Artificial Sequence
  MKO10125663_B_Vmn1r227
  gRNA
cugucuacacaacuaccaag

SEQ ID NO: 125664 - RNA, 20 nt, Artificial Sequence
  MKO10125664_B_Vmn1r228
  gRNA
aagcaguuauucaauaaugu

SEQ ID NO: 125665 - RNA, 20 nt, Artificial Sequence
  MKO10125665_B_Vmn1r228
  gRNA
cuucuagauguugcuuuacc

SEQ ID NO: 125666 - RNA, 20 nt, Artificial Sequence
  MKO10125666_B_Vmn1r228
  gRNA
gccuguccauuuccuucuac

SEQ ID NO: 125667 - RNA, 20 nt, Artificial Sequence
  MKO10125667_B_Vmn1r229
  gRNA
accaugauagucauacuuua

SEQ ID NO: 125668 - RNA, 20 nt, Artificial Sequence
  MKO10125668_B_Vmn1r229
  gRNA
augugcguucuuuguuauaa

SEQ ID NO: 125669 - RNA, 20 nt, Artificial Sequence
  MKO10125669_B_Vmn1r229
  gRNA
caugcuaauugacauacucc

SEQ ID NO: 125670 - RNA, 20 nt, Artificial Sequence
  MKO10125670_B_Vmn1r22
  gRNA
gccaaauauccccugcagug

SEQ ID NO: 125671 - RNA, 20 nt, Artificial Sequence
  MKO10125671_B_Vmn1r22
  gRNA
uaugugcaucacaugccucc

SEQ ID NO: 125672 - RNA, 20 nt, Artificial Sequence
  MKO10125672_B_Vmn1r22
  gRNA
acagaccauccugcugcugc

SEQ ID NO: 125673 - RNA, 20 nt, Artificial Sequence
  MKO10125673_B_Vmn1r230
  gRNA
gacucuaauauucuuccaac

SEQ ID NO: 125674 - RNA, 20 nt, Artificial Sequence
  MKO10125674_B_Vmn1r230
  gRNA
uacauguccauaacauuuac

SEQ ID NO: 125675 - RNA, 20 nt, Artificial Sequence
  MKO10125675_B_Vmn1r230
  gRNA
uuugaagcaugagaaguguu

SEQ ID NO: 125676 - RNA, 20 nt, Artificial Sequence
  MKO10125676_B_Vmn1r231
  gRNA
agcucccagaacagacaaua

SEQ ID NO: 125677 - RNA, 20 nt, Artificial Sequence
  MKO10125677_B_Vmn1r231
  gRNA
ccauuaaggcacgagucacu

SEQ ID NO: 125678 - RNA, 20 nt, Artificial Sequence
  MKO10125678_B_Vmn1r231
  gRNA
aauuaugguuaaugacaaga

SEQ ID NO: 125679 - RNA, 20 nt, Artificial Sequence
  MKO10125679_B_Vmn1r232
  gRNA
acccaacaucauugaauaac

SEQ ID NO: 125680 - RNA, 20 nt, Artificial Sequence
  MKO10125680_B_Vmn1r232
  gRNA
acccaaaagcucccauuauc

SEQ ID NO: 125681 - RNA, 20 nt, Artificial Sequence
  MKO10125681_B_Vmn1r232
  gRNA
aggaacauggcaauaggagu

SEQ ID NO: 125682 - RNA, 20 nt, Artificial Sequence
  MKO10125682_B_Vmn1r233
  gRNA
cccuguauaggcacaagcaa

SEQ ID NO: 125683 - RNA, 20 nt, Artificial Sequence
  MKO10125683_B_Vmn1r233
  gRNA
uauaguagagauuguguaac

SEQ ID NO: 125684 - RNA, 20 nt, Artificial Sequence
  MKO10125684_B_Vmn1r233
  gRNA
uugacacuaaugcugcauac

SEQ ID NO: 125685 - RNA, 20 nt, Artificial Sequence
  MKO10125685_B_Vmn1r234
  gRNA
cgccucuucccacccuauga

SEQ ID NO: 125686 - RNA, 20 nt, Artificial Sequence
  MKO10125686_B_Vmn1r234
  gRNA
gacccuucugccugaucccg

SEQ ID NO: 125687 - RNA, 20 nt, Artificial Sequence
  MKO10125687_B_Vmn1r234
  gRNA
cugggcugauagugaugacc

SEQ ID NO: 125688 - RNA, 20 nt, Artificial Sequence
  MKO10125688_B_Vmn1r235
  gRNA
uuuaagcccaaaagcugcca

SEQ ID NO: 125689 - RNA, 20 nt, Artificial Sequence
  MKO10125689_B_Vmn1r235
  gRNA
uaaauguacucaauugaaga

SEQ ID NO: 125690 - RNA, 20 nt, Artificial Sequence
  MKO10125690_B_Vmn1r235
  gRNA
auaauucaacauccagucug

SEQ ID NO: 125691 - RNA, 20 nt, Artificial Sequence
  MKO10125691_B_Vmn1r236
  gRNA
acaaguuaaggucuacagac

SEQ ID NO: 125692 - RNA, 20 nt, Artificial Sequence
  MKO10125692_B_Vmn1r236
  gRNA
uauuccuauagacaacucac

SEQ ID NO: 125693 - RNA, 20 nt, Artificial Sequence
  MKO10125693_B_Vmn1r236
  gRNA
acauaguacaguuaagauau

SEQ ID NO: 125694 - RNA, 20 nt, Artificial Sequence
  MKO10125694_B_Vmn1r237
  gRNA
ggcuuuaagcuguguccacc

SEQ ID NO: 125695 - RNA, 20 nt, Artificial Sequence
  MKO10125695_B_Vmn1r237
  gRNA
agacuaagaaggaguugccc

SEQ ID NO: 125696 - RNA, 20 nt, Artificial Sequence
  MKO10125696_B_Vmn1r237
  gRNA
guuuacaaccaaugucaucg

SEQ ID NO: 125697 - RNA, 20 nt, Artificial Sequence
  MKO10125697_B_Vmn1r238
  gRNA
aaguuaucucuuaccuaagc

SEQ ID NO: 125698 - RNA, 20 nt, Artificial Sequence
  MKO10125698_B_Vmn1r238
  gRNA
acaagaaaaaugcaacuaac

SEQ ID NO: 125699 - RNA, 20 nt, Artificial Sequence
  MKO10125699_B_Vmn1r238
  gRNA
cuucucugaugucuucuguc

SEQ ID NO: 125700 - RNA, 20 nt, Artificial Sequence
  MKO10125700_B_Vmn1r23
  gRNA
gaaaaucagcagaaacauau

SEQ ID NO: 125701 - RNA, 20 nt, Artificial Sequence
  MKO10125701_B_Vmn1r23
  gRNA
uaagaaugacuucauaugua

SEQ ID NO: 125702 - RNA, 20 nt, Artificial Sequence
  MKO10125702_B_Vmn1r23
  gRNA
uaacaucauuaugugaacga

SEQ ID NO: 125703 - RNA, 20 nt, Artificial Sequence
  MKO10125703_B_Vmn1r24
  gRNA
uaccaccauguaugaacuug

SEQ ID NO: 125704 - RNA, 20 nt, Artificial Sequence
  MKO10125704_B_Vmn1r24
  gRNA
uccccuuauaauguuguuca

SEQ ID NO: 125705 - RNA, 20 nt, Artificial Sequence
  MKO10125705_B_Vmn1r24
  gRNA
augucacaguccuaagccug

SEQ ID NO: 125706 - RNA, 20 nt, Artificial Sequence
  MKO10125706_B_Vmn1r25
  gRNA
cuaugagcuucugaacaguc

SEQ ID NO: 125707 - RNA, 20 nt, Artificial Sequence
  MKO10125707_B_Vmn1r25
  gRNA
agucaccuguuagucuaugu

SEQ ID NO: 125708 - RNA, 20 nt, Artificial Sequence
  MKO10125708_B_Vmn1r25
  gRNA
uauacaaauagggucaugag

SEQ ID NO: 125709 - RNA, 20 nt, Artificial Sequence
  MKO10125709_B_Vmn1r26
  gRNA
ggugacaacaagugcauaca

SEQ ID NO: 125710 - RNA, 20 nt, Artificial Sequence
  MKO10125710_B_Vmn1r26
  gRNA
gugccagcaucaugccacuu

SEQ ID NO: 125711 - RNA, 20 nt, Artificial Sequence
  MKO10125711_B_Vmn1r26
  gRNA
uugccccuuuaaaaaaagcu

SEQ ID NO: 125712 - RNA, 20 nt, Artificial Sequence
  MKO10125712_B_Vmn1r27
  gRNA
aauccacaacagaacugaug

SEQ ID NO: 125713 - RNA, 20 nt, Artificial Sequence
  MKO10125713_B_Vmn1r27
  gRNA
ucagaaacuucugaaccauc

SEQ ID NO: 125714 - RNA, 20 nt, Artificial Sequence
  MKO10125714_B_Vmn1r27
  gRNA
caaccacaucaguucuguug

SEQ ID NO: 125715 - RNA, 20 nt, Artificial Sequence
  MKO10125715_B_Vmn1r28
  gRNA
uccuacaagaaauacauccc

SEQ ID NO: 125716 - RNA, 20 nt, Artificial Sequence
  MKO10125716_B_Vmn1r28
  gRNA
gaacacuaccaacagcaaga

SEQ ID NO: 125717 - RNA, 20 nt, Artificial Sequence
  MKO10125717_B_Vmn1r28
  gRNA
auacuuccaugacaggguug

SEQ ID NO: 125718 - RNA, 20 nt, Artificial Sequence
  MKO10125718_B_Vmn1r29
  gRNA
ccagaccaucuuacugcuug

SEQ ID NO: 125719 - RNA, 20 nt, Artificial Sequence
  MKO10125719_B_Vmn1r29
  gRNA
gaagaccacaagcaguaaga

SEQ ID NO: 125720 - RNA, 20 nt, Artificial Sequence
  MKO10125720_B_Vmn1r29
  gRNA
ccuuugaugauguaguucuu

SEQ ID NO: 125721 - RNA, 20 nt, Artificial Sequence
  MKO10125721_B_Vmn1r2
  gRNA
acaagaaaaaugcaacuaac

SEQ ID NO: 125722 - RNA, 20 nt, Artificial Sequence
  MKO10125722_B_Vmn1r2
  gRNA
gagucaagauguuuagaagc

SEQ ID NO: 125723 - RNA, 20 nt, Artificial Sequence
  MKO10125723_B_Vmn1r2
  gRNA
cuucucugaugucuucuguc

SEQ ID NO: 125724 - RNA, 20 nt, Artificial Sequence
  MKO10125724_B_Vmn1r30
  gRNA
gaaaaccacaaguaguaaga

SEQ ID NO: 125725 - RNA, 20 nt, Artificial Sequence
  MKO10125725_B_Vmn1r30
  gRNA
ugggcuuugaucuaugaccu

SEQ ID NO: 125726 - RNA, 20 nt, Artificial Sequence
  MKO10125726_B_Vmn1r30
  gRNA
aggauugagugacucucauc

SEQ ID NO: 125727 - RNA, 20 nt, Artificial Sequence
  MKO10125727_B_Vmn1r31
  gRNA
cagucccaauaccucaaugu

SEQ ID NO: 125728 - RNA, 20 nt, Artificial Sequence
  MKO10125728_B_Vmn1r31
  gRNA
gagugagaauaaccagaugc

SEQ ID NO: 125729 - RNA, 20 nt, Artificial Sequence
  MKO10125729_B_Vmn1r31
  gRNA
aaccaugaacauagaagaac

SEQ ID NO: 125730 - RNA, 20 nt, Artificial Sequence
  MKO10125730_B_Vmn1r32
  gRNA
aaucaccauauaugcacuug

SEQ ID NO: 125731 - RNA, 20 nt, Artificial Sequence
  MKO10125731_B_Vmn1r32
  gRNA
auuugucauucagcaguaac

SEQ ID NO: 125732 - RNA, 20 nt, Artificial Sequence
  MKO10125732_B_Vmn1r32
  gRNA
uacgagcuuccccugagaaa

SEQ ID NO: 125733 - RNA, 20 nt, Artificial Sequence
  MKO10125733_B_Vmn1r33
  gRNA
aauuaucauguaugcacuug

SEQ ID NO: 125734 - RNA, 20 nt, Artificial Sequence
  MKO10125734_B_Vmn1r33
  gRNA
auacugcucacucuucccca

SEQ ID NO: 125735 - RNA, 20 nt, Artificial Sequence
  MKO10125735_B_Vmn1r33
  gRNA
gaccauaauuaugugaacga

SEQ ID NO: 125736 - RNA, 20 nt, Artificial Sequence
  MKO10125736_B_Vmn1r34
  gRNA
ucucaggggaugcucugaag

SEQ ID NO: 125737 - RNA, 20 nt, Artificial Sequence
  MKO10125737_B_Vmn1r34
  gRNA
ccauagcuccaagcccagcu

SEQ ID NO: 125738 - RNA, 20 nt, Artificial Sequence
  MKO10125738_B_Vmn1r34
  gRNA
ccagacuaucuugcugcugc

SEQ ID NO: 125739 - RNA, 20 nt, Artificial Sequence
  MKO10125739_B_Vmn1r35
  gRNA
aguauuuaaucaccuucaac

SEQ ID NO: 125740 - RNA, 20 nt, Artificial Sequence
  MKO10125740_B_Vmn1r35
  gRNA
gagugagaccagccaguuga

SEQ ID NO: 125741 - RNA, 20 nt, Artificial Sequence
  MKO10125741_B_Vmn1r35
  gRNA
aaacaacauuaugugaauga

SEQ ID NO: 125742 - RNA, 20 nt, Artificial Sequence
  MKO10125742_B_Vmn1r36
  gRNA
uccccaugaacuacaucauc

SEQ ID NO: 125743 - RNA, 20 nt, Artificial Sequence
  MKO10125743_B_Vmn1r36
  gRNA
ugggacugaucgucacagcc

SEQ ID NO: 125744 - RNA, 20 nt, Artificial Sequence
  MKO10125744_B_Vmn1r36
  gRNA
uuaagagauguguuucuugu

SEQ ID NO: 125745 - RNA, 20 nt, Artificial Sequence
  MKO10125745_B_Vmn1r37
  gRNA
ugggacugaucgucacagcc

SEQ ID NO: 125746 - RNA, 20 nt, Artificial Sequence
  MKO10125746_B_Vmn1r37
  gRNA
uccccaugaacuacaucauc

SEQ ID NO: 125747 - RNA, 20 nt, Artificial Sequence
  MKO10125747_B_Vmn1r37
  gRNA
ggcaggugaugcagauagag

SEQ ID NO: 125748 - RNA, 20 nt, Artificial Sequence
  MKO10125748_B_Vmn1r38
  gRNA
gaccuucauucacauaauca

SEQ ID NO: 125749 - RNA, 20 nt, Artificial Sequence
  MKO10125749_B_Vmn1r38
  gRNA
ugauaguguagaaaauaaga

SEQ ID NO: 125750 - RNA, 20 nt, Artificial Sequence
  MKO10125750_B_Vmn1r38
  gRNA
ucccuaugaacaacaucauc

SEQ ID NO: 125751 - RNA, 20 nt, Artificial Sequence
  MKO10125751_B_Vmn1r39
  gRNA
gaagaugcuugcauugccuc

SEQ ID NO: 125752 - RNA, 20 nt, Artificial Sequence
  MKO10125752_B_Vmn1r39
  gRNA
cuaggguuccaaguacagcu

SEQ ID NO: 125753 - RNA, 20 nt, Artificial Sequence
  MKO10125753_B_Vmn1r39
  gRNA
uucugaacagucaacaugac

SEQ ID NO: 125754 - RNA, 20 nt, Artificial Sequence
  MKO10125754_B_Vmn1r3
  gRNA
cuucucugaugucuucuguc

SEQ ID NO: 125755 - RNA, 20 nt, Artificial Sequence
  MKO10125755_B_Vmn1r3
  gRNA
gagucaagauguuuagaagc

SEQ ID NO: 125756 - RNA, 20 nt, Artificial Sequence
  MKO10125756_B_Vmn1r3
  gRNA
ggccugcucaaguaucucca

SEQ ID NO: 125757 - RNA, 20 nt, Artificial Sequence
  MKO10125757_B_Vmn1r40
  gRNA
uucuaccucugaguuacucc

SEQ ID NO: 125758 - RNA, 20 nt, Artificial Sequence
  MKO10125758_B_Vmn1r40
  gRNA
aaaucuccucaucauaucuc

SEQ ID NO: 125759 - RNA, 20 nt, Artificial Sequence
  MKO10125759_B_Vmn1r40
  gRNA
uguggacauguuucuaucuc

SEQ ID NO: 125760 - RNA, 20 nt, Artificial Sequence
  MKO10125760_B_Vmn1r41
  gRNA
uuguucucugaagugagugu

SEQ ID NO: 125761 - RNA, 20 nt, Artificial Sequence
  MKO10125761_B_Vmn1r41
  gRNA
uguggaaaacaugcuugucc

SEQ ID NO: 125762 - RNA, 20 nt, Artificial Sequence
  MKO10125762_B_Vmn1r41
  gRNA
uuuccacagcgauagccauc

SEQ ID NO: 125763 - RNA, 20 nt, Artificial Sequence
  MKO10125763_B_Vmn1r42
  gRNA
guuuccugugcaugcuuaag

SEQ ID NO: 125764 - RNA, 20 nt, Artificial Sequence
  MKO10125764_B_Vmn1r42
  gRNA
cuacauacucauucuaucau

SEQ ID NO: 125765 - RNA, 20 nt, Artificial Sequence
  MKO10125765_B_Vmn1r42
  gRNA
cuaccauguaccaauuagag

SEQ ID NO: 125766 - RNA, 20 nt, Artificial Sequence
  MKO10125766_B_Vmn1r43
  gRNA
auucuacgcugcuagccauc

SEQ ID NO: 125767 - RNA, 20 nt, Artificial Sequence
  MKO10125767_B_Vmn1r43
  gRNA
guaugugagaacagugaaca

SEQ ID NO: 125768 - RNA, 20 nt, Artificial Sequence
  MKO10125768_B_Vmn1r43
  gRNA
aacauaaguaaggucauuug

SEQ ID NO: 125769 - RNA, 20 nt, Artificial Sequence
  MKO10125769_B_Vmn1r44
  gRNA
ugcagagguaggcuauaaaa

SEQ ID NO: 125770 - RNA, 20 nt, Artificial Sequence
  MKO10125770_B_Vmn1r44
  gRNA
gccuaccucugcaugcuccu

SEQ ID NO: 125771 - RNA, 20 nt, Artificial Sequence
  MKO10125771_B_Vmn1r44
  gRNA
uaagcagcauuaguugaguu

SEQ ID NO: 125772 - RNA, 20 nt, Artificial Sequence
  MKO10125772_B_Vmn1r45
  gRNA
cuuacugaugcuacugcuca

SEQ ID NO: 125773 - RNA, 20 nt, Artificial Sequence
  MKO10125773_B_Vmn1r45
  gRNA
caaauuggggguagcaauga

SEQ ID NO: 125774 - RNA, 20 nt, Artificial Sequence
  MKO10125774_B_Vmn1r45
  gRNA
gugcuugagcuuugcuaaac

SEQ ID NO: 125775 - RNA, 20 nt, Artificial Sequence
  MKO10125775_B_Vmn1r46
  gRNA
acucuguuaucuucuacuca

SEQ ID NO: 125776 - RNA, 20 nt, Artificial Sequence
  MKO10125776_B_Vmn1r46
  gRNA
guuucuuggacuaaggguga

SEQ ID NO: 125777 - RNA, 20 nt, Artificial Sequence
  MKO10125777_B_Vmn1r46
  gRNA
ccuaaugcugcuuguaacua

SEQ ID NO: 125778 - RNA, 20 nt, Artificial Sequence
  MKO10125778_B_Vmn1r47
  gRNA
auuuauuauccacucacaca

SEQ ID NO: 125779 - RNA, 20 nt, Artificial Sequence
  MKO10125779_B_Vmn1r47
  gRNA
gacugcuaauugacauauac

SEQ ID NO: 125780 - RNA, 20 nt, Artificial Sequence
  MKO10125780_B_Vmn1r47
  gRNA
uggcccucuugugcaugcac

SEQ ID NO: 125781 - RNA, 20 nt, Artificial Sequence
  MKO10125781_B_Vmn1r48
  gRNA
ucagugcuuauaaacacaaa

SEQ ID NO: 125782 - RNA, 20 nt, Artificial Sequence
  MKO10125782_B_Vmn1r48
  gRNA
uacacacucauucuaacaua

SEQ ID NO: 125783 - RNA, 20 nt, Artificial Sequence
  MKO10125783_B_Vmn1r48
  gRNA
cucagggaagucuuucuuau

SEQ ID NO: 125784 - RNA, 20 nt, Artificial Sequence
  MKO10125784_B_Vmn1r49
  gRNA
gcugcucacgagccucuuug

SEQ ID NO: 125785 - RNA, 20 nt, Artificial Sequence
  MKO10125785_B_Vmn1r49
  gRNA
aaagaguugucuuccaauca

SEQ ID NO: 125786 - RNA, 20 nt, Artificial Sequence
  MKO10125786_B_Vmn1r49
  gRNA
ugaguuacuccagagaaagc

SEQ ID NO: 125787 - RNA, 20 nt, Artificial Sequence
  MKO10125787_B_Vmn1r4
  gRNA
aagaaacacgucucuuaaga

SEQ ID NO: 125788 - RNA, 20 nt, Artificial Sequence
  MKO10125788_B_Vmn1r4
  gRNA
uaagaugucauugugacugu

SEQ ID NO: 125789 - RNA, 20 nt, Artificial Sequence
  MKO10125789_B_Vmn1r4
  gRNA
cugauaacagaauaaucaau

SEQ ID NO: 125790 - RNA, 20 nt, Artificial Sequence
  MKO10125790_B_Vmn1r50
  gRNA
guuugggcuuguucucauga

SEQ ID NO: 125791 - RNA, 20 nt, Artificial Sequence
  MKO10125791_B_Vmn1r50
  gRNA
aaguuugucacaucaaugug

SEQ ID NO: 125792 - RNA, 20 nt, Artificial Sequence
  MKO10125792_B_Vmn1r50
  gRNA
gaagcccaugaguagcauga

SEQ ID NO: 125793 - RNA, 20 nt, Artificial Sequence
  MKO10125793_B_Vmn1r51
  gRNA
auaugaugaaugagaacagc

SEQ ID NO: 125794 - RNA, 20 nt, Artificial Sequence
  MKO10125794_B_Vmn1r51
  gRNA
uacacacucauucuaacuua

SEQ ID NO: 125795 - RNA, 20 nt, Artificial Sequence
  MKO10125795_B_Vmn1r51
  gRNA
ccaugaccaguagcauuagu

SEQ ID NO: 125796 - RNA, 20 nt, Artificial Sequence
  MKO10125796_B_Vmn1r52
  gRNA
gaauagcugcuauuaaaaua

SEQ ID NO: 125797 - RNA, 20 nt, Artificial Sequence
  MKO10125797_B_Vmn1r52
  gRNA
auuccugaaagccaacagug

SEQ ID NO: 125798 - RNA, 20 nt, Artificial Sequence
  MKO10125798_B_Vmn1r52
  gRNA
aaugccuucuucucugagau

SEQ ID NO: 125799 - RNA, 20 nt, Artificial Sequence
  MKO10125799_B_Vmn1r53
  gRNA
aagaaaggcugguccuguga

SEQ ID NO: 125800 - RNA, 20 nt, Artificial Sequence
  MKO10125800_B_Vmn1r53
  gRNA
ugcagagaugggcaaaaaua

SEQ ID NO: 125801 - RNA, 20 nt, Artificial Sequence
  MKO10125801_B_Vmn1r53
  gRNA
ccuugaacuucauucuugag

SEQ ID NO: 125802 - RNA, 20 nt, Artificial Sequence
  MKO10125802_B_Vmn1r54
  gRNA
ugguaaccaucauauugcuc

SEQ ID NO: 125803 - RNA, 20 nt, Artificial Sequence
  MKO10125803_B_Vmn1r54
  gRNA
ccuauuccugagcaauauga

SEQ ID NO: 125804 - RNA, 20 nt, Artificial Sequence
  MKO10125804_B_Vmn1r54
  gRNA
aaugggcaggucaauauguc

SEQ ID NO: 125805 - RNA, 20 nt, Artificial Sequence
  MKO10125805_B_Vmn1r55
  gRNA
uguucucuguacuucaaugu

SEQ ID NO: 125806 - RNA, 20 nt, Artificial Sequence
  MKO10125806_B_Vmn1r55
  gRNA
uaaugacuuugccagucaca

SEQ ID NO: 125807 - RNA, 20 nt, Artificial Sequence
  MKO10125807_B_Vmn1r55
  gRNA
acaagaguaucucacgaccu

SEQ ID NO: 125808 - RNA, 20 nt, Artificial Sequence
  MKO10125808_B_Vmn1r56
  gRNA
agucgggaaucagucaagau

SEQ ID NO: 125809 - RNA, 20 nt, Artificial Sequence
  MKO10125809_B_Vmn1r56
  gRNA
ucuugacugauucccgacug

SEQ ID NO: 125810 - RNA, 20 nt, Artificial Sequence
  MKO10125810_B_Vmn1r56
  gRNA
caucauguuccuuagcauca

SEQ ID NO: 125811 - RNA, 20 nt, Artificial Sequence
  MKO10125811_B_Vmn1r57
  gRNA
gccuggaaauccacgugacu

SEQ ID NO: 125812 - RNA, 20 nt, Artificial Sequence
  MKO10125812_B_Vmn1r57
  gRNA
uccuuggaacaaaaucaauc

SEQ ID NO: 125813 - RNA, 20 nt, Artificial Sequence
  MKO10125813_B_Vmn1r57
  gRNA
agucuggagucagucaaguu

SEQ ID NO: 125814 - RNA, 20 nt, Artificial Sequence
  MKO10125814_B_Vmn1r58
  gRNA
aucccuaaauaucaaaagaa

SEQ ID NO: 125815 - RNA, 20 nt, Artificial Sequence
  MKO10125815_B_Vmn1r58
  gRNA
gagguaugccacaaaacucc

SEQ ID NO: 125816 - RNA, 20 nt, Artificial Sequence
  MKO10125816_B_Vmn1r58
  gRNA
caguuugucacucuuguccc

SEQ ID NO: 125817 - RNA, 20 nt, Artificial Sequence
  MKO10125817_B_Vmn1r59
  gRNA
auguagacaugcauuucuug

SEQ ID NO: 125818 - RNA, 20 nt, Artificial Sequence
  MKO10125818_B_Vmn1r59
  gRNA
gagaaugaaccgcauacaua

SEQ ID NO: 125819 - RNA, 20 nt, Artificial Sequence
  MKO10125819_B_Vmn1r59
  gRNA
agucuggagucagucaagac

SEQ ID NO: 125820 - RNA, 20 nt, Artificial Sequence
  MKO10125820_B_Vmn1r5
  gRNA
uuuaguagccuucaucuguu

SEQ ID NO: 125821 - RNA, 20 nt, Artificial Sequence
  MKO10125821_B_Vmn1r5
  gRNA
aguaaccagaucuucuuugu

SEQ ID NO: 125822 - RNA, 20 nt, Artificial Sequence
  MKO10125822_B_Vmn1r5
  gRNA
cauauaaucauguuucucac

SEQ ID NO: 125823 - RNA, 20 nt, Artificial Sequence
  MKO10125823_B_Vmn1r60
  gRNA
uucuuucaccuaguugcucg

SEQ ID NO: 125824 - RNA, 20 nt, Artificial Sequence
  MKO10125824_B_Vmn1r60
  gRNA
guguggacaugaaugucuug

SEQ ID NO: 125825 - RNA, 20 nt, Artificial Sequence
  MKO10125825_B_Vmn1r60
  gRNA
uauuaaggaauaugauguca

SEQ ID NO: 125826 - RNA, 20 nt, Artificial Sequence
  MKO10125826_B_Vmn1r61
  gRNA
aguuuacauuugacuucagu

SEQ ID NO: 125827 - RNA, 20 nt, Artificial Sequence
  MKO10125827_B_Vmn1r61
  gRNA
ucguggggaagcuuagagcc

SEQ ID NO: 125828 - RNA, 20 nt, Artificial Sequence
  MKO10125828_B_Vmn1r61
  gRNA
ucaagauucgagagaaguua

SEQ ID NO: 125829 - RNA, 20 nt, Artificial Sequence
  MKO10125829_B_Vmn1r62
  gRNA
uacaugcuaaugaaugucag

SEQ ID NO: 125830 - RNA, 20 nt, Artificial Sequence
  MKO10125830_B_Vmn1r62
  gRNA
gagucauugugugauuucug

SEQ ID NO: 125831 - RNA, 20 nt, Artificial Sequence
  MKO10125831_B_Vmn1r62
  gRNA
aauucgauaugcuccaucuc

SEQ ID NO: 125832 - RNA, 20 nt, Artificial Sequence
  MKO10125832_B_Vmn1r63
  gRNA
gucuacacugaccccagaga

SEQ ID NO: 125833 - RNA, 20 nt, Artificial Sequence
  MKO10125833_B_Vmn1r63
  gRNA
cacaaugacucugauucuaa

SEQ ID NO: 125834 - RNA, 20 nt, Artificial Sequence
  MKO10125834_B_Vmn1r63
  gRNA
gagucauugugugauuucug

SEQ ID NO: 125835 - RNA, 20 nt, Artificial Sequence
  MKO10125835_B_Vmn1r64
  gRNA
cucccuuccuguugauuugu

SEQ ID NO: 125836 - RNA, 20 nt, Artificial Sequence
  MKO10125836_B_Vmn1r64
  gRNA
uccugggaacaaaaucaauc

SEQ ID NO: 125837 - RNA, 20 nt, Artificial Sequence
  MKO10125837_B_Vmn1r64
  gRNA
ucuugacugacucccgacug

SEQ ID NO: 125838 - RNA, 20 nt, Artificial Sequence
  MKO10125838_B_Vmn1r65
  gRNA
ucuguucaggugaagcacua

SEQ ID NO: 125839 - RNA, 20 nt, Artificial Sequence
  MKO10125839_B_Vmn1r65
  gRNA
gagcuucuuacaguuugccc

SEQ ID NO: 125840 - RNA, 20 nt, Artificial Sequence
  MKO10125840_B_Vmn1r65
  gRNA
cauccaaacaaacuuagcug

SEQ ID NO: 125841 - RNA, 20 nt, Artificial Sequence
  MKO10125841_B_Vmn1r66
  gRNA
gccaauauacuuugcaacuu

SEQ ID NO: 125842 - RNA, 20 nt, Artificial Sequence
  MKO10125842_B_Vmn1r66
  gRNA
gccuugauaguucuuucuac

SEQ ID NO: 125843 - RNA, 20 nt, Artificial Sequence
  MKO10125843_B_Vmn1r66
  gRNA
auccagaccaaacuuagucu

SEQ ID NO: 125844 - RNA, 20 nt, Artificial Sequence
  MKO10125844_B_Vmn1r67
  gRNA
acaaugauucauaagaacga

SEQ ID NO: 125845 - RNA, 20 nt, Artificial Sequence
  MKO10125845_B_Vmn1r67
  gRNA
gccuugauaguucucuuuac

SEQ ID NO: 125846 - RNA, 20 nt, Artificial Sequence
  MKO10125846_B_Vmn1r67
  gRNA
uuugauucucaugcaccuaa

SEQ ID NO: 125847 - RNA, 20 nt, Artificial Sequence
  MKO10125847_B_Vmn1r68
  gRNA
uacccuaugacugauuguaa

SEQ ID NO: 125848 - RNA, 20 nt, Artificial Sequence
  MKO10125848_B_Vmn1r68
  gRNA
guaaugacucauuagaacac

SEQ ID NO: 125849 - RNA, 20 nt, Artificial Sequence
  MKO10125849_B_Vmn1r68
  gRNA
ucauaggguaucuuguuaua

SEQ ID NO: 125850 - RNA, 20 nt, Artificial Sequence
  MKO10125850_B_Vmn1r69
  gRNA
gucaaaucugcaaaguacgu

SEQ ID NO: 125851 - RNA, 20 nt, Artificial Sequence
  MKO10125851_B_Vmn1r69
  gRNA
cuuacucuauguagcauuag

SEQ ID NO: 125852 - RNA, 20 nt, Artificial Sequence
  MKO10125852_B_Vmn1r69
  gRNA
ugcccaaacucaguuugacc

SEQ ID NO: 125853 - RNA, 20 nt, Artificial Sequence
  MKO10125853_B_Vmn1r6
  gRNA
gaagauccuguuacuacuga

SEQ ID NO: 125854 - RNA, 20 nt, Artificial Sequence
  MKO10125854_B_Vmn1r6
  gRNA
caaccaccucauuccucuua

SEQ ID NO: 125855 - RNA, 20 nt, Artificial Sequence
  MKO10125855_B_Vmn1r6
  gRNA
gaaaacuaccagcaucaaga

SEQ ID NO: 125856 - RNA, 20 nt, Artificial Sequence
  MKO10125856_B_Vmn1r70
  gRNA
uuuaucaucgcugacuucac

SEQ ID NO: 125857 - RNA, 20 nt, Artificial Sequence
  MKO10125857_B_Vmn1r70
  gRNA
uuucugucccagauugugcu

SEQ ID NO: 125858 - RNA, 20 nt, Artificial Sequence
  MKO10125858_B_Vmn1r70
  gRNA
aggucagguguuuaacaauu

SEQ ID NO: 125859 - RNA, 20 nt, Artificial Sequence
  MKO10125859_B_Vmn1r71
  gRNA
cuggugauacuucucucuau

SEQ ID NO: 125860 - RNA, 20 nt, Artificial Sequence
  MKO10125860_B_Vmn1r71
  gRNA
agcuacaaagccucuuaaga

SEQ ID NO: 125861 - RNA, 20 nt, Artificial Sequence
  MKO10125861_B_Vmn1r71
  gRNA
ucucucaccaccaucuuaag

SEQ ID NO: 125862 - RNA, 20 nt, Artificial Sequence
  MKO10125862_B_Vmn1r72
  gRNA
uuguuuaagcaucagcccuu

SEQ ID NO: 125863 - RNA, 20 nt, Artificial Sequence
  MKO10125863_B_Vmn1r72
  gRNA
auuuacauccagugacaucc

SEQ ID NO: 125864 - RNA, 20 nt, Artificial Sequence
  MKO10125864_B_Vmn1r72
  gRNA
aaagauuuccuggaugucac

SEQ ID NO: 125865 - RNA, 20 nt, Artificial Sequence
  MKO10125865_B_Vmn1r73
  gRNA
uuauuuguucuccuccauua

SEQ ID NO: 125866 - RNA, 20 nt, Artificial Sequence
  MKO10125866_B_Vmn1r73
  gRNA
ccacagacacuguugaauua

SEQ ID NO: 125867 - RNA, 20 nt, Artificial Sequence
  MKO10125867_B_Vmn1r73
  gRNA
caaagagcuacuaaguacau

SEQ ID NO: 125868 - RNA, 20 nt, Artificial Sequence
  MKO10125868_B_Vmn1r74
  gRNA
auacuuaccacccauagcau

SEQ ID NO: 125869 - RNA, 20 nt, Artificial Sequence
  MKO10125869_B_Vmn1r74
  gRNA
uaugcuuaucgaauaacaag

SEQ ID NO: 125870 - RNA, 20 nt, Artificial Sequence
  MKO10125870_B_Vmn1r74
  gRNA
ccacagacacugucaaauua

SEQ ID NO: 125871 - RNA, 20 nt, Artificial Sequence
  MKO10125871_B_Vmn1r75
  gRNA
ccacaaucugacauugcccg

SEQ ID NO: 125872 - RNA, 20 nt, Artificial Sequence
  MKO10125872_B_Vmn1r75
  gRNA
gguugucaagaugaccacua

SEQ ID NO: 125873 - RNA, 20 nt, Artificial Sequence
  MKO10125873_B_Vmn1r75
  gRNA
aauucccauugcaaaaugcc

SEQ ID NO: 125874 - RNA, 20 nt, Artificial Sequence
  MKO10125874_B_Vmn1r76
  gRNA
aaguuaucucuuacaaaagc

SEQ ID NO: 125875 - RNA, 20 nt, Artificial Sequence
  MKO10125875_B_Vmn1r76
  gRNA
ugauuuaugguucuuguuca

SEQ ID NO: 125876 - RNA, 20 nt, Artificial Sequence
  MKO10125876_B_Vmn1r76
  gRNA
cugugucugggucucauggc

SEQ ID NO: 125877 - RNA, 20 nt, Artificial Sequence
  MKO10125877_B_Vmn1r77
  gRNA
ucaucuuaagagacauucca

SEQ ID NO: 125878 - RNA, 20 nt, Artificial Sequence
  MKO10125878_B_Vmn1r77
  gRNA
uggacauacaucuuguuauu

SEQ ID NO: 125879 - RNA, 20 nt, Artificial Sequence
  MKO10125879_B_Vmn1r77
  gRNA
caaauauacacagaaagaug

SEQ ID NO: 125880 - RNA, 20 nt, Artificial Sequence
  MKO10125880_B_Vmn1r78
  gRNA
cagagcaguugccacauuuc

SEQ ID NO: 125881 - RNA, 20 nt, Artificial Sequence
  MKO10125881_B_Vmn1r78
  gRNA
uuggcucaugcaauauuuga

SEQ ID NO: 125882 - RNA, 20 nt, Artificial Sequence
  MKO10125882_B_Vmn1r78
  gRNA
caaucagccccagcaacacc

SEQ ID NO: 125883 - RNA, 20 nt, Artificial Sequence
  MKO10125883_B_Vmn1r79
  gRNA
ugggacugauggugauugcu

SEQ ID NO: 125884 - RNA, 20 nt, Artificial Sequence
  MKO10125884_B_Vmn1r79
  gRNA
aguuaucucuuaccuaagca

SEQ ID NO: 125885 - RNA, 20 nt, Artificial Sequence
  MKO10125885_B_Vmn1r79
  gRNA
auaggaaugaaaauggaucc

SEQ ID NO: 125886 - RNA, 20 nt, Artificial Sequence
  MKO10125886_B_Vmn1r7
  gRNA
cuuucuuuguuguccuauac

SEQ ID NO: 125887 - RNA, 20 nt, Artificial Sequence
  MKO10125887_B_Vmn1r7
  gRNA
aaccaccauuaugugaacaa

SEQ ID NO: 125888 - RNA, 20 nt, Artificial Sequence
  MKO10125888_B_Vmn1r7
  gRNA
cauuuaccucagaaauguua

SEQ ID NO: 125889 - RNA, 20 nt, Artificial Sequence
  MKO10125889_B_Vmn1r80
  gRNA
uuaaaaaaucuugagcccug

SEQ ID NO: 125890 - RNA, 20 nt, Artificial Sequence
  MKO10125890_B_Vmn1r80
  gRNA
gagaaaguuauuaugaaagc

SEQ ID NO: 125891 - RNA, 20 nt, Artificial Sequence
  MKO10125891_B_Vmn1r80
  gRNA
caugaaaacuauccucaucc

SEQ ID NO: 125892 - RNA, 20 nt, Artificial Sequence
  MKO10125892_B_Vmn1r81
  gRNA
agugcaguugccagauugcu

SEQ ID NO: 125893 - RNA, 20 nt, Artificial Sequence
  MKO10125893_B_Vmn1r81
  gRNA
ccuguaugcaaugugccuac

SEQ ID NO: 125894 - RNA, 20 nt, Artificial Sequence
  MKO10125894_B_Vmn1r81
  gRNA
uguauauuuaccgaguaaca

SEQ ID NO: 125895 - RNA, 20 nt, Artificial Sequence
  MKO10125895_B_Vmn1r82
  gRNA
ucagccuuauuugguaaucc

SEQ ID NO: 125896 - RNA, 20 nt, Artificial Sequence
  MKO10125896_B_Vmn1r82
  gRNA
ucagcucaagcaccaccaaa

SEQ ID NO: 125897 - RNA, 20 nt, Artificial Sequence
  MKO10125897_B_Vmn1r82
  gRNA
uuguauauagugaaaccccc

SEQ ID NO: 125898 - RNA, 20 nt, Artificial Sequence
  MKO10125898_B_Vmn1r83
  gRNA
cacagagccgugaaguacgu

SEQ ID NO: 125899 - RNA, 20 nt, Artificial Sequence
  MKO10125899_B_Vmn1r83
  gRNA
uguauauuuaccgaauagug

SEQ ID NO: 125900 - RNA, 20 nt, Artificial Sequence
  MKO10125900_B_Vmn1r83
  gRNA
gagacaucccccucacuauu

SEQ ID NO: 125901 - RNA, 20 nt, Artificial Sequence
  MKO10125901_B_Vmn1r84
  gRNA
uuauggugaagauucucuau

SEQ ID NO: 125902 - RNA, 20 nt, Artificial Sequence
  MKO10125902_B_Vmn1r84
  gRNA
cuuuacccugcuguaguaga

SEQ ID NO: 125903 - RNA, 20 nt, Artificial Sequence
  MKO10125903_B_Vmn1r84
  gRNA
acugggguugcaguaucucc

SEQ ID NO: 125904 - RNA, 20 nt, Artificial Sequence
  MKO10125904_B_Vmn1r85
  gRNA
uguauaucuauagagucucc

SEQ ID NO: 125905 - RNA, 20 nt, Artificial Sequence
  MKO10125905_B_Vmn1r85
  gRNA
acuuaaucacccuuuaugau

SEQ ID NO: 125906 - RNA, 20 nt, Artificial Sequence
  MKO10125906_B_Vmn1r85
  gRNA
ccuggauugggguacucaac

SEQ ID NO: 125907 - RNA, 20 nt, Artificial Sequence
  MKO10125907_B_Vmn1r86
  gRNA
aaaacaaauaacagucacgu

SEQ ID NO: 125908 - RNA, 20 nt, Artificial Sequence
  MKO10125908_B_Vmn1r86
  gRNA
cacucaugaucucaucuaug

SEQ ID NO: 125909 - RNA, 20 nt, Artificial Sequence
  MKO10125909_B_Vmn1r86
  gRNA
ggagaugcugggcugucuug

SEQ ID NO: 125910 - RNA, 20 nt, Artificial Sequence
  MKO10125910_B_Vmn1r87
  gRNA
gauauacugccgaaguagcc

SEQ ID NO: 125911 - RNA, 20 nt, Artificial Sequence
  MKO10125911_B_Vmn1r87
  gRNA
acccaagagcaacccaguau

SEQ ID NO: 125912 - RNA, 20 nt, Artificial Sequence
  MKO10125912_B_Vmn1r87
  gRNA
ucaugagauccuuugcaguc

SEQ ID NO: 125913 - RNA, 20 nt, Artificial Sequence
  MKO10125913_B_Vmn1r88
  gRNA
gauaaguagauuaauaaucc

SEQ ID NO: 125914 - RNA, 20 nt, Artificial Sequence
  MKO10125914_B_Vmn1r88
  gRNA
auaauccuacguuugucucc

SEQ ID NO: 125915 - RNA, 20 nt, Artificial Sequence
  MKO10125915_B_Vmn1r88
  gRNA
ggagaugcugggcuaacuug

SEQ ID NO: 125916 - RNA, 20 nt, Artificial Sequence
  MKO10125916_B_Vmn1r89
  gRNA
cuuauuaaccuagucaucua

SEQ ID NO: 125917 - RNA, 20 nt, Artificial Sequence
  MKO10125917_B_Vmn1r89
  gRNA
gcauuaauugacuccaaucu

SEQ ID NO: 125918 - RNA, 20 nt, Artificial Sequence
  MKO10125918_B_Vmn1r89
  gRNA
cugaauauccauugccaaca

SEQ ID NO: 125919 - RNA, 20 nt, Artificial Sequence
  MKO10125919_B_Vmn1r8
  gRNA
uauuguaaaaauaagucccc

SEQ ID NO: 125920 - RNA, 20 nt, Artificial Sequence
  MKO10125920_B_Vmn1r8
  gRNA
uacccaugaaccacaucacc

SEQ ID NO: 125921 - RNA, 20 nt, Artificial Sequence
  MKO10125921_B_Vmn1r8
  gRNA
auuugucuuucaguacuaac

SEQ ID NO: 125922 - RNA, 20 nt, Artificial Sequence
  MKO10125922_B_Vmn1r90
  gRNA
ccacaagcauagcaaugcua

SEQ ID NO: 125923 - RNA, 20 nt, Artificial Sequence
  MKO10125923_B_Vmn1r90
  gRNA
ccauagcauugcuaugcuug

SEQ ID NO: 125924 - RNA, 20 nt, Artificial Sequence
  MKO10125924_B_Vmn1r90
  gRNA
guuaguacaaaucacuuguu

SEQ ID NO: 125925 - RNA, 20 nt, Artificial Sequence
  MKO10125925_B_Vmn1r91
  gRNA
ucucugaagaucaacacuaa

SEQ ID NO: 125926 - RNA, 20 nt, Artificial Sequence
  MKO10125926_B_Vmn1r91
  gRNA
gauauuuccaaacaacauga

SEQ ID NO: 125927 - RNA, 20 nt, Artificial Sequence
  MKO10125927_B_Vmn1r91
  gRNA
ugggguccugauugggagug

SEQ ID NO: 125928 - RNA, 20 nt, Artificial Sequence
  MKO10125928_B_Vmn1r93
  gRNA
guuauucuuguuacgguugu

SEQ ID NO: 125929 - RNA, 20 nt, Artificial Sequence
  MKO10125929_B_Vmn1r93
  gRNA
ucuuacagugaauccagaag

SEQ ID NO: 125930 - RNA, 20 nt, Artificial Sequence
  MKO10125930_B_Vmn1r93
  gRNA
uaacauccacauuccaauua

SEQ ID NO: 125931 - RNA, 20 nt, Artificial Sequence
  MKO10125931_B_Vmn1r94
  gRNA
uaacauccacauuccaauua

SEQ ID NO: 125932 - RNA, 20 nt, Artificial Sequence
  MKO10125932_B_Vmn1r94
  gRNA
gccuacaaugaauccagaag

SEQ ID NO: 125933 - RNA, 20 nt, Artificial Sequence
  MKO10125933_B_Vmn1r94
  gRNA
aacuuguucuguuccacuuc

SEQ ID NO: 125934 - RNA, 20 nt, Artificial Sequence
  MKO10125934_B_Vmn1r95
  gRNA
auuauuccugcuacaguugu

SEQ ID NO: 125935 - RNA, 20 nt, Artificial Sequence
  MKO10125935_B_Vmn1r95
  gRNA
guguuauugucuguuaucug

SEQ ID NO: 125936 - RNA, 20 nt, Artificial Sequence
  MKO10125936_B_Vmn1r95
  gRNA
uaacauccacauuccaauua

SEQ ID NO: 125937 - RNA, 20 nt, Artificial Sequence
  MKO10125937_B_Vmn1r9
  gRNA
cauucaccucagacaugaua

SEQ ID NO: 125938 - RNA, 20 nt, Artificial Sequence
  MKO10125938_B_Vmn1r9
  gRNA
gaaagacaccagcagcaaga

SEQ ID NO: 125939 - RNA, 20 nt, Artificial Sequence
  MKO10125939_B_Vmn1r9
  gRNA
ucauaaacuucugaacaguc

SEQ ID NO: 125940 - RNA, 20 nt, Artificial Sequence
  MKO10125940_B_Vmn2r100
  gRNA
ugagacuucagcaacuucaa

SEQ ID NO: 125941 - RNA, 20 nt, Artificial Sequence
  MKO10125941_B_Vmn2r100
  gRNA
uaaaaccuuucuuuccacau

SEQ ID NO: 125942 - RNA, 20 nt, Artificial Sequence
  MKO10125942_B_Vmn2r100
  gRNA
cacagcccauguggaaagaa

SEQ ID NO: 125943 - RNA, 20 nt, Artificial Sequence
  MKO10125943_B_Vmn2r101
  gRNA
guugaagcaaugucccuauc

SEQ ID NO: 125944 - RNA, 20 nt, Artificial Sequence
  MKO10125944_B_Vmn2r101
  gRNA
cuuucaguucaaugucuuuc

SEQ ID NO: 125945 - RNA, 20 nt, Artificial Sequence
  MKO10125945_B_Vmn2r101
  gRNA
ugcucugcaauuugcaauug

SEQ ID NO: 125946 - RNA, 20 nt, Artificial Sequence
  MKO10125946_B_Vmn2r102
  gRNA
cuguuacccaacacaucucu

SEQ ID NO: 125947 - RNA, 20 nt, Artificial Sequence
  MKO10125947_B_Vmn2r102
  gRNA
aaagauaacuguugacccug

SEQ ID NO: 125948 - RNA, 20 nt, Artificial Sequence
  MKO10125948_B_Vmn2r102
  gRNA
cccaccucugaaaauauuuc

SEQ ID NO: 125949 - RNA, 20 nt, Artificial Sequence
  MKO10125949_B_Vmn2r103
  gRNA
gaaaucucguugucuccaca

SEQ ID NO: 125950 - RNA, 20 nt, Artificial Sequence
  MKO10125950_B_Vmn2r103
  gRNA
cuauuacccaacacaucucu

SEQ ID NO: 125951 - RNA, 20 nt, Artificial Sequence
  MKO10125951_B_Vmn2r103
  gRNA
auaaagacaacucuugaccc

SEQ ID NO: 125952 - RNA, 20 nt, Artificial Sequence
  MKO10125952_B_Vmn2r104
  gRNA
uaucauugcucucuuuacau

SEQ ID NO: 125953 - RNA, 20 nt, Artificial Sequence
  MKO10125953_B_Vmn2r104
  gRNA
cucauuagauaucucauugu

SEQ ID NO: 125954 - RNA, 20 nt, Artificial Sequence
  MKO10125954_B_Vmn2r104
  gRNA
ucagcuaaacacauuccuga

SEQ ID NO: 125955 - RNA, 20 nt, Artificial Sequence
  MKO10125955_B_Vmn2r105
  gRNA
uaacugagcagaucauccaa

SEQ ID NO: 125956 - RNA, 20 nt, Artificial Sequence
  MKO10125956_B_Vmn2r105
  gRNA
uauucagucaugugacauaa

SEQ ID NO: 125957 - RNA, 20 nt, Artificial Sequence
  MKO10125957_B_Vmn2r105
  gRNA
uggaccauaucugcacaaau

SEQ ID NO: 125958 - RNA, 20 nt, Artificial Sequence
  MKO10125958_B_Vmn2r106
  gRNA
gaguguccuucucagugaau

SEQ ID NO: 125959 - RNA, 20 nt, Artificial Sequence
  MKO10125959_B_Vmn2r106
  gRNA
cucacaucuaaaaauccuuc

SEQ ID NO: 125960 - RNA, 20 nt, Artificial Sequence
  MKO10125960_B_Vmn2r106
  gRNA
ucagcuuaacacuuucuuaa

SEQ ID NO: 125961 - RNA, 20 nt, Artificial Sequence
  MKO10125961_B_Vmn2r107
  gRNA
gauccuuucuugagugaccg

SEQ ID NO: 125962 - RNA, 20 nt, Artificial Sequence
  MKO10125962_B_Vmn2r107
  gRNA
gaaaguaacccuggagaaua

SEQ ID NO: 125963 - RNA, 20 nt, Artificial Sequence
  MKO10125963_B_Vmn2r107
  gRNA
cacuuaugaauacuguuauu

SEQ ID NO: 125964 - RNA, 20 nt, Artificial Sequence
  MKO10125964_B_Vmn2r108
  gRNA
gagagagacaauaugaguuu

SEQ ID NO: 125965 - RNA, 20 nt, Artificial Sequence
  MKO10125965_B_Vmn2r108
  gRNA
caaugucagauucauugaga

SEQ ID NO: 125966 - RNA, 20 nt, Artificial Sequence
  MKO10125966_B_Vmn2r108
  gRNA
guucagauaaagacaacugu

SEQ ID NO: 125967 - RNA, 20 nt, Artificial Sequence
  MKO10125967_B_Vmn2r109
  gRNA
accaaagggucuuggacgaa

SEQ ID NO: 125968 - RNA, 20 nt, Artificial Sequence
  MKO10125968_B_Vmn2r109
  gRNA
cucgggagcauuugcugaga

SEQ ID NO: 125969 - RNA, 20 nt, Artificial Sequence
  MKO10125969_B_Vmn2r109
  gRNA
ugcaguaagagcugugagcc

SEQ ID NO: 125970 - RNA, 20 nt, Artificial Sequence
  MKO10125970_B_Vmn2r10
  gRNA
auuuaaguauaaggagaauc

SEQ ID NO: 125971 - RNA, 20 nt, Artificial Sequence
  MKO10125971_B_Vmn2r10
  gRNA
acccacugaugauccuccug

SEQ ID NO: 125972 - RNA, 20 nt, Artificial Sequence
  MKO10125972_B_Vmn2r10
  gRNA
ugucuuccaugcugaagucc

SEQ ID NO: 125973 - RNA, 20 nt, Artificial Sequence
  MKO10125973_B_Vmn2r110
  gRNA
caauagcaaacaccaaagcc

SEQ ID NO: 125974 - RNA, 20 nt, Artificial Sequence
  MKO10125974_B_Vmn2r110
  gRNA
uaagaacuaccaguauaucc

SEQ ID NO: 125975 - RNA, 20 nt, Artificial Sequence
  MKO10125975_B_Vmn2r110
  gRNA
cucucucauuaauguccuuc

SEQ ID NO: 125976 - RNA, 20 nt, Artificial Sequence
  MKO10125976_B_Vmn2r111
  gRNA
uaucugaaguuauaauaaag

SEQ ID NO: 125977 - RNA, 20 nt, Artificial Sequence
  MKO10125977_B_Vmn2r111
  gRNA
agcucuaccagauagucauc

SEQ ID NO: 125978 - RNA, 20 nt, Artificial Sequence
  MKO10125978_B_Vmn2r111
  gRNA
uuuagucccuaucuuccaaa

SEQ ID NO: 125979 - RNA, 20 nt, Artificial Sequence
  MKO10125979_B_Vmn2r112
  gRNA
gaauaacuucaugucugagc

SEQ ID NO: 125980 - RNA, 20 nt, Artificial Sequence
  MKO10125980_B_Vmn2r112
  gRNA
auagugaauaugaaccaaaa

SEQ ID NO: 125981 - RNA, 20 nt, Artificial Sequence
  MKO10125981_B_Vmn2r112
  gRNA
auuuaucugaaguuaugaua

SEQ ID NO: 125982 - RNA, 20 nt, Artificial Sequence
  MKO10125982_B_Vmn2r113
  gRNA
uuguucuuucacauugucag

SEQ ID NO: 125983 - RNA, 20 nt, Artificial Sequence
  MKO10125983_B_Vmn2r113
  gRNA
uaguuccuucaucuuacuua

SEQ ID NO: 125984 - RNA, 20 nt, Artificial Sequence
  MKO10125984_B_Vmn2r113
  gRNA
cuguugaccauuuauaauau

SEQ ID NO: 125985 - RNA, 20 nt, Artificial Sequence
  MKO10125985_B_Vmn2r114
  gRNA
cuccuauuugagaagaguca

SEQ ID NO: 125986 - RNA, 20 nt, Artificial Sequence
  MKO10125986_B_Vmn2r114
  gRNA
aaagacccaguucacuaauc

SEQ ID NO: 125987 - RNA, 20 nt, Artificial Sequence
  MKO10125987_B_Vmn2r114
  gRNA
uggaucaagaaaauucagga

SEQ ID NO: 125988 - RNA, 20 nt, Artificial Sequence
  MKO10125988_B_Vmn2r115
  gRNA
ucucaguacacaauuguguc

SEQ ID NO: 125989 - RNA, 20 nt, Artificial Sequence
  MKO10125989_B_Vmn2r115
  gRNA
acccaguucauuaauccugu

SEQ ID NO: 125990 - RNA, 20 nt, Artificial Sequence
  MKO10125990_B_Vmn2r115
  gRNA
cuuggauuuaaaguuaaaau

SEQ ID NO: 125991 - RNA, 20 nt, Artificial Sequence
  MKO10125991_B_Vmn2r116
  gRNA
uggaucuagaaaauuucgga

SEQ ID NO: 125992 - RNA, 20 nt, Artificial Sequence
  MKO10125992_B_Vmn2r116
  gRNA
guaauaacucucuucaauaa

SEQ ID NO: 125993 - RNA, 20 nt, Artificial Sequence
  MKO10125993_B_Vmn2r116
  gRNA
aaguuccauaaguaauauga

SEQ ID NO: 125994 - RNA, 20 nt, Artificial Sequence
  MKO10125994_B_Vmn2r117
  gRNA
auauuuacucuguccccaac

SEQ ID NO: 125995 - RNA, 20 nt, Artificial Sequence
  MKO10125995_B_Vmn2r117
  gRNA
aaagcuugauaaucugccca

SEQ ID NO: 125996 - RNA, 20 nt, Artificial Sequence
  MKO10125996_B_Vmn2r117
  gRNA
uaguuccuucagauuacuua

SEQ ID NO: 125997 - RNA, 20 nt, Artificial Sequence
  MKO10125997_B_Vmn2r118
  gRNA
gcaugugaaauagcacuuac

SEQ ID NO: 125998 - RNA, 20 nt, Artificial Sequence
  MKO10125998_B_Vmn2r118
  gRNA
aguaugagaucuauaugauu

SEQ ID NO: 125999 - RNA, 20 nt, Artificial Sequence
  MKO10125999_B_Vmn2r118
  gRNA
ucuuuagauccaugcauucu

SEQ ID NO: 126000 - RNA, 20 nt, Artificial Sequence
  MKO10126000_B_Vmn2r11
  gRNA
acuaugauuguuaggauauu

SEQ ID NO: 126001 - RNA, 20 nt, Artificial Sequence
  MKO10126001_B_Vmn2r11
  gRNA
uaacaaucauaguccucaug

SEQ ID NO: 126002 - RNA, 20 nt, Artificial Sequence
  MKO10126002_B_Vmn2r11
  gRNA
uguaguaugacaugcacugc

SEQ ID NO: 126003 - RNA, 20 nt, Artificial Sequence
  MKO10126003_B_Vmn2r120
  gRNA
guggggcaccaaagacaaac

SEQ ID NO: 126004 - RNA, 20 nt, Artificial Sequence
  MKO10126004_B_Vmn2r120
  gRNA
aaauuaauagcaguagugac

SEQ ID NO: 126005 - RNA, 20 nt, Artificial Sequence
  MKO10126005_B_Vmn2r120
  gRNA
auauuuguagagaccuagaa

SEQ ID NO: 126006 - RNA, 20 nt, Artificial Sequence
  MKO10126006_B_Vmn2r121
  gRNA
auugcauucuucgaugccac

SEQ ID NO: 126007 - RNA, 20 nt, Artificial Sequence
  MKO10126007_B_Vmn2r121
  gRNA
acuucauauaugugaugacu

SEQ ID NO: 126008 - RNA, 20 nt, Artificial Sequence
  MKO10126008_B_Vmn2r121
  gRNA
uccauccucuguauguagug

SEQ ID NO: 126009 - RNA, 20 nt, Artificial Sequence
  MKO10126009_B_Vmn2r122
  gRNA
aauuguaaccuucaucgcuc

SEQ ID NO: 126010 - RNA, 20 nt, Artificial Sequence
  MKO10126010_B_Vmn2r122
  gRNA
uuagaugauucaugugccac

SEQ ID NO: 126011 - RNA, 20 nt, Artificial Sequence
  MKO10126011_B_Vmn2r122
  gRNA
agauauuucucauacuauuu

SEQ ID NO: 126012 - RNA, 20 nt, Artificial Sequence
  MKO10126012_B_Vmn2r123
  gRNA
ccuugauguuucacuuuaga

SEQ ID NO: 126013 - RNA, 20 nt, Artificial Sequence
  MKO10126013_B_Vmn2r123
  gRNA
acccacugauguuccucccu

SEQ ID NO: 126014 - RNA, 20 nt, Artificial Sequence
  MKO10126014_B_Vmn2r123
  gRNA
ugucuuccuugaugaaaacc

SEQ ID NO: 126015 - RNA, 20 nt, Artificial Sequence
  MKO10126015_B_Vmn2r124
  gRNA
uccugaaagacauugaagug

SEQ ID NO: 126016 - RNA, 20 nt, Artificial Sequence
  MKO10126016_B_Vmn2r124
  gRNA
cucuugauaaugcuguuauu

SEQ ID NO: 126017 - RNA, 20 nt, Artificial Sequence
  MKO10126017_B_Vmn2r124
  gRNA
auagcagggugagaauauac

SEQ ID NO: 126018 - RNA, 20 nt, Artificial Sequence
  MKO10126018_B_Vmn2r12
  gRNA
acuauuugccuuguuaccaa

SEQ ID NO: 126019 - RNA, 20 nt, Artificial Sequence
  MKO10126019_B_Vmn2r12
  gRNA
uucacccucgauuucuucca

SEQ ID NO: 126020 - RNA, 20 nt, Artificial Sequence
  MKO10126020_B_Vmn2r12
  gRNA
acaacuucauauauaugauu

SEQ ID NO: 126021 - RNA, 20 nt, Artificial Sequence
  MKO10126021_B_Vmn2r13
  gRNA
uuuagaagguggauacauuu

SEQ ID NO: 126022 - RNA, 20 nt, Artificial Sequence
  MKO10126022_B_Vmn2r13
  gRNA
agaguauuuacuaacccugu

SEQ ID NO: 126023 - RNA, 20 nt, Artificial Sequence
  MKO10126023_B_Vmn2r13
  gRNA
acccacugauguuccuccug

SEQ ID NO: 126024 - RNA, 20 nt, Artificial Sequence
  MKO10126024_B_Vmn2r14
  gRNA
aaauauccuggauuucagug

SEQ ID NO: 126025 - RNA, 20 nt, Artificial Sequence
  MKO10126025_B_Vmn2r14
  gRNA
ugucuuccacacugaaaucc

SEQ ID NO: 126026 - RNA, 20 nt, Artificial Sequence
  MKO10126026_B_Vmn2r14
  gRNA
cagcaaacagaagaacccaa

SEQ ID NO: 126027 - RNA, 20 nt, Artificial Sequence
  MKO10126027_B_Vmn2r15
  gRNA
caguuccgugaaagaaauca

SEQ ID NO: 126028 - RNA, 20 nt, Artificial Sequence
  MKO10126028_B_Vmn2r15
  gRNA
ugucuuccaugcugaaaucc

SEQ ID NO: 126029 - RNA, 20 nt, Artificial Sequence
  MKO10126029_B_Vmn2r15
  gRNA
acccacugacgauccuccug

SEQ ID NO: 126030 - RNA, 20 nt, Artificial Sequence
  MKO10126030_B_Vmn2r16
  gRNA
acauguaacauacaaauuac

SEQ ID NO: 126031 - RNA, 20 nt, Artificial Sequence
  MKO10126031_B_Vmn2r16
  gRNA
agauacauugggauauauag

SEQ ID NO: 126032 - RNA, 20 nt, Artificial Sequence
  MKO10126032_B_Vmn2r16
  gRNA
gugggcuacaggaggagcuu

SEQ ID NO: 126033 - RNA, 20 nt, Artificial Sequence
  MKO10126033_B_Vmn2r17
  gRNA
auauaacaauuucaccauug

SEQ ID NO: 126034 - RNA, 20 nt, Artificial Sequence
  MKO10126034_B_Vmn2r17
  gRNA
gauacauauaccugucucau

SEQ ID NO: 126035 - RNA, 20 nt, Artificial Sequence
  MKO10126035_B_Vmn2r17
  gRNA
gugggccacaggaggaacgu

SEQ ID NO: 126036 - RNA, 20 nt, Artificial Sequence
  MKO10126036_B_Vmn2r18
  gRNA
guacaguauacaucuggugu

SEQ ID NO: 126037 - RNA, 20 nt, Artificial Sequence
  MKO10126037_B_Vmn2r18
  gRNA
guaaaugugaacauacucua

SEQ ID NO: 126038 - RNA, 20 nt, Artificial Sequence
  MKO10126038_B_Vmn2r18
  gRNA
cauuucaaguuucucuuauc

SEQ ID NO: 126039 - RNA, 20 nt, Artificial Sequence
  MKO10126039_B_Vmn2r19
  gRNA
acuuucugccaauacaaaua

SEQ ID NO: 126040 - RNA, 20 nt, Artificial Sequence
  MKO10126040_B_Vmn2r19
  gRNA
gauugucugccaugugcaga

SEQ ID NO: 126041 - RNA, 20 nt, Artificial Sequence
  MKO10126041_B_Vmn2r19
  gRNA
uguugacuaucuugagauga

SEQ ID NO: 126042 - RNA, 20 nt, Artificial Sequence
  MKO10126042_B_Vmn2r1
  gRNA
gacacuaugauguccuaaac

SEQ ID NO: 126043 - RNA, 20 nt, Artificial Sequence
  MKO10126043_B_Vmn2r1
  gRNA
caaaauauuguagaauucgu

SEQ ID NO: 126044 - RNA, 20 nt, Artificial Sequence
  MKO10126044_B_Vmn2r1
  gRNA
cucagacuggagguuaucac

SEQ ID NO: 126045 - RNA, 20 nt, Artificial Sequence
  MKO10126045_B_Vmn2r20
  gRNA
cauuguagagacuuagaacu

SEQ ID NO: 126046 - RNA, 20 nt, Artificial Sequence
  MKO10126046_B_Vmn2r20
  gRNA
auagcuaccuuccaagggag

SEQ ID NO: 126047 - RNA, 20 nt, Artificial Sequence
  MKO10126047_B_Vmn2r20
  gRNA
auuaucauuuacugaucgca

SEQ ID NO: 126048 - RNA, 20 nt, Artificial Sequence
  MKO10126048_B_Vmn2r21
  gRNA
auuaucauuuacugaucgca

SEQ ID NO: 126049 - RNA, 20 nt, Artificial Sequence
  MKO10126049_B_Vmn2r21
  gRNA
gcuccauccauucuugcaaa

SEQ ID NO: 126050 - RNA, 20 nt, Artificial Sequence
  MKO10126050_B_Vmn2r21
  gRNA
uuguaccacucugcagagac

SEQ ID NO: 126051 - RNA, 20 nt, Artificial Sequence
  MKO10126051_B_Vmn2r22
  gRNA
caauaugugcugauaguguu

SEQ ID NO: 126052 - RNA, 20 nt, Artificial Sequence
  MKO10126052_B_Vmn2r22
  gRNA
gcuccauccauucuugcaaa

SEQ ID NO: 126053 - RNA, 20 nt, Artificial Sequence
  MKO10126053_B_Vmn2r22
  gRNA
uuguaccacucugcagagac

SEQ ID NO: 126054 - RNA, 20 nt, Artificial Sequence
  MKO10126054_B_Vmn2r23
  gRNA
uaaugaagcaagcaugaaua

SEQ ID NO: 126055 - RNA, 20 nt, Artificial Sequence
  MKO10126055_B_Vmn2r23
  gRNA
aguugacccuucuguaagaa

SEQ ID NO: 126056 - RNA, 20 nt, Artificial Sequence
  MKO10126056_B_Vmn2r23
  gRNA
caauuccuaacuacaguugu

SEQ ID NO: 126057 - RNA, 20 nt, Artificial Sequence
  MKO10126057_B_Vmn2r24
  gRNA
aagucucuacaacauuccac

SEQ ID NO: 126058 - RNA, 20 nt, Artificial Sequence
  MKO10126058_B_Vmn2r24
  gRNA
uucuuacaaaacagccaacu

SEQ ID NO: 126059 - RNA, 20 nt, Artificial Sequence
  MKO10126059_B_Vmn2r24
  gRNA
cuuugacuacaagcagauaa

SEQ ID NO: 126060 - RNA, 20 nt, Artificial Sequence
  MKO10126060_B_Vmn2r25
  gRNA
aguugggagaagcaccaaug

SEQ ID NO: 126061 - RNA, 20 nt, Artificial Sequence
  MKO10126061_B_Vmn2r25
  gRNA
uauucuauucaauaaguccc

SEQ ID NO: 126062 - RNA, 20 nt, Artificial Sequence
  MKO10126062_B_Vmn2r25
  gRNA
aagucucuacaaagucccac

SEQ ID NO: 126063 - RNA, 20 nt, Artificial Sequence
  MKO10126063_B_Vmn2r26
  gRNA
uauucuauucaacaaguccc

SEQ ID NO: 126064 - RNA, 20 nt, Artificial Sequence
  MKO10126064_B_Vmn2r26
  gRNA
gacuuguugaauagaauauu

SEQ ID NO: 126065 - RNA, 20 nt, Artificial Sequence
  MKO10126065_B_Vmn2r26
  gRNA
acuugggagaagcaccaaug

SEQ ID NO: 126066 - RNA, 20 nt, Artificial Sequence
  MKO10126066_B_Vmn2r27
  gRNA
uuagcaaaauaccugaugau

SEQ ID NO: 126067 - RNA, 20 nt, Artificial Sequence
  MKO10126067_B_Vmn2r27
  gRNA
caacaccauacaacuuucca

SEQ ID NO: 126068 - RNA, 20 nt, Artificial Sequence
  MKO10126068_B_Vmn2r27
  gRNA
aauaugugcugauaauguuu

SEQ ID NO: 126069 - RNA, 20 nt, Artificial Sequence
  MKO10126069_B_Vmn2r28
  gRNA
uuccgggaucuucugaaucc

SEQ ID NO: 126070 - RNA, 20 nt, Artificial Sequence
  MKO10126070_B_Vmn2r28
  gRNA
uaaaaaccacaaauaugcuu

SEQ ID NO: 126071 - RNA, 20 nt, Artificial Sequence
  MKO10126071_B_Vmn2r28
  gRNA
guggagauaagaaaaugucc

SEQ ID NO: 126072 - RNA, 20 nt, Artificial Sequence
  MKO10126072_B_Vmn2r29
  gRNA
guggagauaaaaagcugucc

SEQ ID NO: 126073 - RNA, 20 nt, Artificial Sequence
  MKO10126073_B_Vmn2r29
  gRNA
uagauccuucagcuuaccua

SEQ ID NO: 126074 - RNA, 20 nt, Artificial Sequence
  MKO10126074_B_Vmn2r29
  gRNA
uaccuucaagcagugagaac

SEQ ID NO: 126075 - RNA, 20 nt, Artificial Sequence
  MKO10126075_B_Vmn2r2
  gRNA
gacccgaagggggauucgac

SEQ ID NO: 126076 - RNA, 20 nt, Artificial Sequence
  MKO10126076_B_Vmn2r2
  gRNA
ccagugccucuccauaagca

SEQ ID NO: 126077 - RNA, 20 nt, Artificial Sequence
  MKO10126077_B_Vmn2r2
  gRNA
uugaaaauuauuacacauga

SEQ ID NO: 126078 - RNA, 20 nt, Artificial Sequence
  MKO10126078_B_Vmn2r30
  gRNA
uaccuucaagcagugagaac

SEQ ID NO: 126079 - RNA, 20 nt, Artificial Sequence
  MKO10126079_B_Vmn2r30
  gRNA
agguaaacuccuuucuaaga

SEQ ID NO: 126080 - RNA, 20 nt, Artificial Sequence
  MKO10126080_B_Vmn2r30
  gRNA
acuuaccuuucuucuuccug

SEQ ID NO: 126081 - RNA, 20 nt, Artificial Sequence
  MKO10126081_B_Vmn2r31
  gRNA
uagauccuucagcuuaccua

SEQ ID NO: 126082 - RNA, 20 nt, Artificial Sequence
  MKO10126082_B_Vmn2r31
  gRNA
auccacuucacuaauccucu

SEQ ID NO: 126083 - RNA, 20 nt, Artificial Sequence
  MKO10126083_B_Vmn2r31
  gRNA
acccaccuuucuacuuccug

SEQ ID NO: 126084 - RNA, 20 nt, Artificial Sequence
  MKO10126084_B_Vmn2r32
  gRNA
uagauccuucagcuuuccua

SEQ ID NO: 126085 - RNA, 20 nt, Artificial Sequence
  MKO10126085_B_Vmn2r32
  gRNA
agguaaacuccuuucuaaga

SEQ ID NO: 126086 - RNA, 20 nt, Artificial Sequence
  MKO10126086_B_Vmn2r32
  gRNA
ucuuaccuuucuucuuccug

SEQ ID NO: 126087 - RNA, 20 nt, Artificial Sequence
  MKO10126087_B_Vmn2r33
  gRNA
guggagauaagaagcugucc

SEQ ID NO: 126088 - RNA, 20 nt, Artificial Sequence
  MKO10126088_B_Vmn2r33
  gRNA
uagauccuucagcuuaccua

SEQ ID NO: 126089 - RNA, 20 nt, Artificial Sequence
  MKO10126089_B_Vmn2r33
  gRNA
uaccuucaagcagugagaac

SEQ ID NO: 126090 - RNA, 20 nt, Artificial Sequence
  MKO10126090_B_Vmn2r34
  gRNA
aaccuaaagauaccucccaa

SEQ ID NO: 126091 - RNA, 20 nt, Artificial Sequence
  MKO10126091_B_Vmn2r34
  gRNA
agguaaacuccuuucuaaga

SEQ ID NO: 126092 - RNA, 20 nt, Artificial Sequence
  MKO10126092_B_Vmn2r34
  gRNA
acuuaccuuucuucuuccug

SEQ ID NO: 126093 - RNA, 20 nt, Artificial Sequence
  MKO10126093_B_Vmn2r35
  gRNA
uaccuucaagcagugagaac

SEQ ID NO: 126094 - RNA, 20 nt, Artificial Sequence
  MKO10126094_B_Vmn2r35
  gRNA
auccacuuuacuaauccucu

SEQ ID NO: 126095 - RNA, 20 nt, Artificial Sequence
  MKO10126095_B_Vmn2r35
  gRNA
gaaacaaagaguaauaaugc

SEQ ID NO: 126096 - RNA, 20 nt, Artificial Sequence
  MKO10126096_B_Vmn2r36
  gRNA
uaccuucaagcagugagaac

SEQ ID NO: 126097 - RNA, 20 nt, Artificial Sequence
  MKO10126097_B_Vmn2r36
  gRNA
agguaaacuccuuucuaaga

SEQ ID NO: 126098 - RNA, 20 nt, Artificial Sequence
  MKO10126098_B_Vmn2r36
  gRNA
ucuuaccuuucuucuuccug

SEQ ID NO: 126099 - RNA, 20 nt, Artificial Sequence
  MKO10126099_B_Vmn2r37
  gRNA
uaccuucaagcagugagaac

SEQ ID NO: 126100 - RNA, 20 nt, Artificial Sequence
  MKO10126100_B_Vmn2r37
  gRNA
agguaaacuccuuucuaaga

SEQ ID NO: 126101 - RNA, 20 nt, Artificial Sequence
  MKO10126101_B_Vmn2r37
  gRNA
acuuaccuuucuucuuccug

SEQ ID NO: 126102 - RNA, 20 nt, Artificial Sequence
  MKO10126102_B_Vmn2r38
  gRNA
uaccuucaagcagugagaac

SEQ ID NO: 126103 - RNA, 20 nt, Artificial Sequence
  MKO10126103_B_Vmn2r38
  gRNA
auccacuucacuaauccucu

SEQ ID NO: 126104 - RNA, 20 nt, Artificial Sequence
  MKO10126104_B_Vmn2r38
  gRNA
acccaccuuucuacuuccug

SEQ ID NO: 126105 - RNA, 20 nt, Artificial Sequence
  MKO10126105_B_Vmn2r39
  gRNA
guggagauaagaagcugucc

SEQ ID NO: 126106 - RNA, 20 nt, Artificial Sequence
  MKO10126106_B_Vmn2r39
  gRNA
uagauccuucagcuuaccua

SEQ ID NO: 126107 - RNA, 20 nt, Artificial Sequence
  MKO10126107_B_Vmn2r39
  gRNA
uaccuucaagcagugagaac

SEQ ID NO: 126108 - RNA, 20 nt, Artificial Sequence
  MKO10126108_B_Vmn2r3
  gRNA
uguuauccaucugccaauuu

SEQ ID NO: 126109 - RNA, 20 nt, Artificial Sequence
  MKO10126109_B_Vmn2r3
  gRNA
acuagcuuucauguccuaua

SEQ ID NO: 126110 - RNA, 20 nt, Artificial Sequence
  MKO10126110_B_Vmn2r3
  gRNA
uggagauauugccauuguca

SEQ ID NO: 126111 - RNA, 20 nt, Artificial Sequence
  MKO10126111_B_Vmn2r40
  gRNA
guggagauaagaagcugucc

SEQ ID NO: 126112 - RNA, 20 nt, Artificial Sequence
  MKO10126112_B_Vmn2r40
  gRNA
agguaaacuccuuucuaaga

SEQ ID NO: 126113 - RNA, 20 nt, Artificial Sequence
  MKO10126113_B_Vmn2r40
  gRNA
acuuaccuuucuucuuccug

SEQ ID NO: 126114 - RNA, 20 nt, Artificial Sequence
  MKO10126114_B_Vmn2r41
  gRNA
uaccuucaagcagugagaac

SEQ ID NO: 126115 - RNA, 20 nt, Artificial Sequence
  MKO10126115_B_Vmn2r41
  gRNA
agguaaacuccuuucuaaga

SEQ ID NO: 126116 - RNA, 20 nt, Artificial Sequence
  MKO10126116_B_Vmn2r41
  gRNA
acuuaccuuucuucuuccug

SEQ ID NO: 126117 - RNA, 20 nt, Artificial Sequence
  MKO10126117_B_Vmn2r42
  gRNA
uaccuucaagcagugagaac

SEQ ID NO: 126118 - RNA, 20 nt, Artificial Sequence
  MKO10126118_B_Vmn2r42
  gRNA
agguaaacuccuuucuaaga

SEQ ID NO: 126119 - RNA, 20 nt, Artificial Sequence
  MKO10126119_B_Vmn2r42
  gRNA
ucuuaccuuucuucuuccug

SEQ ID NO: 126120 - RNA, 20 nt, Artificial Sequence
  MKO10126120_B_Vmn2r43
  gRNA
uagauccuucagcuuaccua

SEQ ID NO: 126121 - RNA, 20 nt, Artificial Sequence
  MKO10126121_B_Vmn2r43
  gRNA
auccacuucacuaauccugu

SEQ ID NO: 126122 - RNA, 20 nt, Artificial Sequence
  MKO10126122_B_Vmn2r43
  gRNA
acucaccuuucuacuuccug

SEQ ID NO: 126123 - RNA, 20 nt, Artificial Sequence
  MKO10126123_B_Vmn2r44
  gRNA
uaccuucaagcagugagaac

SEQ ID NO: 126124 - RNA, 20 nt, Artificial Sequence
  MKO10126124_B_Vmn2r44
  gRNA
auccacuucacuaauccucu

SEQ ID NO: 126125 - RNA, 20 nt, Artificial Sequence
  MKO10126125_B_Vmn2r44
  gRNA
acccaccuuucuacuuccug

SEQ ID NO: 126126 - RNA, 20 nt, Artificial Sequence
  MKO10126126_B_Vmn2r45
  gRNA
uuugauuauaagauacucuu

SEQ ID NO: 126127 - RNA, 20 nt, Artificial Sequence
  MKO10126127_B_Vmn2r45
  gRNA
uaaaaaccacaaauaugcuu

SEQ ID NO: 126128 - RNA, 20 nt, Artificial Sequence
  MKO10126128_B_Vmn2r45
  gRNA
agguaaacuccuuucuaaga

SEQ ID NO: 126129 - RNA, 20 nt, Artificial Sequence
  MKO10126129_B_Vmn2r46
  gRNA
uaccuucaagcagugagaac

SEQ ID NO: 126130 - RNA, 20 nt, Artificial Sequence
  MKO10126130_B_Vmn2r46
  gRNA
acccacuucacuaauccucu

SEQ ID NO: 126131 - RNA, 20 nt, Artificial Sequence
  MKO10126131_B_Vmn2r46
  gRNA
acucaccuuucuacuuccug

SEQ ID NO: 126132 - RNA, 20 nt, Artificial Sequence
  MKO10126132_B_Vmn2r47
  gRNA
uaccuucaagcagugagaac

SEQ ID NO: 126133 - RNA, 20 nt, Artificial Sequence
  MKO10126133_B_Vmn2r47
  gRNA
agguaaacuccuuucuaaga

SEQ ID NO: 126134 - RNA, 20 nt, Artificial Sequence
  MKO10126134_B_Vmn2r47
  gRNA
acuuaccuuucuucuuccug

SEQ ID NO: 126135 - RNA, 20 nt, Artificial Sequence
  MKO10126135_B_Vmn2r48
  gRNA
uaccuucaagcagugagaac

SEQ ID NO: 126136 - RNA, 20 nt, Artificial Sequence
  MKO10126136_B_Vmn2r48
  gRNA
agguaaacuccuuucuaaga

SEQ ID NO: 126137 - RNA, 20 nt, Artificial Sequence
  MKO10126137_B_Vmn2r48
  gRNA
acuuaccuuucuucuuccug

SEQ ID NO: 126138 - RNA, 20 nt, Artificial Sequence
  MKO10126138_B_Vmn2r49
  gRNA
uagauccuucagcuuuccua

SEQ ID NO: 126139 - RNA, 20 nt, Artificial Sequence
  MKO10126139_B_Vmn2r49
  gRNA
uaccuucaagcagugagaac

SEQ ID NO: 126140 - RNA, 20 nt, Artificial Sequence
  MKO10126140_B_Vmn2r49
  gRNA
agguaaacuccuuucuaaga

SEQ ID NO: 126141 - RNA, 20 nt, Artificial Sequence
  MKO10126141_B_Vmn2r4
  gRNA
agaauucccuuccgaguccc

SEQ ID NO: 126142 - RNA, 20 nt, Artificial Sequence
  MKO10126142_B_Vmn2r4
  gRNA
augcacagcuuacuuaguuu

SEQ ID NO: 126143 - RNA, 20 nt, Artificial Sequence
  MKO10126143_B_Vmn2r4
  gRNA
aaaauagaacuugguaguaa

SEQ ID NO: 126144 - RNA, 20 nt, Artificial Sequence
  MKO10126144_B_Vmn2r50
  gRNA
ggggcugcaaaaaaaacagc

SEQ ID NO: 126145 - RNA, 20 nt, Artificial Sequence
  MKO10126145_B_Vmn2r50
  gRNA
uaaaaaccacaaauaugcuu

SEQ ID NO: 126146 - RNA, 20 nt, Artificial Sequence
  MKO10126146_B_Vmn2r50
  gRNA
uagauccuucagcuuaccua

SEQ ID NO: 126147 - RNA, 20 nt, Artificial Sequence
  MKO10126147_B_Vmn2r51
  gRNA
aagugaaagugucgaccgug

SEQ ID NO: 126148 - RNA, 20 nt, Artificial Sequence
  MKO10126148_B_Vmn2r51
  gRNA
gaauaugacauuguucacuu

SEQ ID NO: 126149 - RNA, 20 nt, Artificial Sequence
  MKO10126149_B_Vmn2r51
  gRNA
guggagauaagaagcuguuc

SEQ ID NO: 126150 - RNA, 20 nt, Artificial Sequence
  MKO10126150_B_Vmn2r52
  gRNA
uggauucagaagaucuugga

SEQ ID NO: 126151 - RNA, 20 nt, Artificial Sequence
  MKO10126151_B_Vmn2r52
  gRNA
gaggcugcaagugaaacagc

SEQ ID NO: 126152 - RNA, 20 nt, Artificial Sequence
  MKO10126152_B_Vmn2r52
  gRNA
aauugaaaguguucaccaug

SEQ ID NO: 126153 - RNA, 20 nt, Artificial Sequence
  MKO10126153_B_Vmn2r53
  gRNA
uacucaaugcacacaccagc

SEQ ID NO: 126154 - RNA, 20 nt, Artificial Sequence
  MKO10126154_B_Vmn2r53
  gRNA
guguacuucaagacuucuga

SEQ ID NO: 126155 - RNA, 20 nt, Artificial Sequence
  MKO10126155_B_Vmn2r53
  gRNA
cugcauuuagagaacucacu

SEQ ID NO: 126156 - RNA, 20 nt, Artificial Sequence
  MKO10126156_B_Vmn2r54
  gRNA
cauugucauccagugccaag

SEQ ID NO: 126157 - RNA, 20 nt, Artificial Sequence
  MKO10126157_B_Vmn2r54
  gRNA
acugauaggaagggacguga

SEQ ID NO: 126158 - RNA, 20 nt, Artificial Sequence
  MKO10126158_B_Vmn2r54
  gRNA
caacaguuuccucugcauuc

SEQ ID NO: 126159 - RNA, 20 nt, Artificial Sequence
  MKO10126159_B_Vmn2r55
  gRNA
aguucaccuuugauuguacg

SEQ ID NO: 126160 - RNA, 20 nt, Artificial Sequence
  MKO10126160_B_Vmn2r55
  gRNA
gcugcuccaugcccucaaaa

SEQ ID NO: 126161 - RNA, 20 nt, Artificial Sequence
  MKO10126161_B_Vmn2r55
  gRNA
aagauuauguuugaugccaa

SEQ ID NO: 126162 - RNA, 20 nt, Artificial Sequence
  MKO10126162_B_Vmn2r56
  gRNA
ggccagcucucuggccaguc

SEQ ID NO: 126163 - RNA, 20 nt, Artificial Sequence
  MKO10126163_B_Vmn2r56
  gRNA
aaacauaaucucacuuccau

SEQ ID NO: 126164 - RNA, 20 nt, Artificial Sequence
  MKO10126164_B_Vmn2r56
  gRNA
guucagccaagugcccagac

SEQ ID NO: 126165 - RNA, 20 nt, Artificial Sequence
  MKO10126165_B_Vmn2r57
  gRNA
guuggcaguucucuaaaagu

SEQ ID NO: 126166 - RNA, 20 nt, Artificial Sequence
  MKO10126166_B_Vmn2r57
  gRNA
aauuuaccugcagcacuuac

SEQ ID NO: 126167 - RNA, 20 nt, Artificial Sequence
  MKO10126167_B_Vmn2r57
  gRNA
gauguuccuguaagugcugc

SEQ ID NO: 126168 - RNA, 20 nt, Artificial Sequence
  MKO10126168_B_Vmn2r58
  gRNA
uucuguccacagucacaauu

SEQ ID NO: 126169 - RNA, 20 nt, Artificial Sequence
  MKO10126169_B_Vmn2r58
  gRNA
uaagaacuaccaauuuguuc

SEQ ID NO: 126170 - RNA, 20 nt, Artificial Sequence
  MKO10126170_B_Vmn2r58
  gRNA
cucaccauuguaaacccugu

SEQ ID NO: 126171 - RNA, 20 nt, Artificial Sequence
  MKO10126171_B_Vmn2r59
  gRNA
uucucuaucgugccuuuauu

SEQ ID NO: 126172 - RNA, 20 nt, Artificial Sequence
  MKO10126172_B_Vmn2r59
  gRNA
uucaggaaagcugccaaaga

SEQ ID NO: 126173 - RNA, 20 nt, Artificial Sequence
  MKO10126173_B_Vmn2r59
  gRNA
cuuucacugcauacagaccg

SEQ ID NO: 126174 - RNA, 20 nt, Artificial Sequence
  MKO10126174_B_Vmn2r5
  gRNA
cugaaaauuacuacccauga

SEQ ID NO: 126175 - RNA, 20 nt, Artificial Sequence
  MKO10126175_B_Vmn2r5
  gRNA
caaaacaacgaugaguucuu

SEQ ID NO: 126176 - RNA, 20 nt, Artificial Sequence
  MKO10126176_B_Vmn2r5
  gRNA
ugcacaaaacugugugcucc

SEQ ID NO: 126177 - RNA, 20 nt, Artificial Sequence
  MKO10126177_B_Vmn2r60
  gRNA
aaagagaauuaaacugagcu

SEQ ID NO: 126178 - RNA, 20 nt, Artificial Sequence
  MKO10126178_B_Vmn2r60
  gRNA
augaagcaacaaaaagacua

SEQ ID NO: 126179 - RNA, 20 nt, Artificial Sequence
  MKO10126179_B_Vmn2r60
  gRNA
gugcugagcacuuagagaau

SEQ ID NO: 126180 - RNA, 20 nt, Artificial Sequence
  MKO10126180_B_Vmn2r61
  gRNA
uccauuccuaauugugacua

SEQ ID NO: 126181 - RNA, 20 nt, Artificial Sequence
  MKO10126181_B_Vmn2r61
  gRNA
cuauucuguaagugcuccgc

SEQ ID NO: 126182 - RNA, 20 nt, Artificial Sequence
  MKO10126182_B_Vmn2r61
  gRNA
aucauauccaauaguaguau

SEQ ID NO: 126183 - RNA, 20 nt, Artificial Sequence
  MKO10126183_B_Vmn2r62
  gRNA
gaaugccauuccgucuccau

SEQ ID NO: 126184 - RNA, 20 nt, Artificial Sequence
  MKO10126184_B_Vmn2r62
  gRNA
cuacuuaaaaaccauccaag

SEQ ID NO: 126185 - RNA, 20 nt, Artificial Sequence
  MKO10126185_B_Vmn2r62
  gRNA
uuguaucauuuccucagaua

SEQ ID NO: 126186 - RNA, 20 nt, Artificial Sequence
  MKO10126186_B_Vmn2r63
  gRNA
gcaaaugugauuguuauuug

SEQ ID NO: 126187 - RNA, 20 nt, Artificial Sequence
  MKO10126187_B_Vmn2r63
  gRNA
gacguuccagugagugcugc

SEQ ID NO: 126188 - RNA, 20 nt, Artificial Sequence
  MKO10126188_B_Vmn2r63
  gRNA
cucucacugcacaaagacug

SEQ ID NO: 126189 - RNA, 20 nt, Artificial Sequence
  MKO10126189_B_Vmn2r65
  gRNA
uuggaccauagacauuagac

SEQ ID NO: 126190 - RNA, 20 nt, Artificial Sequence
  MKO10126190_B_Vmn2r65
  gRNA
acucaccugucuaaugucua

SEQ ID NO: 126191 - RNA, 20 nt, Artificial Sequence
  MKO10126191_B_Vmn2r65
  gRNA
acacaucuuugcaauaccac

SEQ ID NO: 126192 - RNA, 20 nt, Artificial Sequence
  MKO10126192_B_Vmn2r66
  gRNA
uguccuuagugguucauuuc

SEQ ID NO: 126193 - RNA, 20 nt, Artificial Sequence
  MKO10126193_B_Vmn2r66
  gRNA
uggauaaauugcucaaaacc

SEQ ID NO: 126194 - RNA, 20 nt, Artificial Sequence
  MKO10126194_B_Vmn2r66
  gRNA
ucaacaguuacuuaugucua

SEQ ID NO: 126195 - RNA, 20 nt, Artificial Sequence
  MKO10126195_B_Vmn2r67
  gRNA
uaaaaccuuacuugucaugu

SEQ ID NO: 126196 - RNA, 20 nt, Artificial Sequence
  MKO10126196_B_Vmn2r67
  gRNA
aaaaaauaugaugaaaaaac

SEQ ID NO: 126197 - RNA, 20 nt, Artificial Sequence
  MKO10126197_B_Vmn2r67
  gRNA
uuucucuguuuaucuugccu

SEQ ID NO: 126198 - RNA, 20 nt, Artificial Sequence
  MKO10126198_B_Vmn2r68
  gRNA
uuauauuuacagcuccaaua

SEQ ID NO: 126199 - RNA, 20 nt, Artificial Sequence
  MKO10126199_B_Vmn2r68
  gRNA
caauuucuuucuaaauugag

SEQ ID NO: 126200 - RNA, 20 nt, Artificial Sequence
  MKO10126200_B_Vmn2r68
  gRNA
uuacaauuuguaaauccugc

SEQ ID NO: 126201 - RNA, 20 nt, Artificial Sequence
  MKO10126201_B_Vmn2r69
  gRNA
cuagucaauauugaauguaa

SEQ ID NO: 126202 - RNA, 20 nt, Artificial Sequence
  MKO10126202_B_Vmn2r69
  gRNA
auauguucucucauuugugc

SEQ ID NO: 126203 - RNA, 20 nt, Artificial Sequence
  MKO10126203_B_Vmn2r69
  gRNA
uuaaaauuuguaaauccugc

SEQ ID NO: 126204 - RNA, 20 nt, Artificial Sequence
  MKO10126204_B_Vmn2r6
  gRNA
augcacaacuuacuuagugu

SEQ ID NO: 126205 - RNA, 20 nt, Artificial Sequence
  MKO10126205_B_Vmn2r6
  gRNA
auaaaauucauuacccauga

SEQ ID NO: 126206 - RNA, 20 nt, Artificial Sequence
  MKO10126206_B_Vmn2r6
  gRNA
ugcacaaaaguguguccucc

SEQ ID NO: 126207 - RNA, 20 nt, Artificial Sequence
  MKO10126207_B_Vmn2r70
  gRNA
uaucaaaacucagaagcucg

SEQ ID NO: 126208 - RNA, 20 nt, Artificial Sequence
  MKO10126208_B_Vmn2r70
  gRNA
auucgggacauaaaaaggaa

SEQ ID NO: 126209 - RNA, 20 nt, Artificial Sequence
  MKO10126209_B_Vmn2r70
  gRNA
aucuuuacuugauuuaccuc

SEQ ID NO: 126210 - RNA, 20 nt, Artificial Sequence
  MKO10126210_B_Vmn2r71
  gRNA
cuaguuaauacugaauguaa

SEQ ID NO: 126211 - RNA, 20 nt, Artificial Sequence
  MKO10126211_B_Vmn2r71
  gRNA
uguagugugccuugcagucc

SEQ ID NO: 126212 - RNA, 20 nt, Artificial Sequence
  MKO10126212_B_Vmn2r71
  gRNA
cgaaaauaugaugagaaaac

SEQ ID NO: 126213 - RNA, 20 nt, Artificial Sequence
  MKO10126213_B_Vmn2r72
  gRNA
cagauauccauuucuuccuc

SEQ ID NO: 126214 - RNA, 20 nt, Artificial Sequence
  MKO10126214_B_Vmn2r72
  gRNA
auaucuucuuucauuugugc

SEQ ID NO: 126215 - RNA, 20 nt, Artificial Sequence
  MKO10126215_B_Vmn2r72
  gRNA
caaaaauaugaugaaaaaac

SEQ ID NO: 126216 - RNA, 20 nt, Artificial Sequence
  MKO10126216_B_Vmn2r73
  gRNA
ucauuugcacaguaguaauu

SEQ ID NO: 126217 - RNA, 20 nt, Artificial Sequence
  MKO10126217_B_Vmn2r73
  gRNA
cucagaaaauccccgcagga

SEQ ID NO: 126218 - RNA, 20 nt, Artificial Sequence
  MKO10126218_B_Vmn2r73
  gRNA
gauagaaugggcuacagaua

SEQ ID NO: 126219 - RNA, 20 nt, Artificial Sequence
  MKO10126219_B_Vmn2r74
  gRNA
auucuggacaugaacaggua

SEQ ID NO: 126220 - RNA, 20 nt, Artificial Sequence
  MKO10126220_B_Vmn2r74
  gRNA
auguugacuaaaucuccagc

SEQ ID NO: 126221 - RNA, 20 nt, Artificial Sequence
  MKO10126221_B_Vmn2r74
  gRNA
auauauaucuguugaccacu

SEQ ID NO: 126222 - RNA, 20 nt, Artificial Sequence
  MKO10126222_B_Vmn2r75
  gRNA
acucuagagauguacaguaa

SEQ ID NO: 126223 - RNA, 20 nt, Artificial Sequence
  MKO10126223_B_Vmn2r75
  gRNA
ccaaauuuccaaaaauauua

SEQ ID NO: 126224 - RNA, 20 nt, Artificial Sequence
  MKO10126224_B_Vmn2r75
  gRNA
caugaaccagaauuuaaaac

SEQ ID NO: 126225 - RNA, 20 nt, Artificial Sequence
  MKO10126225_B_Vmn2r76
  gRNA
cugggccacagauguuagac

SEQ ID NO: 126226 - RNA, 20 nt, Artificial Sequence
  MKO10126226_B_Vmn2r76
  gRNA
ucauacauaagcaauucuug

SEQ ID NO: 126227 - RNA, 20 nt, Artificial Sequence
  MKO10126227_B_Vmn2r76
  gRNA
gucaguuuauccucaagaag

SEQ ID NO: 126228 - RNA, 20 nt, Artificial Sequence
  MKO10126228_B_Vmn2r77
  gRNA
guacuucucuagaacuccag

SEQ ID NO: 126229 - RNA, 20 nt, Artificial Sequence
  MKO10126229_B_Vmn2r77
  gRNA
caugaaccagaauagaaaac

SEQ ID NO: 126230 - RNA, 20 nt, Artificial Sequence
  MKO10126230_B_Vmn2r77
  gRNA
gaaggacuuaagaugaaaau

SEQ ID NO: 126231 - RNA, 20 nt, Artificial Sequence
  MKO10126231_B_Vmn2r78
  gRNA
auauuuauuaggucuccagc

SEQ ID NO: 126232 - RNA, 20 nt, Artificial Sequence
  MKO10126232_B_Vmn2r78
  gRNA
auaugaaccagaauagagaa

SEQ ID NO: 126233 - RNA, 20 nt, Artificial Sequence
  MKO10126233_B_Vmn2r78
  gRNA
ucugacuuaccucuggaguu

SEQ ID NO: 126234 - RNA, 20 nt, Artificial Sequence
  MKO10126234_B_Vmn2r79
  gRNA
auacaauuuguaaacccugu

SEQ ID NO: 126235 - RNA, 20 nt, Artificial Sequence
  MKO10126235_B_Vmn2r79
  gRNA
cgauauuuaauuguacugac

SEQ ID NO: 126236 - RNA, 20 nt, Artificial Sequence
  MKO10126236_B_Vmn2r79
  gRNA
cauauccucaccugucaugu

SEQ ID NO: 126237 - RNA, 20 nt, Artificial Sequence
  MKO10126237_B_Vmn2r7
  gRNA
agagcugagcuuccucauuc

SEQ ID NO: 126238 - RNA, 20 nt, Artificial Sequence
  MKO10126238_B_Vmn2r7
  gRNA
caaaggcuuugugauccaug

SEQ ID NO: 126239 - RNA, 20 nt, Artificial Sequence
  MKO10126239_B_Vmn2r7
  gRNA
auaaaauucauuacccauga

SEQ ID NO: 126240 - RNA, 20 nt, Artificial Sequence
  MKO10126240_B_Vmn2r80
  gRNA
uauugacaauuguuccccuu

SEQ ID NO: 126241 - RNA, 20 nt, Artificial Sequence
  MKO10126241_B_Vmn2r80
  gRNA
acuaauugugaaagaccugu

SEQ ID NO: 126242 - RNA, 20 nt, Artificial Sequence
  MKO10126242_B_Vmn2r80
  gRNA
aaauuuguaaagauccaaua

SEQ ID NO: 126243 - RNA, 20 nt, Artificial Sequence
  MKO10126243_B_Vmn2r81
  gRNA
cauugacaauuguuccccuu

SEQ ID NO: 126244 - RNA, 20 nt, Artificial Sequence
  MKO10126244_B_Vmn2r81
  gRNA
ugcacugagagcugcaaucc

SEQ ID NO: 126245 - RNA, 20 nt, Artificial Sequence
  MKO10126245_B_Vmn2r81
  gRNA
aggagugcaaucaaagcaac

SEQ ID NO: 126246 - RNA, 20 nt, Artificial Sequence
  MKO10126246_B_Vmn2r82
  gRNA
ugucugaauauaugauuaac

SEQ ID NO: 126247 - RNA, 20 nt, Artificial Sequence
  MKO10126247_B_Vmn2r82
  gRNA
acgaaacuaccaacucguuu

SEQ ID NO: 126248 - RNA, 20 nt, Artificial Sequence
  MKO10126248_B_Vmn2r82
  gRNA
aaaauauuccuuccaauagc

SEQ ID NO: 126249 - RNA, 20 nt, Artificial Sequence
  MKO10126249_B_Vmn2r83
  gRNA
uaucugaacacauaauugac

SEQ ID NO: 126250 - RNA, 20 nt, Artificial Sequence
  MKO10126250_B_Vmn2r83
  gRNA
cccaugagauaauucuaaca

SEQ ID NO: 126251 - RNA, 20 nt, Artificial Sequence
  MKO10126251_B_Vmn2r83
  gRNA
auuugcuccaagugcuccaa

SEQ ID NO: 126252 - RNA, 20 nt, Artificial Sequence
  MKO10126252_B_Vmn2r84
  gRNA
agaauacacagaaugucagc

SEQ ID NO: 126253 - RNA, 20 nt, Artificial Sequence
  MKO10126253_B_Vmn2r84
  gRNA
cuuguugaagaaugugcuca

SEQ ID NO: 126254 - RNA, 20 nt, Artificial Sequence
  MKO10126254_B_Vmn2r84
  gRNA
acccacugauguuccuccug

SEQ ID NO: 126255 - RNA, 20 nt, Artificial Sequence
  MKO10126255_B_Vmn2r85
  gRNA
acaugucacacugcacauug

SEQ ID NO: 126256 - RNA, 20 nt, Artificial Sequence
  MKO10126256_B_Vmn2r85
  gRNA
auugacucagaaaugcuuau

SEQ ID NO: 126257 - RNA, 20 nt, Artificial Sequence
  MKO10126257_B_Vmn2r85
  gRNA
aacugguggauaugaaucau

SEQ ID NO: 126258 - RNA, 20 nt, Artificial Sequence
  MKO10126258_B_Vmn2r86
  gRNA
aguacaugucacacugcaaa

SEQ ID NO: 126259 - RNA, 20 nt, Artificial Sequence
  MKO10126259_B_Vmn2r86
  gRNA
auaugaaguuguugacucca

SEQ ID NO: 126260 - RNA, 20 nt, Artificial Sequence
  MKO10126260_B_Vmn2r86
  gRNA
acaaacucauauucacuugc

SEQ ID NO: 126261 - RNA, 20 nt, Artificial Sequence
  MKO10126261_B_Vmn2r87
  gRNA
auauguaguuguugacuccg

SEQ ID NO: 126262 - RNA, 20 nt, Artificial Sequence
  MKO10126262_B_Vmn2r87
  gRNA
ugguaaaugucaagauucuu

SEQ ID NO: 126263 - RNA, 20 nt, Artificial Sequence
  MKO10126263_B_Vmn2r87
  gRNA
aaaauacacagaaugucagc

SEQ ID NO: 126264 - RNA, 20 nt, Artificial Sequence
  MKO10126264_B_Vmn2r88
  gRNA
uaagaauuugugacaaugaa

SEQ ID NO: 126265 - RNA, 20 nt, Artificial Sequence
  MKO10126265_B_Vmn2r88
  gRNA
uugucacaaauucuuaccag

SEQ ID NO: 126266 - RNA, 20 nt, Artificial Sequence
  MKO10126266_B_Vmn2r88
  gRNA
auaugaaguucuugucucug

SEQ ID NO: 126267 - RNA, 20 nt, Artificial Sequence
  MKO10126267_B_Vmn2r89
  gRNA
uaauaugauaucccauugug

SEQ ID NO: 126268 - RNA, 20 nt, Artificial Sequence
  MKO10126268_B_Vmn2r89
  gRNA
aagaauagugaagauaguga

SEQ ID NO: 126269 - RNA, 20 nt, Artificial Sequence
  MKO10126269_B_Vmn2r89
  gRNA
uuauaaaaauuaucuucaau

SEQ ID NO: 126270 - RNA, 20 nt, Artificial Sequence
  MKO10126270_B_Vmn2r8
  gRNA
gaccauuuaauccugaccug

SEQ ID NO: 126271 - RNA, 20 nt, Artificial Sequence
  MKO10126271_B_Vmn2r8
  gRNA
caguacaugucacacuacac

SEQ ID NO: 126272 - RNA, 20 nt, Artificial Sequence
  MKO10126272_B_Vmn2r8
  gRNA
uggcuuccaugcugaaaucc

SEQ ID NO: 126273 - RNA, 20 nt, Artificial Sequence
  MKO10126273_B_Vmn2r90
  gRNA
ucuucuacccaauauaacuu

SEQ ID NO: 126274 - RNA, 20 nt, Artificial Sequence
  MKO10126274_B_Vmn2r90
  gRNA
uugcugaugauuccuuaguc

SEQ ID NO: 126275 - RNA, 20 nt, Artificial Sequence
  MKO10126275_B_Vmn2r90
  gRNA
aucaaagcccaaaguuauau

SEQ ID NO: 126276 - RNA, 20 nt, Artificial Sequence
  MKO10126276_B_Vmn2r91
  gRNA
auugaagcaaugucccaauu

SEQ ID NO: 126277 - RNA, 20 nt, Artificial Sequence
  MKO10126277_B_Vmn2r91
  gRNA
cccaccucugaaaauauuuc

SEQ ID NO: 126278 - RNA, 20 nt, Artificial Sequence
  MKO10126278_B_Vmn2r91
  gRNA
ucagcuuaacacuuuccuga

SEQ ID NO: 126279 - RNA, 20 nt, Artificial Sequence
  MKO10126279_B_Vmn2r92
  gRNA
gguuauugacauggaauguc

SEQ ID NO: 126280 - RNA, 20 nt, Artificial Sequence
  MKO10126280_B_Vmn2r92
  gRNA
cccaccucugaaaauauuuc

SEQ ID NO: 126281 - RNA, 20 nt, Artificial Sequence
  MKO10126281_B_Vmn2r92
  gRNA
ucagcuuaacacuuuccuga

SEQ ID NO: 126282 - RNA, 20 nt, Artificial Sequence
  MKO10126282_B_Vmn2r93
  gRNA
uucucaucucaauauccuuc

SEQ ID NO: 126283 - RNA, 20 nt, Artificial Sequence
  MKO10126283_B_Vmn2r93
  gRNA
ccaucuaaaaugaacaauca

SEQ ID NO: 126284 - RNA, 20 nt, Artificial Sequence
  MKO10126284_B_Vmn2r93
  gRNA
uggauggcaucugcccaaau

SEQ ID NO: 126285 - RNA, 20 nt, Artificial Sequence
  MKO10126285_B_Vmn2r94
  gRNA
auucagaacaguaacccagc

SEQ ID NO: 126286 - RNA, 20 nt, Artificial Sequence
  MKO10126286_B_Vmn2r94
  gRNA
cacagcccauguagagagaa

SEQ ID NO: 126287 - RNA, 20 nt, Artificial Sequence
  MKO10126287_B_Vmn2r94
  gRNA
uggagacagacaaaagauuc

SEQ ID NO: 126288 - RNA, 20 nt, Artificial Sequence
  MKO10126288_B_Vmn2r95
  gRNA
aacuuucacugcacacagau

SEQ ID NO: 126289 - RNA, 20 nt, Artificial Sequence
  MKO10126289_B_Vmn2r95
  gRNA
acucaaaauucucccuauaa

SEQ ID NO: 126290 - RNA, 20 nt, Artificial Sequence
  MKO10126290_B_Vmn2r95
  gRNA
gagacaaaaagaguuuagau

SEQ ID NO: 126291 - RNA, 20 nt, Artificial Sequence
  MKO10126291_B_Vmn2r96
  gRNA
cacuuuccugaagaauauug

SEQ ID NO: 126292 - RNA, 20 nt, Artificial Sequence
  MKO10126292_B_Vmn2r96
  gRNA
cucaucuguggccuuccauu

SEQ ID NO: 126293 - RNA, 20 nt, Artificial Sequence
  MKO10126293_B_Vmn2r96
  gRNA
cuggaggaugcaggaaacug

SEQ ID NO: 126294 - RNA, 20 nt, Artificial Sequence
  MKO10126294_B_Vmn2r97
  gRNA
aucaaacccaagagauaugu

SEQ ID NO: 126295 - RNA, 20 nt, Artificial Sequence
  MKO10126295_B_Vmn2r97
  gRNA
guugaagcaaugucccaauu

SEQ ID NO: 126296 - RNA, 20 nt, Artificial Sequence
  MKO10126296_B_Vmn2r97
  gRNA
auauugaggugaaagacaaa

SEQ ID NO: 126297 - RNA, 20 nt, Artificial Sequence
  MKO10126297_B_Vmn2r98
  gRNA
auuguaaauacuugugcucu

SEQ ID NO: 126298 - RNA, 20 nt, Artificial Sequence
  MKO10126298_B_Vmn2r98
  gRNA
cuuucacuucaauauccuuc

SEQ ID NO: 126299 - RNA, 20 nt, Artificial Sequence
  MKO10126299_B_Vmn2r98
  gRNA
guugaagcaaugucccaauu

SEQ ID NO: 126300 - RNA, 20 nt, Artificial Sequence
  MKO10126300_B_Vmn2r99
  gRNA
auaaacacaacugcugaucc

SEQ ID NO: 126301 - RNA, 20 nt, Artificial Sequence
  MKO10126301_B_Vmn2r99
  gRNA
aauucagagcaagaauauac

SEQ ID NO: 126302 - RNA, 20 nt, Artificial Sequence
  MKO10126302_B_Vmn2r99
  gRNA
cuuucaauucaauauccuuc

SEQ ID NO: 126303 - RNA, 20 nt, Artificial Sequence
  MKO10126303_B_Vmn2r9
  gRNA
cacacacuugucccaugcca

SEQ ID NO: 126304 - RNA, 20 nt, Artificial Sequence
  MKO10126304_B_Vmn2r9
  gRNA
uguagugugacguguacugc

SEQ ID NO: 126305 - RNA, 20 nt, Artificial Sequence
  MKO10126305_B_Vmn2r9
  gRNA
acccacugauguuccuucug

SEQ ID NO: 126306 - RNA, 20 nt, Artificial Sequence
  MKO10126306_B_Vmo1
  gRNA
ucccucgagugcaguguagc

SEQ ID NO: 126307 - RNA, 20 nt, Artificial Sequence
  MKO10126307_B_Vmo1
  gRNA
auguaaauggcuccacccgg

SEQ ID NO: 126308 - RNA, 20 nt, Artificial Sequence
  MKO10126308_B_Vmo1
  gRNA
aucaccccagguaccaccgu

SEQ ID NO: 126309 - RNA, 20 nt, Artificial Sequence
  MKO10126309_B_Vmp1
  gRNA
guggcaucgucaaagcauug

SEQ ID NO: 126310 - RNA, 20 nt, Artificial Sequence
  MKO10126310_B_Vmp1
  gRNA
gcuuaccagauaaagcagaa

SEQ ID NO: 126311 - RNA, 20 nt, Artificial Sequence
  MKO10126311_B_Vmp1
  gRNA
uccuguuccaagaccaacag

SEQ ID NO: 126312 - RNA, 20 nt, Artificial Sequence
  MKO10126312_B_Vnn1
  gRNA
ucuaugcacccgauucucca

SEQ ID NO: 126313 - RNA, 20 nt, Artificial Sequence
  MKO10126313_B_Vnn1
  gRNA
ccauacuguucccaaccgcc

SEQ ID NO: 126314 - RNA, 20 nt, Artificial Sequence
  MKO10126314_B_Vnn1
  gRNA
gugacuuucgacacccccuu

SEQ ID NO: 126315 - RNA, 20 nt, Artificial Sequence
  MKO10126315_B_Vnn3
  gRNA
cuggcccacaccgaauggaa

SEQ ID NO: 126316 - RNA, 20 nt, Artificial Sequence
  MKO10126316_B_Vnn3
  gRNA
gcuaacagcccgcuaccaua

SEQ ID NO: 126317 - RNA, 20 nt, Artificial Sequence
  MKO10126317_B_Vnn3
  gRNA
gaccauuuaccccuaccuag

SEQ ID NO: 126318 - RNA, 20 nt, Artificial Sequence
  MKO10126318_B_Vopp1
  gRNA
ggacccgggaugaauccugu

SEQ ID NO: 126319 - RNA, 20 nt, Artificial Sequence
  MKO10126319_B_Vopp1
  gRNA
ugagggcccuuuccauacag

SEQ ID NO: 126320 - RNA, 20 nt, Artificial Sequence
  MKO10126320_B_Vopp1
  gRNA
cuauacuuacauauaguaug

SEQ ID NO: 126321 - RNA, 20 nt, Artificial Sequence
  MKO10126321_B_Vprbp
  gRNA
acauauucuacuggacugcu

SEQ ID NO: 126322 - RNA, 20 nt, Artificial Sequence
  MKO10126322_B_Vprbp
  gRNA
cgcaguugucuuucaagaaa

SEQ ID NO: 126323 - RNA, 20 nt, Artificial Sequence
  MKO10126323_B_Vprbp
  gRNA
agcugauccagaguguaugc

SEQ ID NO: 126324 - RNA, 20 nt, Artificial Sequence
  MKO10126324_B_Vpreb1
  gRNA
gucuguccugcucaugcugc

SEQ ID NO: 126325 - RNA, 20 nt, Artificial Sequence
  MKO10126325_B_Vpreb1
  gRNA
ccuggucguaucuuuggacc

SEQ ID NO: 126326 - RNA, 20 nt, Artificial Sequence
  MKO10126326_B_Vpreb1
  gRNA
ccaagggaagaagaugcuaa

SEQ ID NO: 126327 - RNA, 20 nt, Artificial Sequence
  MKO10126327_B_Vpreb2
  gRNA
gucuguccugcucaugcugc

SEQ ID NO: 126328 - RNA, 20 nt, Artificial Sequence
  MKO10126328_B_Vpreb2
  gRNA
caaagauacggccaggaacc

SEQ ID NO: 126329 - RNA, 20 nt, Artificial Sequence
  MKO10126329_B_Vpreb2
  gRNA
ccaagggaagaagaugcuga

SEQ ID NO: 126330 - RNA, 20 nt, Artificial Sequence
  MKO10126330_B_Vpreb3
  gRNA
augugccguaccugccacaa

SEQ ID NO: 126331 - RNA, 20 nt, Artificial Sequence
  MKO10126331_B_Vpreb3
  gRNA
gacgcguucucagucuuccc

SEQ ID NO: 126332 - RNA, 20 nt, Artificial Sequence
  MKO10126332_B_Vpreb3
  gRNA
cgacagauucucagcuaccg

SEQ ID NO: 126333 - RNA, 20 nt, Artificial Sequence
  MKO10126333_B_Vps11
  gRNA
gugugucacccguaguuugu

SEQ ID NO: 126334 - RNA, 20 nt, Artificial Sequence
  MKO10126334_B_Vps11
  gRNA
guuccaggccuacaaacuac

SEQ ID NO: 126335 - RNA, 20 nt, Artificial Sequence
  MKO10126335_B_Vps11
  gRNA
ggucuuuccugcuuggcgaa

SEQ ID NO: 126336 - RNA, 20 nt, Artificial Sequence
  MKO10126336_B_Vps13a
  gRNA
ucuuccaaaacagcuucaac

SEQ ID NO: 126337 - RNA, 20 nt, Artificial Sequence
  MKO10126337_B_Vps13a
  gRNA
aaacagaaaguauuugauaa

SEQ ID NO: 126338 - RNA, 20 nt, Artificial Sequence
  MKO10126338_B_Vps13a
  gRNA
uguaauuaaagaaaaugcau

SEQ ID NO: 126339 - RNA, 20 nt, Artificial Sequence
  MKO10126339_B_Vps13b
  gRNA
aaaaccccgaagaauucagc

SEQ ID NO: 126340 - RNA, 20 nt, Artificial Sequence
  MKO10126340_B_Vps13b
  gRNA
aaaauugggcuccgaaccug

SEQ ID NO: 126341 - RNA, 20 nt, Artificial Sequence
  MKO10126341_B_Vps13b
  gRNA
gaauuaccuggugguaaguc

SEQ ID NO: 126342 - RNA, 20 nt, Artificial Sequence
  MKO10126342_B_Vps13c
  gRNA
uuaaacagguaauguggcuu

SEQ ID NO: 126343 - RNA, 20 nt, Artificial Sequence
  MKO10126343_B_Vps13c
  gRNA
uuucuguuuaauauccugca

SEQ ID NO: 126344 - RNA, 20 nt, Artificial Sequence
  MKO10126344_B_Vps13c
  gRNA
uggccagccuugacuuugaa

SEQ ID NO: 126345 - RNA, 20 nt, Artificial Sequence
  MKO10126345_B_Vps13d
  gRNA
gcguaagaaagcgcugcuuc

SEQ ID NO: 126346 - RNA, 20 nt, Artificial Sequence
  MKO10126346_B_Vps13d
  gRNA
uucccuugcagagugagcgg

SEQ ID NO: 126347 - RNA, 20 nt, Artificial Sequence
  MKO10126347_B_Vps13d
  gRNA
cguaccagcuuugacuucaa

SEQ ID NO: 126348 - RNA, 20 nt, Artificial Sequence
  MKO10126348_B_Vps16
  gRNA
gcagaguagaucuccaguac

SEQ ID NO: 126349 - RNA, 20 nt, Artificial Sequence
  MKO10126349_B_Vps16
  gRNA
ccuccucagcugaccagccg

SEQ ID NO: 126350 - RNA, 20 nt, Artificial Sequence
  MKO10126350_B_Vps16
  gRNA
cuuccggaggcacuucagca

SEQ ID NO: 126351 - RNA, 20 nt, Artificial Sequence
  MKO10126351_B_Vps18
  gRNA
ggaugucuggcgcaccuacu

SEQ ID NO: 126352 - RNA, 20 nt, Artificial Sequence
  MKO10126352_B_Vps18
  gRNA
uugacuucacccccucggag

SEQ ID NO: 126353 - RNA, 20 nt, Artificial Sequence
  MKO10126353_B_Vps18
  gRNA
ggcaagugagcccaaccgug

SEQ ID NO: 126354 - RNA, 20 nt, Artificial Sequence
  MKO10126354_B_Vps25
  gRNA
acaaucugaauugacuccac

SEQ ID NO: 126355 - RNA, 20 nt, Artificial Sequence
  MKO10126355_B_Vps25
  gRNA
uauucuuauccaaccacucg

SEQ ID NO: 126356 - RNA, 20 nt, Artificial Sequence
  MKO10126356_B_Vps25
  gRNA
agucuagcuuccugaucaug

SEQ ID NO: 126357 - RNA, 20 nt, Artificial Sequence
  MKO10126357_B_Vps26a
  gRNA
uuaauagaguuguugacauc

SEQ ID NO: 126358 - RNA, 20 nt, Artificial Sequence
  MKO10126358_B_Vps26a
  gRNA
ugucaacaacucuauuaaaa

SEQ ID NO: 126359 - RNA, 20 nt, Artificial Sequence
  MKO10126359_B_Vps26a
  gRNA
ggcaacaucaaucucacaaa

SEQ ID NO: 126360 - RNA, 20 nt, Artificial Sequence
  MKO10126360_B_Vps26b
  gRNA
ggcggcugaugguggcucga

SEQ ID NO: 126361 - RNA, 20 nt, Artificial Sequence
  MKO10126361_B_Vps26b
  gRNA
ugugcgcuauuaccucaacu

SEQ ID NO: 126362 - RNA, 20 nt, Artificial Sequence
  MKO10126362_B_Vps26b
  gRNA
caggugaguccauccccauc

SEQ ID NO: 126363 - RNA, 20 nt, Artificial Sequence
  MKO10126363_B_Vps28
  gRNA
ccuggagaaggcguacauca

SEQ ID NO: 126364 - RNA, 20 nt, Artificial Sequence
  MKO10126364_B_Vps28
  gRNA
ugcagccccugggaacaagc

SEQ ID NO: 126365 - RNA, 20 nt, Artificial Sequence
  MKO10126365_B_Vps28
  gRNA
uaaagcucuacaagaaugcu

SEQ ID NO: 126366 - RNA, 20 nt, Artificial Sequence
  MKO10126366_B_Vps29
  gRNA
cacuggggccuauaaugccu

SEQ ID NO: 126367 - RNA, 20 nt, Artificial Sequence
  MKO10126367_B_Vps29
  gRNA
ggaucagaccgaucuugaac

SEQ ID NO: 126368 - RNA, 20 nt, Artificial Sequence
  MKO10126368_B_Vps29
  gRNA
auguccaucagcacaaacga

SEQ ID NO: 126369 - RNA, 20 nt, Artificial Sequence
  MKO10126369_B_Vps33a
  gRNA
uauguccaucagcucuagcc

SEQ ID NO: 126370 - RNA, 20 nt, Artificial Sequence
  MKO10126370_B_Vps33a
  gRNA
cagccuguaccacgcagcca

SEQ ID NO: 126371 - RNA, 20 nt, Artificial Sequence
  MKO10126371_B_Vps33a
  gRNA
ugauggggaccucuuaucca

SEQ ID NO: 126372 - RNA, 20 nt, Artificial Sequence
  MKO10126372_B_Vps33b
  gRNA
uagcgcauauucuugauucg

SEQ ID NO: 126373 - RNA, 20 nt, Artificial Sequence
  MKO10126373_B_Vps33b
  gRNA
ucuugucaaugcugacaagc

SEQ ID NO: 126374 - RNA, 20 nt, Artificial Sequence
  MKO10126374_B_Vps33b
  gRNA
agucauccuaagcccucaga

SEQ ID NO: 126375 - RNA, 20 nt, Artificial Sequence
  MKO10126375_B_Vps35
  gRNA
ccggagcucuccaagcauau

SEQ ID NO: 126376 - RNA, 20 nt, Artificial Sequence
  MKO10126376_B_Vps35
  gRNA
aguuaucucuugaucacagu

SEQ ID NO: 126377 - RNA, 20 nt, Artificial Sequence
  MKO10126377_B_Vps35
  gRNA
augacugaaccuucacagcc

SEQ ID NO: 126378 - RNA, 20 nt, Artificial Sequence
  MKO10126378_B_Vps36
  gRNA
uguacuaagaagaagagucc

SEQ ID NO: 126379 - RNA, 20 nt, Artificial Sequence
  MKO10126379_B_Vps36
  gRNA
aggcagcuggaaucgggaag

SEQ ID NO: 126380 - RNA, 20 nt, Artificial Sequence
  MKO10126380_B_Vps36
  gRNA
cucuucuucuuaguacacac

SEQ ID NO: 126381 - RNA, 20 nt, Artificial Sequence
  MKO10126381_B_Vps37a
  gRNA
uuuacaaugcacucagaucu

SEQ ID NO: 126382 - RNA, 20 nt, Artificial Sequence
  MKO10126382_B_Vps37a
  gRNA
gccaaucagacaucauuuaa

SEQ ID NO: 126383 - RNA, 20 nt, Artificial Sequence
  MKO10126383_B_Vps37a
  gRNA
acauauuaauguuaauuguc

SEQ ID NO: 126384 - RNA, 20 nt, Artificial Sequence
  MKO10126384_B_Vps37b
  gRNA
gcacaugcgccgugugaaag

SEQ ID NO: 126385 - RNA, 20 nt, Artificial Sequence
  MKO10126385_B_Vps37b
  gRNA
ucuguuagcgcuucuucaag

SEQ ID NO: 126386 - RNA, 20 nt, Artificial Sequence
  MKO10126386_B_Vps37b
  gRNA
acagucuaacaacgcuuccu

SEQ ID NO: 126387 - RNA, 20 nt, Artificial Sequence
  MKO10126387_B_Vps37c
  gRNA
cucugccaggcuccgguucg

SEQ ID NO: 126388 - RNA, 20 nt, Artificial Sequence
  MKO10126388_B_Vps37c
  gRNA
acuggccacgaaccggagcc

SEQ ID NO: 126389 - RNA, 20 nt, Artificial Sequence
  MKO10126389_B_Vps37c
  gRNA
cuagccgggcaauggcuucu

SEQ ID NO: 126390 - RNA, 20 nt, Artificial Sequence
  MKO10126390_B_Vps37d
  gRNA
cacccgggagagcccuucac

SEQ ID NO: 126391 - RNA, 20 nt, Artificial Sequence
  MKO10126391_B_Vps37d
  gRNA
guguccgccucaggugggcc

SEQ ID NO: 126392 - RNA, 20 nt, Artificial Sequence
  MKO10126392_B_Vps37d
  gRNA
gcccccaaugugcgcugggc

SEQ ID NO: 126393 - RNA, 20 nt, Artificial Sequence
  MKO10126393_B_Vps39
  gRNA
agcugaccagaaucuuaaac

SEQ ID NO: 126394 - RNA, 20 nt, Artificial Sequence
  MKO10126394_B_Vps39
  gRNA
gguuucccaguuuaagauuc

SEQ ID NO: 126395 - RNA, 20 nt, Artificial Sequence
  MKO10126395_B_Vps39
  gRNA
aagggcaucuucuucucuac

SEQ ID NO: 126396 - RNA, 20 nt, Artificial Sequence
  MKO10126396_B_Vps41
  gRNA
cacugucauccaagcuaauu

SEQ ID NO: 126397 - RNA, 20 nt, Artificial Sequence
  MKO10126397_B_Vps41
  gRNA
gaagauaaaccaaauuagcu

SEQ ID NO: 126398 - RNA, 20 nt, Artificial Sequence
  MKO10126398_B_Vps41
  gRNA
acuucugagugauguuuccc

SEQ ID NO: 126399 - RNA, 20 nt, Artificial Sequence
  MKO10126399_B_Vps45
  gRNA
caagagugacgugaagucac

SEQ ID NO: 126400 - RNA, 20 nt, Artificial Sequence
  MKO10126400_B_Vps45
  gRNA
agcugacgagcaggaaguug

SEQ ID NO: 126401 - RNA, 20 nt, Artificial Sequence
  MKO10126401_B_Vps45
  gRNA
aauaaaauauaugcuguacu

SEQ ID NO: 126402 - RNA, 20 nt, Artificial Sequence
  MKO10126402_B_Vps4a
  gRNA
uucuuaccugugaauaagug

SEQ ID NO: 126403 - RNA, 20 nt, Artificial Sequence
  MKO10126403_B_Vps4a
  gRNA
ucagcuucuccgcucugucu

SEQ ID NO: 126404 - RNA, 20 nt, Artificial Sequence
  MKO10126404_B_Vps4a
  gRNA
cucaccccuugccuucacuc

SEQ ID NO: 126405 - RNA, 20 nt, Artificial Sequence
  MKO10126405_B_Vps4b
  gRNA
auuucaccuguaaacagaug

SEQ ID NO: 126406 - RNA, 20 nt, Artificial Sequence
  MKO10126406_B_Vps4b
  gRNA
acaucacuccacuucacauu

SEQ ID NO: 126407 - RNA, 20 nt, Artificial Sequence
  MKO10126407_B_Vps4b
  gRNA
uucauuaggaaugacaguga

SEQ ID NO: 126408 - RNA, 20 nt, Artificial Sequence
  MKO10126408_B_Vps51
  gRNA
uucgcgccucaccaagugug

SEQ ID NO: 126409 - RNA, 20 nt, Artificial Sequence
  MKO10126409_B_Vps51
  gRNA
ugggcaggcagugcgcuauc

SEQ ID NO: 126410 - RNA, 20 nt, Artificial Sequence
  MKO10126410_B_Vps51
  gRNA
gcugauccgugcgcugaagu

SEQ ID NO: 126411 - RNA, 20 nt, Artificial Sequence
  MKO10126411_B_Vps52
  gRNA
gucucugcacaaucagauca

SEQ ID NO: 126412 - RNA, 20 nt, Artificial Sequence
  MKO10126412_B_Vps52
  gRNA
agauugagcagaagucaauc

SEQ ID NO: 126413 - RNA, 20 nt, Artificial Sequence
  MKO10126413_B_Vps52
  gRNA
ccucuucaggggggggguuc

SEQ ID NO: 126414 - RNA, 20 nt, Artificial Sequence
  MKO10126414_B_Vps53
  gRNA
cagaguauugauauacucaa

SEQ ID NO: 126415 - RNA, 20 nt, Artificial Sequence
  MKO10126415_B_Vps53
  gRNA
uuugccaaagaguugcugaa

SEQ ID NO: 126416 - RNA, 20 nt, Artificial Sequence
  MKO10126416_B_Vps53
  gRNA
uuuauuauaggcacuugaag

SEQ ID NO: 126417 - RNA, 20 nt, Artificial Sequence
  MKO10126417_B_Vps54
  gRNA
ugcugcugggagauuuacuu

SEQ ID NO: 126418 - RNA, 20 nt, Artificial Sequence
  MKO10126418_B_Vps54
  gRNA
auguaaaagaguccugucaa

SEQ ID NO: 126419 - RNA, 20 nt, Artificial Sequence
  MKO10126419_B_Vps54
  gRNA
gcaguauuaaaaugagacca

SEQ ID NO: 126420 - RNA, 20 nt, Artificial Sequence
  MKO10126420_B_Vps72
  gRNA
uguuggggagcccggcccca

SEQ ID NO: 126421 - RNA, 20 nt, Artificial Sequence
  MKO10126421_B_Vps72
  gRNA
uccucuuaccuuauaggcuu

SEQ ID NO: 126422 - RNA, 20 nt, Artificial Sequence
  MKO10126422_B_Vps72
  gRNA
ccucauccuccguaucagac

SEQ ID NO: 126423 - RNA, 20 nt, Artificial Sequence
  MKO10126423_B_Vps8
  gRNA
cucuuacgauaccucaucug

SEQ ID NO: 126424 - RNA, 20 nt, Artificial Sequence
  MKO10126424_B_Vps8
  gRNA
cuaccaaagagaucaucguu

SEQ ID NO: 126425 - RNA, 20 nt, Artificial Sequence
  MKO10126425_B_Vps8
  gRNA
cuuuacuuagaucgaugaca

SEQ ID NO: 126426 - RNA, 20 nt, Artificial Sequence
  MKO10126426_B_Vps9d1
  gRNA
ggccaugcagaagacaucgc

SEQ ID NO: 126427 - RNA, 20 nt, Artificial Sequence
  MKO10126427_B_Vps9d1
  gRNA
cgccgaguguguucagauga

SEQ ID NO: 126428 - RNA, 20 nt, Artificial Sequence
  MKO10126428_B_Vps9d1
  gRNA
caagcuugguagcuguugac

SEQ ID NO: 126429 - RNA, 20 nt, Artificial Sequence
  MKO10126429_B_Vrk1
  gRNA
cgcgcccuguguugugaaag

SEQ ID NO: 126430 - RNA, 20 nt, Artificial Sequence
  MKO10126430_B_Vrk1
  gRNA
cggaauuaaaguucuaccag

SEQ ID NO: 126431 - RNA, 20 nt, Artificial Sequence
  MKO10126431_B_Vrk1
  gRNA
guuccuaaguauuggggauc

SEQ ID NO: 126432 - RNA, 20 nt, Artificial Sequence
  MKO10126432_B_Vrk2
  gRNA
uccaaaaguggauacaacag

SEQ ID NO: 126433 - RNA, 20 nt, Artificial Sequence
  MKO10126433_B_Vrk2
  gRNA
uuuggucugacugauuucaa

SEQ ID NO: 126434 - RNA, 20 nt, Artificial Sequence
  MKO10126434_B_Vrk2
  gRNA
aauagauuuacagaaacucc

SEQ ID NO: 126435 - RNA, 20 nt, Artificial Sequence
  MKO10126435_B_Vrk3
  gRNA
gaccaaggcauucucuauga

SEQ ID NO: 126436 - RNA, 20 nt, Artificial Sequence
  MKO10126436_B_Vrk3
  gRNA
uggaauaccuugcagaggcu

SEQ ID NO: 126437 - RNA, 20 nt, Artificial Sequence
  MKO10126437_B_Vrk3
  gRNA
ccgggugaccaccucacucc

SEQ ID NO: 126438 - RNA, 20 nt, Artificial Sequence
  MKO10126438_B_Vrtn
  gRNA
cgcccgcuuccacauguagu

SEQ ID NO: 126439 - RNA, 20 nt, Artificial Sequence
  MKO10126439_B_Vrtn
  gRNA
caacgagcuucuccaaugug

SEQ ID NO: 126440 - RNA, 20 nt, Artificial Sequence
  MKO10126440_B_Vrtn
  gRNA
cgaggucuaccuacuacaac

SEQ ID NO: 126441 - RNA, 20 nt, Artificial Sequence
  MKO10126441_B_Vsig10
  gRNA
cugagcacguguaguugccu

SEQ ID NO: 126442 - RNA, 20 nt, Artificial Sequence
  MKO10126442_B_Vsig10
  gRNA
guagcccccgucccaguuac

SEQ ID NO: 126443 - RNA, 20 nt, Artificial Sequence
  MKO10126443_B_Vsig10
  gRNA
aacucgccuguaacugggac

SEQ ID NO: 126444 - RNA, 20 nt, Artificial Sequence
  MKO10126444_B_Vsig1
  gRNA
caccgucuccuuuguauuac

SEQ ID NO: 126445 - RNA, 20 nt, Artificial Sequence
  MKO10126445_B_Vsig1
  gRNA
uauggugauagaugcauuac

SEQ ID NO: 126446 - RNA, 20 nt, Artificial Sequence
  MKO10126446_B_Vsig1
  gRNA
uguacugccaucaacagucu

SEQ ID NO: 126447 - RNA, 20 nt, Artificial Sequence
  MKO10126447_B_Vsig2
  gRNA
uacgggcacggacgcagaga

SEQ ID NO: 126448 - RNA, 20 nt, Artificial Sequence
  MKO10126448_B_Vsig2
  gRNA
agacguucccaguuguacac

SEQ ID NO: 126449 - RNA, 20 nt, Artificial Sequence
  MKO10126449_B_Vsig2
  gRNA
uuacccuuuggcacgcucag

SEQ ID NO: 126450 - RNA, 20 nt, Artificial Sequence
  MKO10126450_B_Vsig4
  gRNA
accucugacuugaccacuaa

SEQ ID NO: 126451 - RNA, 20 nt, Artificial Sequence
  MKO10126451_B_Vsig4
  gRNA
acucuuaccugaaccagcaa

SEQ ID NO: 126452 - RNA, 20 nt, Artificial Sequence
  MKO10126452_B_Vsig4
  gRNA
uacaacccugcacuccucuu

SEQ ID NO: 126453 - RNA, 20 nt, Artificial Sequence
  MKO10126453_B_Vsig8
  gRNA
guccaacacaugggcaccgc

SEQ ID NO: 126454 - RNA, 20 nt, Artificial Sequence
  MKO10126454_B_Vsig8
  gRNA
uggccaggaggucauguacc

SEQ ID NO: 126455 - RNA, 20 nt, Artificial Sequence
  MKO10126455_B_Vsig8
  gRNA
gugcacaguggccaaccaug

SEQ ID NO: 126456 - RNA, 20 nt, Artificial Sequence
  MKO10126456_B_Vsnl1
  gRNA
aucuuguccacccgcuguuc

SEQ ID NO: 126457 - RNA, 20 nt, Artificial Sequence
  MKO10126457_B_Vsnl1
  gRNA
auggccugacgccugaacag

SEQ ID NO: 126458 - RNA, 20 nt, Artificial Sequence
  MKO10126458_B_Vsnl1
  gRNA
guuccagcagcucuauguga

SEQ ID NO: 126459 - RNA, 20 nt, Artificial Sequence
  MKO10126459_B_Vstm2a
  gRNA
cgcuaacuacggggagcuuc

SEQ ID NO: 126460 - RNA, 20 nt, Artificial Sequence
  MKO10126460_B_Vstm2a
  gRNA
agucacauuucucggcaacu

SEQ ID NO: 126461 - RNA, 20 nt, Artificial Sequence
  MKO10126461_B_Vstm2a
  gRNA
gcgaggauagcuacaagcca

SEQ ID NO: 126462 - RNA, 20 nt, Artificial Sequence
  MKO10126462_B_Vstm2b
  gRNA
accuucguccugcaaucgua

SEQ ID NO: 126463 - RNA, 20 nt, Artificial Sequence
  MKO10126463_B_Vstm2b
  gRNA
ucacuugcagguaccggccc

SEQ ID NO: 126464 - RNA, 20 nt, Artificial Sequence
  MKO10126464_B_Vstm2b
  gRNA
uaaguuccugcacccacuuc

SEQ ID NO: 126465 - RNA, 20 nt, Artificial Sequence
  MKO10126465_B_Vstm2l
  gRNA
gcguggcgccgccgaguugc

SEQ ID NO: 126466 - RNA, 20 nt, Artificial Sequence
  MKO10126466_B_Vstm2l
  gRNA
cuguccgugccgucauguca

SEQ ID NO: 126467 - RNA, 20 nt, Artificial Sequence
  MKO10126467_B_Vstm2l
  gRNA
ggugguaccugcgcagccac

SEQ ID NO: 126468 - RNA, 20 nt, Artificial Sequence
  MKO10126468_B_Vstm4
  gRNA
cgcuguccuugugugcugcg

SEQ ID NO: 126469 - RNA, 20 nt, Artificial Sequence
  MKO10126469_B_Vstm4
  gRNA
aauauuccuaccuguucuga

SEQ ID NO: 126470 - RNA, 20 nt, Artificial Sequence
  MKO10126470_B_Vstm4
  gRNA
acagugaucucccucaaagc

SEQ ID NO: 126471 - RNA, 20 nt, Artificial Sequence
  MKO10126471_B_Vstm5
  gRNA
gaggacccaaggcaucccgc

SEQ ID NO: 126472 - RNA, 20 nt, Artificial Sequence
  MKO10126472_B_Vstm5
  gRNA
agugugcguauaaauuccaa

SEQ ID NO: 126473 - RNA, 20 nt, Artificial Sequence
  MKO10126473_B_Vstm5
  gRNA
acugauugcaaacccacaug

SEQ ID NO: 126474 - RNA, 20 nt, Artificial Sequence
  MKO10126474_B_Vsx1
  gRNA
gacaccuguauucggucuuc

SEQ ID NO: 126475 - RNA, 20 nt, Artificial Sequence
  MKO10126475_B_Vsx1
  gRNA
gggaugcauaaaaaguccac

SEQ ID NO: 126476 - RNA, 20 nt, Artificial Sequence
  MKO10126476_B_Vsx1
  gRNA
guuucgucuggcccccucuc

SEQ ID NO: 126477 - RNA, 20 nt, Artificial Sequence
  MKO10126477_B_Vsx2
  gRNA
cgcccuccgagccaaagcuc

SEQ ID NO: 126478 - RNA, 20 nt, Artificial Sequence
  MKO10126478_B_Vsx2
  gRNA
acucagccaugacgcugcuc

SEQ ID NO: 126479 - RNA, 20 nt, Artificial Sequence
  MKO10126479_B_Vsx2
  gRNA
ggaauccauuaugccauccu

SEQ ID NO: 126480 - RNA, 20 nt, Artificial Sequence
  MKO10126480_B_Vua1
  gRNA
gcuguuacucaagaaauagu

SEQ ID NO: 126481 - RNA, 20 nt, Artificial Sequence
  MKO10126481_B_Vua1
  gRNA
cugugaugacaucuauuaaa

SEQ ID NO: 126482 - RNA, 20 nt, Artificial Sequence
  MKO10126482_B_Vua1
  gRNA
auucauaacugcuuaaagaa

SEQ ID NO: 126483 - RNA, 20 nt, Artificial Sequence
  MKO10126483_B_Vucn1
  gRNA
augccguugaguuugauguc

SEQ ID NO: 126484 - RNA, 20 nt, Artificial Sequence
  MKO10126484_B_Vucn1
  gRNA
aaagccaaugaugagugcga

SEQ ID NO: 126485 - RNA, 20 nt, Artificial Sequence
  MKO10126485_B_Vucn1
  gRNA
uguuacauccgcaccucaaa

SEQ ID NO: 126486 - RNA, 20 nt, Artificial Sequence
  MKO10126486_B_Vti1a
  gRNA
ugcuauacauuccucgacuu

SEQ ID NO: 126487 - RNA, 20 nt, Artificial Sequence
  MKO10126487_B_Vti1a
  gRNA
gaaauuccaccccaaagucg

SEQ ID NO: 126488 - RNA, 20 nt, Artificial Sequence
  MKO10126488_B_Vti1a
  gRNA
uaccagucuccacugcuauc

SEQ ID NO: 126489 - RNA, 20 nt, Artificial Sequence
  MKO10126489_B_Vti1b
  gRNA
acauugagcgaagaaucuuc

SEQ ID NO: 126490 - RNA, 20 nt, Artificial Sequence
  MKO10126490_B_Vti1b
  gRNA
aaagcauugagcguucucau

SEQ ID NO: 126491 - RNA, 20 nt, Artificial Sequence
  MKO10126491_B_Vti1b
  gRNA
augaaaauuugagcaaaagc

SEQ ID NO: 126492 - RNA, 20 nt, Artificial Sequence
  MKO10126492_B_Vtn
  gRNA
gagcugcugugccgacuaca

SEQ ID NO: 126493 - RNA, 20 nt, Artificial Sequence
  MKO10126493_B_Vtn
  gRNA
cuucacucgcaucaacuguc

SEQ ID NO: 126494 - RNA, 20 nt, Artificial Sequence
  MKO10126494_B_Vtn
  gRNA
aacgcugcaucaacauuguc

SEQ ID NO: 126495 - RNA, 20 nt, Artificial Sequence
  MKO10126495_B_Vwa1
  gRNA
ccauacguuggggugcaaca

SEQ ID NO: 126496 - RNA, 20 nt, Artificial Sequence
  MKO10126496_B_Vwa1
  gRNA
gcgcggagcagcauagagcg

SEQ ID NO: 126497 - RNA, 20 nt, Artificial Sequence
  MKO10126497_B_Vwa1
  gRNA
gaccuggacagaucucgacc

SEQ ID NO: 126498 - RNA, 20 nt, Artificial Sequence
  MKO10126498_B_Vwa2
  gRNA
agagucggagccuugcaguu

SEQ ID NO: 126499 - RNA, 20 nt, Artificial Sequence
  MKO10126499_B_Vwa2
  gRNA
cucaacucgacaggaaguga

SEQ ID NO: 126500 - RNA, 20 nt, Artificial Sequence
  MKO10126500_B_Vwa2
  gRNA
ggccacagcgaucuucccca

SEQ ID NO: 126501 - RNA, 20 nt, Artificial Sequence
  MKO10126501_B_Vwa3a
  gRNA
uacacauguuaaccagaccc

SEQ ID NO: 126502 - RNA, 20 nt, Artificial Sequence
  MKO10126502_B_Vwa3a
  gRNA
cuauugaacucuaucagcag

SEQ ID NO: 126503 - RNA, 20 nt, Artificial Sequence
  MKO10126503_B_Vwa3a
  gRNA
ccauccaccacuucaaguca

SEQ ID NO: 126504 - RNA, 20 nt, Artificial Sequence
  MKO10126504_B_Vwa5a
  gRNA
aaccuuaaauuacgagaaug

SEQ ID NO: 126505 - RNA, 20 nt, Artificial Sequence
  MKO10126505_B_Vwa5a
  gRNA
ggacccuuucaauaccaugc

SEQ ID NO: 126506 - RNA, 20 nt, Artificial Sequence
  MKO10126506_B_Vwa5a
  gRNA
gcacaaguuugaccgggaug

SEQ ID NO: 126507 - RNA, 20 nt, Artificial Sequence
  MKO10126507_B_Vwa5b1
  gRNA
acugugcuauacucgucuau

SEQ ID NO: 126508 - RNA, 20 nt, Artificial Sequence
  MKO10126508_B_Vwa5b1
  gRNA
ccgauggggcugcgucugcu

SEQ ID NO: 126509 - RNA, 20 nt, Artificial Sequence
  MKO10126509_B_Vwa5b1
  gRNA
aauagacgaguauagcacag

SEQ ID NO: 126510 - RNA, 20 nt, Artificial Sequence
  MKO10126510_B_Vwa5b2
  gRNA
gagcggcagcggcguccagc

SEQ ID NO: 126511 - RNA, 20 nt, Artificial Sequence
  MKO10126511_B_Vwa5b2
  gRNA
cgcucaccgacuccugcguc

SEQ ID NO: 126512 - RNA, 20 nt, Artificial Sequence
  MKO10126512_B_Vwa5b2
  gRNA
cuccggggcucugugacgac

SEQ ID NO: 126513 - RNA, 20 nt, Artificial Sequence
  MKO10126513_B_Vwa7
  gRNA
cagccuccugcgaagccgcc

SEQ ID NO: 126514 - RNA, 20 nt, Artificial Sequence
  MKO10126514_B_Vwa7
  gRNA
uuauggugcggggagaaacu

SEQ ID NO: 126515 - RNA, 20 nt, Artificial Sequence
  MKO10126515_B_Vwa7
  gRNA
augcauuccgaaguagccag

SEQ ID NO: 126516 - RNA, 20 nt, Artificial Sequence
  MKO10126516_B_Vwa8
  gRNA
uggaauacaucgcccuguca

SEQ ID NO: 126517 - RNA, 20 nt, Artificial Sequence
  MKO10126517_B_Vwa8
  gRNA
uccaguacugaacaacuugc

SEQ ID NO: 126518 - RNA, 20 nt, Artificial Sequence
  MKO10126518_B_Vwa8
  gRNA
gucuuucucaucggaccucc

SEQ ID NO: 126519 - RNA, 20 nt, Artificial Sequence
  MKO10126519_B_Vwa9
  gRNA
cugauguacaagucuucccc

SEQ ID NO: 126520 - RNA, 20 nt, Artificial Sequence
  MKO10126520_B_Vwa9
  gRNA
uaaguuauaugucaugugca

SEQ ID NO: 126521 - RNA, 20 nt, Artificial Sequence
  MKO10126521_B_Vwa9
  gRNA
acaggaagcacugaguaaca

SEQ ID NO: 126522 - RNA, 20 nt, Artificial Sequence
  MKO10126522_B_Vwc2l
  gRNA
gaagacuauccugcugauga

SEQ ID NO: 126523 - RNA, 20 nt, Artificial Sequence
  MKO10126523_B_Vwc2l
  gRNA
ccuagcccucuccaugugaa

SEQ ID NO: 126524 - RNA, 20 nt, Artificial Sequence
  MKO10126524_B_Vwc2l
  gRNA
aacacagugaacuucauugc

SEQ ID NO: 126525 - RNA, 20 nt, Artificial Sequence
  MKO10126525_B_Vwc2
  gRNA
ucacagcggcaccguucaca

SEQ ID NO: 126526 - RNA, 20 nt, Artificial Sequence
  MKO10126526_B_Vwc2
  gRNA
gcacucaugucucgugcaca

SEQ ID NO: 126527 - RNA, 20 nt, Artificial Sequence
  MKO10126527_B_Vwc2
  gRNA
augucacugcacuuaugaag

SEQ ID NO: 126528 - RNA, 20 nt, Artificial Sequence
  MKO10126528_B_Vwce
  gRNA
gagcaaggggccacuugccc

SEQ ID NO: 126529 - RNA, 20 nt, Artificial Sequence
  MKO10126529_B_Vwce
  gRNA
cacugcgugaacacagaagg

SEQ ID NO: 126530 - RNA, 20 nt, Artificial Sequence
  MKO10126530_B_Vwce
  gRNA
gaugccacucccacagccaa

SEQ ID NO: 126531 - RNA, 20 nt, Artificial Sequence
  MKO10126531_B_Vwde
  gRNA
ggucuugaacagcugaauac

SEQ ID NO: 126532 - RNA, 20 nt, Artificial Sequence
  MKO10126532_B_Vwde
  gRNA
uguaugggcuacugugcuga

SEQ ID NO: 126533 - RNA, 20 nt, Artificial Sequence
  MKO10126533_B_Vwde
  gRNA
aaguacaccuacaaaacacc

SEQ ID NO: 126534 - RNA, 20 nt, Artificial Sequence
  MKO10126534_B_Vwf
  gRNA
guugccauugccaucgauuc

SEQ ID NO: 126535 - RNA, 20 nt, Artificial Sequence
  MKO10126535_B_Vwf
  gRNA
gcggccagaaucgauggcaa

SEQ ID NO: 126536 - RNA, 20 nt, Artificial Sequence
  MKO10126536_B_Vwf
  gRNA
acggcccgaugcagccucuu

SEQ ID NO: 126537 - RNA, 20 nt, Artificial Sequence
  MKO10126537_B_Wac
  gRNA
aaggcugagaguccccucuc

SEQ ID NO: 126538 - RNA, 20 nt, Artificial Sequence
  MKO10126538_B_Wac
  gRNA
aaacagcagagacucaguga

SEQ ID NO: 126539 - RNA, 20 nt, Artificial Sequence
  MKO10126539_B_Wac
  gRNA
ucaaagagucaccccaguag

SEQ ID NO: 126540 - RNA, 20 nt, Artificial Sequence
  MKO10126540_B_Wapal
  gRNA
uuacuuacugugacacgcug

SEQ ID NO: 126541 - RNA, 20 nt, Artificial Sequence
  MKO10126541_B_Wapal
  gRNA
ggggccacuaaaaaucuuuc

SEQ ID NO: 126542 - RNA, 20 nt, Artificial Sequence
  MKO10126542_B_Wapal
  gRNA
aagaagcccauaaguaaaca

SEQ ID NO: 126543 - RNA, 20 nt, Artificial Sequence
  MKO10126543_B_Wap
  gRNA
ggcccucgcucagaaccuag

SEQ ID NO: 126544 - RNA, 20 nt, Artificial Sequence
  MKO10126544_B_Wap
  gRNA
auucugggcacacuccucgu

SEQ ID NO: 126545 - RNA, 20 nt, Artificial Sequence
  MKO10126545_B_Wap
  gRNA
ucugagcgagggccaccucc

SEQ ID NO: 126546 - RNA, 20 nt, Artificial Sequence
  MKO10126546_B_Wars2
  gRNA
cgaaguuucaaccaaaagua

SEQ ID NO: 126547 - RNA, 20 nt, Artificial Sequence
  MKO10126547_B_Wars2
  gRNA
cacagugauauacagcaucg

SEQ ID NO: 126548 - RNA, 20 nt, Artificial Sequence
  MKO10126548_B_Wars2
  gRNA
gauugcagcauuuacaccag

SEQ ID NO: 126549 - RNA, 20 nt, Artificial Sequence
  MKO10126549_B_Wars
  gRNA
agaggugcaggacucgccac

SEQ ID NO: 126550 - RNA, 20 nt, Artificial Sequence
  MKO10126550_B_Wars
  gRNA
uuguggauccauggacggug

SEQ ID NO: 126551 - RNA, 20 nt, Artificial Sequence
  MKO10126551_B_Wars
  gRNA
cugcuuguccgcaccgucca

SEQ ID NO: 126552 - RNA, 20 nt, Artificial Sequence
  MKO10126552_B_Wasf1
  gRNA
uugcaacgaguuaacucuga

SEQ ID NO: 126553 - RNA, 20 nt, Artificial Sequence
  MKO10126553_B_Wasf1
  gRNA
gcaagauauaacgaugagaa

SEQ ID NO: 126554 - RNA, 20 nt, Artificial Sequence
  MKO10126554_B_Wasf1
  gRNA
ugccaagagcaccucaugac

SEQ ID NO: 126555 - RNA, 20 nt, Artificial Sequence
  MKO10126555_B_Wasf2
  gRNA
aggagcgucacagcuguuau

SEQ ID NO: 126556 - RNA, 20 nt, Artificial Sequence
  MKO10126556_B_Wasf2
  gRNA
uaaggacugagauuguuaag

SEQ ID NO: 126557 - RNA, 20 nt, Artificial Sequence
  MKO10126557_B_Wasf2
  gRNA
acaagaauuuguagagucca

SEQ ID NO: 126558 - RNA, 20 nt, Artificial Sequence
  MKO10126558_B_Wasf3
  gRNA
caggaacaaaagcguguaga

SEQ ID NO: 126559 - RNA, 20 nt, Artificial Sequence
  MKO10126559_B_Wasf3
  gRNA
cucuaccauccaagaccagc

SEQ ID NO: 126560 - RNA, 20 nt, Artificial Sequence
  MKO10126560_B_Wasf3
  gRNA
cccuucaagacagaaucgau

SEQ ID NO: 126561 - RNA, 20 nt, Artificial Sequence
  MKO10126561_B_Wash
  gRNA
aacaaaaacgcacacgaugc

SEQ ID NO: 126562 - RNA, 20 nt, Artificial Sequence
  MKO10126562_B_Wash
  gRNA
ugcagagaagaccccguuac

SEQ ID NO: 126563 - RNA, 20 nt, Artificial Sequence
  MKO10126563_B_Wash
  gRNA
uuuguuacugcaccagccag

SEQ ID NO: 126564 - RNA, 20 nt, Artificial Sequence
  MKO10126564_B_Wasl
  gRNA
uuuguauauaauaguccuag

SEQ ID NO: 126565 - RNA, 20 nt, Artificial Sequence
  MKO10126565_B_Wasl
  gRNA
aaaagcaguuacagaccugu

SEQ ID NO: 126566 - RNA, 20 nt, Artificial Sequence
  MKO10126566_B_Wasl
  gRNA
aggacuuacaucuccagcaa

SEQ ID NO: 126567 - RNA, 20 nt, Artificial Sequence
  MKO10126567_B_Was
  gRNA
gaggacucacccucauugau

SEQ ID NO: 126568 - RNA, 20 nt, Artificial Sequence
  MKO10126568_B_Was
  gRNA
cauguauaggacugucaagu

SEQ ID NO: 126569 - RNA, 20 nt, Artificial Sequence
  MKO10126569_B_Was
  gRNA
accaccagcaccaaucaaug

SEQ ID NO: 126570 - RNA, 20 nt, Artificial Sequence
  MKO10126570_B_Wbp11
  gRNA
cugaagaaaaccucagcgua

SEQ ID NO: 126571 - RNA, 20 nt, Artificial Sequence
  MKO10126571_B_Wbp11
  gRNA
aagaccccaaacaaauuauc

SEQ ID NO: 126572 - RNA, 20 nt, Artificial Sequence
  MKO10126572_B_Wbp11
  gRNA
gaacaaaaaacagcgcauga

SEQ ID NO: 126573 - RNA, 20 nt, Artificial Sequence
  MKO10126573_B_Wbp1l
  gRNA
ccgagccaagcaccgccuuc

SEQ ID NO: 126574 - RNA, 20 nt, Artificial Sequence
  MKO10126574_B_Wbp1l
  gRNA
acagauguagcuuugauugu

SEQ ID NO: 126575 - RNA, 20 nt, Artificial Sequence
  MKO10126575_B_Wbp1l
  gRNA
caaagcuacaucugugacac

SEQ ID NO: 126576 - RNA, 20 nt, Artificial Sequence
  MKO10126576_B_Wbp1
  gRNA
acuucaggcgccgcaacagc

SEQ ID NO: 126577 - RNA, 20 nt, Artificial Sequence
  MKO10126577_B_Wbp1
  gRNA
ggggcuggcccuguuccaac

SEQ ID NO: 126578 - RNA, 20 nt, Artificial Sequence
  MKO10126578_B_Wbp1
  gRNA
acaccagaguucauaguagu

SEQ ID NO: 126579 - RNA, 20 nt, Artificial Sequence
  MKO10126579_B_Wbp2nl
  gRNA
auguaguuugcaccaaagau

SEQ ID NO: 126580 - RNA, 20 nt, Artificial Sequence
  MKO10126580_B_Wbp2nl
  gRNA
cccucuuuguaccacuaaag

SEQ ID NO: 126581 - RNA, 20 nt, Artificial Sequence
  MKO10126581_B_Wbp2nl
  gRNA
agucgauagcaccuccuuuc

SEQ ID NO: 126582 - RNA, 20 nt, Artificial Sequence
  MKO10126582_B_Wbp2
  gRNA
gagauuaagcagccgguguu

SEQ ID NO: 126583 - RNA, 20 nt, Artificial Sequence
  MKO10126583_B_Wbp2
  gRNA
uacauuccauuggcgacugg

SEQ ID NO: 126584 - RNA, 20 nt, Artificial Sequence
  MKO10126584_B_Wbp2
  gRNA
augaaguucgcaccaaacac

SEQ ID NO: 126585 - RNA, 20 nt, Artificial Sequence
  MKO10126585_B_Wbp4
  gRNA
guggaaggcgugacagccga

SEQ ID NO: 126586 - RNA, 20 nt, Artificial Sequence
  MKO10126586_B_Wbp4
  gRNA
uacuauuaugaucucaucac

SEQ ID NO: 126587 - RNA, 20 nt, Artificial Sequence
  MKO10126587_B_Wbp4
  gRNA
gguuaccucacugauccucc

SEQ ID NO: 126588 - RNA, 20 nt, Artificial Sequence
  MKO10126588_B_Wbp5
  gRNA
uaaacagaucaucacugcuc

SEQ ID NO: 126589 - RNA, 20 nt, Artificial Sequence
  MKO10126589_B_Wbp5
  gRNA
aaagccggaggaaaagcccg

SEQ ID NO: 126590 - RNA, 20 nt, Artificial Sequence
  MKO10126590_B_Wbp5
  gRNA
uccggcuuuggcucuuccuc

SEQ ID NO: 126591 - RNA, 20 nt, Artificial Sequence
  MKO10126591_B_Wbscr16
  gRNA
ugguggaggaugaaguauac

SEQ ID NO: 126592 - RNA, 20 nt, Artificial Sequence
  MKO10126592_B_Wbscr16
  gRNA
gcaggacuucgauggacagg

SEQ ID NO: 126593 - RNA, 20 nt, Artificial Sequence
  MKO10126593_B_Wbscr16
  gRNA
gcgagagucacaaagugcac

SEQ ID NO: 126594 - RNA, 20 nt, Artificial Sequence
  MKO10126594_B_Wbscr17
  gRNA
uacuugguaggacgauaauc

SEQ ID NO: 126595 - RNA, 20 nt, Artificial Sequence
  MKO10126595_B_Wbscr17
  gRNA
cauacccuucgaugagcccg

SEQ ID NO: 126596 - RNA, 20 nt, Artificial Sequence
  MKO10126596_B_Wbscr17
  gRNA
guccugcuugauguugucga

SEQ ID NO: 126597 - RNA, 20 nt, Artificial Sequence
  MKO10126597_B_Wbscr22
  gRNA
gaccucacccaaugucuaac

SEQ ID NO: 126598 - RNA, 20 nt, Artificial Sequence
  MKO10126598_B_Wbscr22
  gRNA
caagaugacugagcgagcgc

SEQ ID NO: 126599 - RNA, 20 nt, Artificial Sequence
  MKO10126599_B_Wbscr22
  gRNA
cguuucuucagcugcgguuc

SEQ ID NO: 126600 - RNA, 20 nt, Artificial Sequence
  MKO10126600_B_Wbscr27
  gRNA
acacgcagggaccuuugacg

SEQ ID NO: 126601 - RNA, 20 nt, Artificial Sequence
  MKO10126601_B_Wbscr27
  gRNA
gacuuguuugucugacuacc

SEQ ID NO: 126602 - RNA, 20 nt, Artificial Sequence
  MKO10126602_B_Wbscr27
  gRNA
aagguuggauggguuggucc

SEQ ID NO: 126603 - RNA, 20 nt, Artificial Sequence
  MKO10126603_B_Wbscr28
  gRNA
cagacauggaggccgcuccc

SEQ ID NO: 126604 - RNA, 20 nt, Artificial Sequence
  MKO10126604_B_Wbscr28
  gRNA
uagaggcgucucagcagggc

SEQ ID NO: 126605 - RNA, 20 nt, Artificial Sequence
  MKO10126605_B_Wbscr28
  gRNA
cccgcagaagaauucugaga

SEQ ID NO: 126606 - RNA, 20 nt, Artificial Sequence
  MKO10126606_B_Wdfy1
  gRNA
cauaccaccacgacagcagg

SEQ ID NO: 126607 - RNA, 20 nt, Artificial Sequence
  MKO10126607_B_Wdfy1
  gRNA
uccacagaaccauccgagua

SEQ ID NO: 126608 - RNA, 20 nt, Artificial Sequence
  MKO10126608_B_Wdfy1
  gRNA
aaagagacagcggccaguac

SEQ ID NO: 126609 - RNA, 20 nt, Artificial Sequence
  MKO10126609_B_Wdfy2
  gRNA
cuguccauaggucuagacaa

SEQ ID NO: 126610 - RNA, 20 nt, Artificial Sequence
  MKO10126610_B_Wdfy2
  gRNA
uguaccauugucuagaccua

SEQ ID NO: 126611 - RNA, 20 nt, Artificial Sequence
  MKO10126611_B_Wdfy2
  gRNA
gauacuuacaaggcauugca

SEQ ID NO: 126612 - RNA, 20 nt, Artificial Sequence
  MKO10126612_B_Wdfy3
  gRNA
aacgcaagucucccgacuca

SEQ ID NO: 126613 - RNA, 20 nt, Artificial Sequence
  MKO10126613_B_Wdfy3
  gRNA
cuucacucugauugaucucc

SEQ ID NO: 126614 - RNA, 20 nt, Artificial Sequence
  MKO10126614_B_Wdfy3
  gRNA
ccuaacaacaauuaaccugc

SEQ ID NO: 126615 - RNA, 20 nt, Artificial Sequence
  MKO10126615_B_Wdfy4
  gRNA
cuugaacaucgcucuccaaa

SEQ ID NO: 126616 - RNA, 20 nt, Artificial Sequence
  MKO10126616_B_Wdfy4
  gRNA
caagugccuguuguauuucc

SEQ ID NO: 126617 - RNA, 20 nt, Artificial Sequence
  MKO10126617_B_Wdfy4
  gRNA
aaauacaacaggcacuugcu

SEQ ID NO: 126618 - RNA, 20 nt, Artificial Sequence
  MKO10126618_B_Wdhd1
  gRNA
caggcaucggcuaguuguga

SEQ ID NO: 126619 - RNA, 20 nt, Artificial Sequence
  MKO10126619_B_Wdhd1
  gRNA
gguauggaauauaucugauc

SEQ ID NO: 126620 - RNA, 20 nt, Artificial Sequence
  MKO10126620_B_Wdhd1
  gRNA
guccucgaaauguuugcugc

SEQ ID NO: 126621 - RNA, 20 nt, Artificial Sequence
  MKO10126621_B_Wdpcp
  gRNA
guccgugugugcugagcaaa

SEQ ID NO: 126622 - RNA, 20 nt, Artificial Sequence
  MKO10126622_B_Wdpcp
  gRNA
uaugacaagaaagauccauc

SEQ ID NO: 126623 - RNA, 20 nt, Artificial Sequence
  MKO10126623_B_Wdpcp
  gRNA
uuccauuugcucagcacaca

SEQ ID NO: 126624 - RNA, 20 nt, Artificial Sequence
  MKO10126624_B_Wdr11
  gRNA
cauccgcagaagccaagcgc

SEQ ID NO: 126625 - RNA, 20 nt, Artificial Sequence
  MKO10126625_B_Wdr11
  gRNA
uuccacagcacgauguaauu

SEQ ID NO: 126626 - RNA, 20 nt, Artificial Sequence
  MKO10126626_B_Wdr11
  gRNA
ugcauauggaugccauucac

SEQ ID NO: 126627 - RNA, 20 nt, Artificial Sequence
  MKO10126627_B_Wdr12
  gRNA
aaucaaacucgacaugcuug

SEQ ID NO: 126628 - RNA, 20 nt, Artificial Sequence
  MKO10126628_B_Wdr12
  gRNA
cugugacuaggaagagguug

SEQ ID NO: 126629 - RNA, 20 nt, Artificial Sequence
  MKO10126629_B_Wdr12
  gRNA
cgaguuugauuuccuuauca

SEQ ID NO: 126630 - RNA, 20 nt, Artificial Sequence
  MKO10126630_B_Wdr13
  gRNA
ugcgcuucgccaaugacgac

SEQ ID NO: 126631 - RNA, 20 nt, Artificial Sequence
  MKO10126631_B_Wdr13
  gRNA
aaccucggcugacagaucgg

SEQ ID NO: 126632 - RNA, 20 nt, Artificial Sequence
  MKO10126632_B_Wdr13
  gRNA
acuugccucugccaccgacg

SEQ ID NO: 126633 - RNA, 20 nt, Artificial Sequence
  MKO10126633_B_Wdr16
  gRNA
caagggcaaaaucgaagccu

SEQ ID NO: 126634 - RNA, 20 nt, Artificial Sequence
  MKO10126634_B_Wdr16
  gRNA
uaaaucaggugcuccugguc

SEQ ID NO: 126635 - RNA, 20 nt, Artificial Sequence
  MKO10126635_B_Wdr16
  gRNA
cacaggagacguuguuacca

SEQ ID NO: 126636 - RNA, 20 nt, Artificial Sequence
  MKO10126636_B_Wdr17
  gRNA
gcuaaacucgacaacaucaa

SEQ ID NO: 126637 - RNA, 20 nt, Artificial Sequence
  MKO10126637_B_Wdr17
  gRNA
gcuccaggcauguuuauaac

SEQ ID NO: 126638 - RNA, 20 nt, Artificial Sequence
  MKO10126638_B_Wdr17
  gRNA
aaacaaucacggcaauuucc

SEQ ID NO: 126639 - RNA, 20 nt, Artificial Sequence
  MKO10126639_B_Wdr18
  gRNA
ugcuacaggcagacccaucc

SEQ ID NO: 126640 - RNA, 20 nt, Artificial Sequence
  MKO10126640_B_Wdr18
  gRNA
ggccacucacccagcugcac

SEQ ID NO: 126641 - RNA, 20 nt, Artificial Sequence
  MKO10126641_B_Wdr18
  gRNA
auacaagccauuaggugcug

SEQ ID NO: 126642 - RNA, 20 nt, Artificial Sequence
  MKO10126642_B_Wdr19
  gRNA
ggaaacuaccuugcaguaac

SEQ ID NO: 126643 - RNA, 20 nt, Artificial Sequence
  MKO10126643_B_Wdr19
  gRNA
accucaugccauuguccagc

SEQ ID NO: 126644 - RNA, 20 nt, Artificial Sequence
  MKO10126644_B_Wdr19
  gRNA
ucucgaaagauuccuguucu

SEQ ID NO: 126645 - RNA, 20 nt, Artificial Sequence
  MKO10126645_B_Wdr1
  gRNA
agaagcaauguagaauccgc

SEQ ID NO: 126646 - RNA, 20 nt, Artificial Sequence
  MKO10126646_B_Wdr1
  gRNA
uacucacaucgauguuucuu

SEQ ID NO: 126647 - RNA, 20 nt, Artificial Sequence
  MKO10126647_B_Wdr1
  gRNA
uaacugugcugcguucuucg

SEQ ID NO: 126648 - RNA, 20 nt, Artificial Sequence
  MKO10126648_B_Wdr20rt
  gRNA
gaacauguacucguacaaug

SEQ ID NO: 126649 - RNA, 20 nt, Artificial Sequence
  MKO10126649_B_Wdr20rt
  gRNA
gacagcgcucccauugcuuc

SEQ ID NO: 126650 - RNA, 20 nt, Artificial Sequence
  MKO10126650_B_Wdr20rt
  gRNA
guacaggcugcugccgcacu

SEQ ID NO: 126651 - RNA, 20 nt, Artificial Sequence
  MKO10126651_B_Wdr20
  gRNA
cgaccgccucugcuucaaug

SEQ ID NO: 126652 - RNA, 20 nt, Artificial Sequence
  MKO10126652_B_Wdr20
  gRNA
gaccagcaagcuguuuaaug

SEQ ID NO: 126653 - RNA, 20 nt, Artificial Sequence
  MKO10126653_B_Wdr20
  gRNA
ugaguaaacccauagauaag

SEQ ID NO: 126654 - RNA, 20 nt, Artificial Sequence
  MKO10126654_B_Wdr24
  gRNA
acaguagauaauccguaaca

SEQ ID NO: 126655 - RNA, 20 nt, Artificial Sequence
  MKO10126655_B_Wdr24
  gRNA
acccucauuggugacgagug

SEQ ID NO: 126656 - RNA, 20 nt, Artificial Sequence
  MKO10126656_B_Wdr24
  gRNA
caucccgcacgcucucagac

SEQ ID NO: 126657 - RNA, 20 nt, Artificial Sequence
  MKO10126657_B_Wdr25
  gRNA
aaucccaggcgauaaugguu

SEQ ID NO: 126658 - RNA, 20 nt, Artificial Sequence
  MKO10126658_B_Wdr25
  gRNA
cgccacauaaaaagacguug

SEQ ID NO: 126659 - RNA, 20 nt, Artificial Sequence
  MKO10126659_B_Wdr25
  gRNA
caccuaacagaccuugaaac

SEQ ID NO: 126660 - RNA, 20 nt, Artificial Sequence
  MKO10126660_B_Wdr26
  gRNA
cgcucgguguuguauuucaa

SEQ ID NO: 126661 - RNA, 20 nt, Artificial Sequence
  MKO10126661_B_Wdr26
  gRNA
gcagccaugccgaagaccua

SEQ ID NO: 126662 - RNA, 20 nt, Artificial Sequence
  MKO10126662_B_Wdr26
  gRNA
gaucuccucaugcaagaguc

SEQ ID NO: 126663 - RNA, 20 nt, Artificial Sequence
  MKO10126663_B_Wdr27
  gRNA
cucguagaagcagucugugc

SEQ ID NO: 126664 - RNA, 20 nt, Artificial Sequence
  MKO10126664_B_Wdr27
  gRNA
uuauauuauaauguggaacg

SEQ ID NO: 126665 - RNA, 20 nt, Artificial Sequence
  MKO10126665_B_Wdr27
  gRNA
uuuaagcuucucacccuaca

SEQ ID NO: 126666 - RNA, 20 nt, Artificial Sequence
  MKO10126666_B_Wdr31
  gRNA
cucgagaggcgcugaagaac

SEQ ID NO: 126667 - RNA, 20 nt, Artificial Sequence
  MKO10126667_B_Wdr31
  gRNA
ugcagggcuccucgcacccu

SEQ ID NO: 126668 - RNA, 20 nt, Artificial Sequence
  MKO10126668_B_Wdr31
  gRNA
gacucgucccagcugugcac

SEQ ID NO: 126669 - RNA, 20 nt, Artificial Sequence
  MKO10126669_B_Wdr33
  gRNA
gugaccaaucgucuuccuuc

SEQ ID NO: 126670 - RNA, 20 nt, Artificial Sequence
  MKO10126670_B_Wdr33
  gRNA
uuauucaacauuccuauugg

SEQ ID NO: 126671 - RNA, 20 nt, Artificial Sequence
  MKO10126671_B_Wdr33
  gRNA
ucauuauaauaaccugcauc

SEQ ID NO: 126672 - RNA, 20 nt, Artificial Sequence
  MKO10126672_B_Wdr34
  gRNA
uaggcacucaccggcaaugu

SEQ ID NO: 126673 - RNA, 20 nt, Artificial Sequence
  MKO10126673_B_Wdr34
  gRNA
cacagccgagucgucugccc

SEQ ID NO: 126674 - RNA, 20 nt, Artificial Sequence
  MKO10126674_B_Wdr34
  gRNA
cacucaccgaccauaggcac

SEQ ID NO: 126675 - RNA, 20 nt, Artificial Sequence
  MKO10126675_B_Wdr35
  gRNA
auugucuggaugcuguauaa

SEQ ID NO: 126676 - RNA, 20 nt, Artificial Sequence
  MKO10126676_B_Wdr35
  gRNA
cacuaugaccuucaagauuu

SEQ ID NO: 126677 - RNA, 20 nt, Artificial Sequence
  MKO10126677_B_Wdr35
  gRNA
cauggaaagguuacuagggg

SEQ ID NO: 126678 - RNA, 20 nt, Artificial Sequence
  MKO10126678_B_Wdr36
  gRNA
uaauacgaaccucuuuauuc

SEQ ID NO: 126679 - RNA, 20 nt, Artificial Sequence
  MKO10126679_B_Wdr36
  gRNA
ugagauaacgugauccccaa

SEQ ID NO: 126680 - RNA, 20 nt, Artificial Sequence
  MKO10126680_B_Wdr36
  gRNA
cugacagcguucuuauuauu

SEQ ID NO: 126681 - RNA, 20 nt, Artificial Sequence
  MKO10126681_B_Wdr37
  gRNA
gaagcuuaagaccaccuaca

SEQ ID NO: 126682 - RNA, 20 nt, Artificial Sequence
  MKO10126682_B_Wdr37
  gRNA
uguuaguucuucguauagaa

SEQ ID NO: 126683 - RNA, 20 nt, Artificial Sequence
  MKO10126683_B_Wdr37
  gRNA
cucaguucgcaguacacugc

SEQ ID NO: 126684 - RNA, 20 nt, Artificial Sequence
  MKO10126684_B_Wdr38
  gRNA
aagugucuacaugugcugaa

SEQ ID NO: 126685 - RNA, 20 nt, Artificial Sequence
  MKO10126685_B_Wdr38
  gRNA
ugacaguuuccacacuccuc

SEQ ID NO: 126686 - RNA, 20 nt, Artificial Sequence
  MKO10126686_B_Wdr38
  gRNA
ucucucuacagucuggccgc

SEQ ID NO: 126687 - RNA, 20 nt, Artificial Sequence
  MKO10126687_B_Wdr3
  gRNA
caauacauaccucaguucgg

SEQ ID NO: 126688 - RNA, 20 nt, Artificial Sequence
  MKO10126688_B_Wdr3
  gRNA
uugcagauagucgauguccc

SEQ ID NO: 126689 - RNA, 20 nt, Artificial Sequence
  MKO10126689_B_Wdr3
  gRNA
aagcuuuguuucuccgagaa

SEQ ID NO: 126690 - RNA, 20 nt, Artificial Sequence
  MKO10126690_B_Wdr41
  gRNA
uccuccccuagacucgugug

SEQ ID NO: 126691 - RNA, 20 nt, Artificial Sequence
  MKO10126691_B_Wdr41
  gRNA
caaaccagguuugcaucugc

SEQ ID NO: 126692 - RNA, 20 nt, Artificial Sequence
  MKO10126692_B_Wdr41
  gRNA
augauggaauuauaguugug

SEQ ID NO: 126693 - RNA, 20 nt, Artificial Sequence
  MKO10126693_B_Wdr43
  gRNA
cugccgugccaagagccaac

SEQ ID NO: 126694 - RNA, 20 nt, Artificial Sequence
  MKO10126694_B_Wdr43
  gRNA
aaaaggaaaucggaaguuac

SEQ ID NO: 126695 - RNA, 20 nt, Artificial Sequence
  MKO10126695_B_Wdr43
  gRNA
gaaaguaacaucuuuccauc

SEQ ID NO: 126696 - RNA, 20 nt, Artificial Sequence
  MKO10126696_B_Wdr44
  gRNA
ucuugucucaauucuuguac

SEQ ID NO: 126697 - RNA, 20 nt, Artificial Sequence
  MKO10126697_B_Wdr44
  gRNA
gauuuagcaagugcuaccag

SEQ ID NO: 126698 - RNA, 20 nt, Artificial Sequence
  MKO10126698_B_Wdr44
  gRNA
gagacaagauguaucuaaaa

SEQ ID NO: 126699 - RNA, 20 nt, Artificial Sequence
  MKO10126699_B_Wdr45b
  gRNA
gaaaccugcuacaacccuaa

SEQ ID NO: 126700 - RNA, 20 nt, Artificial Sequence
  MKO10126700_B_Wdr45b
  gRNA
acuacuguaccuuuguuggg

SEQ ID NO: 126701 - RNA, 20 nt, Artificial Sequence
  MKO10126701_B_Wdr45b
  gRNA
ugguguuucagugaugaucu

SEQ ID NO: 126702 - RNA, 20 nt, Artificial Sequence
  MKO10126702_B_Wdr45
  gRNA
ccaggaucgugauugugcug

SEQ ID NO: 126703 - RNA, 20 nt, Artificial Sequence
  MKO10126703_B_Wdr45
  gRNA
agaugccccuucuccauaag

SEQ ID NO: 126704 - RNA, 20 nt, Artificial Sequence
  MKO10126704_B_Wdr45
  gRNA
ggaaggaguacacauagaug

SEQ ID NO: 126705 - RNA, 20 nt, Artificial Sequence
  MKO10126705_B_Wdr46
  gRNA
caggcucaggacccguuccc

SEQ ID NO: 126706 - RNA, 20 nt, Artificial Sequence
  MKO10126706_B_Wdr46
  gRNA
cugcaagcagcagcucagcg

SEQ ID NO: 126707 - RNA, 20 nt, Artificial Sequence
  MKO10126707_B_Wdr46
  gRNA
aacucaaagcaaacucgaga

SEQ ID NO: 126708 - RNA, 20 nt, Artificial Sequence
  MKO10126708_B_Wdr47
  gRNA
uuuauuuaggcagcugaucc

SEQ ID NO: 126709 - RNA, 20 nt, Artificial Sequence
  MKO10126709_B_Wdr47
  gRNA
aauuucuccauacauucuag

SEQ ID NO: 126710 - RNA, 20 nt, Artificial Sequence
  MKO10126710_B_Wdr47
  gRNA
uuagaaaaagagccugcaaa

SEQ ID NO: 126711 - RNA, 20 nt, Artificial Sequence
  MKO10126711_B_Wdr48
  gRNA
guacgccaaggauaaagagc

SEQ ID NO: 126712 - RNA, 20 nt, Artificial Sequence
  MKO10126712_B_Wdr48
  gRNA
gaugucgugcucuguugcaa

SEQ ID NO: 126713 - RNA, 20 nt, Artificial Sequence
  MKO10126713_B_Wdr48
  gRNA
uuauguaauucgagaugaag

SEQ ID NO: 126714 - RNA, 20 nt, Artificial Sequence
  MKO10126714_B_Wdr4
  gRNA
uagcaucgagucuuucugcc

SEQ ID NO: 126715 - RNA, 20 nt, Artificial Sequence
  MKO10126715_B_Wdr4
  gRNA
augagaagauccgggucagc

SEQ ID NO: 126716 - RNA, 20 nt, Artificial Sequence
  MKO10126716_B_Wdr4
  gRNA
uccagccugccacauccauc

SEQ ID NO: 126717 - RNA, 20 nt, Artificial Sequence
  MKO10126717_B_Wdr52
  gRNA
gcgagccaaccuacagcuuc

SEQ ID NO: 126718 - RNA, 20 nt, Artificial Sequence
  MKO10126718_B_Wdr52
  gRNA
uacuucgcaguugccgaaaa

SEQ ID NO: 126719 - RNA, 20 nt, Artificial Sequence
  MKO10126719_B_Wdr52
  gRNA
acagcugacucauauaccga

SEQ ID NO: 126720 - RNA, 20 nt, Artificial Sequence
  MKO10126720_B_Wdr53
  gRNA
cccguuaggacacaugcaau

SEQ ID NO: 126721 - RNA, 20 nt, Artificial Sequence
  MKO10126721_B_Wdr53
  gRNA
ucugucucuguagcgucgug

SEQ ID NO: 126722 - RNA, 20 nt, Artificial Sequence
  MKO10126722_B_Wdr53
  gRNA
ucuggaguuuccacccugcg

SEQ ID NO: 126723 - RNA, 20 nt, Artificial Sequence
  MKO10126723_B_Wdr54
  gRNA
caugguuuauuggcacgccu

SEQ ID NO: 126724 - RNA, 20 nt, Artificial Sequence
  MKO10126724_B_Wdr54
  gRNA
aucaaagaccaguacucgac

SEQ ID NO: 126725 - RNA, 20 nt, Artificial Sequence
  MKO10126725_B_Wdr54
  gRNA
caccuguaucccucgaugcg

SEQ ID NO: 126726 - RNA, 20 nt, Artificial Sequence
  MKO10126726_B_Wdr55
  gRNA
augagaaugcucugguuacg

SEQ ID NO: 126727 - RNA, 20 nt, Artificial Sequence
  MKO10126727_B_Wdr55
  gRNA
cuguacuuucaugagggcga

SEQ ID NO: 126728 - RNA, 20 nt, Artificial Sequence
  MKO10126728_B_Wdr55
  gRNA
ucuucaacaucaagagacgc

SEQ ID NO: 126729 - RNA, 20 nt, Artificial Sequence
  MKO10126729_B_Wdr59
  gRNA
gguggaguuucgagacucuc

SEQ ID NO: 126730 - RNA, 20 nt, Artificial Sequence
  MKO10126730_B_Wdr59
  gRNA
ggaaguugguacaacuuuac

SEQ ID NO: 126731 - RNA, 20 nt, Artificial Sequence
  MKO10126731_B_Wdr59
  gRNA
ugccaucuuuccacuuauaa

SEQ ID NO: 126732 - RNA, 20 nt, Artificial Sequence
  MKO10126732_B_Wdr5b
  gRNA
accauccaaccucaucguuu

SEQ ID NO: 126733 - RNA, 20 nt, Artificial Sequence
  MKO10126733_B_Wdr5b
  gRNA
cucagaugauaagacucuaa

SEQ ID NO: 126734 - RNA, 20 nt, Artificial Sequence
  MKO10126734_B_Wdr5b
  gRNA
ucuaccaguaaccgagaaac

SEQ ID NO: 126735 - RNA, 20 nt, Artificial Sequence
  MKO10126735_B_Wdr5
  gRNA
auaguuuggcuuaacuggug

SEQ ID NO: 126736 - RNA, 20 nt, Artificial Sequence
  MKO10126736_B_Wdr5
  gRNA
uuacagacccugagacgaug

SEQ ID NO: 126737 - RNA, 20 nt, Artificial Sequence
  MKO10126737_B_Wdr5
  gRNA
aaguuugagaaaacuauauc

SEQ ID NO: 126738 - RNA, 20 nt, Artificial Sequence
  MKO10126738_B_Wdr60
  gRNA
cucuugagucgagauaugcg

SEQ ID NO: 126739 - RNA, 20 nt, Artificial Sequence
  MKO10126739_B_Wdr60
  gRNA
agcaaguaaaauacgaacug

SEQ ID NO: 126740 - RNA, 20 nt, Artificial Sequence
  MKO10126740_B_Wdr60
  gRNA
ugaccucagaaagcaccuga

SEQ ID NO: 126741 - RNA, 20 nt, Artificial Sequence
  MKO10126741_B_Wdr61
  gRNA
cuccuugacagaguccugau

SEQ ID NO: 126742 - RNA, 20 nt, Artificial Sequence
  MKO10126742_B_Wdr61
  gRNA
uccuuacauaugcaauacua

SEQ ID NO: 126743 - RNA, 20 nt, Artificial Sequence
  MKO10126743_B_Wdr61
  gRNA
ucuaguggaugccuggacuu

SEQ ID NO: 126744 - RNA, 20 nt, Artificial Sequence
  MKO10126744_B_Wdr62
  gRNA
auugggugagaaagccacac

SEQ ID NO: 126745 - RNA, 20 nt, Artificial Sequence
  MKO10126745_B_Wdr62
  gRNA
uuucccuaggugcguggugg

SEQ ID NO: 126746 - RNA, 20 nt, Artificial Sequence
  MKO10126746_B_Wdr62
  gRNA
gaugggaaguacauagugac

SEQ ID NO: 126747 - RNA, 20 nt, Artificial Sequence
  MKO10126747_B_Wdr63
  gRNA
cucgacaguugaauauuucc

SEQ ID NO: 126748 - RNA, 20 nt, Artificial Sequence
  MKO10126748_B_Wdr63
  gRNA
ugaagucuuugucauaaacg

SEQ ID NO: 126749 - RNA, 20 nt, Artificial Sequence
  MKO10126749_B_Wdr63
  gRNA
ugccguccucuguuccaaug

SEQ ID NO: 126750 - RNA, 20 nt, Artificial Sequence
  MKO10126750_B_Wdr64
  gRNA
agauucucuuacuucgcaga

SEQ ID NO: 126751 - RNA, 20 nt, Artificial Sequence
  MKO10126751_B_Wdr64
  gRNA
ugugaucaaaugcauuguga

SEQ ID NO: 126752 - RNA, 20 nt, Artificial Sequence
  MKO10126752_B_Wdr64
  gRNA
aaacagcgaauugugauugc

SEQ ID NO: 126753 - RNA, 20 nt, Artificial Sequence
  MKO10126753_B_Wdr65
  gRNA
uuucccacagccaauagacg

SEQ ID NO: 126754 - RNA, 20 nt, Artificial Sequence
  MKO10126754_B_Wdr65
  gRNA
uuaccuugcugaucuccguc

SEQ ID NO: 126755 - RNA, 20 nt, Artificial Sequence
  MKO10126755_B_Wdr65
  gRNA
cugacucuugaaugaccucc

SEQ ID NO: 126756 - RNA, 20 nt, Artificial Sequence
  MKO10126756_B_Wdr6
  gRNA
gccucucaccgacgcugguu

SEQ ID NO: 126757 - RNA, 20 nt, Artificial Sequence
  MKO10126757_B_Wdr6
  gRNA
uuugugagcuugacaacgau

SEQ ID NO: 126758 - RNA, 20 nt, Artificial Sequence
  MKO10126758_B_Wdr6
  gRNA
gaauucgcccagaguccugc

SEQ ID NO: 126759 - RNA, 20 nt, Artificial Sequence
  MKO10126759_B_Wdr70
  gRNA
ugaugacugugagcgcucuc

SEQ ID NO: 126760 - RNA, 20 nt, Artificial Sequence
  MKO10126760_B_Wdr70
  gRNA
uccagugacaggcgcagaca

SEQ ID NO: 126761 - RNA, 20 nt, Artificial Sequence
  MKO10126761_B_Wdr70
  gRNA
accgaauccugugaagccca

SEQ ID NO: 126762 - RNA, 20 nt, Artificial Sequence
  MKO10126762_B_Wdr72
  gRNA
ucagcagcacucacaacgua

SEQ ID NO: 126763 - RNA, 20 nt, Artificial Sequence
  MKO10126763_B_Wdr72
  gRNA
gauguucucguccuugaugc

SEQ ID NO: 126764 - RNA, 20 nt, Artificial Sequence
  MKO10126764_B_Wdr72
  gRNA
uucggcuucggugacauguu

SEQ ID NO: 126765 - RNA, 20 nt, Artificial Sequence
  MKO10126765_B_Wdr73
  gRNA
cacauuuguauguaacaccc

SEQ ID NO: 126766 - RNA, 20 nt, Artificial Sequence
  MKO10126766_B_Wdr73
  gRNA
caggguguuacauacaaaug

SEQ ID NO: 126767 - RNA, 20 nt, Artificial Sequence
  MKO10126767_B_Wdr73
  gRNA
uucauuugauacuaccucuc

SEQ ID NO: 126768 - RNA, 20 nt, Artificial Sequence
  MKO10126768_B_Wdr74
  gRNA
gcggcaaauuucacaccguc

SEQ ID NO: 126769 - RNA, 20 nt, Artificial Sequence
  MKO10126769_B_Wdr74
  gRNA
cagaauccacacaugugaua

SEQ ID NO: 126770 - RNA, 20 nt, Artificial Sequence
  MKO10126770_B_Wdr74
  gRNA
cagcacccuuaucacaugug

SEQ ID NO: 126771 - RNA, 20 nt, Artificial Sequence
  MKO10126771_B_Wdr75
  gRNA
aagcugugggacuauguuga

SEQ ID NO: 126772 - RNA, 20 nt, Artificial Sequence
  MKO10126772_B_Wdr75
  gRNA
auaaagaaggcguggaguuu

SEQ ID NO: 126773 - RNA, 20 nt, Artificial Sequence
  MKO10126773_B_Wdr75
  gRNA
gagugugugcacauucugca

SEQ ID NO: 126774 - RNA, 20 nt, Artificial Sequence
  MKO10126774_B_Wdr76
  gRNA
ugcuucccuucaguuagcug

SEQ ID NO: 126775 - RNA, 20 nt, Artificial Sequence
  MKO10126775_B_Wdr76
  gRNA
acaguucacugcugucaucu

SEQ ID NO: 126776 - RNA, 20 nt, Artificial Sequence
  MKO10126776_B_Wdr76
  gRNA
cgcgcuucuuuaucauccca

SEQ ID NO: 126777 - RNA, 20 nt, Artificial Sequence
  MKO10126777_B_Wdr77
  gRNA
caacaggugcuguugaauug

SEQ ID NO: 126778 - RNA, 20 nt, Artificial Sequence
  MKO10126778_B_Wdr77
  gRNA
cagcuacuccagccucgguc

SEQ ID NO: 126779 - RNA, 20 nt, Artificial Sequence
  MKO10126779_B_Wdr77
  gRNA
uguguuucuuucauguagug

SEQ ID NO: 126780 - RNA, 20 nt, Artificial Sequence
  MKO10126780_B_Wdr78
  gRNA
aacaacugagucgaugucag

SEQ ID NO: 126781 - RNA, 20 nt, Artificial Sequence
  MKO10126781_B_Wdr78
  gRNA
ggagugccagugcacaacca

SEQ ID NO: 126782 - RNA, 20 nt, Artificial Sequence
  MKO10126782_B_Wdr78
  gRNA
ucgacacugaacugcucccc

SEQ ID NO: 126783 - RNA, 20 nt, Artificial Sequence
  MKO10126783_B_Wdr7
  gRNA
uugucaaaagccugcgcuuc

SEQ ID NO: 126784 - RNA, 20 nt, Artificial Sequence
  MKO10126784_B_Wdr7
  gRNA
cuuacagagagaugugccuc

SEQ ID NO: 126785 - RNA, 20 nt, Artificial Sequence
  MKO10126785_B_Wdr7
  gRNA
auugucaccucugaaaugag

SEQ ID NO: 126786 - RNA, 20 nt, Artificial Sequence
  MKO10126786_B_Wdr81
  gRNA
cagccgacugaacagccgca

SEQ ID NO: 126787 - RNA, 20 nt, Artificial Sequence
  MKO10126787_B_Wdr81
  gRNA
gccccgacacgaugucaccu

SEQ ID NO: 126788 - RNA, 20 nt, Artificial Sequence
  MKO10126788_B_Wdr81
  gRNA
gacaccccuccacugaaugc

SEQ ID NO: 126789 - RNA, 20 nt, Artificial Sequence
  MKO10126789_B_Wdr82
  gRNA
auagggccucaugcaucuac

SEQ ID NO: 126790 - RNA, 20 nt, Artificial Sequence
  MKO10126790_B_Wdr82
  gRNA
gguaccauuaccuggcaguu

SEQ ID NO: 126791 - RNA, 20 nt, Artificial Sequence
  MKO10126791_B_Wdr82
  gRNA
acccuguacaguaagaagua

SEQ ID NO: 126792 - RNA, 20 nt, Artificial Sequence
  MKO10126792_B_Wdr83
  gRNA
ucgauuccaguguccgaugu

SEQ ID NO: 126793 - RNA, 20 nt, Artificial Sequence
  MKO10126793_B_Wdr83
  gRNA
gagaacgacaaucccaacau

SEQ ID NO: 126794 - RNA, 20 nt, Artificial Sequence
  MKO10126794_B_Wdr83
  gRNA
caccguucaguuuaaugaag

SEQ ID NO: 126795 - RNA, 20 nt, Artificial Sequence
  MKO10126795_B_Wdr86
  gRNA
guagugcugacugcaccauc

SEQ ID NO: 126796 - RNA, 20 nt, Artificial Sequence
  MKO10126796_B_Wdr86
  gRNA
cggacagaacugucaagugc

SEQ ID NO: 126797 - RNA, 20 nt, Artificial Sequence
  MKO10126797_B_Wdr86
  gRNA
cgggccuuugaugcccaguc

SEQ ID NO: 126798 - RNA, 20 nt, Artificial Sequence
  MKO10126798_B_Wdr89
  gRNA
uugacgugucuaugccaagc

SEQ ID NO: 126799 - RNA, 20 nt, Artificial Sequence
  MKO10126799_B_Wdr89
  gRNA
ucuuguaagaaucgcugcug

SEQ ID NO: 126800 - RNA, 20 nt, Artificial Sequence
  MKO10126800_B_Wdr89
  gRNA
cugucgacgagagacccacu

SEQ ID NO: 126801 - RNA, 20 nt, Artificial Sequence
  MKO10126801_B_Wdr8
  gRNA
ucccuggcagcugcgaauca

SEQ ID NO: 126802 - RNA, 20 nt, Artificial Sequence
  MKO10126802_B_Wdr8
  gRNA
cugcagaccacucuaugugc

SEQ ID NO: 126803 - RNA, 20 nt, Artificial Sequence
  MKO10126803_B_Wdr8
  gRNA
ccacaggacuaacuuucacc

SEQ ID NO: 126804 - RNA, 20 nt, Artificial Sequence
  MKO10126804_B_Wdr90
  gRNA
augacaauuacauccacguu

SEQ ID NO: 126805 - RNA, 20 nt, Artificial Sequence
  MKO10126805_B_Wdr90
  gRNA
uucauucaagccgucccucu

SEQ ID NO: 126806 - RNA, 20 nt, Artificial Sequence
  MKO10126806_B_Wdr90
  gRNA
uagcucuuccucgugcccgc

SEQ ID NO: 126807 - RNA, 20 nt, Artificial Sequence
  MKO10126807_B_Wdr91
  gRNA
gccgccuuauguuuccagua

SEQ ID NO: 126808 - RNA, 20 nt, Artificial Sequence
  MKO10126808_B_Wdr91
  gRNA
aaaugaaguucugcgccaga

SEQ ID NO: 126809 - RNA, 20 nt, Artificial Sequence
  MKO10126809_B_Wdr91
  gRNA
ggcauuccgcaucaaaguuc

SEQ ID NO: 126810 - RNA, 20 nt, Artificial Sequence
  MKO10126810_B_Wdr92
  gRNA
gcuaacauggaaccugcaca

SEQ ID NO: 126811 - RNA, 20 nt, Artificial Sequence
  MKO10126811_B_Wdr92
  gRNA
aaggccaagcccauuaaaug

SEQ ID NO: 126812 - RNA, 20 nt, Artificial Sequence
  MKO10126812_B_Wdr92
  gRNA
gaagaacguguugucugugc

SEQ ID NO: 126813 - RNA, 20 nt, Artificial Sequence
  MKO10126813_B_Wdr93
  gRNA
cacuuccagccagacauccc

SEQ ID NO: 126814 - RNA, 20 nt, Artificial Sequence
  MKO10126814_B_Wdr93
  gRNA
uccuaccaguugcagcuguu

SEQ ID NO: 126815 - RNA, 20 nt, Artificial Sequence
  MKO10126815_B_Wdr93
  gRNA
gauaaagacuguccuuacac

SEQ ID NO: 126816 - RNA, 20 nt, Artificial Sequence
  MKO10126816_B_Wdr95
  gRNA
gcucuuggugggaacguacc

SEQ ID NO: 126817 - RNA, 20 nt, Artificial Sequence
  MKO10126817_B_Wdr95
  gRNA
gaguucucccuugaugccac

SEQ ID NO: 126818 - RNA, 20 nt, Artificial Sequence
  MKO10126818_B_Wdr95
  gRNA
gcugagaggccaccgggcuc

SEQ ID NO: 126819 - RNA, 20 nt, Artificial Sequence
  MKO10126819_B_Wdr96
  gRNA
ugccgggcugguaggcgaag

SEQ ID NO: 126820 - RNA, 20 nt, Artificial Sequence
  MKO10126820_B_Wdr96
  gRNA
uaaugugcccagugaagucg

SEQ ID NO: 126821 - RNA, 20 nt, Artificial Sequence
  MKO10126821_B_Wdr96
  gRNA
cagaccaucugcuacccuuc

SEQ ID NO: 126822 - RNA, 20 nt, Artificial Sequence
  MKO10126822_B_Wdsub1
  gRNA
cuugaccacaugacgccaac

SEQ ID NO: 126823 - RNA, 20 nt, Artificial Sequence
  MKO10126823_B_Wdsub1
  gRNA
guuacuauuacccgugucuu

SEQ ID NO: 126824 - RNA, 20 nt, Artificial Sequence
  MKO10126824_B_Wdsub1
  gRNA
cacugucaaguccccgcccg

SEQ ID NO: 126825 - RNA, 20 nt, Artificial Sequence
  MKO10126825_B_Wduc1
  gRNA
cacaauggugugcuggucgu

SEQ ID NO: 126826 - RNA, 20 nt, Artificial Sequence
  MKO10126826_B_Wduc1
  gRNA
uuaccugaagcuccgccucc

SEQ ID NO: 126827 - RNA, 20 nt, Artificial Sequence
  MKO10126827_B_Wduc1
  gRNA
acccucagccugcuggcguc

SEQ ID NO: 126828 - RNA, 20 nt, Artificial Sequence
  MKO10126828_B_Wdyhv1
  gRNA
ucuucuauguaaaugucgaa

SEQ ID NO: 126829 - RNA, 20 nt, Artificial Sequence
  MKO10126829_B_Wdyhv1
  gRNA
ggccaucuuacccagaucac

SEQ ID NO: 126830 - RNA, 20 nt, Artificial Sequence
  MKO10126830_B_Wdyhv1
  gRNA
agcacuccuccaacagauac

SEQ ID NO: 126831 - RNA, 20 nt, Artificial Sequence
  MKO10126831_B_Wee1
  gRNA
ucguucgcuauuucucugcc

SEQ ID NO: 126832 - RNA, 20 nt, Artificial Sequence
  MKO10126832_B_Wee1
  gRNA
uacaacugaauuucaugagc

SEQ ID NO: 126833 - RNA, 20 nt, Artificial Sequence
  MKO10126833_B_Wee1
  gRNA
aucuucaaacucauaaucac

SEQ ID NO: 126834 - RNA, 20 nt, Artificial Sequence
  MKO10126834_B_Wee2
  gRNA
cagucuacaagugcauuaag

SEQ ID NO: 126835 - RNA, 20 nt, Artificial Sequence
  MKO10126835_B_Wee2
  gRNA
cccgaagcucuagacauaug

SEQ ID NO: 126836 - RNA, 20 nt, Artificial Sequence
  MKO10126836_B_Wee2
  gRNA
uauucuacaagaaacuaaua

SEQ ID NO: 126837 - RNA, 20 nt, Artificial Sequence
  MKO10126837_B_Wfdc10
  gRNA
cggcugcacagauaccguuu

SEQ ID NO: 126838 - RNA, 20 nt, Artificial Sequence
  MKO10126838_B_Wfdc10
  gRNA
aucugcugcuccgcugcaug

SEQ ID NO: 126839 - RNA, 20 nt, Artificial Sequence
  MKO10126839_B_Wfdc10
  gRNA
gacuaugucuacccagagag

SEQ ID NO: 126840 - RNA, 20 nt, Artificial Sequence
  MKO10126840_B_Wfdc11
  gRNA
acacuucuugacgcagucau

SEQ ID NO: 126841 - RNA, 20 nt, Artificial Sequence
  MKO10126841_B_Wfdc11
  gRNA
ugcacagauguuaccacagu

SEQ ID NO: 126842 - RNA, 20 nt, Artificial Sequence
  MKO10126842_B_Wfdc11
  gRNA
gguaacaucugugcagaaaa

SEQ ID NO: 126843 - RNA, 20 nt, Artificial Sequence
  MKO10126843_B_Wfdc12
  gRNA
augaggaccaagauacuguu

SEQ ID NO: 126844 - RNA, 20 nt, Artificial Sequence
  MKO10126844_B_Wfdc12
  gRNA
agauaucacaccuuacucug

SEQ ID NO: 126845 - RNA, 20 nt, Artificial Sequence
  MKO10126845_B_Wfdc12
  gRNA
uagacagaucccucagagua

SEQ ID NO: 126846 - RNA, 20 nt, Artificial Sequence
  MKO10126846_B_Wfdc13
  gRNA
gucaccuuugcagcuccugc

SEQ ID NO: 126847 - RNA, 20 nt, Artificial Sequence
  MKO10126847_B_Wfdc13
  gRNA
cuucauuccagaguacaucc

SEQ ID NO: 126848 - RNA, 20 nt, Artificial Sequence
  MKO10126848_B_Wfdc13
  gRNA
gaacagcacugaagcgguuc

SEQ ID NO: 126849 - RNA, 20 nt, Artificial Sequence
  MKO10126849_B_Wfdc15a
  gRNA
ugguuguugugaacaguagg

SEQ ID NO: 126850 - RNA, 20 nt, Artificial Sequence
  MKO10126850_B_Wfdc15a
  gRNA
ugcccuugcacccuuuauca

SEQ ID NO: 126851 - RNA, 20 nt, Artificial Sequence
  MKO10126851_B_Wfdc15a
  gRNA
uccggacaguaccccuguuu

SEQ ID NO: 126852 - RNA, 20 nt, Artificial Sequence
  MKO10126852_B_Wfdc15b
  gRNA
ucuugggagaugaagcugcu

SEQ ID NO: 126853 - RNA, 20 nt, Artificial Sequence
  MKO10126853_B_Wfdc15b
  gRNA
ccuuuaucacgccugcauuu

SEQ ID NO: 126854 - RNA, 20 nt, Artificial Sequence
  MKO10126854_B_Wfdc15b
  gRNA
uccaugggagagcccagaau

SEQ ID NO: 126855 - RNA, 20 nt, Artificial Sequence
  MKO10126855_B_Wfdc16
  gRNA
gagugacuugccacuucaug

SEQ ID NO: 126856 - RNA, 20 nt, Artificial Sequence
  MKO10126856_B_Wfdc16
  gRNA
accuacuguaaucuugaauu

SEQ ID NO: 126857 - RNA, 20 nt, Artificial Sequence
  MKO10126857_B_Wfdc16
  gRNA
caaagccaaaccauacaauc

SEQ ID NO: 126858 - RNA, 20 nt, Artificial Sequence
  MKO10126858_B_Wfdc17
  gRNA
uauguagugucuugccccaa

SEQ ID NO: 126859 - RNA, 20 nt, Artificial Sequence
  MKO10126859_B_Wfdc17
  gRNA
aagccuucaccagaaagugu

SEQ ID NO: 126860 - RNA, 20 nt, Artificial Sequence
  MKO10126860_B_Wfdc17
  gRNA
gacagccacagucuuguuuc

SEQ ID NO: 126861 - RNA, 20 nt, Artificial Sequence
  MKO10126861_B_Wfdc18
  gRNA
uuugggguuagacagagccc

SEQ ID NO: 126862 - RNA, 20 nt, Artificial Sequence
  MKO10126862_B_Wfdc18
  gRNA
ggcggcuuaggacaagcgcc

SEQ ID NO: 126863 - RNA, 20 nt, Artificial Sequence
  MKO10126863_B_Wfdc18
  gRNA
ucacaaguuccaaaacugcg

SEQ ID NO: 126864 - RNA, 20 nt, Artificial Sequence
  MKO10126864_B_Wfdc1
  gRNA
ccguugccacccagccaucg

SEQ ID NO: 126865 - RNA, 20 nt, Artificial Sequence
  MKO10126865_B_Wfdc1
  gRNA
accgcugcccaccaccgcca

SEQ ID NO: 126866 - RNA, 20 nt, Artificial Sequence
  MKO10126866_B_Wfdc1
  gRNA
gcccagggcauacccaacca

SEQ ID NO: 126867 - RNA, 20 nt, Artificial Sequence
  MKO10126867_B_Wfdc2
  gRNA
gagcuuggguauguccacgc

SEQ ID NO: 126868 - RNA, 20 nt, Artificial Sequence
  MKO10126868_B_Wfdc2
  gRNA
ucggacaccuaagccuuccc

SEQ ID NO: 126869 - RNA, 20 nt, Artificial Sequence
  MKO10126869_B_Wfdc2
  gRNA
aacaugaaaugcugccgcaa

SEQ ID NO: 126870 - RNA, 20 nt, Artificial Sequence
  MKO10126870_B_Wfdc3
  gRNA
ugacuuacagcaccuuuccc

SEQ ID NO: 126871 - RNA, 20 nt, Artificial Sequence
  MKO10126871_B_Wfdc3
  gRNA
cuggcaucuuggguagcugc

SEQ ID NO: 126872 - RNA, 20 nt, Artificial Sequence
  MKO10126872_B_Wfdc3
  gRNA
cugcagcuacccaagaugcc

SEQ ID NO: 126873 - RNA, 20 nt, Artificial Sequence
  MKO10126873_B_Wfdc5
  gRNA
ugguugcagaguccaucguc

SEQ ID NO: 126874 - RNA, 20 nt, Artificial Sequence
  MKO10126874_B_Wfdc5
  gRNA
gcaagugagucuccaaagcc

SEQ ID NO: 126875 - RNA, 20 nt, Artificial Sequence
  MKO10126875_B_Wfdc5
  gRNA
aguccagagcucccuccucc

SEQ ID NO: 126876 - RNA, 20 nt, Artificial Sequence
  MKO10126876_B_Wfdc6a
  gRNA
auuucuucccacagcugaac

SEQ ID NO: 126877 - RNA, 20 nt, Artificial Sequence
  MKO10126877_B_Wfdc6a
  gRNA
aagaaacccucugccagcuc

SEQ ID NO: 126878 - RNA, 20 nt, Artificial Sequence
  MKO10126878_B_Wfdc6a
  gRNA
ccaggaaccugagcuggcag

SEQ ID NO: 126879 - RNA, 20 nt, Artificial Sequence
  MKO10126879_B_Wfdc6b
  gRNA
auuuccucccacaggcgaac

SEQ ID NO: 126880 - RNA, 20 nt, Artificial Sequence
  MKO10126880_B_Wfdc6b
  gRNA
gaugaauucgauacaaagcu

SEQ ID NO: 126881 - RNA, 20 nt, Artificial Sequence
  MKO10126881_B_Wfdc6b
  gRNA
ccaggaaccugcgcuggcag

SEQ ID NO: 126882 - RNA, 20 nt, Artificial Sequence
  MKO10126882_B_Wfdc8
  gRNA
gacgcacgcacguuugaucu

SEQ ID NO: 126883 - RNA, 20 nt, Artificial Sequence
  MKO10126883_B_Wfdc8
  gRNA
agcguuucuacagucagucu

SEQ ID NO: 126884 - RNA, 20 nt, Artificial Sequence
  MKO10126884_B_Wfdc8
  gRNA
cugcauuccaaccgcugccu

SEQ ID NO: 126885 - RNA, 20 nt, Artificial Sequence
  MKO10126885_B_Wfdc9
  gRNA
cugguguuucugcacguucu

SEQ ID NO: 126886 - RNA, 20 nt, Artificial Sequence
  MKO10126886_B_Wfdc9
  gRNA
acuuucaucaguguuucaaa

SEQ ID NO: 126887 - RNA, 20 nt, Artificial Sequence
  MKO10126887_B_Wfdc9
  gRNA
cacagucuaccaugaagccu

SEQ ID NO: 126888 - RNA, 20 nt, Artificial Sequence
  MKO10126888_B_Wfikkn1
  gRNA
ugcucugggcgucgacccac

SEQ ID NO: 126889 - RNA, 20 nt, Artificial Sequence
  MKO10126889_B_Wfikkn1
  gRNA
caaccacguugccauacauu

SEQ ID NO: 126890 - RNA, 20 nt, Artificial Sequence
  MKO10126890_B_Wfikkn1
  gRNA
cccaacgugacagcugucga

SEQ ID NO: 126891 - RNA, 20 nt, Artificial Sequence
  MKO10126891_B_Wfikkn2
  gRNA
aucaucgguucugguuucac

SEQ ID NO: 126892 - RNA, 20 nt, Artificial Sequence
  MKO10126892_B_Wfikkn2
  gRNA
agcgacauuucgagcuguac

SEQ ID NO: 126893 - RNA, 20 nt, Artificial Sequence
  MKO10126893_B_Wfikkn2
  gRNA
gaaaaccugugacguccuca

SEQ ID NO: 126894 - RNA, 20 nt, Artificial Sequence
  MKO10126894_B_Wfs1
  gRNA
gauccccuuugaagaagucc

SEQ ID NO: 126895 - RNA, 20 nt, Artificial Sequence
  MKO10126895_B_Wfs1
  gRNA
gcuauccucugagaccgacc

SEQ ID NO: 126896 - RNA, 20 nt, Artificial Sequence
  MKO10126896_B_Wfs1
  gRNA
acagauggaggggcgcagcc

SEQ ID NO: 126897 - RNA, 20 nt, Artificial Sequence
  MKO10126897_B_Whamm
  gRNA
ugagcuggguccuagaaggg

SEQ ID NO: 126898 - RNA, 20 nt, Artificial Sequence
  MKO10126898_B_Whamm
  gRNA
guugcaacuucauguaagcu

SEQ ID NO: 126899 - RNA, 20 nt, Artificial Sequence
  MKO10126899_B_Whamm
  gRNA
aucucaagcucauguuagcu

SEQ ID NO: 126900 - RNA, 20 nt, Artificial Sequence
  MKO10126900_B_Whrn
  gRNA
gaaagcgucgccaacucagc

SEQ ID NO: 126901 - RNA, 20 nt, Artificial Sequence
  MKO10126901_B_Whrn
  gRNA
cugcuccaccucggaucgug

SEQ ID NO: 126902 - RNA, 20 nt, Artificial Sequence
  MKO10126902_B_Whrn
  gRNA
uccuugggccucacgauccg

SEQ ID NO: 126903 - RNA, 20 nt, Artificial Sequence
  MKO10126903_B_Whsc1l1
  gRNA
ccaaggguagguucccaccu

SEQ ID NO: 126904 - RNA, 20 nt, Artificial Sequence
  MKO10126904_B_Whsc1l1
  gRNA
uucaagugauccccagcuug

SEQ ID NO: 126905 - RNA, 20 nt, Artificial Sequence
  MKO10126905_B_Whsc1l1
  gRNA
ggguucaugagaaacgggua

SEQ ID NO: 126906 - RNA, 20 nt, Artificial Sequence
  MKO10126906_B_Whsc1
  gRNA
cucuuguuaaaauacaacgu

SEQ ID NO: 126907 - RNA, 20 nt, Artificial Sequence
  MKO10126907_B_Whsc1
  gRNA
ucaacuuucuaacagccuac

SEQ ID NO: 126908 - RNA, 20 nt, Artificial Sequence
  MKO10126908_B_Whsc1
  gRNA
ggggucaugcagaaauuuaa

SEQ ID NO: 126909 - RNA, 20 nt, Artificial Sequence
  MKO10126909_B_Wibg
  gRNA
gccggucucgucaguuacau

SEQ ID NO: 126910 - RNA, 20 nt, Artificial Sequence
  MKO10126910_B_Wibg
  gRNA
gacguggcgaaagcagcgga

SEQ ID NO: 126911 - RNA, 20 nt, Artificial Sequence
  MKO10126911_B_Wibg
  gRNA
cccuauguaacugacgagac

SEQ ID NO: 126912 - RNA, 20 nt, Artificial Sequence
  MKO10126912_B_Wif1
  gRNA
auucugagggguccuaagga

SEQ ID NO: 126913 - RNA, 20 nt, Artificial Sequence
  MKO10126913_B_Wif1
  gRNA
acagugccucacaaggcauc

SEQ ID NO: 126914 - RNA, 20 nt, Artificial Sequence
  MKO10126914_B_Wif1
  gRNA
cccccuuuacacaugauuuc

SEQ ID NO: 126915 - RNA, 20 nt, Artificial Sequence
  MKO10126915_B_Wipf1
  gRNA
cccuccacaucaguucgaaa

SEQ ID NO: 126916 - RNA, 20 nt, Artificial Sequence
  MKO10126916_B_Wipf1
  gRNA
agcugagguccaccgccaac

SEQ ID NO: 126917 - RNA, 20 nt, Artificial Sequence
  MKO10126917_B_Wipf1
  gRNA
aauaguccucccaguccugg

SEQ ID NO: 126918 - RNA, 20 nt, Artificial Sequence
  MKO10126918_B_Wipf2
  gRNA
ucugacccaugcauccggua

SEQ ID NO: 126919 - RNA, 20 nt, Artificial Sequence
  MKO10126919_B_Wipf2
  gRNA
agugccgaagcuccgaccug

SEQ ID NO: 126920 - RNA, 20 nt, Artificial Sequence
  MKO10126920_B_Wipf2
  gRNA
aggugaccaacguuaaugau

SEQ ID NO: 126921 - RNA, 20 nt, Artificial Sequence
  MKO10126921_B_Wipf3
  gRNA
ccgcagugccccacagaucg

SEQ ID NO: 126922 - RNA, 20 nt, Artificial Sequence
  MKO10126922_B_Wipf3
  gRNA
acaggucuuaccggaggccc

SEQ ID NO: 126923 - RNA, 20 nt, Artificial Sequence
  MKO10126923_B_Wipf3
  gRNA
ggaggggguggcgccccaag

SEQ ID NO: 126924 - RNA, 20 nt, Artificial Sequence
  MKO10126924_B_Wipi1
  gRNA
aaucccugacguguauaucg

SEQ ID NO: 126925 - RNA, 20 nt, Artificial Sequence
  MKO10126925_B_Wipi1
  gRNA
acucuaugauggaaacuccc

SEQ ID NO: 126926 - RNA, 20 nt, Artificial Sequence
  MKO10126926_B_Wipi1
  gRNA
guacaaucucgccuguacuc

SEQ ID NO: 126927 - RNA, 20 nt, Artificial Sequence
  MKO10126927_B_Wipi2
  gRNA
ggucuucgacaccauuaacu

SEQ ID NO: 126928 - RNA, 20 nt, Artificial Sequence
  MKO10126928_B_Wipi2
  gRNA
cgcucuacauacacaacauc

SEQ ID NO: 126929 - RNA, 20 nt, Artificial Sequence
  MKO10126929_B_Wipi2
  gRNA
cagcuacuccaacacuaucc

SEQ ID NO: 126930 - RNA, 20 nt, Artificial Sequence
  MKO10126930_B_Wisp1
  gRNA
gccacgaacuucacucucgc

SEQ ID NO: 126931 - RNA, 20 nt, Artificial Sequence
  MKO10126931_B_Wisp1
  gRNA
ccccacuguaaucgcaguag

SEQ ID NO: 126932 - RNA, 20 nt, Artificial Sequence
  MKO10126932_B_Wisp1
  gRNA
uacagcagcgucaggcgccg

SEQ ID NO: 126933 - RNA, 20 nt, Artificial Sequence
  MKO10126933_B_Wisp2
  gRNA
gcugucgagugugugcacgg

SEQ ID NO: 126934 - RNA, 20 nt, Artificial Sequence
  MKO10126934_B_Wisp2
  gRNA
uugccggcugcaucacugcc

SEQ ID NO: 126935 - RNA, 20 nt, Artificial Sequence
  MKO10126935_B_Wisp2
  gRNA
gguacccccggugggcacug

SEQ ID NO: 126936 - RNA, 20 nt, Artificial Sequence
  MKO10126936_B_Wisp3
  gRNA
gcugaaauacuuggccauuc

SEQ ID NO: 126937 - RNA, 20 nt, Artificial Sequence
  MKO10126937_B_Wisp3
  gRNA
guuccccggccacaguuugg

SEQ ID NO: 126938 - RNA, 20 nt, Artificial Sequence
  MKO10126938_B_Wisp3
  gRNA
ccacuuaaaugacccuucac

SEQ ID NO: 126939 - RNA, 20 nt, Artificial Sequence
  MKO10126939_B_Wiz
  gRNA
ucugcuucaccagcucguag

SEQ ID NO: 126940 - RNA, 20 nt, Artificial Sequence
  MKO10126940_B_Wiz
  gRNA
aucuucucgaggcgugcccc

SEQ ID NO: 126941 - RNA, 20 nt, Artificial Sequence
  MKO10126941_B_Wiz
  gRNA
gcugccccggaucauccucg

SEQ ID NO: 126942 - RNA, 20 nt, Artificial Sequence
  MKO10126942_B_Wls
  gRNA
uaauaacgaccuucgugcuc

SEQ ID NO: 126943 - RNA, 20 nt, Artificial Sequence
  MKO10126943_B_Wls
  gRNA
gucccgaccuccagugcuuc

SEQ ID NO: 126944 - RNA, 20 nt, Artificial Sequence
  MKO10126944_B_Wls
  gRNA
aaaguacauuugaguuuacg

SEQ ID NO: 126945 - RNA, 20 nt, Artificial Sequence
  MKO10126945_B_Wnk1
  gRNA
uuggucuggcaacucuaaag

SEQ ID NO: 126946 - RNA, 20 nt, Artificial Sequence
  MKO10126946_B_Wnk1
  gRNA
ccgaucuugacugagccagu

SEQ ID NO: 126947 - RNA, 20 nt, Artificial Sequence
  MKO10126947_B_Wnk1
  gRNA
aucauagaaucgaacaaugu

SEQ ID NO: 126948 - RNA, 20 nt, Artificial Sequence
  MKO10126948_B_Wnk2
  gRNA
uucauccuugcgugcgcgcc

SEQ ID NO: 126949 - RNA, 20 nt, Artificial Sequence
  MKO10126949_B_Wnk2
  gRNA
ucaucaccuugaaccgcuuc

SEQ ID NO: 126950 - RNA, 20 nt, Artificial Sequence
  MKO10126950_B_Wnk2
  gRNA
aggugaccuugcgauagauc

SEQ ID NO: 126951 - RNA, 20 nt, Artificial Sequence
  MKO10126951_B_Wnk3
  gRNA
uacaggcacuccugaauuua

SEQ ID NO: 126952 - RNA, 20 nt, Artificial Sequence
  MKO10126952_B_Wnk3
  gRNA
ccagcucuauaucgaauuuc

SEQ ID NO: 126953 - RNA, 20 nt, Artificial Sequence
  MKO10126953_B_Wnk3
  gRNA
uugcaacuuccccuaguggc

SEQ ID NO: 126954 - RNA, 20 nt, Artificial Sequence
  MKO10126954_B_Wnk4
  gRNA
aaaggaggcgcgcuugagcg

SEQ ID NO: 126955 - RNA, 20 nt, Artificial Sequence
  MKO10126955_B_Wnk4
  gRNA
ucauuucgcggaaccgccuc

SEQ ID NO: 126956 - RNA, 20 nt, Artificial Sequence
  MKO10126956_B_Wnk4
  gRNA
guacgaggaaaaguacgacg

SEQ ID NO: 126957 - RNA, 20 nt, Artificial Sequence
  MKO10126957_B_Wnt10a
  gRNA
cugugagcgcgagccgcgcc

SEQ ID NO: 126958 - RNA, 20 nt, Artificial Sequence
  MKO10126958_B_Wnt10a
  gRNA
gugugugcgucacccugacg

SEQ ID NO: 126959 - RNA, 20 nt, Artificial Sequence
  MKO10126959_B_Wnt10a
  gRNA
gucagcacccaacgacaucc

SEQ ID NO: 126960 - RNA, 20 nt, Artificial Sequence
  MKO10126960_B_Wnt10b
  gRNA
ucucuccgaaguccaugucg

SEQ ID NO: 126961 - RNA, 20 nt, Artificial Sequence
  MKO10126961_B_Wnt10b
  gRNA
ggcgucccacccuguuguug

SEQ ID NO: 126962 - RNA, 20 nt, Artificial Sequence
  MKO10126962_B_Wnt10b
  gRNA
cacagcgccauccucaagcg

SEQ ID NO: 126963 - RNA, 20 nt, Artificial Sequence
  MKO10126963_B_Wnt11
  gRNA
guguagacgcaucaguuuau

SEQ ID NO: 126964 - RNA, 20 nt, Artificial Sequence
  MKO10126964_B_Wnt11
  gRNA
gcaccaucgugcacgccgcc

SEQ ID NO: 126965 - RNA, 20 nt, Artificial Sequence
  MKO10126965_B_Wnt11
  gRNA
ccgcuaccugucagccacga

SEQ ID NO: 126966 - RNA, 20 nt, Artificial Sequence
  MKO10126966_B_Wnt16
  gRNA
ugcugaaccacaugccguac

SEQ ID NO: 126967 - RNA, 20 nt, Artificial Sequence
  MKO10126967_B_Wnt16
  gRNA
guugccugcacugcaugacc

SEQ ID NO: 126968 - RNA, 20 nt, Artificial Sequence
  MKO10126968_B_Wnt16
  gRNA
gcuacaacacccauguaguc

SEQ ID NO: 126969 - RNA, 20 nt, Artificial Sequence
  MKO10126969_B_Wnt1
  gRNA
ggaucagucgccgcugcuug

SEQ ID NO: 126970 - RNA, 20 nt, Artificial Sequence
  MKO10126970_B_Wnt1
  gRNA
gucgcaggugcaggacucga

SEQ ID NO: 126971 - RNA, 20 nt, Artificial Sequence
  MKO10126971_B_Wnt1
  gRNA
aguccugcaccugcgacuac

SEQ ID NO: 126972 - RNA, 20 nt, Artificial Sequence
  MKO10126972_B_Wnt2b
  gRNA
caauuucacagcagcgcgcc

SEQ ID NO: 126973 - RNA, 20 nt, Artificial Sequence
  MKO10126973_B_Wnt2b
  gRNA
cucucagacuuccgacgcac

SEQ ID NO: 126974 - RNA, 20 nt, Artificial Sequence
  MKO10126974_B_Wnt2b
  gRNA
ccagacaucaugcgcucagu

SEQ ID NO: 126975 - RNA, 20 nt, Artificial Sequence
  MKO10126975_B_Wnt2
  gRNA
gugugcaacuugacuucccg

SEQ ID NO: 126976 - RNA, 20 nt, Artificial Sequence
  MKO10126976_B_Wnt2
  gRNA
uguugcaguuccagcgaugc

SEQ ID NO: 126977 - RNA, 20 nt, Artificial Sequence
  MKO10126977_B_Wnt2
  gRNA
aaacaggcgacuaucucugg

SEQ ID NO: 126978 - RNA, 20 nt, Artificial Sequence
  MKO10126978_B_Wnt3a
  gRNA
cucugggcagcuacccgauc

SEQ ID NO: 126979 - RNA, 20 nt, Artificial Sequence
  MKO10126979_B_Wnt3a
  gRNA
agcacuaagagguauccgag

SEQ ID NO: 126980 - RNA, 20 nt, Artificial Sequence
  MKO10126980_B_Wnt3a
  gRNA
gggugucaaagcgggcaucc

SEQ ID NO: 126981 - RNA, 20 nt, Artificial Sequence
  MKO10126981_B_Wnt3
  gRNA
gaucgcagccaucgaugccg

SEQ ID NO: 126982 - RNA, 20 nt, Artificial Sequence
  MKO10126982_B_Wnt3
  gRNA
cgaggcgauggcaugcacga

SEQ ID NO: 126983 - RNA, 20 nt, Artificial Sequence
  MKO10126983_B_Wnt3
  gRNA
gcaugaucucgauguaauug

SEQ ID NO: 126984 - RNA, 20 nt, Artificial Sequence
  MKO10126984_B_Wnt4
  gRNA
ugcucggacaacaucgccua

SEQ ID NO: 126985 - RNA, 20 nt, Artificial Sequence
  MKO10126985_B_Wnt4
  gRNA
ggcugaccccgugcacuguc

SEQ ID NO: 126986 - RNA, 20 nt, Artificial Sequence
  MKO10126986_B_Wnt4
  gRNA
cugguauuggcacuccucga

SEQ ID NO: 126987 - RNA, 20 nt, Artificial Sequence
  MKO10126987_B_Wnt5a
  gRNA
ucguugcgcacacaguaguc

SEQ ID NO: 126988 - RNA, 20 nt, Artificial Sequence
  MKO10126988_B_Wnt5a
  gRNA
ugcaguuccaucuccgaugc

SEQ ID NO: 126989 - RNA, 20 nt, Artificial Sequence
  MKO10126989_B_Wnt5a
  gRNA
gaaacucugccacuuguauc

SEQ ID NO: 126990 - RNA, 20 nt, Artificial Sequence
  MKO10126990_B_Wnt5b
  gRNA
uccagcgccucugucgaaac

SEQ ID NO: 126991 - RNA, 20 nt, Artificial Sequence
  MKO10126991_B_Wnt5b
  gRNA
guggcugcagccgugcugcg

SEQ ID NO: 126992 - RNA, 20 nt, Artificial Sequence
  MKO10126992_B_Wnt5b
  gRNA
acguaugcagugagcgccgc

SEQ ID NO: 126993 - RNA, 20 nt, Artificial Sequence
  MKO10126993_B_Wnt6
  gRNA
ccacaguccaucgacgugcg

SEQ ID NO: 126994 - RNA, 20 nt, Artificial Sequence
  MKO10126994_B_Wnt6
  gRNA
gccuaggcggugcccgcccg

SEQ ID NO: 126995 - RNA, 20 nt, Artificial Sequence
  MKO10126995_B_Wnt6
  gRNA
cccgcgggcgggcaccgccu

SEQ ID NO: 126996 - RNA, 20 nt, Artificial Sequence
  MKO10126996_B_Wnt7a
  gRNA
uaacacgugcagcgagcgca

SEQ ID NO: 126997 - RNA, 20 nt, Artificial Sequence
  MKO10126997_B_Wnt7a
  gRNA
acugaaacugacacucgucc

SEQ ID NO: 126998 - RNA, 20 nt, Artificial Sequence
  MKO10126998_B_Wnt7a
  gRNA
caccuaugcgauuaucgcug

SEQ ID NO: 126999 - RNA, 20 nt, Artificial Sequence
  MKO10126999_B_Wnt7b
  gRNA
cgccacgcccgccgccguga

SEQ ID NO: 127000 - RNA, 20 nt, Artificial Sequence
  MKO10127000_B_Wnt7b
  gRNA
acggagaccagcgcgcugcg

SEQ ID NO: 127001 - RNA, 20 nt, Artificial Sequence
  MKO10127001_B_Wnt7b
  gRNA
ccgcuggaacugcuccgccc

SEQ ID NO: 127002 - RNA, 20 nt, Artificial Sequence
  MKO10127002_B_Wnt8a
  gRNA
acuggcgguguaggucagau

SEQ ID NO: 127003 - RNA, 20 nt, Artificial Sequence
  MKO10127003_B_Wnt8a
  gRNA
ugccggcccuguuguuguga

SEQ ID NO: 127004 - RNA, 20 nt, Artificial Sequence
  MKO10127004_B_Wnt8a
  gRNA
ggcugugacgagucacaaaa

SEQ ID NO: 127005 - RNA, 20 nt, Artificial Sequence
  MKO10127005_B_Wnt8b
  gRNA
ggcugugaugacucccgaaa

SEQ ID NO: 127006 - RNA, 20 nt, Artificial Sequence
  MKO10127006_B_Wnt8b
  gRNA
gggcaucuuguccugucucg

SEQ ID NO: 127007 - RNA, 20 nt, Artificial Sequence
  MKO10127007_B_Wnt8b
  gRNA
cucauuguugugcagauuca

SEQ ID NO: 127008 - RNA, 20 nt, Artificial Sequence
  MKO10127008_B_Wnt9a
  gRNA
agcagcgccgcaugugccgc

SEQ ID NO: 127009 - RNA, 20 nt, Artificial Sequence
  MKO10127009_B_Wnt9a
  gRNA
gcucgccgcgcugcgcccuu

SEQ ID NO: 127010 - RNA, 20 nt, Artificial Sequence
  MKO10127010_B_Wnt9a
  gRNA
ggcgcggcaagaugcuggau

SEQ ID NO: 127011 - RNA, 20 nt, Artificial Sequence
  MKO10127011_B_Wnt9b
  gRNA
cguguauaccugcaagcgcu

SEQ ID NO: 127012 - RNA, 20 nt, Artificial Sequence
  MKO10127012_B_Wnt9b
  gRNA
cggcacugacccgaaguagg

SEQ ID NO: 127013 - RNA, 20 nt, Artificial Sequence
  MKO10127013_B_Wnt9b
  gRNA
ugacgcccacaacacccacg

SEQ ID NO: 127014 - RNA, 20 nt, Artificial Sequence
  MKO10127014_B_Wrap53
  gRNA
cgcuccgagaacuucuugaa

SEQ ID NO: 127015 - RNA, 20 nt, Artificial Sequence
  MKO10127015_B_Wrap53
  gRNA
uuggaccuacagcuucucgc

SEQ ID NO: 127016 - RNA, 20 nt, Artificial Sequence
  MKO10127016_B_Wrap53
  gRNA
acaccaucuaugauuacugc

SEQ ID NO: 127017 - RNA, 20 nt, Artificial Sequence
  MKO10127017_B_Wrap73
  gRNA
ccacaggacuaacuuucacc

SEQ ID NO: 127018 - RNA, 20 nt, Artificial Sequence
  MKO10127018_B_Wrap73
  gRNA
ucgaucuugcagugccauuc

SEQ ID NO: 127019 - RNA, 20 nt, Artificial Sequence
  MKO10127019_B_Wrap73
  gRNA
gcagucccgccucucugcua

SEQ ID NO: 127020 - RNA, 20 nt, Artificial Sequence
  MKO10127020_B_Wrb
  gRNA
aaacucguccaucauguuga

SEQ ID NO: 127021 - RNA, 20 nt, Artificial Sequence
  MKO10127021_B_Wrb
  gRNA
acuuauaaaccacuugaucu

SEQ ID NO: 127022 - RNA, 20 nt, Artificial Sequence
  MKO10127022_B_Wrb
  gRNA
uggccuuccccucagcugaa

SEQ ID NO: 127023 - RNA, 20 nt, Artificial Sequence
  MKO10127023_B_Wrnip1
  gRNA
ucagugaucagaacucgacu

SEQ ID NO: 127024 - RNA, 20 nt, Artificial Sequence
  MKO10127024_B_Wrnip1
  gRNA
ccacucaccgauguccucgc

SEQ ID NO: 127025 - RNA, 20 nt, Artificial Sequence
  MKO10127025_B_Wrnip1
  gRNA
gcugguaagguuugccagcg

SEQ ID NO: 127026 - RNA, 20 nt, Artificial Sequence
  MKO10127026_B_Wrn
  gRNA
aguccauccgcugcagcaau

SEQ ID NO: 127027 - RNA, 20 nt, Artificial Sequence
  MKO10127027_B_Wrn
  gRNA
aagaacacucuucugaacgc

SEQ ID NO: 127028 - RNA, 20 nt, Artificial Sequence
  MKO10127028_B_Wrn
  gRNA
cgauguggugggauuugaca

SEQ ID NO: 127029 - RNA, 20 nt, Artificial Sequence
  MKO10127029_B_Wsb1
  gRNA
uccuugugaccacgcaaagu

SEQ ID NO: 127030 - RNA, 20 nt, Artificial Sequence
  MKO10127030_B_Wsb1
  gRNA
ugucucuugaagcugauaca

SEQ ID NO: 127031 - RNA, 20 nt, Artificial Sequence
  MKO10127031_B_Wsb1
  gRNA
aaucucuaaccauuucaaug

SEQ ID NO: 127032 - RNA, 20 nt, Artificial Sequence
  MKO10127032_B_Wsb2
  gRNA
gacuuacaacuguuccucua

SEQ ID NO: 127033 - RNA, 20 nt, Artificial Sequence
  MKO10127033_B_Wsb2
  gRNA
uguggcagguaagcagaucc

SEQ ID NO: 127034 - RNA, 20 nt, Artificial Sequence
  MKO10127034_B_Wsb2
  gRNA
cugggcacgucaccaucccc

SEQ ID NO: 127035 - RNA, 20 nt, Artificial Sequence
  MKO10127035_B_Wscd1
  gRNA
augacuguggagacguguuc

SEQ ID NO: 127036 - RNA, 20 nt, Artificial Sequence
  MKO10127036_B_Wscd1
  gRNA
ccaugugcggggcugugcgc

SEQ ID NO: 127037 - RNA, 20 nt, Artificial Sequence
  MKO10127037_B_Wscd1
  gRNA
acuccugauugcacuccuuc

SEQ ID NO: 127038 - RNA, 20 nt, Artificial Sequence
  MKO10127038_B_Wscd2
  gRNA
gaugacagucuuccguugcc

SEQ ID NO: 127039 - RNA, 20 nt, Artificial Sequence
  MKO10127039_B_Wscd2
  gRNA
cagguagcagccgauguacu

SEQ ID NO: 127040 - RNA, 20 nt, Artificial Sequence
  MKO10127040_B_Wscd2
  gRNA
cuucaucguguaccagacac

SEQ ID NO: 127041 - RNA, 20 nt, Artificial Sequence
  MKO10127041_B_Wt1
  gRNA
cccagcuugaaugcaugacc

SEQ ID NO: 127042 - RNA, 20 nt, Artificial Sequence
  MKO10127042_B_Wt1
  gRNA
accugcuguagggcguccuc

SEQ ID NO: 127043 - RNA, 20 nt, Artificial Sequence
  MKO10127043_B_Wt1
  gRNA
gaaccuaggagcuaccuuaa

SEQ ID NO: 127044 - RNA, 20 nt, Artificial Sequence
  MKO10127044_B_Wuap
  gRNA
cgaagaaccucuuccuaaaa

SEQ ID NO: 127045 - RNA, 20 nt, Artificial Sequence
  MKO10127045_B_Wuap
  gRNA
ugaaacagacuucaaaguua

SEQ ID NO: 127046 - RNA, 20 nt, Artificial Sequence
  MKO10127046_B_Wuap
  gRNA
ugaagcauauguucaagcuu

SEQ ID NO: 127047 - RNA, 20 nt, Artificial Sequence
  MKO10127047_B_Wtip
  gRNA
uuucucacccacguuauaga

SEQ ID NO: 127048 - RNA, 20 nt, Artificial Sequence
  MKO10127048_B_Wtip
  gRNA
cucagugugcaacgagugcu

SEQ ID NO: 127049 - RNA, 20 nt, Artificial Sequence
  MKO10127049_B_Wtip
  gRNA
cuuccagggagacggcuccg

SEQ ID NO: 127050 - RNA, 20 nt, Artificial Sequence
  MKO10127050_B_Wwc1
  gRNA
auccaagggugcaauggcgg

SEQ ID NO: 127051 - RNA, 20 nt, Artificial Sequence
  MKO10127051_B_Wwc1
  gRNA
gucauacuuggagcuggacg

SEQ ID NO: 127052 - RNA, 20 nt, Artificial Sequence
  MKO10127052_B_Wwc1
  gRNA
aaauugccacugcaaagucc

SEQ ID NO: 127053 - RNA, 20 nt, Artificial Sequence
  MKO10127053_B_Wwc2
  gRNA
agaucuccaccacacaauua

SEQ ID NO: 127054 - RNA, 20 nt, Artificial Sequence
  MKO10127054_B_Wwc2
  gRNA
guugauguggucgauguagu

SEQ ID NO: 127055 - RNA, 20 nt, Artificial Sequence
  MKO10127055_B_Wwc2
  gRNA
caaucuuacccuuaauugug

SEQ ID NO: 127056 - RNA, 20 nt, Artificial Sequence
  MKO10127056_B_Wwox
  gRNA
ccaggaucacaugcgcgcca

SEQ ID NO: 127057 - RNA, 20 nt, Artificial Sequence
  MKO10127057_B_Wwox
  gRNA
uguguuucagauuugccgua

SEQ ID NO: 127058 - RNA, 20 nt, Artificial Sequence
  MKO10127058_B_Wwox
  gRNA
aacauccgaaaaccggcaag

SEQ ID NO: 127059 - RNA, 20 nt, Artificial Sequence
  MKO10127059_B_Wwp1
  gRNA
guaguuccucuaauccaaaa

SEQ ID NO: 127060 - RNA, 20 nt, Artificial Sequence
  MKO10127060_B_Wwp1
  gRNA
acuccaaacucggaacucca

SEQ ID NO: 127061 - RNA, 20 nt, Artificial Sequence
  MKO10127061_B_Wwp1
  gRNA
gcacagcuuacuggguggcg

SEQ ID NO: 127062 - RNA, 20 nt, Artificial Sequence
  MKO10127062_B_Wwp2
  gRNA
ccuucagauccaaaugacuc

SEQ ID NO: 127063 - RNA, 20 nt, Artificial Sequence
  MKO10127063_B_Wwp2
  gRNA
gaucugggaagugugccuaa

SEQ ID NO: 127064 - RNA, 20 nt, Artificial Sequence
  MKO10127064_B_Wwp2
  gRNA
ccccccaguacaaacugcuu

SEQ ID NO: 127065 - RNA, 20 nt, Artificial Sequence
  MKO10127065_B_Wwtr1
  gRNA
ggcuaguggccacgacuugc

SEQ ID NO: 127066 - RNA, 20 nt, Artificial Sequence
  MKO10127066_B_Wwtr1
  gRNA
gcgcgagugcgagccggaau

SEQ ID NO: 127067 - RNA, 20 nt, Artificial Sequence
  MKO10127067_B_Wwtr1
  gRNA
uaaacuuacccauugaggaa

SEQ ID NO: 127068 - RNA, 20 nt, Artificial Sequence
  MKO10127068_B_Xab2
  gRNA
acuggcaguagucuaaccac

SEQ ID NO: 127069 - RNA, 20 nt, Artificial Sequence
  MKO10127069_B_Xab2
  gRNA
accgauaucugaaggcacgc

SEQ ID NO: 127070 - RNA, 20 nt, Artificial Sequence
  MKO10127070_B_Xab2
  gRNA
gcugugcagccucgucuagc

SEQ ID NO: 127071 - RNA, 20 nt, Artificial Sequence
  MKO10127071_B_Xaf1
  gRNA
aaauacguaugccucccaua

SEQ ID NO: 127072 - RNA, 20 nt, Artificial Sequence
  MKO10127072_B_Xaf1
  gRNA
auccagauugcuaagcugca

SEQ ID NO: 127073 - RNA, 20 nt, Artificial Sequence
  MKO10127073_B_Xaf1
  gRNA
ucuccacuucaugcuccacg

SEQ ID NO: 127074 - RNA, 20 nt, Artificial Sequence
  MKO10127074_B_Xbp1
  gRNA
acuuguccagaaugcccaaa

SEQ ID NO: 127075 - RNA, 20 nt, Artificial Sequence
  MKO10127075_B_Xbp1
  gRNA
uuccccagagucugcuaguc

SEQ ID NO: 127076 - RNA, 20 nt, Artificial Sequence
  MKO10127076_B_Xbp1
  gRNA
acuaugugcaccucugcagc

SEQ ID NO: 127077 - RNA, 20 nt, Artificial Sequence
  MKO10127077_B_Xcl1
  gRNA
ucgcugugcugguggaccuc

SEQ ID NO: 127078 - RNA, 20 nt, Artificial Sequence
  MKO10127078_B_Xcl1
  gRNA
gugugaacuuacaaacccag

SEQ ID NO: 127079 - RNA, 20 nt, Artificial Sequence
  MKO10127079_B_Xcl1
  gRNA
gagucugcugccucacccca

SEQ ID NO: 127080 - RNA, 20 nt, Artificial Sequence
  MKO10127080_B_Xcr1
  gRNA
ugaagaugagccugacuguu

SEQ ID NO: 127081 - RNA, 20 nt, Artificial Sequence
  MKO10127081_B_Xcr1
  gRNA
gacagagacaccgaacaguc

SEQ ID NO: 127082 - RNA, 20 nt, Artificial Sequence
  MKO10127082_B_Xcr1
  gRNA
uagaggacuccaucuggacg

SEQ ID NO: 127083 - RNA, 20 nt, Artificial Sequence
  MKO10127083_B_Xdh
  gRNA
gauacacgaucuuguucuga

SEQ ID NO: 127084 - RNA, 20 nt, Artificial Sequence
  MKO10127084_B_Xdh
  gRNA
caagaagcugcauccugucc

SEQ ID NO: 127085 - RNA, 20 nt, Artificial Sequence
  MKO10127085_B_Xdh
  gRNA
ugucacagcaacaugaugca

SEQ ID NO: 127086 - RNA, 20 nt, Artificial Sequence
  MKO10127086_B_Xiap
  gRNA
cuugccccuucucauccaau

SEQ ID NO: 127087 - RNA, 20 nt, Artificial Sequence
  MKO10127087_B_Xiap
  gRNA
cacucacaagaucugcaauc

SEQ ID NO: 127088 - RNA, 20 nt, Artificial Sequence
  MKO10127088_B_Xiap
  gRNA
agucaaacuucauugcagaa

SEQ ID NO: 127089 - RNA, 20 nt, Artificial Sequence
  MKO10127089_B_Xirp1
  gRNA
ucguccgucaagugcugcgc

SEQ ID NO: 127090 - RNA, 20 nt, Artificial Sequence
  MKO10127090_B_Xirp1
  gRNA
cgccccgguauaugcuaugc

SEQ ID NO: 127091 - RNA, 20 nt, Artificial Sequence
  MKO10127091_B_Xirp1
  gRNA
ugugucagguggcaacgucc

SEQ ID NO: 127092 - RNA, 20 nt, Artificial Sequence
  MKO10127092_B_Xirp2
  gRNA
auacucagaaaaggcguugc

SEQ ID NO: 127093 - RNA, 20 nt, Artificial Sequence
  MKO10127093_B_Xirp2
  gRNA
uuauuauuucuugacugcug

SEQ ID NO: 127094 - RNA, 20 nt, Artificial Sequence
  MKO10127094_B_Xirp2
  gRNA
gcagucaagaaauaauaaga

SEQ ID NO: 127095 - RNA, 20 nt, Artificial Sequence
  MKO10127095_B_Xkr4
  gRNA
ugccaucccugcauugugcg

SEQ ID NO: 127096 - RNA, 20 nt, Artificial Sequence
  MKO10127096_B_Xkr4
  gRNA
uauccggagccggcagagug

SEQ ID NO: 127097 - RNA, 20 nt, Artificial Sequence
  MKO10127097_B_Xkr4
  gRNA
guacaauaaugcagagcugc

SEQ ID NO: 127098 - RNA, 20 nt, Artificial Sequence
  MKO10127098_B_Xkr5
  gRNA
gaacuccauacucuuacuac

SEQ ID NO: 127099 - RNA, 20 nt, Artificial Sequence
  MKO10127099_B_Xkr5
  gRNA
ucucuacaaugucgcucugc

SEQ ID NO: 127100 - RNA, 20 nt, Artificial Sequence
  MKO10127100_B_Xkr5
  gRNA
caggccaccauaccaugcua

SEQ ID NO: 127101 - RNA, 20 nt, Artificial Sequence
  MKO10127101_B_Xkr6
  gRNA
ucguauaguaugcgaacauu

SEQ ID NO: 127102 - RNA, 20 nt, Artificial Sequence
  MKO10127102_B_Xkr6
  gRNA
cgaagaucccgaaauacagc

SEQ ID NO: 127103 - RNA, 20 nt, Artificial Sequence
  MKO10127103_B_Xkr6
  gRNA
ugucaacaugcugcgccucc

SEQ ID NO: 127104 - RNA, 20 nt, Artificial Sequence
  MKO10127104_B_Xkr7
  gRNA
ggccaggguucgugccgcaa

SEQ ID NO: 127105 - RNA, 20 nt, Artificial Sequence
  MKO10127105_B_Xkr7
  gRNA
guaccugcgcgcccuauacc

SEQ ID NO: 127106 - RNA, 20 nt, Artificial Sequence
  MKO10127106_B_Xkr7
  gRNA
gacugcagagccgcuggcgc

SEQ ID NO: 127107 - RNA, 20 nt, Artificial Sequence
  MKO10127107_B_Xkr8
  gRNA
cacacugguaguauuccgcc

SEQ ID NO: 127108 - RNA, 20 nt, Artificial Sequence
  MKO10127108_B_Xkr8
  gRNA
ggcgacgccacagcucacac

SEQ ID NO: 127109 - RNA, 20 nt, Artificial Sequence
  MKO10127109_B_Xkr8
  gRNA
ugacggcccggccucgagug

SEQ ID NO: 127110 - RNA, 20 nt, Artificial Sequence
  MKO10127110_B_Xkr9
  gRNA
cuucuacuucauugcuugca

SEQ ID NO: 127111 - RNA, 20 nt, Artificial Sequence
  MKO10127111_B_Xkr9
  gRNA
uacacugacuuaaauuugcc

SEQ ID NO: 127112 - RNA, 20 nt, Artificial Sequence
  MKO10127112_B_Xkr9
  gRNA
auagauuauaaugcccaaaa

SEQ ID NO: 127113 - RNA, 20 nt, Artificial Sequence
  MKO10127113_B_Xkrx
  gRNA
gagaaaaacuucagccgagu

SEQ ID NO: 127114 - RNA, 20 nt, Artificial Sequence
  MKO10127114_B_Xkrx
  gRNA
ggcugcgucugcuuuguaca

SEQ ID NO: 127115 - RNA, 20 nt, Artificial Sequence
  MKO10127115_B_Xkrx
  gRNA
uaaagcguggguuaggcccc

SEQ ID NO: 127116 - RNA, 20 nt, Artificial Sequence
  MKO10127116_B_Xk
  gRNA
ugccacccgagucaucgucc

SEQ ID NO: 127117 - RNA, 20 nt, Artificial Sequence
  MKO10127117_B_Xk
  gRNA
uaaucagcuugccuucugcc

SEQ ID NO: 127118 - RNA, 20 nt, Artificial Sequence
  MKO10127118_B_Xk
  gRNA
cuuucuccaccuccucugaa

SEQ ID NO: 127119 - RNA, 20 nt, Artificial Sequence
  MKO10127119_B_Xlr3a
  gRNA
ucuuugcaggaaggaaaaac

SEQ ID NO: 127120 - RNA, 20 nt, Artificial Sequence
  MKO10127120_B_Xlr3a
  gRNA
agaacauaccuucgaauucu

SEQ ID NO: 127121 - RNA, 20 nt, Artificial Sequence
  MKO10127121_B_Xlr3a
  gRNA
gccaccuaacaaaguucuuc

SEQ ID NO: 127122 - RNA, 20 nt, Artificial Sequence
  MKO10127122_B_Xlr3b
  gRNA
ucuuugcaggaaggaaaaac

SEQ ID NO: 127123 - RNA, 20 nt, Artificial Sequence
  MKO10127123_B_Xlr3b
  gRNA
aacccuaccucucuucacag

SEQ ID NO: 127124 - RNA, 20 nt, Artificial Sequence
  MKO10127124_B_Xlr3b
  gRNA
gccaccuaacaaaguucuuc

SEQ ID NO: 127125 - RNA, 20 nt, Artificial Sequence
  MKO10127125_B_Xlr3c
  gRNA
cuguugccucucuguuccug

SEQ ID NO: 127126 - RNA, 20 nt, Artificial Sequence
  MKO10127126_B_Xlr3c
  gRNA
ucuuugcaggaaggaaaaac

SEQ ID NO: 127127 - RNA, 20 nt, Artificial Sequence
  MKO10127127_B_Xlr3c
  gRNA
agaacauaccuucgaauucu

SEQ ID NO: 127128 - RNA, 20 nt, Artificial Sequence
  MKO10127128_B_Xlr4a
  gRNA
agucuuaccuucgcucaugc

SEQ ID NO: 127129 - RNA, 20 nt, Artificial Sequence
  MKO10127129_B_Xlr4a
  gRNA
cuacaggcaggaacuuuaua

SEQ ID NO: 127130 - RNA, 20 nt, Artificial Sequence
  MKO10127130_B_Xlr4a
  gRNA
uuccagccuguuucuugauu

SEQ ID NO: 127131 - RNA, 20 nt, Artificial Sequence
  MKO10127131_B_Xlr4b
  gRNA
guaagaaaacucuaaaugaa

SEQ ID NO: 127132 - RNA, 20 nt, Artificial Sequence
  MKO10127132_B_Xlr4b
  gRNA
uuccagccuguuucuugauu

SEQ ID NO: 127133 - RNA, 20 nt, Artificial Sequence
  MKO10127133_B_Xlr4b
  gRNA
cuacaggcaggaacuuuaua

SEQ ID NO: 127134 - RNA, 20 nt, Artificial Sequence
  MKO10127134_B_Xlr4c
  gRNA
agucuuaccuucgcucaugc

SEQ ID NO: 127135 - RNA, 20 nt, Artificial Sequence
  MKO10127135_B_Xlr4c
  gRNA
cuacaggcaggaacuuuaua

SEQ ID NO: 127136 - RNA, 20 nt, Artificial Sequence
  MKO10127136_B_Xlr4c
  gRNA
uuccagccuguuucuugauu

SEQ ID NO: 127137 - RNA, 20 nt, Artificial Sequence
  MKO10127137_B_Xlr5a
  gRNA
uccugcaucuucuucugaac

SEQ ID NO: 127138 - RNA, 20 nt, Artificial Sequence
  MKO10127138_B_Xlr5a
  gRNA
cacacaggugaugaugguac

SEQ ID NO: 127139 - RNA, 20 nt, Artificial Sequence
  MKO10127139_B_Xlr5a
  gRNA
gcugagcuuucaaaaugcuc

SEQ ID NO: 127140 - RNA, 20 nt, Artificial Sequence
  MKO10127140_B_Xlr5b
  gRNA
gccuguucagaagaagaugc

SEQ ID NO: 127141 - RNA, 20 nt, Artificial Sequence
  MKO10127141_B_Xlr5b
  gRNA
gcugagcuuucaaaaugcuc

SEQ ID NO: 127142 - RNA, 20 nt, Artificial Sequence
  MKO10127142_B_Xlr5b
  gRNA
cacacaggugaugaugguac

SEQ ID NO: 127143 - RNA, 20 nt, Artificial Sequence
  MKO10127143_B_Xlr5c
  gRNA
uccugcaucuucuucugaac

SEQ ID NO: 127144 - RNA, 20 nt, Artificial Sequence
  MKO10127144_B_Xlr5c
  gRNA
cacacaggugaugaugguac

SEQ ID NO: 127145 - RNA, 20 nt, Artificial Sequence
  MKO10127145_B_Xlr5c
  gRNA
gcugagcuuucaaaaugcuc

SEQ ID NO: 127146 - RNA, 20 nt, Artificial Sequence
  MKO10127146_B_Xlr
  gRNA
aucuccaguacaaaauauuc

SEQ ID NO: 127147 - RNA, 20 nt, Artificial Sequence
  MKO10127147_B_Xlr
  gRNA
auauaggugacauuaacaag

SEQ ID NO: 127148 - RNA, 20 nt, Artificial Sequence
  MKO10127148_B_Xlr
  gRNA
uacauuucagaaguuugaua

SEQ ID NO: 127149 - RNA, 20 nt, Artificial Sequence
  MKO10127149_B_Xndr-trpc2
  gRNA
gucagugcgggacauuagca

SEQ ID NO: 127150 - RNA, 20 nt, Artificial Sequence
  MKO10127150_B_Xndr-trpc2
  gRNA
aagaauguccuccggauaga

SEQ ID NO: 127151 - RNA, 20 nt, Artificial Sequence
  MKO10127151_B_Xndr-trpc2
  gRNA
cccauaagcuauauugaugu

SEQ ID NO: 127152 - RNA, 20 nt, Artificial Sequence
  MKO10127152_B_Xndr
  gRNA
aaacaucaacaguaccaccg

SEQ ID NO: 127153 - RNA, 20 nt, Artificial Sequence
  MKO10127153_B_Xndr
  gRNA
gcgugucuuccucgcacuua

SEQ ID NO: 127154 - RNA, 20 nt, Artificial Sequence
  MKO10127154_B_Xndr
  gRNA
gucagugcgggacauuagca

SEQ ID NO: 127155 - RNA, 20 nt, Artificial Sequence
  MKO10127155_B_Xpa
  gRNA
cccaaaaugauugacaccaa

SEQ ID NO: 127156 - RNA, 20 nt, Artificial Sequence
  MKO10127156_B_Xpa
  gRNA
ucauaucgccccacugugaa

SEQ ID NO: 127157 - RNA, 20 nt, Artificial Sequence
  MKO10127157_B_Xpa
  gRNA
ucuugaagugugggguagcc

SEQ ID NO: 127158 - RNA, 20 nt, Artificial Sequence
  MKO10127158_B_Xpc
  gRNA
agagcuuacugaaccugugc

SEQ ID NO: 127159 - RNA, 20 nt, Artificial Sequence
  MKO10127159_B_Xpc
  gRNA
ucaaucuccaccgccuucac

SEQ ID NO: 127160 - RNA, 20 nt, Artificial Sequence
  MKO10127160_B_Xpc
  gRNA
augagaagcagaaaccccga

SEQ ID NO: 127161 - RNA, 20 nt, Artificial Sequence
  MKO10127161_B_Xpnpep1
  gRNA
uaugaggaacuccgaauacg

SEQ ID NO: 127162 - RNA, 20 nt, Artificial Sequence
  MKO10127162_B_Xpnpep1
  gRNA
gauggguucugccacguauu

SEQ ID NO: 127163 - RNA, 20 nt, Artificial Sequence
  MKO10127163_B_Xpnpep1
  gRNA
cgcaugcuccuccgugauga

SEQ ID NO: 127164 - RNA, 20 nt, Artificial Sequence
  MKO10127164_B_Xpnpep2
  gRNA
cugccgucaauacaacaaug

SEQ ID NO: 127165 - RNA, 20 nt, Artificial Sequence
  MKO10127165_B_Xpnpep2
  gRNA
uacccagagcccaaguaccu

SEQ ID NO: 127166 - RNA, 20 nt, Artificial Sequence
  MKO10127166_B_Xpnpep2
  gRNA
aaccugauaagaggcgagag

SEQ ID NO: 127167 - RNA, 20 nt, Artificial Sequence
  MKO10127167_B_Xpnpep3
  gRNA
ccaucccacaauucucggcc

SEQ ID NO: 127168 - RNA, 20 nt, Artificial Sequence
  MKO10127168_B_Xpnpep3
  gRNA
gcaugucauguuuacagcga

SEQ ID NO: 127169 - RNA, 20 nt, Artificial Sequence
  MKO10127169_B_Xpnpep3
  gRNA
uguggauguguaaccgggcu

SEQ ID NO: 127170 - RNA, 20 nt, Artificial Sequence
  MKO10127170_B_Xpo1
  gRNA
guacuauggacuacagauuu

SEQ ID NO: 127171 - RNA, 20 nt, Artificial Sequence
  MKO10127171_B_Xpo1
  gRNA
cuuccaaggaaccaguguga

SEQ ID NO: 127172 - RNA, 20 nt, Artificial Sequence
  MKO10127172_B_Xpo1
  gRNA
agaaguacugacacauuuaa

SEQ ID NO: 127173 - RNA, 20 nt, Artificial Sequence
  MKO10127173_B_Xpo4
  gRNA
uaacugcaagcgagucuuuc

SEQ ID NO: 127174 - RNA, 20 nt, Artificial Sequence
  MKO10127174_B_Xpo4
  gRNA
agacucgcuugcaguuaccg

SEQ ID NO: 127175 - RNA, 20 nt, Artificial Sequence
  MKO10127175_B_Xpo4
  gRNA
ucuguucccgaacauacuuu

SEQ ID NO: 127176 - RNA, 20 nt, Artificial Sequence
  MKO10127176_B_Xpo5
  gRNA
gcaaacauugacgcagaaca

SEQ ID NO: 127177 - RNA, 20 nt, Artificial Sequence
  MKO10127177_B_Xpo5
  gRNA
aaggccaaaaugucugacga

SEQ ID NO: 127178 - RNA, 20 nt, Artificial Sequence
  MKO10127178_B_Xpo5
  gRNA
auugccaucgucagacauuu

SEQ ID NO: 127179 - RNA, 20 nt, Artificial Sequence
  MKO10127179_B_Xpo6
  gRNA
ccuccuuccgagccacgcug

SEQ ID NO: 127180 - RNA, 20 nt, Artificial Sequence
  MKO10127180_B_Xpo6
  gRNA
caucagaagaagccucccuc

SEQ ID NO: 127181 - RNA, 20 nt, Artificial Sequence
  MKO10127181_B_Xpo6
  gRNA
aguuuauuccgaauaaagua

SEQ ID NO: 127182 - RNA, 20 nt, Artificial Sequence
  MKO10127182_B_Xpo7
  gRNA
gccuuaccaagcucgugucu

SEQ ID NO: 127183 - RNA, 20 nt, Artificial Sequence
  MKO10127183_B_Xpo7
  gRNA
uacguacacuuccucucucg

SEQ ID NO: 127184 - RNA, 20 nt, Artificial Sequence
  MKO10127184_B_Xpo7
  gRNA
gucacgaaaguugccaacuu

SEQ ID NO: 127185 - RNA, 20 nt, Artificial Sequence
  MKO10127185_B_Xpot
  gRNA
gaugauuguggauucugcug

SEQ ID NO: 127186 - RNA, 20 nt, Artificial Sequence
  MKO10127186_B_Xpot
  gRNA
uaacuugaugcucuaguacu

SEQ ID NO: 127187 - RNA, 20 nt, Artificial Sequence
  MKO10127187_B_Xpot
  gRNA
cugcucagcagcagcucauc

SEQ ID NO: 127188 - RNA, 20 nt, Artificial Sequence
  MKO10127188_B_Xpr1
  gRNA
cugcuccacgagauguuucc

SEQ ID NO: 127189 - RNA, 20 nt, Artificial Sequence
  MKO10127189_B_Xpr1
  gRNA
aaacaucucguggagcagau

SEQ ID NO: 127190 - RNA, 20 nt, Artificial Sequence
  MKO10127190_B_Xpr1
  gRNA
cucaacuuaccuucaacuga

SEQ ID NO: 127191 - RNA, 20 nt, Artificial Sequence
  MKO10127191_B_Xrcc1
  gRNA
ugagccacuucggcucucag

SEQ ID NO: 127192 - RNA, 20 nt, Artificial Sequence
  MKO10127192_B_Xrcc1
  gRNA
cuguuccaggacucgccaua

SEQ ID NO: 127193 - RNA, 20 nt, Artificial Sequence
  MKO10127193_B_Xrcc1
  gRNA
gugcuagugggcagcucggc

SEQ ID NO: 127194 - RNA, 20 nt, Artificial Sequence
  MKO10127194_B_Xrcc2
  gRNA
acgagcuucugccuucaagu

SEQ ID NO: 127195 - RNA, 20 nt, Artificial Sequence
  MKO10127195_B_Xrcc2
  gRNA
gugaaucuucaucagcaaac

SEQ ID NO: 127196 - RNA, 20 nt, Artificial Sequence
  MKO10127196_B_Xrcc2
  gRNA
acucagugacaagccgcucu

SEQ ID NO: 127197 - RNA, 20 nt, Artificial Sequence
  MKO10127197_B_Xrcc3
  gRNA
ccggugagccgcugcaaguc

SEQ ID NO: 127198 - RNA, 20 nt, Artificial Sequence
  MKO10127198_B_Xrcc3
  gRNA
gagcaggagcuucgcccuga

SEQ ID NO: 127199 - RNA, 20 nt, Artificial Sequence
  MKO10127199_B_Xrcc3
  gRNA
ccgcguguucaaugaagaug

SEQ ID NO: 127200 - RNA, 20 nt, Artificial Sequence
  MKO10127200_B_Xrcc4
  gRNA
gcuaaaugaaguccagcagc

SEQ ID NO: 127201 - RNA, 20 nt, Artificial Sequence
  MKO10127201_B_Xrcc4
  gRNA
aggaugcuaccuuucagguu

SEQ ID NO: 127202 - RNA, 20 nt, Artificial Sequence
  MKO10127202_B_Xrcc4
  gRNA
gaacaucauuccagucucuc

SEQ ID NO: 127203 - RNA, 20 nt, Artificial Sequence
  MKO10127203_B_Xrcc5
  gRNA
ggcacugauaaugcccuugc

SEQ ID NO: 127204 - RNA, 20 nt, Artificial Sequence
  MKO10127204_B_Xrcc5
  gRNA
ccucagcagcccguucagcc

SEQ ID NO: 127205 - RNA, 20 nt, Artificial Sequence
  MKO10127205_B_Xrcc5
  gRNA
aaaggauacagucggcuugc

SEQ ID NO: 127206 - RNA, 20 nt, Artificial Sequence
  MKO10127206_B_Xrcc6bp1
  gRNA
uucccgugggccggcggcuc

SEQ ID NO: 127207 - RNA, 20 nt, Artificial Sequence
  MKO10127207_B_Xrcc6bp1
  gRNA
gagucgggucgcugcagcag

SEQ ID NO: 127208 - RNA, 20 nt, Artificial Sequence
  MKO10127208_B_Xrcc6bp1
  gRNA
guuuccaucgcagacuucgc

SEQ ID NO: 127209 - RNA, 20 nt, Artificial Sequence
  MKO10127209_B_Xrcc6
  gRNA
uggcucgaaccuuccuuagc

SEQ ID NO: 127210 - RNA, 20 nt, Artificial Sequence
  MKO10127210_B_Xrcc6
  gRNA
cugagauucgaacauagccc

SEQ ID NO: 127211 - RNA, 20 nt, Artificial Sequence
  MKO10127211_B_Xrcc6
  gRNA
aucgcugcuuaugaucuuac

SEQ ID NO: 127212 - RNA, 20 nt, Artificial Sequence
  MKO10127212_B_Xrn1
  gRNA
uguuucgaauuauuaaaccu

SEQ ID NO: 127213 - RNA, 20 nt, Artificial Sequence
  MKO10127213_B_Xrn1
  gRNA
cuucagauguucaugcaauc

SEQ ID NO: 127214 - RNA, 20 nt, Artificial Sequence
  MKO10127214_B_Xrn1
  gRNA
accuugccaugauuugucug

SEQ ID NO: 127215 - RNA, 20 nt, Artificial Sequence
  MKO10127215_B_Xrn2
  gRNA
uaaaccuaauccaaaugaug

SEQ ID NO: 127216 - RNA, 20 nt, Artificial Sequence
  MKO10127216_B_Xrn2
  gRNA
accaagaagacuucucuaca

SEQ ID NO: 127217 - RNA, 20 nt, Artificial Sequence
  MKO10127217_B_Xrn2
  gRNA
ugagaagcagcgagucagag

SEQ ID NO: 127218 - RNA, 20 nt, Artificial Sequence
  MKO10127218_B_Xrra1
  gRNA
ugcguucaauggcaucaaga

SEQ ID NO: 127219 - RNA, 20 nt, Artificial Sequence
  MKO10127219_B_Xrra1
  gRNA
ucugaaaaccugcuaccucu

SEQ ID NO: 127220 - RNA, 20 nt, Artificial Sequence
  MKO10127220_B_Xrra1
  gRNA
agcugaagcaccacucugcc

SEQ ID NO: 127221 - RNA, 20 nt, Artificial Sequence
  MKO10127221_B_Xxylt1
  gRNA
ggccacgucaagaucuacca

SEQ ID NO: 127222 - RNA, 20 nt, Artificial Sequence
  MKO10127222_B_Xxylt1
  gRNA
gguuaccuuugggcaugauc

SEQ ID NO: 127223 - RNA, 20 nt, Artificial Sequence
  MKO10127223_B_Xxylt1
  gRNA
gaucccgaggaucauccagc

SEQ ID NO: 127224 - RNA, 20 nt, Artificial Sequence
  MKO10127224_B_Xylb
  gRNA
gagcuggugacaagcuugac

SEQ ID NO: 127225 - RNA, 20 nt, Artificial Sequence
  MKO10127225_B_Xylb
  gRNA
ucaccucuccgguccugaug

SEQ ID NO: 127226 - RNA, 20 nt, Artificial Sequence
  MKO10127226_B_Xylb
  gRNA
aaccuggccugcuccagaua

SEQ ID NO: 127227 - RNA, 20 nt, Artificial Sequence
  MKO10127227_B_Xylt1
  gRNA
agcguuccaauuaccugcau

SEQ ID NO: 127228 - RNA, 20 nt, Artificial Sequence
  MKO10127228_B_Xylt1
  gRNA
caugcgcuguagcugucgag

SEQ ID NO: 127229 - RNA, 20 nt, Artificial Sequence
  MKO10127229_B_Xylt1
  gRNA
agucagaaucgccuuugucc

SEQ ID NO: 127230 - RNA, 20 nt, Artificial Sequence
  MKO10127230_B_Xylt2
  gRNA
ccuucagaagacgcuucagc

SEQ ID NO: 127231 - RNA, 20 nt, Artificial Sequence
  MKO10127231_B_Xylt2
  gRNA
gguuacugcccgcaccaccu

SEQ ID NO: 127232 - RNA, 20 nt, Artificial Sequence
  MKO10127232_B_Xylt2
  gRNA
cguacuggagggccaccaac

SEQ ID NO: 127233 - RNA, 20 nt, Artificial Sequence
  MKO10127233_B_Yae1d1
  gRNA
gaacgcgagcccuggagacc

SEQ ID NO: 127234 - RNA, 20 nt, Artificial Sequence
  MKO10127234_B_Yae1d1
  gRNA
auuaccucaguguuccucua

SEQ ID NO: 127235 - RNA, 20 nt, Artificial Sequence
  MKO10127235_B_Yae1d1
  gRNA
gcaaagcacuuacucuucaa

SEQ ID NO: 127236 - RNA, 20 nt, Artificial Sequence
  MKO10127236_B_Yaf2
  gRNA
agugcaugaugugcgaugug

SEQ ID NO: 127237 - RNA, 20 nt, Artificial Sequence
  MKO10127237_B_Yaf2
  gRNA
ugaccugcugugcgaccagc

SEQ ID NO: 127238 - RNA, 20 nt, Artificial Sequence
  MKO10127238_B_Yaf2
  gRNA
gccacgcccugucucccagc

SEQ ID NO: 127239 - RNA, 20 nt, Artificial Sequence
  MKO10127239_B_Yap1
  gRNA
cgcaguaccugcaucaguac

SEQ ID NO: 127240 - RNA, 20 nt, Artificial Sequence
  MKO10127240_B_Yap1
  gRNA
aacguucaguugcgaaagca

SEQ ID NO: 127241 - RNA, 20 nt, Artificial Sequence
  MKO10127241_B_Yap1
  gRNA
gaugauguaccacugccagc

SEQ ID NO: 127242 - RNA, 20 nt, Artificial Sequence
  MKO10127242_B_Yars2
  gRNA
ccucuaauuacaaguacaac

SEQ ID NO: 127243 - RNA, 20 nt, Artificial Sequence
  MKO10127243_B_Yars2
  gRNA
agcaagaugauuccguagaa

SEQ ID NO: 127244 - RNA, 20 nt, Artificial Sequence
  MKO10127244_B_Yars2
  gRNA
ccagugccucuaugcugcua

SEQ ID NO: 127245 - RNA, 20 nt, Artificial Sequence
  MKO10127245_B_Yars
  gRNA
aaccucagcccccgcuuucu

SEQ ID NO: 127246 - RNA, 20 nt, Artificial Sequence
  MKO10127246_B_Yars
  gRNA
cuucaaaaagucagcgaucu

SEQ ID NO: 127247 - RNA, 20 nt, Artificial Sequence
  MKO10127247_B_Yars
  gRNA
ucgaaguucuagaagcuccc

SEQ ID NO: 127248 - RNA, 20 nt, Artificial Sequence
  MKO10127248_B_Ybey
  gRNA
cccacagcuccaaagccgag

SEQ ID NO: 127249 - RNA, 20 nt, Artificial Sequence
  MKO10127249_B_Ybey
  gRNA
aaauccaucuuccugcgaag

SEQ ID NO: 127250 - RNA, 20 nt, Artificial Sequence
  MKO10127250_B_Ybey
  gRNA
ucagaagagugccacuucgc

SEQ ID NO: 127251 - RNA, 20 nt, Artificial Sequence
  MKO10127251_B_Ybx1
  gRNA
ccauaaagaagaauaacccc

SEQ ID NO: 127252 - RNA, 20 nt, Artificial Sequence
  MKO10127252_B_Ybx1
  gRNA
acggauacgguuucaucaac

SEQ ID NO: 127253 - RNA, 20 nt, Artificial Sequence
  MKO10127253_B_Ybx1
  gRNA
guguacaaauacgucuuccu

SEQ ID NO: 127254 - RNA, 20 nt, Artificial Sequence
  MKO10127254_B_Ybx2
  gRNA
augguuacggauucaucaac

SEQ ID NO: 127255 - RNA, 20 nt, Artificial Sequence
  MKO10127255_B_Ybx2
  gRNA
gacuguggaguuugaugucg

SEQ ID NO: 127256 - RNA, 20 nt, Artificial Sequence
  MKO10127256_B_Ybx2
  gRNA
cuauuaagagaaacaacccc

SEQ ID NO: 127257 - RNA, 20 nt, Artificial Sequence
  MKO10127257_B_Ybx3
  gRNA
acacugcgcagauacuugcg

SEQ ID NO: 127258 - RNA, 20 nt, Artificial Sequence
  MKO10127258_B_Ybx3
  gRNA
aaaugguucaacgucagaaa

SEQ ID NO: 127259 - RNA, 20 nt, Artificial Sequence
  MKO10127259_B_Ybx3
  gRNA
agaagauguguuuguacacc

SEQ ID NO: 127260 - RNA, 20 nt, Artificial Sequence
  MKO10127260_B_Ydjc
  gRNA
gggcaggucccccacgcacg

SEQ ID NO: 127261 - RNA, 20 nt, Artificial Sequence
  MKO10127261_B_Ydjc
  gRNA
uaugccggccacaagugcuc

SEQ ID NO: 127262 - RNA, 20 nt, Artificial Sequence
  MKO10127262_B_Ydjc
  gRNA
aagcucaacucagccgcuuc

SEQ ID NO: 127263 - RNA, 20 nt, Artificial Sequence
  MKO10127263_B_Yeaus2
  gRNA
caggacacgucuaguaucag

SEQ ID NO: 127264 - RNA, 20 nt, Artificial Sequence
  MKO10127264_B_Yeaus2
  gRNA
auuaaagacauuugauccga

SEQ ID NO: 127265 - RNA, 20 nt, Artificial Sequence
  MKO10127265_B_Yeaus2
  gRNA
uuuagcgacugauugaagcc

SEQ ID NO: 127266 - RNA, 20 nt, Artificial Sequence
  MKO10127266_B_Yeaus4
  gRNA
uucagaguucuaugacgaaa

SEQ ID NO: 127267 - RNA, 20 nt, Artificial Sequence
  MKO10127267_B_Yeaus4
  gRNA
agcuuucguguaauuuaaac

SEQ ID NO: 127268 - RNA, 20 nt, Artificial Sequence
  MKO10127268_B_Yeaus4
  gRNA
uuuaaauuacacgaaagcua

SEQ ID NO: 127269 - RNA, 20 nt, Artificial Sequence
  MKO10127269_B_Yes1
  gRNA
acucccucucaauccgugau

SEQ ID NO: 127270 - RNA, 20 nt, Artificial Sequence
  MKO10127270_B_Yes1
  gRNA
gaagcaagaucaauugcuac

SEQ ID NO: 127271 - RNA, 20 nt, Artificial Sequence
  MKO10127271_B_Yes1
  gRNA
aaaauaccucgcugauuccc

SEQ ID NO: 127272 - RNA, 20 nt, Artificial Sequence
  MKO10127272_B_Yif1a
  gRNA
ggggcauugagaucuuuccg

SEQ ID NO: 127273 - RNA, 20 nt, Artificial Sequence
  MKO10127273_B_Yif1a
  gRNA
cuucaucacauacgugcugc

SEQ ID NO: 127274 - RNA, 20 nt, Artificial Sequence
  MKO10127274_B_Yif1a
  gRNA
gccuaugucgcuaagaagcu

SEQ ID NO: 127275 - RNA, 20 nt, Artificial Sequence
  MKO10127275_B_Yif1b
  gRNA
cgcagccggggcguccccgc

SEQ ID NO: 127276 - RNA, 20 nt, Artificial Sequence
  MKO10127276_B_Yif1b
  gRNA
cuggagcauugaugucgaag

SEQ ID NO: 127277 - RNA, 20 nt, Artificial Sequence
  MKO10127277_B_Yif1b
  gRNA
gcucaaguauuacuuugcag

SEQ ID NO: 127278 - RNA, 20 nt, Artificial Sequence
  MKO10127278_B_Yipf1
  gRNA
aagguucccacuaauugcua

SEQ ID NO: 127279 - RNA, 20 nt, Artificial Sequence
  MKO10127279_B_Yipf1
  gRNA
auaguauucgaauguccaga

SEQ ID NO: 127280 - RNA, 20 nt, Artificial Sequence
  MKO10127280_B_Yipf1
  gRNA
cagcacauaccauagagauc

SEQ ID NO: 127281 - RNA, 20 nt, Artificial Sequence
  MKO10127281_B_Yipf2
  gRNA
uggcuaguaguagcugcauc

SEQ ID NO: 127282 - RNA, 20 nt, Artificial Sequence
  MKO10127282_B_Yipf2
  gRNA
gugguuguggguucaggcau

SEQ ID NO: 127283 - RNA, 20 nt, Artificial Sequence
  MKO10127283_B_Yipf2
  gRNA
aguuacuggcaaucucacuu

SEQ ID NO: 127284 - RNA, 20 nt, Artificial Sequence
  MKO10127284_B_Yipf3
  gRNA
gugagcugcaccagcgccug

SEQ ID NO: 127285 - RNA, 20 nt, Artificial Sequence
  MKO10127285_B_Yipf3
  gRNA
gggaaguugaccaucuugau

SEQ ID NO: 127286 - RNA, 20 nt, Artificial Sequence
  MKO10127286_B_Yipf3
  gRNA
agccugcccagguccgaagc

SEQ ID NO: 127287 - RNA, 20 nt, Artificial Sequence
  MKO10127287_B_Yipf4
  gRNA
gauccaaccaccaaaaguau

SEQ ID NO: 127288 - RNA, 20 nt, Artificial Sequence
  MKO10127288_B_Yipf4
  gRNA
ccagaugucaaauuaaaccu

SEQ ID NO: 127289 - RNA, 20 nt, Artificial Sequence
  MKO10127289_B_Yipf4
  gRNA
uguaauagccccuauacuuu

SEQ ID NO: 127290 - RNA, 20 nt, Artificial Sequence
  MKO10127290_B_Yipf5
  gRNA
acaacaccucagccauucua

SEQ ID NO: 127291 - RNA, 20 nt, Artificial Sequence
  MKO10127291_B_Yipf5
  gRNA
uaggcuggcaaaauccaguu

SEQ ID NO: 127292 - RNA, 20 nt, Artificial Sequence
  MKO10127292_B_Yipf5
  gRNA
uaacggugcuacacccccug

SEQ ID NO: 127293 - RNA, 20 nt, Artificial Sequence
  MKO10127293_B_Yipf6
  gRNA
cauguuuccgccaagaaguu

SEQ ID NO: 127294 - RNA, 20 nt, Artificial Sequence
  MKO10127294_B_Yipf6
  gRNA
gaugcgagaucuaaaagcug

SEQ ID NO: 127295 - RNA, 20 nt, Artificial Sequence
  MKO10127295_B_Yipf6
  gRNA
ucucauuguaggggaccugu

SEQ ID NO: 127296 - RNA, 20 nt, Artificial Sequence
  MKO10127296_B_Yipf7
  gRNA
guugcucaucaaguucagua

SEQ ID NO: 127297 - RNA, 20 nt, Artificial Sequence
  MKO10127297_B_Yipf7
  gRNA
gucuuuagaaaacggucaga

SEQ ID NO: 127298 - RNA, 20 nt, Artificial Sequence
  MKO10127298_B_Yipf7
  gRNA
cucuccuacagggguaccau

SEQ ID NO: 127299 - RNA, 20 nt, Artificial Sequence
  MKO10127299_B_Ykt6
  gRNA
cuuuacaagucaacugauug

SEQ ID NO: 127300 - RNA, 20 nt, Artificial Sequence
  MKO10127300_B_Ykt6
  gRNA
aucuuugccaugucuacguc

SEQ ID NO: 127301 - RNA, 20 nt, Artificial Sequence
  MKO10127301_B_Ykt6
  gRNA
ccugcuuaccagaaugauuu

SEQ ID NO: 127302 - RNA, 20 nt, Artificial Sequence
  MKO10127302_B_Ylpm1
  gRNA
ggcaucccuuguggagcucc

SEQ ID NO: 127303 - RNA, 20 nt, Artificial Sequence
  MKO10127303_B_Ylpm1
  gRNA
ccccggagcuucuucuuuga

SEQ ID NO: 127304 - RNA, 20 nt, Artificial Sequence
  MKO10127304_B_Ylpm1
  gRNA
augauuaccugggguuccuc

SEQ ID NO: 127305 - RNA, 20 nt, Artificial Sequence
  MKO10127305_B_Yme1l1
  gRNA
auguugccuguacaagcuag

SEQ ID NO: 127306 - RNA, 20 nt, Artificial Sequence
  MKO10127306_B_Yme1l1
  gRNA
gugauuaccuucacaaauga

SEQ ID NO: 127307 - RNA, 20 nt, Artificial Sequence
  MKO10127307_B_Yme1l1
  gRNA
gcaugaagcucccaguagug

SEQ ID NO: 127308 - RNA, 20 nt, Artificial Sequence
  MKO10127308_B_Yod1
  gRNA
uuccacgacauaguacacac

SEQ ID NO: 127309 - RNA, 20 nt, Artificial Sequence
  MKO10127309_B_Yod1
  gRNA
ugccggugauagcggcgauu

SEQ ID NO: 127310 - RNA, 20 nt, Artificial Sequence
  MKO10127310_B_Yod1
  gRNA
acccgccacauagugucggc

SEQ ID NO: 127311 - RNA, 20 nt, Artificial Sequence
  MKO10127311_B_Ypel1
  gRNA
ggagauaagcucaucgugau

SEQ ID NO: 127312 - RNA, 20 nt, Artificial Sequence
  MKO10127312_B_Ypel1
  gRNA
ucgccccuggcuucccugaa

SEQ ID NO: 127313 - RNA, 20 nt, Artificial Sequence
  MKO10127313_B_Ypel1
  gRNA
guauuucugacugcucucaa

SEQ ID NO: 127314 - RNA, 20 nt, Artificial Sequence
  MKO10127314_B_Ypel2
  gRNA
cuuuggcacagaguuaaugu

SEQ ID NO: 127315 - RNA, 20 nt, Artificial Sequence
  MKO10127315_B_Ypel2
  gRNA
ugaauuagcacacaugauca

SEQ ID NO: 127316 - RNA, 20 nt, Artificial Sequence
  MKO10127316_B_Ypel2
  gRNA
acacucacacugaguugaag

SEQ ID NO: 127317 - RNA, 20 nt, Artificial Sequence
  MKO10127317_B_Ypel3
  gRNA
uguccccacagagugaaugu

SEQ ID NO: 127318 - RNA, 20 nt, Artificial Sequence
  MKO10127318_B_Ypel3
  gRNA
ccaguccuuccagggcaguc

SEQ ID NO: 127319 - RNA, 20 nt, Artificial Sequence
  MKO10127319_B_Ypel3
  gRNA
ugagaacugcaagaccacuu

SEQ ID NO: 127320 - RNA, 20 nt, Artificial Sequence
  MKO10127320_B_Ypel4
  gRNA
aguggacgcaacuguaagug

SEQ ID NO: 127321 - RNA, 20 nt, Artificial Sequence
  MKO10127321_B_Ypel4
  gRNA
cguccacugucgagcacacu

SEQ ID NO: 127322 - RNA, 20 nt, Artificial Sequence
  MKO10127322_B_Ypel4
  gRNA
aaagacaacggcugggauug

SEQ ID NO: 127323 - RNA, 20 nt, Artificial Sequence
  MKO10127323_B_Ypel5
  gRNA
gcucagaacucaucucuacu

SEQ ID NO: 127324 - RNA, 20 nt, Artificial Sequence
  MKO10127324_B_Ypel5
  gRNA
gcacuaguucgagagaguga

SEQ ID NO: 127325 - RNA, 20 nt, Artificial Sequence
  MKO10127325_B_Ypel5
  gRNA
agcucacaucucgaaccaug

SEQ ID NO: 127326 - RNA, 20 nt, Artificial Sequence
  MKO10127326_B_Yrdc
  gRNA
uccugaccaugccuucaugc

SEQ ID NO: 127327 - RNA, 20 nt, Artificial Sequence
  MKO10127327_B_Yrdc
  gRNA
uuggcacuagugagugcaag

SEQ ID NO: 127328 - RNA, 20 nt, Artificial Sequence
  MKO10127328_B_Yrdc
  gRNA
ucuugacucacacgaguaaa

SEQ ID NO: 127329 - RNA, 20 nt, Artificial Sequence
  MKO10127329_B_Ythdc1
  gRNA
cccauugucuuugauagaag

SEQ ID NO: 127330 - RNA, 20 nt, Artificial Sequence
  MKO10127330_B_Ythdc1
  gRNA
gggcaacaacacugagaaug

SEQ ID NO: 127331 - RNA, 20 nt, Artificial Sequence
  MKO10127331_B_Ythdc1
  gRNA
uugcuuacagaugagcuuag

SEQ ID NO: 127332 - RNA, 20 nt, Artificial Sequence
  MKO10127332_B_Ythdc2
  gRNA
caccgacuaagucaaucucu

SEQ ID NO: 127333 - RNA, 20 nt, Artificial Sequence
  MKO10127333_B_Ythdc2
  gRNA
gaguucaguacguucuuuau

SEQ ID NO: 127334 - RNA, 20 nt, Artificial Sequence
  MKO10127334_B_Ythdc2
  gRNA
cgcuugucuugcucauuucu

SEQ ID NO: 127335 - RNA, 20 nt, Artificial Sequence
  MKO10127335_B_Ythdf1
  gRNA
gacuuugagcccuaccuuuc

SEQ ID NO: 127336 - RNA, 20 nt, Artificial Sequence
  MKO10127336_B_Ythdf1
  gRNA
acaaaaggacaagauaauaa

SEQ ID NO: 127337 - RNA, 20 nt, Artificial Sequence
  MKO10127337_B_Ythdf1
  gRNA
ggcagugcacccccaacuau

SEQ ID NO: 127338 - RNA, 20 nt, Artificial Sequence
  MKO10127338_B_Ythdf2
  gRNA
gccgccuaucguuccaugaa

SEQ ID NO: 127339 - RNA, 20 nt, Artificial Sequence
  MKO10127339_B_Ythdf2
  gRNA
ucgcagagaccaaaagguca

SEQ ID NO: 127340 - RNA, 20 nt, Artificial Sequence
  MKO10127340_B_Ythdf2
  gRNA
cuacucaccggccuugccug

SEQ ID NO: 127341 - RNA, 20 nt, Artificial Sequence
  MKO10127341_B_Ythdf3
  gRNA
aagaaugucagccacuagcg

SEQ ID NO: 127342 - RNA, 20 nt, Artificial Sequence
  MKO10127342_B_Ythdf3
  gRNA
cuuaaguagccagacaaauc

SEQ ID NO: 127343 - RNA, 20 nt, Artificial Sequence
  MKO10127343_B_Ythdf3
  gRNA
ucuugcuucagagaccuaaa

SEQ ID NO: 127344 - RNA, 20 nt, Artificial Sequence
  MKO10127344_B_Ywhab
  gRNA
cuuuguaagacucuucauuc

SEQ ID NO: 127345 - RNA, 20 nt, Artificial Sequence
  MKO10127345_B_Ywhab
  gRNA
cccugaucaugcagcugcuc

SEQ ID NO: 127346 - RNA, 20 nt, Artificial Sequence
  MKO10127346_B_Ywhab
  gRNA
uaucuuucugaaguugcauc

SEQ ID NO: 127347 - RNA, 20 nt, Artificial Sequence
  MKO10127347_B_Ywhae
  gRNA
ugaugacgcaauugcagaac

SEQ ID NO: 127348 - RNA, 20 nt, Artificial Sequence
  MKO10127348_B_Ywhae
  gRNA
guugcauauaaaaaugugau

SEQ ID NO: 127349 - RNA, 20 nt, Artificial Sequence
  MKO10127349_B_Ywhae
  gRNA
guuaaucuguugugacauuc

SEQ ID NO: 127350 - RNA, 20 nt, Artificial Sequence
  MKO10127350_B_Ywhag
  gRNA
aaaccgaguaguugagcgcc

SEQ ID NO: 127351 - RNA, 20 nt, Artificial Sequence
  MKO10127351_B_Ywhag
  gRNA
agcgaccagcaagacgacga

SEQ ID NO: 127352 - RNA, 20 nt, Artificial Sequence
  MKO10127352_B_Ywhag
  gRNA
cgagcucgacacucugaacg

SEQ ID NO: 127353 - RNA, 20 nt, Artificial Sequence
  MKO10127353_B_Ywhah
  gRNA
aucgagagcagcugcugcag

SEQ ID NO: 127354 - RNA, 20 nt, Artificial Sequence
  MKO10127354_B_Ywhah
  gRNA
uuucgaucuucguuagauag

SEQ ID NO: 127355 - RNA, 20 nt, Artificial Sequence
  MKO10127355_B_Ywhah
  gRNA
cucagcuauagcaucaucga

SEQ ID NO: 127356 - RNA, 20 nt, Artificial Sequence
  MKO10127356_B_Ywhaq
  gRNA
ggcguuugauauaagcaaga

SEQ ID NO: 127357 - RNA, 20 nt, Artificial Sequence
  MKO10127357_B_Ywhaq
  gRNA
cucuaagcaacugcaugaug

SEQ ID NO: 127358 - RNA, 20 nt, Artificial Sequence
  MKO10127358_B_Ywhaq
  gRNA
caguguaucaagcucugcga

SEQ ID NO: 127359 - RNA, 20 nt, Artificial Sequence
  MKO10127359_B_Ywhaz
  gRNA
gccgacacaccccaucagac

SEQ ID NO: 127360 - RNA, 20 nt, Artificial Sequence
  MKO10127360_B_Ywhaz
  gRNA
uaauguaucaaguucagcaa

SEQ ID NO: 127361 - RNA, 20 nt, Artificial Sequence
  MKO10127361_B_Ywhaz
  gRNA
cugcuucugcuucaucuccu

SEQ ID NO: 127362 - RNA, 20 nt, Artificial Sequence
  MKO10127362_B_Yy1
  gRNA
guccacgucugugcagagug

SEQ ID NO: 127363 - RNA, 20 nt, Artificial Sequence
  MKO10127363_B_Yy1
  gRNA
ugagggcaagcuauuguucu

SEQ ID NO: 127364 - RNA, 20 nt, Artificial Sequence
  MKO10127364_B_Yy1
  gRNA
aaagcuaaaacgacaccagc

SEQ ID NO: 127365 - RNA, 20 nt, Artificial Sequence
  MKO10127365_B_Yy2
  gRNA
uacaucuccauauacuucga

SEQ ID NO: 127366 - RNA, 20 nt, Artificial Sequence
  MKO10127366_B_Yy2
  gRNA
uugacgaccuuuauagaggc

SEQ ID NO: 127367 - RNA, 20 nt, Artificial Sequence
  MKO10127367_B_Yy2
  gRNA
cgccagaaagcccguaaaag

SEQ ID NO: 127368 - RNA, 20 nt, Artificial Sequence
  MKO10127368_B_Zadh2
  gRNA
gagaccuccucguccggaac

SEQ ID NO: 127369 - RNA, 20 nt, Artificial Sequence
  MKO10127369_B_Zadh2
  gRNA
cugucgacuauauguacacg

SEQ ID NO: 127370 - RNA, 20 nt, Artificial Sequence
  MKO10127370_B_Zadh2
  gRNA
gguuccgauaacguggcacu

SEQ ID NO: 127371 - RNA, 20 nt, Artificial Sequence
  MKO10127371_B_Zak
  gRNA
gucgaacuuaauuugcacaa

SEQ ID NO: 127372 - RNA, 20 nt, Artificial Sequence
  MKO10127372_B_Zak
  gRNA
auucuggaaccucccaacua

SEQ ID NO: 127373 - RNA, 20 nt, Artificial Sequence
  MKO10127373_B_Zak
  gRNA
ugcuguuaauguaaucauac

SEQ ID NO: 127374 - RNA, 20 nt, Artificial Sequence
  MKO10127374_B_Zan
  gRNA
cccaugacagcccgaacaug

SEQ ID NO: 127375 - RNA, 20 nt, Artificial Sequence
  MKO10127375_B_Zan
  gRNA
ggggccagaagugcccguca

SEQ ID NO: 127376 - RNA, 20 nt, Artificial Sequence
  MKO10127376_B_Zan
  gRNA
ucccucgaagugugcaccau

SEQ ID NO: 127377 - RNA, 20 nt, Artificial Sequence
  MKO10127377_B_Zap70
  gRNA
ggcaaguacugcauccccga

SEQ ID NO: 127378 - RNA, 20 nt, Artificial Sequence
  MKO10127378_B_Zap70
  gRNA
ucccaacagcagcgccagcg

SEQ ID NO: 127379 - RNA, 20 nt, Artificial Sequence
  MKO10127379_B_Zap70
  gRNA
cugccagagcgugucaaacu

SEQ ID NO: 127380 - RNA, 20 nt, Artificial Sequence
  MKO10127380_B_Zar1l
  gRNA
ccacagagcuccuggcggug

SEQ ID NO: 127381 - RNA, 20 nt, Artificial Sequence
  MKO10127381_B_Zar1l
  gRNA
ccacaccgccaggagcucug

SEQ ID NO: 127382 - RNA, 20 nt, Artificial Sequence
  MKO10127382_B_Zar1l
  gRNA
aguagaagaaauccaguguc

SEQ ID NO: 127383 - RNA, 20 nt, Artificial Sequence
  MKO10127383_B_Zar1
  gRNA
cccagucagacuucgccacg

SEQ ID NO: 127384 - RNA, 20 nt, Artificial Sequence
  MKO10127384_B_Zar1
  gRNA
gugauguccuccacucugua

SEQ ID NO: 127385 - RNA, 20 nt, Artificial Sequence
  MKO10127385_B_Zar1
  gRNA
caguucuuagagcagaagua

SEQ ID NO: 127386 - RNA, 20 nt, Artificial Sequence
  MKO10127386_B_Zbbx
  gRNA
uccgagaagccuugacacag

SEQ ID NO: 127387 - RNA, 20 nt, Artificial Sequence
  MKO10127387_B_Zbbx
  gRNA
ugcugcucaucaguuuauaa

SEQ ID NO: 127388 - RNA, 20 nt, Artificial Sequence
  MKO10127388_B_Zbbx
  gRNA
ucugugaauucgauauuaau

SEQ ID NO: 127389 - RNA, 20 nt, Artificial Sequence
  MKO10127389_B_Zbed3
  gRNA
cggccucugucccgcgcccg

SEQ ID NO: 127390 - RNA, 20 nt, Artificial Sequence
  MKO10127390_B_Zbed3
  gRNA
acagcgcccgcguccacauc

SEQ ID NO: 127391 - RNA, 20 nt, Artificial Sequence
  MKO10127391_B_Zbed3
  gRNA
cagaggccgccuuguuccgc

SEQ ID NO: 127392 - RNA, 20 nt, Artificial Sequence
  MKO10127392_B_Zbed4
  gRNA
ggacccugagucacagccau

SEQ ID NO: 127393 - RNA, 20 nt, Artificial Sequence
  MKO10127393_B_Zbed4
  gRNA
uuccccucgagauagcacua

SEQ ID NO: 127394 - RNA, 20 nt, Artificial Sequence
  MKO10127394_B_Zbed4
  gRNA
cugccuccuccucugugaac

SEQ ID NO: 127395 - RNA, 20 nt, Artificial Sequence
  MKO10127395_B_Zbed6
  gRNA
cuccugaaugauacgaugcc

SEQ ID NO: 127396 - RNA, 20 nt, Artificial Sequence
  MKO10127396_B_Zbed6
  gRNA
gccccugcuucguuagcuuc

SEQ ID NO: 127397 - RNA, 20 nt, Artificial Sequence
  MKO10127397_B_Zbed6
  gRNA
aauuauauggaaucuucgcc

SEQ ID NO: 127398 - RNA, 20 nt, Artificial Sequence
  MKO10127398_B_Zbp1
  gRNA
cuuggccuuccugacgugag

SEQ ID NO: 127399 - RNA, 20 nt, Artificial Sequence
  MKO10127399_B_Zbp1
  gRNA
ccuccugugcucaagucaac

SEQ ID NO: 127400 - RNA, 20 nt, Artificial Sequence
  MKO10127400_B_Zbp1
  gRNA
gcuccuguugacuugagcac

SEQ ID NO: 127401 - RNA, 20 nt, Artificial Sequence
  MKO10127401_B_Zbtb10
  gRNA
guagcuauguagccaaauac

SEQ ID NO: 127402 - RNA, 20 nt, Artificial Sequence
  MKO10127402_B_Zbtb10
  gRNA
gccugcaguggucaagaugc

SEQ ID NO: 127403 - RNA, 20 nt, Artificial Sequence
  MKO10127403_B_Zbtb10
  gRNA
acacguaaaaagacauuccc

SEQ ID NO: 127404 - RNA, 20 nt, Artificial Sequence
  MKO10127404_B_Zbtb11
  gRNA
aauauucacuauuagccgag

SEQ ID NO: 127405 - RNA, 20 nt, Artificial Sequence
  MKO10127405_B_Zbtb11
  gRNA
gggcuauauccggcuacaca

SEQ ID NO: 127406 - RNA, 20 nt, Artificial Sequence
  MKO10127406_B_Zbtb11
  gRNA
aauggaacuacaacaccacc

SEQ ID NO: 127407 - RNA, 20 nt, Artificial Sequence
  MKO10127407_B_Zbtb12
  gRNA
cgauacccagacccccggcu

SEQ ID NO: 127408 - RNA, 20 nt, Artificial Sequence
  MKO10127408_B_Zbtb12
  gRNA
caccacgguggacguucaug

SEQ ID NO: 127409 - RNA, 20 nt, Artificial Sequence
  MKO10127409_B_Zbtb12
  gRNA
ugacaucugcaucgucaaag

SEQ ID NO: 127410 - RNA, 20 nt, Artificial Sequence
  MKO10127410_B_Zbtb14
  gRNA
aacacugaacgaacagcgcc

SEQ ID NO: 127411 - RNA, 20 nt, Artificial Sequence
  MKO10127411_B_Zbtb14
  gRNA
gacucccgaauccaaagauc

SEQ ID NO: 127412 - RNA, 20 nt, Artificial Sequence
  MKO10127412_B_Zbtb14
  gRNA
ucacacaugugacacgcaaa

SEQ ID NO: 127413 - RNA, 20 nt, Artificial Sequence
  MKO10127413_B_Zbtb16
  gRNA
acauacgggugugaacucug

SEQ ID NO: 127414 - RNA, 20 nt, Artificial Sequence
  MKO10127414_B_Zbtb16
  gRNA
uucucagucgcaaacugucc

SEQ ID NO: 127415 - RNA, 20 nt, Artificial Sequence
  MKO10127415_B_Zbtb16
  gRNA
guucucaaaggaggaugccc

SEQ ID NO: 127416 - RNA, 20 nt, Artificial Sequence
  MKO10127416_B_Zbtb17
  gRNA
agaacaucguccacguucuc

SEQ ID NO: 127417 - RNA, 20 nt, Artificial Sequence
  MKO10127417_B_Zbtb17
  gRNA
gccggaccccacaagcagca

SEQ ID NO: 127418 - RNA, 20 nt, Artificial Sequence
  MKO10127418_B_Zbtb17
  gRNA
gagccuuagcccugagaacg

SEQ ID NO: 127419 - RNA, 20 nt, Artificial Sequence
  MKO10127419_B_Zbtb18
  gRNA
gccgcauugggugcacgugu

SEQ ID NO: 127420 - RNA, 20 nt, Artificial Sequence
  MKO10127420_B_Zbtb18
  gRNA
agcugcuagcacguccucaa

SEQ ID NO: 127421 - RNA, 20 nt, Artificial Sequence
  MKO10127421_B_Zbtb18
  gRNA
ggcucagguugugcgaguac

SEQ ID NO: 127422 - RNA, 20 nt, Artificial Sequence
  MKO10127422_B_Zbtb1
  gRNA
cauaugaucucgcaccuguc

SEQ ID NO: 127423 - RNA, 20 nt, Artificial Sequence
  MKO10127423_B_Zbtb1
  gRNA
cgucgagacacacguucuuu

SEQ ID NO: 127424 - RNA, 20 nt, Artificial Sequence
  MKO10127424_B_Zbtb1
  gRNA
ugaaucaucaggcgccuggu

SEQ ID NO: 127425 - RNA, 20 nt, Artificial Sequence
  MKO10127425_B_Zbtb20
  gRNA
ccuccggcaggcacgccccc

SEQ ID NO: 127426 - RNA, 20 nt, Artificial Sequence
  MKO10127426_B_Zbtb20
  gRNA
guacucacaaucagaugacc

SEQ ID NO: 127427 - RNA, 20 nt, Artificial Sequence
  MKO10127427_B_Zbtb20
  gRNA
uugucagugaaugugucgag

SEQ ID NO: 127428 - RNA, 20 nt, Artificial Sequence
  MKO10127428_B_Zbtb21
  gRNA
agaacguugucaaaagcguc

SEQ ID NO: 127429 - RNA, 20 nt, Artificial Sequence
  MKO10127429_B_Zbtb21
  gRNA
aagaaagaugugugcuugcc

SEQ ID NO: 127430 - RNA, 20 nt, Artificial Sequence
  MKO10127430_B_Zbtb21
  gRNA
uuaugaugcacaguguacag

SEQ ID NO: 127431 - RNA, 20 nt, Artificial Sequence
  MKO10127431_B_Zbtb22
  gRNA
cugcggaucgacccucccga

SEQ ID NO: 127432 - RNA, 20 nt, Artificial Sequence
  MKO10127432_B_Zbtb22
  gRNA
gacacugugagcgucggcac

SEQ ID NO: 127433 - RNA, 20 nt, Artificial Sequence
  MKO10127433_B_Zbtb22
  gRNA
gccgaugagcuaugcgauga

SEQ ID NO: 127434 - RNA, 20 nt, Artificial Sequence
  MKO10127434_B_Zbtb24
  gRNA
agccauuaucguguccauac

SEQ ID NO: 127435 - RNA, 20 nt, Artificial Sequence
  MKO10127435_B_Zbtb24
  gRNA
ggcugcauucugguagugag

SEQ ID NO: 127436 - RNA, 20 nt, Artificial Sequence
  MKO10127436_B_Zbtb24
  gRNA
ccauacaccugcaccgugug

SEQ ID NO: 127437 - RNA, 20 nt, Artificial Sequence
  MKO10127437_B_Zbtb25
  gRNA
ugugacugcacaguugcuau

SEQ ID NO: 127438 - RNA, 20 nt, Artificial Sequence
  MKO10127438_B_Zbtb25
  gRNA
ucaccugagcacucgagccg

SEQ ID NO: 127439 - RNA, 20 nt, Artificial Sequence
  MKO10127439_B_Zbtb25
  gRNA
acagauauaaccguugccaa

SEQ ID NO: 127440 - RNA, 20 nt, Artificial Sequence
  MKO10127440_B_Zbtb26
  gRNA
aucuauuggggauguaucag

SEQ ID NO: 127441 - RNA, 20 nt, Artificial Sequence
  MKO10127441_B_Zbtb26
  gRNA
uugcucuuguccuguuauag

SEQ ID NO: 127442 - RNA, 20 nt, Artificial Sequence
  MKO10127442_B_Zbtb26
  gRNA
gccacaaccugaugcaacac

SEQ ID NO: 127443 - RNA, 20 nt, Artificial Sequence
  MKO10127443_B_Zbtb2
  gRNA
uguuguuuguccaucagacc

SEQ ID NO: 127444 - RNA, 20 nt, Artificial Sequence
  MKO10127444_B_Zbtb2
  gRNA
uguacaugugcucacgccag

SEQ ID NO: 127445 - RNA, 20 nt, Artificial Sequence
  MKO10127445_B_Zbtb2
  gRNA
ucgcugaucauccccgccuc

SEQ ID NO: 127446 - RNA, 20 nt, Artificial Sequence
  MKO10127446_B_Zbtb32
  gRNA
ccagacguuucuaucugcca

SEQ ID NO: 127447 - RNA, 20 nt, Artificial Sequence
  MKO10127447_B_Zbtb32
  gRNA
cagauagaaacgucugggca

SEQ ID NO: 127448 - RNA, 20 nt, Artificial Sequence
  MKO10127448_B_Zbtb32
  gRNA
uacccucuccugcucgcucu

SEQ ID NO: 127449 - RNA, 20 nt, Artificial Sequence
  MKO10127449_B_Zbtb33
  gRNA
cucagaacaagucaacguuc

SEQ ID NO: 127450 - RNA, 20 nt, Artificial Sequence
  MKO10127450_B_Zbtb33
  gRNA
guucauagucaagauccuuc

SEQ ID NO: 127451 - RNA, 20 nt, Artificial Sequence
  MKO10127451_B_Zbtb33
  gRNA
aacuccuugaaugaacagcg

SEQ ID NO: 127452 - RNA, 20 nt, Artificial Sequence
  MKO10127452_B_Zbtb34
  gRNA
accuugaauugcauucuucc

SEQ ID NO: 127453 - RNA, 20 nt, Artificial Sequence
  MKO10127453_B_Zbtb34
  gRNA
ccaacaaguccccuugcucg

SEQ ID NO: 127454 - RNA, 20 nt, Artificial Sequence
  MKO10127454_B_Zbtb34
  gRNA
auaaccgggauuguucauca

SEQ ID NO: 127455 - RNA, 20 nt, Artificial Sequence
  MKO10127455_B_Zbtb37
  gRNA
uaugccguggacuaagugag

SEQ ID NO: 127456 - RNA, 20 nt, Artificial Sequence
  MKO10127456_B_Zbtb37
  gRNA
uccaacagauuuagucccuc

SEQ ID NO: 127457 - RNA, 20 nt, Artificial Sequence
  MKO10127457_B_Zbtb37
  gRNA
accugggagcuaaguugcuu

SEQ ID NO: 127458 - RNA, 20 nt, Artificial Sequence
  MKO10127458_B_Zbtb38
  gRNA
uggguaucugcaccggccga

SEQ ID NO: 127459 - RNA, 20 nt, Artificial Sequence
  MKO10127459_B_Zbtb38
  gRNA
gcuugaucaccgacgagaac

SEQ ID NO: 127460 - RNA, 20 nt, Artificial Sequence
  MKO10127460_B_Zbtb38
  gRNA
cuugucagacgcggaccaca

SEQ ID NO: 127461 - RNA, 20 nt, Artificial Sequence
  MKO10127461_B_Zbtb39
  gRNA
gguaguugaacucgcuugug

SEQ ID NO: 127462 - RNA, 20 nt, Artificial Sequence
  MKO10127462_B_Zbtb39
  gRNA
cugacccugcaccggcggga

SEQ ID NO: 127463 - RNA, 20 nt, Artificial Sequence
  MKO10127463_B_Zbtb39
  gRNA
caagcgaguucaacuaccac

SEQ ID NO: 127464 - RNA, 20 nt, Artificial Sequence
  MKO10127464_B_Zbtb3
  gRNA
agggcaguaucaucgagggc

SEQ ID NO: 127465 - RNA, 20 nt, Artificial Sequence
  MKO10127465_B_Zbtb3
  gRNA
gcugccagcacaucuucuag

SEQ ID NO: 127466 - RNA, 20 nt, Artificial Sequence
  MKO10127466_B_Zbtb3
  gRNA
gaggggcugcaccccuagaa

SEQ ID NO: 127467 - RNA, 20 nt, Artificial Sequence
  MKO10127467_B_Zbtb40
  gRNA
aacacagcucagaccuauug

SEQ ID NO: 127468 - RNA, 20 nt, Artificial Sequence
  MKO10127468_B_Zbtb40
  gRNA
agacgcuuucaugcucuagc

SEQ ID NO: 127469 - RNA, 20 nt, Artificial Sequence
  MKO10127469_B_Zbtb40
  gRNA
uuagcuaguaccuguggugc

SEQ ID NO: 127470 - RNA, 20 nt, Artificial Sequence
  MKO10127470_B_Zbtb41
  gRNA
cgccauauagaauguacuca

SEQ ID NO: 127471 - RNA, 20 nt, Artificial Sequence
  MKO10127471_B_Zbtb41
  gRNA
ugacgaccacauauaucaca

SEQ ID NO: 127472 - RNA, 20 nt, Artificial Sequence
  MKO10127472_B_Zbtb41
  gRNA
aucauguguucuuccaagug

SEQ ID NO: 127473 - RNA, 20 nt, Artificial Sequence
  MKO10127473_B_Zbtb42
  gRNA
gcccgcgagcagccgcgaca

SEQ ID NO: 127474 - RNA, 20 nt, Artificial Sequence
  MKO10127474_B_Zbtb42
  gRNA
cuucauguacgagggccgcu

SEQ ID NO: 127475 - RNA, 20 nt, Artificial Sequence
  MKO10127475_B_Zbtb42
  gRNA
ggggaucgguccgcgcucug

SEQ ID NO: 127476 - RNA, 20 nt, Artificial Sequence
  MKO10127476_B_Zbtb43
  gRNA
aucguacuuugcucuguccu

SEQ ID NO: 127477 - RNA, 20 nt, Artificial Sequence
  MKO10127477_B_Zbtb43
  gRNA
ccguuguaguuacugcuacu

SEQ ID NO: 127478 - RNA, 20 nt, Artificial Sequence
  MKO10127478_B_Zbtb43
  gRNA
ccacgugaagccugagcgcu

SEQ ID NO: 127479 - RNA, 20 nt, Artificial Sequence
  MKO10127479_B_Zbtb44
  gRNA
caaaaucuuccgggcucaca

SEQ ID NO: 127480 - RNA, 20 nt, Artificial Sequence
  MKO10127480_B_Zbtb44
  gRNA
agcguuuaccuucgugcuuu

SEQ ID NO: 127481 - RNA, 20 nt, Artificial Sequence
  MKO10127481_B_Zbtb44
  gRNA
aacggucugucuggaccauu

SEQ ID NO: 127482 - RNA, 20 nt, Artificial Sequence
  MKO10127482_B_Zbtb45
  gRNA
cgauuaccugcucaagcaua

SEQ ID NO: 127483 - RNA, 20 nt, Artificial Sequence
  MKO10127483_B_Zbtb45
  gRNA
gugagcgcgaaaaguucugu

SEQ ID NO: 127484 - RNA, 20 nt, Artificial Sequence
  MKO10127484_B_Zbtb45
  gRNA
ccaccgucugcgccacuugc

SEQ ID NO: 127485 - RNA, 20 nt, Artificial Sequence
  MKO10127485_B_Zbtb46
  gRNA
ugcuggugaagggccguacc

SEQ ID NO: 127486 - RNA, 20 nt, Artificial Sequence
  MKO10127486_B_Zbtb46
  gRNA
cuucauguacuccgcccauc

SEQ ID NO: 127487 - RNA, 20 nt, Artificial Sequence
  MKO10127487_B_Zbtb46
  gRNA
gcacauaagaacgucuugcu

SEQ ID NO: 127488 - RNA, 20 nt, Artificial Sequence
  MKO10127488_B_Zbtb48
  gRNA
cccuucgagugucccaaaug

SEQ ID NO: 127489 - RNA, 20 nt, Artificial Sequence
  MKO10127489_B_Zbtb48
  gRNA
gcacuuacugcgugggguuu

SEQ ID NO: 127490 - RNA, 20 nt, Artificial Sequence
  MKO10127490_B_Zbtb48
  gRNA
cgucccugucguccuccacu

SEQ ID NO: 127491 - RNA, 20 nt, Artificial Sequence
  MKO10127491_B_Zbtb49
  gRNA
accuucagacucacuuacgc

SEQ ID NO: 127492 - RNA, 20 nt, Artificial Sequence
  MKO10127492_B_Zbtb49
  gRNA
ccgcacgugucacacaagug

SEQ ID NO: 127493 - RNA, 20 nt, Artificial Sequence
  MKO10127493_B_Zbtb49
  gRNA
gccggcguaagugagucuga

SEQ ID NO: 127494 - RNA, 20 nt, Artificial Sequence
  MKO10127494_B_Zbtb4
  gRNA
gcccuacaagaccuacaguc

SEQ ID NO: 127495 - RNA, 20 nt, Artificial Sequence
  MKO10127495_B_Zbtb4
  gRNA
gcuggguaucucccgucuac

SEQ ID NO: 127496 - RNA, 20 nt, Artificial Sequence
  MKO10127496_B_Zbtb4
  gRNA
gucgacgaggguccaacacu

SEQ ID NO: 127497 - RNA, 20 nt, Artificial Sequence
  MKO10127497_B_Zbtb5
  gRNA
ucccgggaaugaacucccgc

SEQ ID NO: 127498 - RNA, 20 nt, Artificial Sequence
  MKO10127498_B_Zbtb5
  gRNA
caacguuauggaugucuuau

SEQ ID NO: 127499 - RNA, 20 nt, Artificial Sequence
  MKO10127499_B_Zbtb5
  gRNA
guccccgacccugucggugc

SEQ ID NO: 127500 - RNA, 20 nt, Artificial Sequence
  MKO10127500_B_Zbtb6
  gRNA
uucgaggacacauggguaua

SEQ ID NO: 127501 - RNA, 20 nt, Artificial Sequence
  MKO10127501_B_Zbtb6
  gRNA
ccaaaaucaccuugugcccc

SEQ ID NO: 127502 - RNA, 20 nt, Artificial Sequence
  MKO10127502_B_Zbtb6
  gRNA
cucaguaucguuaauauaaa

SEQ ID NO: 127503 - RNA, 20 nt, Artificial Sequence
  MKO10127503_B_Zbtb7a
  gRNA
aaugggguccccucgcgccg

SEQ ID NO: 127504 - RNA, 20 nt, Artificial Sequence
  MKO10127504_B_Zbtb7a
  gRNA
ucaguggggcccgccccguc

SEQ ID NO: 127505 - RNA, 20 nt, Artificial Sequence
  MKO10127505_B_Zbtb7a
  gRNA
cggugcccccgacgacgacc

SEQ ID NO: 127506 - RNA, 20 nt, Artificial Sequence
  MKO10127506_B_Zbtb7b
  gRNA
cgaccuuuccaauggccacc

SEQ ID NO: 127507 - RNA, 20 nt, Artificial Sequence
  MKO10127507_B_Zbtb7b
  gRNA
ugagcgagcccgacaguacc

SEQ ID NO: 127508 - RNA, 20 nt, Artificial Sequence
  MKO10127508_B_Zbtb7b
  gRNA
uuaccuaaguucgcugcacc

SEQ ID NO: 127509 - RNA, 20 nt, Artificial Sequence
  MKO10127509_B_Zbtb7c
  gRNA
aaagucgaucucauacacgu

SEQ ID NO: 127510 - RNA, 20 nt, Artificial Sequence
  MKO10127510_B_Zbtb7c
  gRNA
ccgagaacguggccgccacu

SEQ ID NO: 127511 - RNA, 20 nt, Artificial Sequence
  MKO10127511_B_Zbtb7c
  gRNA
guggucgcaagcccgcggcc

SEQ ID NO: 127512 - RNA, 20 nt, Artificial Sequence
  MKO10127512_B_Zbtb8a
  gRNA
cuugugggaaacgguucagc

SEQ ID NO: 127513 - RNA, 20 nt, Artificial Sequence
  MKO10127513_B_Zbtb8a
  gRNA
acggucgcugaggacuccuc

SEQ ID NO: 127514 - RNA, 20 nt, Artificial Sequence
  MKO10127514_B_Zbtb8a
  gRNA
guauacauacaguucggaaa

SEQ ID NO: 127515 - RNA, 20 nt, Artificial Sequence
  MKO10127515_B_Zbtb8b
  gRNA
ggcuuccucaggugacgugc

SEQ ID NO: 127516 - RNA, 20 nt, Artificial Sequence
  MKO10127516_B_Zbtb8b
  gRNA
gguaaguugggccgaaugug

SEQ ID NO: 127517 - RNA, 20 nt, Artificial Sequence
  MKO10127517_B_Zbtb8b
  gRNA
cgacagccuuugcagauaau

SEQ ID NO: 127518 - RNA, 20 nt, Artificial Sequence
  MKO10127518_B_Zbtb8os
  gRNA
accuuggguuucuacuucca

SEQ ID NO: 127519 - RNA, 20 nt, Artificial Sequence
  MKO10127519_B_Zbtb8os
  gRNA
aucugucauguaaccaaaca

SEQ ID NO: 127520 - RNA, 20 nt, Artificial Sequence
  MKO10127520_B_Zbtb8os
  gRNA
cugaugaguacuucauaccc

SEQ ID NO: 127521 - RNA, 20 nt, Artificial Sequence
  MKO10127521_B_Zbtb9
  gRNA
acgcaugcagagcucucgca

SEQ ID NO: 127522 - RNA, 20 nt, Artificial Sequence
  MKO10127522_B_Zbtb9
  gRNA
gacuuuaccgaaugucaucg

SEQ ID NO: 127523 - RNA, 20 nt, Artificial Sequence
  MKO10127523_B_Zbtb9
  gRNA
ugaacgucaacaugaugugu

SEQ ID NO: 127524 - RNA, 20 nt, Artificial Sequence
  MKO10127524_B_Zbtbd6
  gRNA
gguggacgagacccuguuac

SEQ ID NO: 127525 - RNA, 20 nt, Artificial Sequence
  MKO10127525_B_Zbtbd6
  gRNA
ugugguaauugagccacuaa

SEQ ID NO: 127526 - RNA, 20 nt, Artificial Sequence
  MKO10127526_B_Zbtbd6
  gRNA
ccgcugugccgccccugugu

SEQ ID NO: 127527 - RNA, 20 nt, Artificial Sequence
  MKO10127527_B_Zc2hc1a
  gRNA
uuuaccuguggccgagaagc

SEQ ID NO: 127528 - RNA, 20 nt, Artificial Sequence
  MKO10127528_B_Zc2hc1a
  gRNA
uccaguguccguauugccag

SEQ ID NO: 127529 - RNA, 20 nt, Artificial Sequence
  MKO10127529_B_Zc2hc1a
  gRNA
gaccuucuucccguuggcuc

SEQ ID NO: 127530 - RNA, 20 nt, Artificial Sequence
  MKO10127530_B_Zc2hc1b
  gRNA
ccccguccaaccuccaaccc

SEQ ID NO: 127531 - RNA, 20 nt, Artificial Sequence
  MKO10127531_B_Zc2hc1b
  gRNA
augcuuugcaacagauguuc

SEQ ID NO: 127532 - RNA, 20 nt, Artificial Sequence
  MKO10127532_B_Zc2hc1b
  gRNA
ggguaaaucuccucagccca

SEQ ID NO: 127533 - RNA, 20 nt, Artificial Sequence
  MKO10127533_B_Zc2hc1c
  gRNA
ccgaguggacccagauccaa

SEQ ID NO: 127534 - RNA, 20 nt, Artificial Sequence
  MKO10127534_B_Zc2hc1c
  gRNA
gucgcgcaugccggagggua

SEQ ID NO: 127535 - RNA, 20 nt, Artificial Sequence
  MKO10127535_B_Zc2hc1c
  gRNA
ucaagucgguccgggacacc

SEQ ID NO: 127536 - RNA, 20 nt, Artificial Sequence
  MKO10127536_B_Zc3h10
  gRNA
cacgccgcugucagccgcuc

SEQ ID NO: 127537 - RNA, 20 nt, Artificial Sequence
  MKO10127537_B_Zc3h10
  gRNA
ucgaaaugggggccgucagg

SEQ ID NO: 127538 - RNA, 20 nt, Artificial Sequence
  MKO10127538_B_Zc3h10
  gRNA
ucacccgccgaccuacccaa

SEQ ID NO: 127539 - RNA, 20 nt, Artificial Sequence
  MKO10127539_B_Zc3h11a
  gRNA
ccaucuccugacguccauaa

SEQ ID NO: 127540 - RNA, 20 nt, Artificial Sequence
  MKO10127540_B_Zc3h11a
  gRNA
ggaagaguccaucaacauag

SEQ ID NO: 127541 - RNA, 20 nt, Artificial Sequence
  MKO10127541_B_Zc3h11a
  gRNA
cuagugcagcuucacaguga

SEQ ID NO: 127542 - RNA, 20 nt, Artificial Sequence
  MKO10127542_B_Zc3h12a
  gRNA
cgaguggggcccgacucccc

SEQ ID NO: 127543 - RNA, 20 nt, Artificial Sequence
  MKO10127543_B_Zc3h12a
  gRNA
uuaccguguuugugccaucu

SEQ ID NO: 127544 - RNA, 20 nt, Artificial Sequence
  MKO10127544_B_Zc3h12a
  gRNA
gcucaucggccacagagcgc

SEQ ID NO: 127545 - RNA, 20 nt, Artificial Sequence
  MKO10127545_B_Zc3h12b
  gRNA
ggccaaccaaccccagcguu

SEQ ID NO: 127546 - RNA, 20 nt, Artificial Sequence
  MKO10127546_B_Zc3h12b
  gRNA
cucggaccauggcguccaag

SEQ ID NO: 127547 - RNA, 20 nt, Artificial Sequence
  MKO10127547_B_Zc3h12b
  gRNA
ucaagauauucuacguaaac

SEQ ID NO: 127548 - RNA, 20 nt, Artificial Sequence
  MKO10127548_B_Zc3h12c
  gRNA
cgcccugacgcccucaucac

SEQ ID NO: 127549 - RNA, 20 nt, Artificial Sequence
  MKO10127549_B_Zc3h12c
  gRNA
gccgugauggugugaauacc

SEQ ID NO: 127550 - RNA, 20 nt, Artificial Sequence
  MKO10127550_B_Zc3h12c
  gRNA
agcacaccacucgccugccc

SEQ ID NO: 127551 - RNA, 20 nt, Artificial Sequence
  MKO10127551_B_Zc3h12d
  gRNA
accccaucccgcaaggugaa

SEQ ID NO: 127552 - RNA, 20 nt, Artificial Sequence
  MKO10127552_B_Zc3h12d
  gRNA
accauagggacaguguugcc

SEQ ID NO: 127553 - RNA, 20 nt, Artificial Sequence
  MKO10127553_B_Zc3h12d
  gRNA
ccacagccagacgaauuccc

SEQ ID NO: 127554 - RNA, 20 nt, Artificial Sequence
  MKO10127554_B_Zc3h13
  gRNA
aagacuggcagcugccucua

SEQ ID NO: 127555 - RNA, 20 nt, Artificial Sequence
  MKO10127555_B_Zc3h13
  gRNA
uuauguucaugaguuaucau

SEQ ID NO: 127556 - RNA, 20 nt, Artificial Sequence
  MKO10127556_B_Zc3h13
  gRNA
cuuuagaaagaaucuucaag

SEQ ID NO: 127557 - RNA, 20 nt, Artificial Sequence
  MKO10127557_B_Zc3h14
  gRNA
uacucacuugcaaggugaaa

SEQ ID NO: 127558 - RNA, 20 nt, Artificial Sequence
  MKO10127558_B_Zc3h14
  gRNA
ucaccagcaccgucuucuaa

SEQ ID NO: 127559 - RNA, 20 nt, Artificial Sequence
  MKO10127559_B_Zc3h14
  gRNA
cagagcuggccauuagaaga

SEQ ID NO: 127560 - RNA, 20 nt, Artificial Sequence
  MKO10127560_B_Zc3h15
  gRNA
gaaugcgcacaccacagauu

SEQ ID NO: 127561 - RNA, 20 nt, Artificial Sequence
  MKO10127561_B_Zc3h15
  gRNA
gucacucaucaagugaaauu

SEQ ID NO: 127562 - RNA, 20 nt, Artificial Sequence
  MKO10127562_B_Zc3h15
  gRNA
gcugcacaaaaaauaagcaa

SEQ ID NO: 127563 - RNA, 20 nt, Artificial Sequence
  MKO10127563_B_Zc3h18
  gRNA
ucacgcacccaaggguuggc

SEQ ID NO: 127564 - RNA, 20 nt, Artificial Sequence
  MKO10127564_B_Zc3h18
  gRNA
uggggcgaggccucaccuuc

SEQ ID NO: 127565 - RNA, 20 nt, Artificial Sequence
  MKO10127565_B_Zc3h18
  gRNA
cccagcgggauccccaugcg

SEQ ID NO: 127566 - RNA, 20 nt, Artificial Sequence
  MKO10127566_B_Zc3h3
  gRNA
accugguauugccccgccuc

SEQ ID NO: 127567 - RNA, 20 nt, Artificial Sequence
  MKO10127567_B_Zc3h3
  gRNA
acccaccucuccaccaagga

SEQ ID NO: 127568 - RNA, 20 nt, Artificial Sequence
  MKO10127568_B_Zc3h3
  gRNA
uggcagccacccauguuccc

SEQ ID NO: 127569 - RNA, 20 nt, Artificial Sequence
  MKO10127569_B_Zc3h4
  gRNA
gagauccuccucgacuccca

SEQ ID NO: 127570 - RNA, 20 nt, Artificial Sequence
  MKO10127570_B_Zc3h4
  gRNA
acuacgagaaugagcaguau

SEQ ID NO: 127571 - RNA, 20 nt, Artificial Sequence
  MKO10127571_B_Zc3h4
  gRNA
uacaggggccgugggagucg

SEQ ID NO: 127572 - RNA, 20 nt, Artificial Sequence
  MKO10127572_B_Zc3h6
  gRNA
aucauaaucccuguaggagc

SEQ ID NO: 127573 - RNA, 20 nt, Artificial Sequence
  MKO10127573_B_Zc3h6
  gRNA
uccauuccugaaaagacaua

SEQ ID NO: 127574 - RNA, 20 nt, Artificial Sequence
  MKO10127574_B_Zc3h6
  gRNA
auuugaagaaacacaagauc

SEQ ID NO: 127575 - RNA, 20 nt, Artificial Sequence
  MKO10127575_B_Zc3h7a
  gRNA
auauuuaucgggaaugugac

SEQ ID NO: 127576 - RNA, 20 nt, Artificial Sequence
  MKO10127576_B_Zc3h7a
  gRNA
uccuuaccgcauacugcucc

SEQ ID NO: 127577 - RNA, 20 nt, Artificial Sequence
  MKO10127577_B_Zc3h7a
  gRNA
ucaagaauuagcucagaaau

SEQ ID NO: 127578 - RNA, 20 nt, Artificial Sequence
  MKO10127578_B_Zc3h7b
  gRNA
uguggcgccccagcucguug

SEQ ID NO: 127579 - RNA, 20 nt, Artificial Sequence
  MKO10127579_B_Zc3h7b
  gRNA
gaaagccuauaagagacccc

SEQ ID NO: 127580 - RNA, 20 nt, Artificial Sequence
  MKO10127580_B_Zc3h7b
  gRNA
accuaccuggggucucuuau

SEQ ID NO: 127581 - RNA, 20 nt, Artificial Sequence
  MKO10127581_B_Zc3h8
  gRNA
uuuacuuaguuuaagcaccu

SEQ ID NO: 127582 - RNA, 20 nt, Artificial Sequence
  MKO10127582_B_Zc3h8
  gRNA
ugcugaagaacaguggcucc

SEQ ID NO: 127583 - RNA, 20 nt, Artificial Sequence
  MKO10127583_B_Zc3h8
  gRNA
ggagccacuguucuucagca

SEQ ID NO: 127584 - RNA, 20 nt, Artificial Sequence
  MKO10127584_B_Zc3hav1l
  gRNA
gugugcaaauccuuugugcg

SEQ ID NO: 127585 - RNA, 20 nt, Artificial Sequence
  MKO10127585_B_Zc3hav1l
  gRNA
uucgcagcugcccuucauug

SEQ ID NO: 127586 - RNA, 20 nt, Artificial Sequence
  MKO10127586_B_Zc3hav1l
  gRNA
cuuggacguugauaggugug

SEQ ID NO: 127587 - RNA, 20 nt, Artificial Sequence
  MKO10127587_B_Zc3hav1
  gRNA
cggagagcucaugauucuuc

SEQ ID NO: 127588 - RNA, 20 nt, Artificial Sequence
  MKO10127588_B_Zc3hav1
  gRNA
gagggccgcaaacagaucug

SEQ ID NO: 127589 - RNA, 20 nt, Artificial Sequence
  MKO10127589_B_Zc3hav1
  gRNA
ucauccauccuaggagauac

SEQ ID NO: 127590 - RNA, 20 nt, Artificial Sequence
  MKO10127590_B_Zc3hc1
  gRNA
gaggcgauccaucaacugac

SEQ ID NO: 127591 - RNA, 20 nt, Artificial Sequence
  MKO10127591_B_Zc3hc1
  gRNA
gccacauuccagucaguuga

SEQ ID NO: 127592 - RNA, 20 nt, Artificial Sequence
  MKO10127592_B_Zc3hc1
  gRNA
guaccuggagaggggcuguc

SEQ ID NO: 127593 - RNA, 20 nt, Artificial Sequence
  MKO10127593_B_Zc4h2
  gRNA
ugcugcugcucaacaacucc

SEQ ID NO: 127594 - RNA, 20 nt, Artificial Sequence
  MKO10127594_B_Zc4h2
  gRNA
gcauccacguguucuuucag

SEQ ID NO: 127595 - RNA, 20 nt, Artificial Sequence
  MKO10127595_B_Zc4h2
  gRNA
agcucacucaccuucauagg

SEQ ID NO: 127596 - RNA, 20 nt, Artificial Sequence
  MKO10127596_B_Zcchc10
  gRNA
cgagcuggaguccgaguccg

SEQ ID NO: 127597 - RNA, 20 nt, Artificial Sequence
  MKO10127597_B_Zcchc10
  gRNA
agauggcgacucccaugcau

SEQ ID NO: 127598 - RNA, 20 nt, Artificial Sequence
  MKO10127598_B_Zcchc10
  gRNA
acugucacugcuagagguac

SEQ ID NO: 127599 - RNA, 20 nt, Artificial Sequence
  MKO10127599_B_Zcchc11
  gRNA
acauuuccuccacaaugucc

SEQ ID NO: 127600 - RNA, 20 nt, Artificial Sequence
  MKO10127600_B_Zcchc11
  gRNA
cugcuuugacaccugagcag

SEQ ID NO: 127601 - RNA, 20 nt, Artificial Sequence
  MKO10127601_B_Zcchc11
  gRNA
uuauuucagaauguucacug

SEQ ID NO: 127602 - RNA, 20 nt, Artificial Sequence
  MKO10127602_B_Zcchc12
  gRNA
agaugacucuccugaugauu

SEQ ID NO: 127603 - RNA, 20 nt, Artificial Sequence
  MKO10127603_B_Zcchc12
  gRNA
ucgauacugcugaucauuau

SEQ ID NO: 127604 - RNA, 20 nt, Artificial Sequence
  MKO10127604_B_Zcchc12
  gRNA
ugaguacagaccuucgauuc

SEQ ID NO: 127605 - RNA, 20 nt, Artificial Sequence
  MKO10127605_B_Zcchc13
  gRNA
gaccucuugcuguucgcccu

SEQ ID NO: 127606 - RNA, 20 nt, Artificial Sequence
  MKO10127606_B_Zcchc13
  gRNA
uccgauguuuguuaucgcug

SEQ ID NO: 127607 - RNA, 20 nt, Artificial Sequence
  MKO10127607_B_Zcchc13
  gRNA
cacaucuguagcacuuaauu

SEQ ID NO: 127608 - RNA, 20 nt, Artificial Sequence
  MKO10127608_B_Zcchc14
  gRNA
cguuccacauagaaggaauc

SEQ ID NO: 127609 - RNA, 20 nt, Artificial Sequence
  MKO10127609_B_Zcchc14
  gRNA
ucgugugugacaaccccuuc

SEQ ID NO: 127610 - RNA, 20 nt, Artificial Sequence
  MKO10127610_B_Zcchc14
  gRNA
uguugaaaagauagaccuga

SEQ ID NO: 127611 - RNA, 20 nt, Artificial Sequence
  MKO10127611_B_Zcchc16
  gRNA
gguacaacuugcccuguuau

SEQ ID NO: 127612 - RNA, 20 nt, Artificial Sequence
  MKO10127612_B_Zcchc16
  gRNA
cucuugugaagugaccagcc

SEQ ID NO: 127613 - RNA, 20 nt, Artificial Sequence
  MKO10127613_B_Zcchc16
  gRNA
gaccaccuauuugagggcuc

SEQ ID NO: 127614 - RNA, 20 nt, Artificial Sequence
  MKO10127614_B_Zcchc17
  gRNA
cgguccuuccaggauuacac

SEQ ID NO: 127615 - RNA, 20 nt, Artificial Sequence
  MKO10127615_B_Zcchc17
  gRNA
guugcuauggugacagacua

SEQ ID NO: 127616 - RNA, 20 nt, Artificial Sequence
  MKO10127616_B_Zcchc17
  gRNA
ucuucugcccaguguaaucc

SEQ ID NO: 127617 - RNA, 20 nt, Artificial Sequence
  MKO10127617_B_Zcchc18
  gRNA
agcgccugaugagaacccuu

SEQ ID NO: 127618 - RNA, 20 nt, Artificial Sequence
  MKO10127618_B_Zcchc18
  gRNA
aaacccucuguaccauacua

SEQ ID NO: 127619 - RNA, 20 nt, Artificial Sequence
  MKO10127619_B_Zcchc18
  gRNA
cacaccuuaguaugguacag

SEQ ID NO: 127620 - RNA, 20 nt, Artificial Sequence
  MKO10127620_B_Zcchc24
  gRNA
caacguguacccgcacaagc

SEQ ID NO: 127621 - RNA, 20 nt, Artificial Sequence
  MKO10127621_B_Zcchc24
  gRNA
ggccaucagcgauguuauug

SEQ ID NO: 127622 - RNA, 20 nt, Artificial Sequence
  MKO10127622_B_Zcchc24
  gRNA
cgcugagcagcagcguguau

SEQ ID NO: 127623 - RNA, 20 nt, Artificial Sequence
  MKO10127623_B_Zcchc2
  gRNA
ccucaucgagcucagcgaga

SEQ ID NO: 127624 - RNA, 20 nt, Artificial Sequence
  MKO10127624_B_Zcchc2
  gRNA
gaaaaagggcugacaaguac

SEQ ID NO: 127625 - RNA, 20 nt, Artificial Sequence
  MKO10127625_B_Zcchc2
  gRNA
guagaaauuccuguaguucu

SEQ ID NO: 127626 - RNA, 20 nt, Artificial Sequence
  MKO10127626_B_Zcchc3
  gRNA
gcgucugacgccucacccgu

SEQ ID NO: 127627 - RNA, 20 nt, Artificial Sequence
  MKO10127627_B_Zcchc3
  gRNA
agggcgacuuccgcgagccg

SEQ ID NO: 127628 - RNA, 20 nt, Artificial Sequence
  MKO10127628_B_Zcchc3
  gRNA
cggcgcgacgaaacuggcag

SEQ ID NO: 127629 - RNA, 20 nt, Artificial Sequence
  MKO10127629_B_Zcchc4
  gRNA
gacauuucugucgcccagcu

SEQ ID NO: 127630 - RNA, 20 nt, Artificial Sequence
  MKO10127630_B_Zcchc4
  gRNA
gcaggccuccuugcuacccu

SEQ ID NO: 127631 - RNA, 20 nt, Artificial Sequence
  MKO10127631_B_Zcchc4
  gRNA
aaugccagccuccucuaucc

SEQ ID NO: 127632 - RNA, 20 nt, Artificial Sequence
  MKO10127632_B_Zcchc5
  gRNA
cgauuacuuguagcuugaac

SEQ ID NO: 127633 - RNA, 20 nt, Artificial Sequence
  MKO10127633_B_Zcchc5
  gRNA
uuccuguucucgcaacuauc

SEQ ID NO: 127634 - RNA, 20 nt, Artificial Sequence
  MKO10127634_B_Zcchc5
  gRNA
cauaaccccuuggggacgcc

SEQ ID NO: 127635 - RNA, 20 nt, Artificial Sequence
  MKO10127635_B_Zcchc6
  gRNA
cgcugccaacugcauguauc

SEQ ID NO: 127636 - RNA, 20 nt, Artificial Sequence
  MKO10127636_B_Zcchc6
  gRNA
acuagaaauuaagcguguca

SEQ ID NO: 127637 - RNA, 20 nt, Artificial Sequence
  MKO10127637_B_Zcchc6
  gRNA
caaagcaucgcacaguuugc

SEQ ID NO: 127638 - RNA, 20 nt, Artificial Sequence
  MKO10127638_B_Zcchc7
  gRNA
aucucacguacuugugguaa

SEQ ID NO: 127639 - RNA, 20 nt, Artificial Sequence
  MKO10127639_B_Zcchc7
  gRNA
caucagugacaaagacaucg

SEQ ID NO: 127640 - RNA, 20 nt, Artificial Sequence
  MKO10127640_B_Zcchc7
  gRNA
uccaggcuugcccagaaauc

SEQ ID NO: 127641 - RNA, 20 nt, Artificial Sequence
  MKO10127641_B_Zcchc8
  gRNA
aaacuuaguaaaacgauuug

SEQ ID NO: 127642 - RNA, 20 nt, Artificial Sequence
  MKO10127642_B_Zcchc8
  gRNA
gcaauaccaccaagaaauag

SEQ ID NO: 127643 - RNA, 20 nt, Artificial Sequence
  MKO10127643_B_Zcchc8
  gRNA
auaaauagaauuuguaguaa

SEQ ID NO: 127644 - RNA, 20 nt, Artificial Sequence
  MKO10127644_B_Zcchc9
  gRNA
ugcagacuaugaagacgugc

SEQ ID NO: 127645 - RNA, 20 nt, Artificial Sequence
  MKO10127645_B_Zcchc9
  gRNA
gguggcagcuguaaacucug

SEQ ID NO: 127646 - RNA, 20 nt, Artificial Sequence
  MKO10127646_B_Zcchc9
  gRNA
uaucagggcaggaucuggac

SEQ ID NO: 127647 - RNA, 20 nt, Artificial Sequence
  MKO10127647_B_Zcrb1
  gRNA
gccuguccuaaaaacaugcu

SEQ ID NO: 127648 - RNA, 20 nt, Artificial Sequence
  MKO10127648_B_Zcrb1
  gRNA
cagagcaauaaauaauaaac

SEQ ID NO: 127649 - RNA, 20 nt, Artificial Sequence
  MKO10127649_B_Zcrb1
  gRNA
uaaugaaagacaaagauacu

SEQ ID NO: 127650 - RNA, 20 nt, Artificial Sequence
  MKO10127650_B_Zcwpw1
  gRNA
ucuuaccagugcagaauuug

SEQ ID NO: 127651 - RNA, 20 nt, Artificial Sequence
  MKO10127651_B_Zcwpw1
  gRNA
ccauacccaagcacuccugc

SEQ ID NO: 127652 - RNA, 20 nt, Artificial Sequence
  MKO10127652_B_Zcwpw1
  gRNA
acacaucagaccuaccaaau

SEQ ID NO: 127653 - RNA, 20 nt, Artificial Sequence
  MKO10127653_B_Zdbf2
  gRNA
ugaccagacagagcagacgu

SEQ ID NO: 127654 - RNA, 20 nt, Artificial Sequence
  MKO10127654_B_Zdbf2
  gRNA
aguaaugaagaacaauggac

SEQ ID NO: 127655 - RNA, 20 nt, Artificial Sequence
  MKO10127655_B_Zdbf2
  gRNA
gauggaagcucagagcuauc

SEQ ID NO: 127656 - RNA, 20 nt, Artificial Sequence
  MKO10127656_B_Zdhhc11
  gRNA
agauggguaccuuuauagag

SEQ ID NO: 127657 - RNA, 20 nt, Artificial Sequence
  MKO10127657_B_Zdhhc11
  gRNA
gauccaggauauugccugaa

SEQ ID NO: 127658 - RNA, 20 nt, Artificial Sequence
  MKO10127658_B_Zdhhc11
  gRNA
aauauccuggaucaccuacc

SEQ ID NO: 127659 - RNA, 20 nt, Artificial Sequence
  MKO10127659_B_Zdhhc12
  gRNA
ccuccccagagcuacgccaa

SEQ ID NO: 127660 - RNA, 20 nt, Artificial Sequence
  MKO10127660_B_Zdhhc12
  gRNA
gugcucuuccugcacgacac

SEQ ID NO: 127661 - RNA, 20 nt, Artificial Sequence
  MKO10127661_B_Zdhhc12
  gRNA
aagcucccugcugcuuuauc

SEQ ID NO: 127662 - RNA, 20 nt, Artificial Sequence
  MKO10127662_B_Zdhhc13
  gRNA
gcugugauagaucaguuggg

SEQ ID NO: 127663 - RNA, 20 nt, Artificial Sequence
  MKO10127663_B_Zdhhc13
  gRNA
uuacucgaguccucuauaag

SEQ ID NO: 127664 - RNA, 20 nt, Artificial Sequence
  MKO10127664_B_Zdhhc13
  gRNA
uaccggauggcccagugaag

SEQ ID NO: 127665 - RNA, 20 nt, Artificial Sequence
  MKO10127665_B_Zdhhc14
  gRNA
aucucgcuggacuguccuua

SEQ ID NO: 127666 - RNA, 20 nt, Artificial Sequence
  MKO10127666_B_Zdhhc14
  gRNA
agccugugugauaacugcgu

SEQ ID NO: 127667 - RNA, 20 nt, Artificial Sequence
  MKO10127667_B_Zdhhc14
  gRNA
ccccacacaguugccuaccc

SEQ ID NO: 127668 - RNA, 20 nt, Artificial Sequence
  MKO10127668_B_Zdhhc15
  gRNA
uuaccaguguacacaagaac

SEQ ID NO: 127669 - RNA, 20 nt, Artificial Sequence
  MKO10127669_B_Zdhhc15
  gRNA
ugugaagauagacuuccagu

SEQ ID NO: 127670 - RNA, 20 nt, Artificial Sequence
  MKO10127670_B_Zdhhc15
  gRNA
cauauucuuaccuucugguu

SEQ ID NO: 127671 - RNA, 20 nt, Artificial Sequence
  MKO10127671_B_Zdhhc16
  gRNA
ggaggcuuaugcugccauug

SEQ ID NO: 127672 - RNA, 20 nt, Artificial Sequence
  MKO10127672_B_Zdhhc16
  gRNA
accacugcagcaucuguaau

SEQ ID NO: 127673 - RNA, 20 nt, Artificial Sequence
  MKO10127673_B_Zdhhc16
  gRNA
accuauuacagaugcugcag

SEQ ID NO: 127674 - RNA, 20 nt, Artificial Sequence
  MKO10127674_B_Zdhhc17
  gRNA
gcagaccccuccuuaauuga

SEQ ID NO: 127675 - RNA, 20 nt, Artificial Sequence
  MKO10127675_B_Zdhhc17
  gRNA
cuccauagccaugguuauag

SEQ ID NO: 127676 - RNA, 20 nt, Artificial Sequence
  MKO10127676_B_Zdhhc17
  gRNA
gcauccuuccccaucaauua

SEQ ID NO: 127677 - RNA, 20 nt, Artificial Sequence
  MKO10127677_B_Zdhhc18
  gRNA
gccccgggccaccaucugug

SEQ ID NO: 127678 - RNA, 20 nt, Artificial Sequence
  MKO10127678_B_Zdhhc18
  gRNA
ccaacucacgaagggucagg

SEQ ID NO: 127679 - RNA, 20 nt, Artificial Sequence
  MKO10127679_B_Zdhhc18
  gRNA
gaugccaggguccgugaaac

SEQ ID NO: 127680 - RNA, 20 nt, Artificial Sequence
  MKO10127680_B_Zdhhc19
  gRNA
cacgucaggcuccaccaaag

SEQ ID NO: 127681 - RNA, 20 nt, Artificial Sequence
  MKO10127681_B_Zdhhc19
  gRNA
ugacauuccuauuucgcaca

SEQ ID NO: 127682 - RNA, 20 nt, Artificial Sequence
  MKO10127682_B_Zdhhc19
  gRNA
ccgcagcgggcacagccacc

SEQ ID NO: 127683 - RNA, 20 nt, Artificial Sequence
  MKO10127683_B_Zdhhc1
  gRNA
gcacugcaaccuaugcgacg

SEQ ID NO: 127684 - RNA, 20 nt, Artificial Sequence
  MKO10127684_B_Zdhhc1
  gRNA
gguggccacuuaugucuucg

SEQ ID NO: 127685 - RNA, 20 nt, Artificial Sequence
  MKO10127685_B_Zdhhc1
  gRNA
gaacuccacgaagacauaag

SEQ ID NO: 127686 - RNA, 20 nt, Artificial Sequence
  MKO10127686_B_Zdhhc20
  gRNA
ugacaguuuaccucuuugga

SEQ ID NO: 127687 - RNA, 20 nt, Artificial Sequence
  MKO10127687_B_Zdhhc20
  gRNA
aucacugcucagcaugugac

SEQ ID NO: 127688 - RNA, 20 nt, Artificial Sequence
  MKO10127688_B_Zdhhc20
  gRNA
cuagguacuauuuccagaac

SEQ ID NO: 127689 - RNA, 20 nt, Artificial Sequence
  MKO10127689_B_Zdhhc21
  gRNA
aggcccucacuaaggcaacc

SEQ ID NO: 127690 - RNA, 20 nt, Artificial Sequence
  MKO10127690_B_Zdhhc21
  gRNA
uccugacgcaguggccgcag

SEQ ID NO: 127691 - RNA, 20 nt, Artificial Sequence
  MKO10127691_B_Zdhhc21
  gRNA
cucuucuauacacaacugau

SEQ ID NO: 127692 - RNA, 20 nt, Artificial Sequence
  MKO10127692_B_Zdhhc22
  gRNA
uguguucccgagucacgcug

SEQ ID NO: 127693 - RNA, 20 nt, Artificial Sequence
  MKO10127693_B_Zdhhc22
  gRNA
ugacgaacaugucagaaccg

SEQ ID NO: 127694 - RNA, 20 nt, Artificial Sequence
  MKO10127694_B_Zdhhc22
  gRNA
ggucgugccucagcgugacu

SEQ ID NO: 127695 - RNA, 20 nt, Artificial Sequence
  MKO10127695_B_Zdhhc23
  gRNA
gagugggccccacgcgcccu

SEQ ID NO: 127696 - RNA, 20 nt, Artificial Sequence
  MKO10127696_B_Zdhhc23
  gRNA
ugcgaauacauagaucgaaa

SEQ ID NO: 127697 - RNA, 20 nt, Artificial Sequence
  MKO10127697_B_Zdhhc23
  gRNA
uugaggauaaauagcugcgu

SEQ ID NO: 127698 - RNA, 20 nt, Artificial Sequence
  MKO10127698_B_Zdhhc24
  gRNA
ggccucgcugggcccuaguc

SEQ ID NO: 127699 - RNA, 20 nt, Artificial Sequence
  MKO10127699_B_Zdhhc24
  gRNA
ugaccaucacugucgccuau

SEQ ID NO: 127700 - RNA, 20 nt, Artificial Sequence
  MKO10127700_B_Zdhhc24
  gRNA
guggcaggugcacuguugug

SEQ ID NO: 127701 - RNA, 20 nt, Artificial Sequence
  MKO10127701_B_Zdhhc25
  gRNA
cguucuugcggaugcagcgc

SEQ ID NO: 127702 - RNA, 20 nt, Artificial Sequence
  MKO10127702_B_Zdhhc25
  gRNA
agaguggcagucgguacagu

SEQ ID NO: 127703 - RNA, 20 nt, Artificial Sequence
  MKO10127703_B_Zdhhc25
  gRNA
gugugacgcgagugccaacg

SEQ ID NO: 127704 - RNA, 20 nt, Artificial Sequence
  MKO10127704_B_Zdhhc2
  gRNA
auucaugggcaauguaaaaa

SEQ ID NO: 127705 - RNA, 20 nt, Artificial Sequence
  MKO10127705_B_Zdhhc2
  gRNA
cuaguguccauggaaaacau

SEQ ID NO: 127706 - RNA, 20 nt, Artificial Sequence
  MKO10127706_B_Zdhhc2
  gRNA
gccaagaggagaagcccauc

SEQ ID NO: 127707 - RNA, 20 nt, Artificial Sequence
  MKO10127707_B_Zdhhc3
  gRNA
uuccuugcacgcccucauca

SEQ ID NO: 127708 - RNA, 20 nt, Artificial Sequence
  MKO10127708_B_Zdhhc3
  gRNA
uaccgucucaucugugcaga

SEQ ID NO: 127709 - RNA, 20 nt, Artificial Sequence
  MKO10127709_B_Zdhhc3
  gRNA
ccgacacaguuguugaccca

SEQ ID NO: 127710 - RNA, 20 nt, Artificial Sequence
  MKO10127710_B_Zdhhc4
  gRNA
guaugcagaauacaccugcg

SEQ ID NO: 127711 - RNA, 20 nt, Artificial Sequence
  MKO10127711_B_Zdhhc4
  gRNA
cagcagaagccgucagcguc

SEQ ID NO: 127712 - RNA, 20 nt, Artificial Sequence
  MKO10127712_B_Zdhhc4
  gRNA
cgucaucuagguaaguuucc

SEQ ID NO: 127713 - RNA, 20 nt, Artificial Sequence
  MKO10127713_B_Zdhhc5
  gRNA
uuaccucggggaaaaauucc

SEQ ID NO: 127714 - RNA, 20 nt, Artificial Sequence
  MKO10127714_B_Zdhhc5
  gRNA
cacccaugaugugagcuguc

SEQ ID NO: 127715 - RNA, 20 nt, Artificial Sequence
  MKO10127715_B_Zdhhc5
  gRNA
gggacgcacaaccaaugaac

SEQ ID NO: 127716 - RNA, 20 nt, Artificial Sequence
  MKO10127716_B_Zdhhc6
  gRNA
accacagcaguuguugaucc

SEQ ID NO: 127717 - RNA, 20 nt, Artificial Sequence
  MKO10127717_B_Zdhhc6
  gRNA
ugccgccaccuuguuugccu

SEQ ID NO: 127718 - RNA, 20 nt, Artificial Sequence
  MKO10127718_B_Zdhhc6
  gRNA
caggaggaagagcgugaacg

SEQ ID NO: 127719 - RNA, 20 nt, Artificial Sequence
  MKO10127719_B_Zdhhc7
  gRNA
ccgugggugaacaacugcgu

SEQ ID NO: 127720 - RNA, 20 nt, Artificial Sequence
  MKO10127720_B_Zdhhc7
  gRNA
gcucuccauguacuccuucg

SEQ ID NO: 127721 - RNA, 20 nt, Artificial Sequence
  MKO10127721_B_Zdhhc7
  gRNA
ccgacgcaguuguucaccca

SEQ ID NO: 127722 - RNA, 20 nt, Artificial Sequence
  MKO10127722_B_Zdhhc8
  gRNA
ccagcuauuccugucuacaa

SEQ ID NO: 127723 - RNA, 20 nt, Artificial Sequence
  MKO10127723_B_Zdhhc8
  gRNA
cuaccucgggggaagacucc

SEQ ID NO: 127724 - RNA, 20 nt, Artificial Sequence
  MKO10127724_B_Zdhhc8
  gRNA
guaccacgugaaagccagug

SEQ ID NO: 127725 - RNA, 20 nt, Artificial Sequence
  MKO10127725_B_Zdhhc9
  gRNA
ggccacauagacgauguuaa

SEQ ID NO: 127726 - RNA, 20 nt, Artificial Sequence
  MKO10127726_B_Zdhhc9
  gRNA
agugcucgaggaaucacucc

SEQ ID NO: 127727 - RNA, 20 nt, Artificial Sequence
  MKO10127727_B_Zdhhc9
  gRNA
uggucgcuggcccuguggca

SEQ ID NO: 127728 - RNA, 20 nt, Artificial Sequence
  MKO10127728_B_Zeb1
  gRNA
guaccgccaugagaagaacg

SEQ ID NO: 127729 - RNA, 20 nt, Artificial Sequence
  MKO10127729_B_Zeb1
  gRNA
gggcgccucaggauaaauga

SEQ ID NO: 127730 - RNA, 20 nt, Artificial Sequence
  MKO10127730_B_Zeb1
  gRNA
ggggcggugccaagaacugc

SEQ ID NO: 127731 - RNA, 20 nt, Artificial Sequence
  MKO10127731_B_Zeb2os
  gRNA
acacgcgccaccuaucuuug

SEQ ID NO: 127732 - RNA, 20 nt, Artificial Sequence
  MKO10127732_B_Zeb2os
  gRNA
aaaaccucgccaagaguguc

SEQ ID NO: 127733 - RNA, 20 nt, Artificial Sequence
  MKO10127733_B_Zeb2os
  gRNA
cacaagcuuugcggaaaacc

SEQ ID NO: 127734 - RNA, 20 nt, Artificial Sequence
  MKO10127734_B_Zeb2
  gRNA
ugauagccuugcaaacccuc

SEQ ID NO: 127735 - RNA, 20 nt, Artificial Sequence
  MKO10127735_B_Zeb2
  gRNA
ccuaccgcacccagcucgag

SEQ ID NO: 127736 - RNA, 20 nt, Artificial Sequence
  MKO10127736_B_Zeb2
  gRNA
ggugaacuaugacaacguag

SEQ ID NO: 127737 - RNA, 20 nt, Artificial Sequence
  MKO10127737_B_Zer1
  gRNA
ggcggucucgggagaugucc

SEQ ID NO: 127738 - RNA, 20 nt, Artificial Sequence
  MKO10127738_B_Zer1
  gRNA
ugcgagugagccgaguacug

SEQ ID NO: 127739 - RNA, 20 nt, Artificial Sequence
  MKO10127739_B_Zer1
  gRNA
cugugccaacaucuucuaug

SEQ ID NO: 127740 - RNA, 20 nt, Artificial Sequence
  MKO10127740_B_Zfand1
  gRNA
uuucuuccauuuguguguga

SEQ ID NO: 127741 - RNA, 20 nt, Artificial Sequence
  MKO10127741_B_Zfand1
  gRNA
gaacaaccaucacacacaaa

SEQ ID NO: 127742 - RNA, 20 nt, Artificial Sequence
  MKO10127742_B_Zfand1
  gRNA
aguccuugcuucuguguuca

SEQ ID NO: 127743 - RNA, 20 nt, Artificial Sequence
  MKO10127743_B_Zfand2a
  gRNA
uaugacccacguaggaaaaa

SEQ ID NO: 127744 - RNA, 20 nt, Artificial Sequence
  MKO10127744_B_Zfand2a
  gRNA
ugcucccagccuggcaauug

SEQ ID NO: 127745 - RNA, 20 nt, Artificial Sequence
  MKO10127745_B_Zfand2a
  gRNA
gccagccaacugacucccga

SEQ ID NO: 127746 - RNA, 20 nt, Artificial Sequence
  MKO10127746_B_Zfand2b
  gRNA
gcaccgcccccaguccaagc

SEQ ID NO: 127747 - RNA, 20 nt, Artificial Sequence
  MKO10127747_B_Zfand2b
  gRNA
caucuucugcgcagaccaug

SEQ ID NO: 127748 - RNA, 20 nt, Artificial Sequence
  MKO10127748_B_Zfand2b
  gRNA
ugcgcagaagaugcccgagc

SEQ ID NO: 127749 - RNA, 20 nt, Artificial Sequence
  MKO10127749_B_Zfand3
  gRNA
agauucacaguccgagaacg

SEQ ID NO: 127750 - RNA, 20 nt, Artificial Sequence
  MKO10127750_B_Zfand3
  gRNA
uguaacuucaccgaguacag

SEQ ID NO: 127751 - RNA, 20 nt, Artificial Sequence
  MKO10127751_B_Zfand3
  gRNA
cuugggguggaaucaucauc

SEQ ID NO: 127752 - RNA, 20 nt, Artificial Sequence
  MKO10127752_B_Zfand4
  gRNA
uuguaccuugaagcugguau

SEQ ID NO: 127753 - RNA, 20 nt, Artificial Sequence
  MKO10127753_B_Zfand4
  gRNA
cguuucgaugaagaguucca

SEQ ID NO: 127754 - RNA, 20 nt, Artificial Sequence
  MKO10127754_B_Zfand4
  gRNA
ucagcugaauuucuuccgug

SEQ ID NO: 127755 - RNA, 20 nt, Artificial Sequence
  MKO10127755_B_Zfand5
  gRNA
cucaaauagaaaugugccug

SEQ ID NO: 127756 - RNA, 20 nt, Artificial Sequence
  MKO10127756_B_Zfand5
  gRNA
aacaacugugaaggugcugc

SEQ ID NO: 127757 - RNA, 20 nt, Artificial Sequence
  MKO10127757_B_Zfand5
  gRNA
uuuauguguagaaagaaagu

SEQ ID NO: 127758 - RNA, 20 nt, Artificial Sequence
  MKO10127758_B_Zfand6
  gRNA
ccacagauguacuguccacu

SEQ ID NO: 127759 - RNA, 20 nt, Artificial Sequence
  MKO10127759_B_Zfand6
  gRNA
cauggaggaucacauucaag

SEQ ID NO: 127760 - RNA, 20 nt, Artificial Sequence
  MKO10127760_B_Zfand6
  gRNA
gacuugcuuugcucuucaga

SEQ ID NO: 127761 - RNA, 20 nt, Artificial Sequence
  MKO10127761_B_Zfau
  gRNA
ugcagaugugcuugcgcagc

SEQ ID NO: 127762 - RNA, 20 nt, Artificial Sequence
  MKO10127762_B_Zfau
  gRNA
augacgucaucauuccccuc

SEQ ID NO: 127763 - RNA, 20 nt, Artificial Sequence
  MKO10127763_B_Zfau
  gRNA
gucacgaguucugacugauu

SEQ ID NO: 127764 - RNA, 20 nt, Artificial Sequence
  MKO10127764_B_Zfc3h1
  gRNA
uuccgcacaguucucgcuuu

SEQ ID NO: 127765 - RNA, 20 nt, Artificial Sequence
  MKO10127765_B_Zfc3h1
  gRNA
uucagucggcuaguaagaaa

SEQ ID NO: 127766 - RNA, 20 nt, Artificial Sequence
  MKO10127766_B_Zfc3h1
  gRNA
cgcuguucagccaaaagcuu

SEQ ID NO: 127767 - RNA, 20 nt, Artificial Sequence
  MKO10127767_B_Zfhx2
  gRNA
guuccgcugccuggugugcc

SEQ ID NO: 127768 - RNA, 20 nt, Artificial Sequence
  MKO10127768_B_Zfhx2
  gRNA
aguucugaccgugaucuggu

SEQ ID NO: 127769 - RNA, 20 nt, Artificial Sequence
  MKO10127769_B_Zfhx2
  gRNA
ccuguuguuccgucuuguuc

SEQ ID NO: 127770 - RNA, 20 nt, Artificial Sequence
  MKO10127770_B_Zfhx3
  gRNA
agacuccgcucucuucgaag

SEQ ID NO: 127771 - RNA, 20 nt, Artificial Sequence
  MKO10127771_B_Zfhx3
  gRNA
ccuugguggaguaguugcac

SEQ ID NO: 127772 - RNA, 20 nt, Artificial Sequence
  MKO10127772_B_Zfhx3
  gRNA
agaggagaucaaacccgagc

SEQ ID NO: 127773 - RNA, 12 nt, Artificial Sequence
  MKO10127773_B_Zfhx4
  gRNA
aagcucauucgc

SEQ ID NO: 127774 - RNA, 20 nt, Artificial Sequence
  MKO10127774_B_Zfhx4
  gRNA
agucacaggcguuacacuuu

SEQ ID NO: 127775 - RNA, 20 nt, Artificial Sequence
  MKO10127775_B_Zfhx4
  gRNA
agggucuccugcaucuucac

SEQ ID NO: 127776 - RNA, 20 nt, Artificial Sequence
  MKO10127776_B_Zfml
  gRNA
ggucccucgaggauuaaacc

SEQ ID NO: 127777 - RNA, 20 nt, Artificial Sequence
  MKO10127777_B_Zfml
  gRNA
acugccgacagcucucaaug

SEQ ID NO: 127778 - RNA, 20 nt, Artificial Sequence
  MKO10127778_B_Zfml
  gRNA
uuucaaauagauacccugau

SEQ ID NO: 127779 - RNA, 20 nt, Artificial Sequence
  MKO10127779_B_Zfp101
  gRNA
guacucaccauuuccagcuu

SEQ ID NO: 127780 - RNA, 20 nt, Artificial Sequence
  MKO10127780_B_Zfp101
  gRNA
guggcugugaacuucaccuc

SEQ ID NO: 127781 - RNA, 20 nt, Artificial Sequence
  MKO10127781_B_Zfp101
  gRNA
caacaaaguccacucuccug

SEQ ID NO: 127782 - RNA, 20 nt, Artificial Sequence
  MKO10127782_B_Zfp105
  gRNA
cuacucguuggcagggacuc

SEQ ID NO: 127783 - RNA, 20 nt, Artificial Sequence
  MKO10127783_B_Zfp105
  gRNA
cguucucauaguacacuugu

SEQ ID NO: 127784 - RNA, 20 nt, Artificial Sequence
  MKO10127784_B_Zfp105
  gRNA
ugaugaaagugucauaaguc

SEQ ID NO: 127785 - RNA, 20 nt, Artificial Sequence
  MKO10127785_B_Zfp106
  gRNA
cauagugcacaguuaccguc

SEQ ID NO: 127786 - RNA, 20 nt, Artificial Sequence
  MKO10127786_B_Zfp106
  gRNA
ucucgggcugaaugcaugac

SEQ ID NO: 127787 - RNA, 20 nt, Artificial Sequence
  MKO10127787_B_Zfp106
  gRNA
gucaugagugccgagugugc

SEQ ID NO: 127788 - RNA, 20 nt, Artificial Sequence
  MKO10127788_B_Zfp108
  gRNA
accggggcacagcgcacaga

SEQ ID NO: 127789 - RNA, 20 nt, Artificial Sequence
  MKO10127789_B_Zfp108
  gRNA
cguggccguggucuucagca

SEQ ID NO: 127790 - RNA, 20 nt, Artificial Sequence
  MKO10127790_B_Zfp108
  gRNA
cuccuccuugcugaagacca

SEQ ID NO: 127791 - RNA, 20 nt, Artificial Sequence
  MKO10127791_B_Zfp109
  gRNA
gagaacaaugaccaaguuac

SEQ ID NO: 127792 - RNA, 20 nt, Artificial Sequence
  MKO10127792_B_Zfp109
  gRNA
cguccucacccacugccagg

SEQ ID NO: 127793 - RNA, 20 nt, Artificial Sequence
  MKO10127793_B_Zfp109
  gRNA
agccaagagccgucguggcu

SEQ ID NO: 127794 - RNA, 20 nt, Artificial Sequence
  MKO10127794_B_Zfp110
  gRNA
accaucguccuuagacaccg

SEQ ID NO: 127795 - RNA, 20 nt, Artificial Sequence
  MKO10127795_B_Zfp110
  gRNA
cugcauuggccagcagucuu

SEQ ID NO: 127796 - RNA, 20 nt, Artificial Sequence
  MKO10127796_B_Zfp110
  gRNA
uuucuccuuuaguugaucag

SEQ ID NO: 127797 - RNA, 20 nt, Artificial Sequence
  MKO10127797_B_Zfp111
  gRNA
cacaggaggcagugacauuc

SEQ ID NO: 127798 - RNA, 20 nt, Artificial Sequence
  MKO10127798_B_Zfp111
  gRNA
cguccucacccacugccagg

SEQ ID NO: 127799 - RNA, 20 nt, Artificial Sequence
  MKO10127799_B_Zfp111
  gRNA
gaaaaacuucagucguagcu

SEQ ID NO: 127800 - RNA, 20 nt, Artificial Sequence
  MKO10127800_B_Zfp112
  gRNA
cacccgagagcccaccugca

SEQ ID NO: 127801 - RNA, 20 nt, Artificial Sequence
  MKO10127801_B_Zfp112
  gRNA
ggagaaaaugaccaaauugc

SEQ ID NO: 127802 - RNA, 20 nt, Artificial Sequence
  MKO10127802_B_Zfp112
  gRNA
gaccacagccacaucccuga

SEQ ID NO: 127803 - RNA, 20 nt, Artificial Sequence
  MKO10127803_B_Zfp113
  gRNA
cuaugggaacguguucucac

SEQ ID NO: 127804 - RNA, 20 nt, Artificial Sequence
  MKO10127804_B_Zfp113
  gRNA
ccccucgcccauggaaaccc

SEQ ID NO: 127805 - RNA, 20 nt, Artificial Sequence
  MKO10127805_B_Zfp113
  gRNA
gcuucuaaaggccaagucuc

SEQ ID NO: 127806 - RNA, 20 nt, Artificial Sequence
  MKO10127806_B_Zfp114
  gRNA
cguccucacccacugccagg

SEQ ID NO: 127807 - RNA, 20 nt, Artificial Sequence
  MKO10127807_B_Zfp114
  gRNA
cacaggaggcagugacauuc

SEQ ID NO: 127808 - RNA, 20 nt, Artificial Sequence
  MKO10127808_B_Zfp114
  gRNA
uccucauguguacuacguac

SEQ ID NO: 127809 - RNA, 20 nt, Artificial Sequence
  MKO10127809_B_Zfp119a
  gRNA
gcucuugugguuccgugucc

SEQ ID NO: 127810 - RNA, 20 nt, Artificial Sequence
  MKO10127810_B_Zfp119a
  gRNA
cccgcucuccucacagcucc

SEQ ID NO: 127811 - RNA, 20 nt, Artificial Sequence
  MKO10127811_B_Zfp119a
  gRNA
uuaggaugcagugaccuaug

SEQ ID NO: 127812 - RNA, 20 nt, Artificial Sequence
  MKO10127812_B_Zfp119b
  gRNA
gaggaucaacaucagaguuc

SEQ ID NO: 127813 - RNA, 20 nt, Artificial Sequence
  MKO10127813_B_Zfp119b
  gRNA
uaaacuucucucaagaagaa

SEQ ID NO: 127814 - RNA, 20 nt, Artificial Sequence
  MKO10127814_B_Zfp119b
  gRNA
guuuacaugcacauccucau

SEQ ID NO: 127815 - RNA, 20 nt, Artificial Sequence
  MKO10127815_B_Zfp11
  gRNA
uuucuccgguguggaugacc

SEQ ID NO: 127816 - RNA, 20 nt, Artificial Sequence
  MKO10127816_B_Zfp11
  gRNA
cagagagaagccguacaagc

SEQ ID NO: 127817 - RNA, 20 nt, Artificial Sequence
  MKO10127817_B_Zfp11
  gRNA
uggcgccggugugaacaaug

SEQ ID NO: 127818 - RNA, 20 nt, Artificial Sequence
  MKO10127818_B_Zfp120
  gRNA
aauguccuucagaaauauua

SEQ ID NO: 127819 - RNA, 20 nt, Artificial Sequence
  MKO10127819_B_Zfp120
  gRNA
gugcaaagucuucaaaauau

SEQ ID NO: 127820 - RNA, 20 nt, Artificial Sequence
  MKO10127820_B_Zfp120
  gRNA
uuugcuggauccuucucaga

SEQ ID NO: 127821 - RNA, 20 nt, Artificial Sequence
  MKO10127821_B_Zfp128
  gRNA
caucacgauacagaguccuc

SEQ ID NO: 127822 - RNA, 20 nt, Artificial Sequence
  MKO10127822_B_Zfp128
  gRNA
uuggccuggaauggaccacc

SEQ ID NO: 127823 - RNA, 20 nt, Artificial Sequence
  MKO10127823_B_Zfp128
  gRNA
accugcaguuaucucccagc

SEQ ID NO: 127824 - RNA, 20 nt, Artificial Sequence
  MKO10127824_B_Zfp12
  gRNA
gacauacagggaugugaugc

SEQ ID NO: 127825 - RNA, 20 nt, Artificial Sequence
  MKO10127825_B_Zfp12
  gRNA
cugcgacuggaaugacgcug

SEQ ID NO: 127826 - RNA, 20 nt, Artificial Sequence
  MKO10127826_B_Zfp12
  gRNA
cucagcgucauuccagucgc

SEQ ID NO: 127827 - RNA, 20 nt, Artificial Sequence
  MKO10127827_B_Zfp131
  gRNA
gaacaccuucgaaaacauac

SEQ ID NO: 127828 - RNA, 20 nt, Artificial Sequence
  MKO10127828_B_Zfp131
  gRNA
gagccuuugguugaaauuga

SEQ ID NO: 127829 - RNA, 20 nt, Artificial Sequence
  MKO10127829_B_Zfp131
  gRNA
cagccuugugggccuuaaaa

SEQ ID NO: 127830 - RNA, 20 nt, Artificial Sequence
  MKO10127830_B_Zfp13
  gRNA
acuccuguacugucccgagg

SEQ ID NO: 127831 - RNA, 20 nt, Artificial Sequence
  MKO10127831_B_Zfp13
  gRNA
cgucccccucgggacaguac

SEQ ID NO: 127832 - RNA, 20 nt, Artificial Sequence
  MKO10127832_B_Zfp13
  gRNA
ccacaguguugcacauuacc

SEQ ID NO: 127833 - RNA, 20 nt, Artificial Sequence
  MKO10127833_B_Zfp142
  gRNA
gcuccaacgucaaacuauuc

SEQ ID NO: 127834 - RNA, 20 nt, Artificial Sequence
  MKO10127834_B_Zfp142
  gRNA
gaagcaaguacaccuuugcc

SEQ ID NO: 127835 - RNA, 20 nt, Artificial Sequence
  MKO10127835_B_Zfp142
  gRNA
gggucagcaugugcuucgau

SEQ ID NO: 127836 - RNA, 20 nt, Artificial Sequence
  MKO10127836_B_Zfp143
  gRNA
guacugcuccaaagcacuaa

SEQ ID NO: 127837 - RNA, 20 nt, Artificial Sequence
  MKO10127837_B_Zfp143
  gRNA
cccagauaccauuagugcuu

SEQ ID NO: 127838 - RNA, 20 nt, Artificial Sequence
  MKO10127838_B_Zfp143
  gRNA
caagcugugacacucgcaga

SEQ ID NO: 127839 - RNA, 20 nt, Artificial Sequence
  MKO10127839_B_Zfp146
  gRNA
gcucuguaagauucgauuug

SEQ ID NO: 127840 - RNA, 20 nt, Artificial Sequence
  MKO10127840_B_Zfp146
  gRNA
ccccgcuuaagauucucugc

SEQ ID NO: 127841 - RNA, 20 nt, Artificial Sequence
  MKO10127841_B_Zfp146
  gRNA
caucucuaaccgugcaugug

SEQ ID NO: 127842 - RNA, 20 nt, Artificial Sequence
  MKO10127842_B_Zfp148
  gRNA
ccauuucgcugugaugaaug

SEQ ID NO: 127843 - RNA, 20 nt, Artificial Sequence
  MKO10127843_B_Zfp148
  gRNA
uaaacagauaaguguaaagc

SEQ ID NO: 127844 - RNA, 20 nt, Artificial Sequence
  MKO10127844_B_Zfp148
  gRNA
agacacgagaagauccauac

SEQ ID NO: 127845 - RNA, 20 nt, Artificial Sequence
  MKO10127845_B_Zfp14
  gRNA
uaacacuauggcccuggcuc

SEQ ID NO: 127846 - RNA, 20 nt, Artificial Sequence
  MKO10127846_B_Zfp14
  gRNA
cagugaaauaaaauugcuau

SEQ ID NO: 127847 - RNA, 20 nt, Artificial Sequence
  MKO10127847_B_Zfp14
  gRNA
aaggugcgcccgcugucuga

SEQ ID NO: 127848 - RNA, 20 nt, Artificial Sequence
  MKO10127848_B_Zfp157
  gRNA
ugcugcuugcugcacugcga

SEQ ID NO: 127849 - RNA, 20 nt, Artificial Sequence
  MKO10127849_B_Zfp157
  gRNA
gagacucacccaaggauacc

SEQ ID NO: 127850 - RNA, 20 nt, Artificial Sequence
  MKO10127850_B_Zfp157
  gRNA
gcauaggagacacuucaguc

SEQ ID NO: 127851 - RNA, 20 nt, Artificial Sequence
  MKO10127851_B_Zfp160
  gRNA
auacaaagggcccuggacug

SEQ ID NO: 127852 - RNA, 20 nt, Artificial Sequence
  MKO10127852_B_Zfp160
  gRNA
augcacagagagcuuugcac

SEQ ID NO: 127853 - RNA, 20 nt, Artificial Sequence
  MKO10127853_B_Zfp160
  gRNA
gccagggauggcugucacuc

SEQ ID NO: 127854 - RNA, 20 nt, Artificial Sequence
  MKO10127854_B_Zfp169
  gRNA
agagcccucucuuucguccc

SEQ ID NO: 127855 - RNA, 20 nt, Artificial Sequence
  MKO10127855_B_Zfp169
  gRNA
ugaaggccacagccacguca

SEQ ID NO: 127856 - RNA, 20 nt, Artificial Sequence
  MKO10127856_B_Zfp169
  gRNA
uccagcugcgugaugaguuu

SEQ ID NO: 127857 - RNA, 20 nt, Artificial Sequence
  MKO10127857_B_Zfp174
  gRNA
accgaugccagaccugugcc

SEQ ID NO: 127858 - RNA, 20 nt, Artificial Sequence
  MKO10127858_B_Zfp174
  gRNA
cuggaagagccuuccugcga

SEQ ID NO: 127859 - RNA, 20 nt, Artificial Sequence
  MKO10127859_B_Zfp174
  gRNA
ccccaaaauggcagcuagaa

SEQ ID NO: 127860 - RNA, 20 nt, Artificial Sequence
  MKO10127860_B_Zfp180
  gRNA
agacuucaagauuguaacug

SEQ ID NO: 127861 - RNA, 20 nt, Artificial Sequence
  MKO10127861_B_Zfp180
  gRNA
cucaucaucuuguugcucca

SEQ ID NO: 127862 - RNA, 20 nt, Artificial Sequence
  MKO10127862_B_Zfp180
  gRNA
ccacuucaaugaucaucucu

SEQ ID NO: 127863 - RNA, 20 nt, Artificial Sequence
  MKO10127863_B_Zfp182
  gRNA
uccagcuugauaaugagauc

SEQ ID NO: 127864 - RNA, 20 nt, Artificial Sequence
  MKO10127864_B_Zfp182
  gRNA
aauaccugaacucuccacag

SEQ ID NO: 127865 - RNA, 20 nt, Artificial Sequence
  MKO10127865_B_Zfp182
  gRNA
uguagcuguggauuucacuc

SEQ ID NO: 127866 - RNA, 20 nt, Artificial Sequence
  MKO10127866_B_Zfp184
  gRNA
aaacguugaugggccguuga

SEQ ID NO: 127867 - RNA, 20 nt, Artificial Sequence
  MKO10127867_B_Zfp184
  gRNA
augcacgaauccucagucca

SEQ ID NO: 127868 - RNA, 20 nt, Artificial Sequence
  MKO10127868_B_Zfp184
  gRNA
caacuuacccgaaaacuaga

SEQ ID NO: 127869 - RNA, 20 nt, Artificial Sequence
  MKO10127869_B_Zfp185
  gRNA
uaccggauuauguaaccagc

SEQ ID NO: 127870 - RNA, 20 nt, Artificial Sequence
  MKO10127870_B_Zfp185
  gRNA
uugcgcuccucuucaccaga

SEQ ID NO: 127871 - RNA, 20 nt, Artificial Sequence
  MKO10127871_B_Zfp185
  gRNA
ccagggagaacuguaccauc

SEQ ID NO: 127872 - RNA, 20 nt, Artificial Sequence
  MKO10127872_B_Zfp189
  gRNA
caacucaccuuuggcuccag

SEQ ID NO: 127873 - RNA, 20 nt, Artificial Sequence
  MKO10127873_B_Zfp189
  gRNA
cuacggaaagcuggucucgc

SEQ ID NO: 127874 - RNA, 20 nt, Artificial Sequence
  MKO10127874_B_Zfp189
  gRNA
ucaggaggagugggguuauc

SEQ ID NO: 127875 - RNA, 20 nt, Artificial Sequence
  MKO10127875_B_Zfp191
  gRNA
gcacuucccguuucugccga

SEQ ID NO: 127876 - RNA, 20 nt, Artificial Sequence
  MKO10127876_B_Zfp191
  gRNA
ucagcuggagagucucauga

SEQ ID NO: 127877 - RNA, 20 nt, Artificial Sequence
  MKO10127877_B_Zfp191
  gRNA
gaugaugccacgacagaaaa

SEQ ID NO: 127878 - RNA, 20 nt, Artificial Sequence
  MKO10127878_B_Zfp1
  gRNA
cauguacagaauccucugcg

SEQ ID NO: 127879 - RNA, 20 nt, Artificial Sequence
  MKO10127879_B_Zfp1
  gRNA
ccagaaaaugaugggguccc

SEQ ID NO: 127880 - RNA, 20 nt, Artificial Sequence
  MKO10127880_B_Zfp1
  gRNA
gaacgaugagguuugacugg

SEQ ID NO: 127881 - RNA, 20 nt, Artificial Sequence
  MKO10127881_B_Zfp202
  gRNA
guaucaucuagucugggaau

SEQ ID NO: 127882 - RNA, 20 nt, Artificial Sequence
  MKO10127882_B_Zfp202
  gRNA
guagaccuucccacagaaca

SEQ ID NO: 127883 - RNA, 20 nt, Artificial Sequence
  MKO10127883_B_Zfp202
  gRNA
gugagaagagcaaccaucuc

SEQ ID NO: 127884 - RNA, 20 nt, Artificial Sequence
  MKO10127884_B_Zfp207
  gRNA
ggugggauauaaccuugcug

SEQ ID NO: 127885 - RNA, 20 nt, Artificial Sequence
  MKO10127885_B_Zfp207
  gRNA
agaagaagcagcucaagccg

SEQ ID NO: 127886 - RNA, 20 nt, Artificial Sequence
  MKO10127886_B_Zfp207
  gRNA
auguuaccuggaggcauucc

SEQ ID NO: 127887 - RNA, 20 nt, Artificial Sequence
  MKO10127887_B_Zfp212
  gRNA
agaaguucuuguuucgaagc

SEQ ID NO: 127888 - RNA, 20 nt, Artificial Sequence
  MKO10127888_B_Zfp212
  gRNA
ggaaagcaacuaugagacgc

SEQ ID NO: 127889 - RNA, 20 nt, Artificial Sequence
  MKO10127889_B_Zfp212
  gRNA
gguggaagaagguacccacc

SEQ ID NO: 127890 - RNA, 20 nt, Artificial Sequence
  MKO10127890_B_Zfp213
  gRNA
gucugucgcucuuuaagaac

SEQ ID NO: 127891 - RNA, 20 nt, Artificial Sequence
  MKO10127891_B_Zfp213
  gRNA
gcugccugggagacccgagc

SEQ ID NO: 127892 - RNA, 20 nt, Artificial Sequence
  MKO10127892_B_Zfp213
  gRNA
guucuuaaagagcgacagac

SEQ ID NO: 127893 - RNA, 20 nt, Artificial Sequence
  MKO10127893_B_Zfp217
  gRNA
ugccccugaugaccaccgag

SEQ ID NO: 127894 - RNA, 20 nt, Artificial Sequence
  MKO10127894_B_Zfp217
  gRNA
acaguaacuacacucucucg

SEQ ID NO: 127895 - RNA, 20 nt, Artificial Sequence
  MKO10127895_B_Zfp217
  gRNA
auucaucucagaacgcauac

SEQ ID NO: 127896 - RNA, 20 nt, Artificial Sequence
  MKO10127896_B_Zfp219
  gRNA
caccaccucgcccguuucgc

SEQ ID NO: 127897 - RNA, 20 nt, Artificial Sequence
  MKO10127897_B_Zfp219
  gRNA
uggagggacacgaucugaag

SEQ ID NO: 127898 - RNA, 20 nt, Artificial Sequence
  MKO10127898_B_Zfp219
  gRNA
ugcagaagaaaacgggcugc

SEQ ID NO: 127899 - RNA, 20 nt, Artificial Sequence
  MKO10127899_B_Zfp229
  gRNA
uguucugagagacgacuguu

SEQ ID NO: 127900 - RNA, 20 nt, Artificial Sequence
  MKO10127900_B_Zfp229
  gRNA
cugaccuggaauguauuuac

SEQ ID NO: 127901 - RNA, 20 nt, Artificial Sequence
  MKO10127901_B_Zfp229
  gRNA
gggagaaauggcugguucuc

SEQ ID NO: 127902 - RNA, 20 nt, Artificial Sequence
  MKO10127902_B_Zfp235
  gRNA
cuccucuucacugaagacua

SEQ ID NO: 127903 - RNA, 20 nt, Artificial Sequence
  MKO10127903_B_Zfp235
  gRNA
gagaacaaugaccaaguuac

SEQ ID NO: 127904 - RNA, 20 nt, Artificial Sequence
  MKO10127904_B_Zfp235
  gRNA
cucuugacucaacaggauua

SEQ ID NO: 127905 - RNA, 20 nt, Artificial Sequence
  MKO10127905_B_Zfp236
  gRNA
cccaauuucagcgucacaug

SEQ ID NO: 127906 - RNA, 20 nt, Artificial Sequence
  MKO10127906_B_Zfp236
  gRNA
cccucaugugacgcugaaau

SEQ ID NO: 127907 - RNA, 20 nt, Artificial Sequence
  MKO10127907_B_Zfp236
  gRNA
gcaggugugcgcucgggugu

SEQ ID NO: 127908 - RNA, 20 nt, Artificial Sequence
  MKO10127908_B_Zfp239
  gRNA
ccugcccacacuugccgcag

SEQ ID NO: 127909 - RNA, 20 nt, Artificial Sequence
  MKO10127909_B_Zfp239
  gRNA
uuacuuagugaagcuccuug

SEQ ID NO: 127910 - RNA, 20 nt, Artificial Sequence
  MKO10127910_B_Zfp239
  gRNA
ccgcacuccucgcacgcaua

SEQ ID NO: 127911 - RNA, 20 nt, Artificial Sequence
  MKO10127911_B_Zfp248
  gRNA
cgaaguugcuauaauucucc

SEQ ID NO: 127912 - RNA, 20 nt, Artificial Sequence
  MKO10127912_B_Zfp248
  gRNA
ucuaucuugaagauuacauc

SEQ ID NO: 127913 - RNA, 20 nt, Artificial Sequence
  MKO10127913_B_Zfp248
  gRNA
cuacuguaccuggguggcac

SEQ ID NO: 127914 - RNA, 20 nt, Artificial Sequence
  MKO10127914_B_Zfp251
  gRNA
gucuugagacguugccagac

SEQ ID NO: 127915 - RNA, 20 nt, Artificial Sequence
  MKO10127915_B_Zfp251
  gRNA
caaguccugcuccccgacuc

SEQ ID NO: 127916 - RNA, 20 nt, Artificial Sequence
  MKO10127916_B_Zfp251
  gRNA
cuucagccccgagaagaucc

SEQ ID NO: 127917 - RNA, 20 nt, Artificial Sequence
  MKO10127917_B_Zfp259
  gRNA
guuccagccacaguguucgc

SEQ ID NO: 127918 - RNA, 20 nt, Artificial Sequence
  MKO10127918_B_Zfp259
  gRNA
cucaucaauucucucugcga

SEQ ID NO: 127919 - RNA, 20 nt, Artificial Sequence
  MKO10127919_B_Zfp259
  gRNA
ccaguacuuaccagugugaa

SEQ ID NO: 127920 - RNA, 20 nt, Artificial Sequence
  MKO10127920_B_Zfp260
  gRNA
ccucucuuacagugcauaug

SEQ ID NO: 127921 - RNA, 20 nt, Artificial Sequence
  MKO10127921_B_Zfp260
  gRNA
gagaaguccccugaguguac

SEQ ID NO: 127922 - RNA, 20 nt, Artificial Sequence
  MKO10127922_B_Zfp260
  gRNA
aaacaccagaauauccauag

SEQ ID NO: 127923 - RNA, 20 nt, Artificial Sequence
  MKO10127923_B_Zfp263
  gRNA
gcggggagcagaagugcuuu

SEQ ID NO: 127924 - RNA, 20 nt, Artificial Sequence
  MKO10127924_B_Zfp263
  gRNA
gggcuucgcucagucuccau

SEQ ID NO: 127925 - RNA, 20 nt, Artificial Sequence
  MKO10127925_B_Zfp263
  gRNA
ucaagcacccacguggagca

SEQ ID NO: 127926 - RNA, 20 nt, Artificial Sequence
  MKO10127926_B_Zfp266
  gRNA
ucagaagaaucuauaccgag

SEQ ID NO: 127927 - RNA, 20 nt, Artificial Sequence
  MKO10127927_B_Zfp266
  gRNA
agcucugaaucgucaauugu

SEQ ID NO: 127928 - RNA, 20 nt, Artificial Sequence
  MKO10127928_B_Zfp266
  gRNA
uacgagaacuugacuucagu

SEQ ID NO: 127929 - RNA, 20 nt, Artificial Sequence
  MKO10127929_B_Zfp26
  gRNA
ccucacuggacccaguucag

SEQ ID NO: 127930 - RNA, 20 nt, Artificial Sequence
  MKO10127930_B_Zfp26
  gRNA
ccucugaacuggguccagug

SEQ ID NO: 127931 - RNA, 20 nt, Artificial Sequence
  MKO10127931_B_Zfp26
  gRNA
cuucuccuugacugcaguuc

SEQ ID NO: 127932 - RNA, 20 nt, Artificial Sequence
  MKO10127932_B_Zfp273
  gRNA
acacaucugugaaugacaga

SEQ ID NO: 127933 - RNA, 20 nt, Artificial Sequence
  MKO10127933_B_Zfp273
  gRNA
gauccucacccaggaacaca

SEQ ID NO: 127934 - RNA, 20 nt, Artificial Sequence
  MKO10127934_B_Zfp273
  gRNA
uuccuacacaccuagaugga

SEQ ID NO: 127935 - RNA, 20 nt, Artificial Sequence
  MKO10127935_B_Zfp275
  gRNA
ggcagucccucuugagaugc

SEQ ID NO: 127936 - RNA, 20 nt, Artificial Sequence
  MKO10127936_B_Zfp275
  gRNA
cuuccccaagacggagcccc

SEQ ID NO: 127937 - RNA, 20 nt, Artificial Sequence
  MKO10127937_B_Zfp275
  gRNA
caguuugaacccggagcagc

SEQ ID NO: 127938 - RNA, 20 nt, Artificial Sequence
  MKO10127938_B_Zfp276
  gRNA
agccaaguguggcugcguac

SEQ ID NO: 127939 - RNA, 20 nt, Artificial Sequence
  MKO10127939_B_Zfp276
  gRNA
gacguugacucucuguaaga

SEQ ID NO: 127940 - RNA, 20 nt, Artificial Sequence
  MKO10127940_B_Zfp276
  gRNA
agggcaacugggugagacgc

SEQ ID NO: 127941 - RNA, 20 nt, Artificial Sequence
  MKO10127941_B_Zfp277
  gRNA
cacgcugcaaaaaucaguga

SEQ ID NO: 127942 - RNA, 20 nt, Artificial Sequence
  MKO10127942_B_Zfp277
  gRNA
agauggagacccuucuaaag

SEQ ID NO: 127943 - RNA, 20 nt, Artificial Sequence
  MKO10127943_B_Zfp277
  gRNA
gcacuuaccaaauggagcug

SEQ ID NO: 127944 - RNA, 20 nt, Artificial Sequence
  MKO10127944_B_Zfp27
  gRNA
uaugcuuacccacugagcgc

SEQ ID NO: 127945 - RNA, 20 nt, Artificial Sequence
  MKO10127945_B_Zfp27
  gRNA
gagauuugaccugccgcuaa

SEQ ID NO: 127946 - RNA, 20 nt, Artificial Sequence
  MKO10127946_B_Zfp27
  gRNA
guacacgugacgucuccuac

SEQ ID NO: 127947 - RNA, 20 nt, Artificial Sequence
  MKO10127947_B_Zfp280b
  gRNA
uaaaaacuguagucggcacu

SEQ ID NO: 127948 - RNA, 20 nt, Artificial Sequence
  MKO10127948_B_Zfp280b
  gRNA
gguccggugacgugugcacu

SEQ ID NO: 127949 - RNA, 20 nt, Artificial Sequence
  MKO10127949_B_Zfp280b
  gRNA
gccaauccacuguccugacg

SEQ ID NO: 127950 - RNA, 20 nt, Artificial Sequence
  MKO10127950_B_Zfp280c
  gRNA
gauaacucuguucaagaaaa

SEQ ID NO: 127951 - RNA, 20 nt, Artificial Sequence
  MKO10127951_B_Zfp280c
  gRNA
gaugaugagcugaucuuugu

SEQ ID NO: 127952 - RNA, 20 nt, Artificial Sequence
  MKO10127952_B_Zfp280c
  gRNA
ucuucaaagggacuaaagaa

SEQ ID NO: 127953 - RNA, 20 nt, Artificial Sequence
  MKO10127953_B_Zfp280d
  gRNA
uauuccucuugaaugagagc

SEQ ID NO: 127954 - RNA, 20 nt, Artificial Sequence
  MKO10127954_B_Zfp280d
  gRNA
gaaagugaaagaagucgaag

SEQ ID NO: 127955 - RNA, 20 nt, Artificial Sequence
  MKO10127955_B_Zfp280d
  gRNA
aagucagaucugcaacuuga

SEQ ID NO: 127956 - RNA, 20 nt, Artificial Sequence
  MKO10127956_B_Zfp281
  gRNA
cgcugcucaguaauacaucg

SEQ ID NO: 127957 - RNA, 20 nt, Artificial Sequence
  MKO10127957_B_Zfp281
  gRNA
cgggguaugaaaaucggcag

SEQ ID NO: 127958 - RNA, 20 nt, Artificial Sequence
  MKO10127958_B_Zfp281
  gRNA
auaacacgcacugcggggga

SEQ ID NO: 127959 - RNA, 20 nt, Artificial Sequence
  MKO10127959_B_Zfp282
  gRNA
gggcuucuucucgcuuuacc

SEQ ID NO: 127960 - RNA, 20 nt, Artificial Sequence
  MKO10127960_B_Zfp282
  gRNA
gaaggagcucuacagcaauc

SEQ ID NO: 127961 - RNA, 20 nt, Artificial Sequence
  MKO10127961_B_Zfp282
  gRNA
ggcacaggacauauccuccc

SEQ ID NO: 127962 - RNA, 20 nt, Artificial Sequence
  MKO10127962_B_Zfp286
  gRNA
caaacccgauaacuauaauu

SEQ ID NO: 127963 - RNA, 20 nt, Artificial Sequence
  MKO10127963_B_Zfp286
  gRNA
uguucuuacagagcgagacc

SEQ ID NO: 127964 - RNA, 20 nt, Artificial Sequence
  MKO10127964_B_Zfp286
  gRNA
aucuuccgaauuauaguuau

SEQ ID NO: 127965 - RNA, 20 nt, Artificial Sequence
  MKO10127965_B_Zfp287
  gRNA
ucuaagacgggaaucacagu

SEQ ID NO: 127966 - RNA, 20 nt, Artificial Sequence
  MKO10127966_B_Zfp287
  gRNA
uucccgucuuagaagagccg

SEQ ID NO: 127967 - RNA, 20 nt, Artificial Sequence
  MKO10127967_B_Zfp287
  gRNA
uuauacaauuccuucugaac

SEQ ID NO: 127968 - RNA, 20 nt, Artificial Sequence
  MKO10127968_B_Zfp28
  gRNA
uucccucacccagggaugcu

SEQ ID NO: 127969 - RNA, 20 nt, Artificial Sequence
  MKO10127969_B_Zfp28
  gRNA
gaugagaaaaggccagcacc

SEQ ID NO: 127970 - RNA, 20 nt, Artificial Sequence
  MKO10127970_B_Zfp28
  gRNA
gcuuuaugucuagucccugu

SEQ ID NO: 127971 - RNA, 20 nt, Artificial Sequence
  MKO10127971_B_Zfp292
  gRNA
acaauuucagaccuugguac

SEQ ID NO: 127972 - RNA, 20 nt, Artificial Sequence
  MKO10127972_B_Zfp292
  gRNA
ucuccugagcuagaguagcu

SEQ ID NO: 127973 - RNA, 20 nt, Artificial Sequence
  MKO10127973_B_Zfp292
  gRNA
uugagcuaucagauaagcag

SEQ ID NO: 127974 - RNA, 20 nt, Artificial Sequence
  MKO10127974_B_Zfp296
  gRNA
ggcgguugagcuugcuacuc

SEQ ID NO: 127975 - RNA, 20 nt, Artificial Sequence
  MKO10127975_B_Zfp296
  gRNA
auggaaagaucuucccgcaa

SEQ ID NO: 127976 - RNA, 20 nt, Artificial Sequence
  MKO10127976_B_Zfp296
  gRNA
caagucuccgaccccaucuc

SEQ ID NO: 127977 - RNA, 20 nt, Artificial Sequence
  MKO10127977_B_Zfp2
  gRNA
gaauccucugaugcuuaagc

SEQ ID NO: 127978 - RNA, 20 nt, Artificial Sequence
  MKO10127978_B_Zfp2
  gRNA
uuccugugacaccuuguaau

SEQ ID NO: 127979 - RNA, 20 nt, Artificial Sequence
  MKO10127979_B_Zfp2
  gRNA
cuguugccccuuuaaccaac

SEQ ID NO: 127980 - RNA, 20 nt, Artificial Sequence
  MKO10127980_B_Zfp300
  gRNA
gugaucgccucuuuagagaa

SEQ ID NO: 127981 - RNA, 20 nt, Artificial Sequence
  MKO10127981_B_Zfp300
  gRNA
gaauaaaaguaugcaauuac

SEQ ID NO: 127982 - RNA, 20 nt, Artificial Sequence
  MKO10127982_B_Zfp300
  gRNA
ucaggaagaauggaaucaac

SEQ ID NO: 127983 - RNA, 20 nt, Artificial Sequence
  MKO10127983_B_Zfp30
  gRNA
ucuguacagaucccucucgu

SEQ ID NO: 127984 - RNA, 20 nt, Artificial Sequence
  MKO10127984_B_Zfp30
  gRNA
aggagccguggaugauugug

SEQ ID NO: 127985 - RNA, 20 nt, Artificial Sequence
  MKO10127985_B_Zfp30
  gRNA
gauuccagaaucgcaagaac

SEQ ID NO: 127986 - RNA, 20 nt, Artificial Sequence
  MKO10127986_B_Zfp316
  gRNA
agugacgacaucucccuccu

SEQ ID NO: 127987 - RNA, 20 nt, Artificial Sequence
  MKO10127987_B_Zfp316
  gRNA
ucuguaccgggaaguaaugc

SEQ ID NO: 127988 - RNA, 20 nt, Artificial Sequence
  MKO10127988_B_Zfp316
  gRNA
gagauacccgggaggucugu

SEQ ID NO: 127989 - RNA, 20 nt, Artificial Sequence
  MKO10127989_B_Zfp317
  gRNA
ugauucuugucagcagaguu

SEQ ID NO: 127990 - RNA, 20 nt, Artificial Sequence
  MKO10127990_B_Zfp317
  gRNA
agcaucugaugauguaagau

SEQ ID NO: 127991 - RNA, 20 nt, Artificial Sequence
  MKO10127991_B_Zfp317
  gRNA
gacauuucaagauauugcug

SEQ ID NO: 127992 - RNA, 20 nt, Artificial Sequence
  MKO10127992_B_Zfp318
  gRNA
cucguagucgucccaaucuc

SEQ ID NO: 127993 - RNA, 20 nt, Artificial Sequence
  MKO10127993_B_Zfp318
  gRNA
acgacuacgagcagcuuguu

SEQ ID NO: 127994 - RNA, 20 nt, Artificial Sequence
  MKO10127994_B_Zfp318
  gRNA
agaucccgaguuucgagaac

SEQ ID NO: 127995 - RNA, 20 nt, Artificial Sequence
  MKO10127995_B_Zfp319
  gRNA
cgccacauguacgcgcauuc

SEQ ID NO: 127996 - RNA, 20 nt, Artificial Sequence
  MKO10127996_B_Zfp319
  gRNA
cucgcagacagcgcacuugu

SEQ ID NO: 127997 - RNA, 20 nt, Artificial Sequence
  MKO10127997_B_Zfp319
  gRNA
uugcaggaguaugccguaca

SEQ ID NO: 127998 - RNA, 20 nt, Artificial Sequence
  MKO10127998_B_Zfp322a
  gRNA
gugagaaaaguuaccgacac

SEQ ID NO: 127999 - RNA, 20 nt, Artificial Sequence
  MKO10127999_B_Zfp322a
  gRNA
gugugagagaacauauaccg

SEQ ID NO: 128000 - RNA, 20 nt, Artificial Sequence
  MKO10128000_B_Zfp322a
  gRNA
uuucaccuguauggcuucgc

SEQ ID NO: 128001 - RNA, 20 nt, Artificial Sequence
  MKO10128001_B_Zfp324
  gRNA
cuuguaccgccauguaaugc

SEQ ID NO: 128002 - RNA, 20 nt, Artificial Sequence
  MKO10128002_B_Zfp324
  gRNA
ucauuccacugcaacgagug

SEQ ID NO: 128003 - RNA, 20 nt, Artificial Sequence
  MKO10128003_B_Zfp324
  gRNA
guuggaugaucacacgaggc

SEQ ID NO: 128004 - RNA, 20 nt, Artificial Sequence
  MKO10128004_B_Zfp326
  gRNA
cuucccagcuagacccgccc

SEQ ID NO: 128005 - RNA, 20 nt, Artificial Sequence
  MKO10128005_B_Zfp326
  gRNA
ucaggaauggaucgugauua

SEQ ID NO: 128006 - RNA, 20 nt, Artificial Sequence
  MKO10128006_B_Zfp326
  gRNA
gacacucaccguuaaagucc

SEQ ID NO: 128007 - RNA, 20 nt, Artificial Sequence
  MKO10128007_B_Zfp329
  gRNA
cuucaaacggaacuccucuc

SEQ ID NO: 128008 - RNA, 20 nt, Artificial Sequence
  MKO10128008_B_Zfp329
  gRNA
gaagucucugauguacuacc

SEQ ID NO: 128009 - RNA, 20 nt, Artificial Sequence
  MKO10128009_B_Zfp329
  gRNA
acaacuugauuguacaucga

SEQ ID NO: 128010 - RNA, 20 nt, Artificial Sequence
  MKO10128010_B_Zfp330
  gRNA
guacaguacuggccuugcua

SEQ ID NO: 128011 - RNA, 20 nt, Artificial Sequence
  MKO10128011_B_Zfp330
  gRNA
aggaaugcgacaaaugucag

SEQ ID NO: 128012 - RNA, 20 nt, Artificial Sequence
  MKO10128012_B_Zfp330
  gRNA
uuaccacacugugcacaaau

SEQ ID NO: 128013 - RNA, 20 nt, Artificial Sequence
  MKO10128013_B_Zfp334
  gRNA
gaccuacaguaaccucaucg

SEQ ID NO: 128014 - RNA, 20 nt, Artificial Sequence
  MKO10128014_B_Zfp334
  gRNA
ggcuguggacuucacccgcg

SEQ ID NO: 128015 - RNA, 20 nt, Artificial Sequence
  MKO10128015_B_Zfp334
  gRNA
accagaugugaucuuaaaac

SEQ ID NO: 128016 - RNA, 20 nt, Artificial Sequence
  MKO10128016_B_Zfp335
  gRNA
uaccgucauccgggccuugc

SEQ ID NO: 128017 - RNA, 20 nt, Artificial Sequence
  MKO10128017_B_Zfp335
  gRNA
caacccugcuccgccacaug

SEQ ID NO: 128018 - RNA, 20 nt, Artificial Sequence
  MKO10128018_B_Zfp335
  gRNA
agauucgaugaucuugucaa

SEQ ID NO: 128019 - RNA, 20 nt, Artificial Sequence
  MKO10128019_B_Zfp341
  gRNA
caccguuccguucccagcca

SEQ ID NO: 128020 - RNA, 20 nt, Artificial Sequence
  MKO10128020_B_Zfp341
  gRNA
ccuggcacuguucacgcuug

SEQ ID NO: 128021 - RNA, 20 nt, Artificial Sequence
  MKO10128021_B_Zfp341
  gRNA
cuggaggcauuggcuggucc

SEQ ID NO: 128022 - RNA, 20 nt, Artificial Sequence
  MKO10128022_B_Zfp345
  gRNA
augugcaugugaacuucacg

SEQ ID NO: 128023 - RNA, 20 nt, Artificial Sequence
  MKO10128023_B_Zfp345
  gRNA
uauagcagcgagauuccugu

SEQ ID NO: 128024 - RNA, 20 nt, Artificial Sequence
  MKO10128024_B_Zfp345
  gRNA
cuucauauuucuagaagaua

SEQ ID NO: 128025 - RNA, 20 nt, Artificial Sequence
  MKO10128025_B_Zfp346
  gRNA
gcagaccuuacacugggugc

SEQ ID NO: 128026 - RNA, 20 nt, Artificial Sequence
  MKO10128026_B_Zfp346
  gRNA
cagaggcugcagaauuuguc

SEQ ID NO: 128027 - RNA, 20 nt, Artificial Sequence
  MKO10128027_B_Zfp346
  gRNA
uagugcgacugugccacagc

SEQ ID NO: 128028 - RNA, 20 nt, Artificial Sequence
  MKO10128028_B_Zfp352
  gRNA
ggucuuguccucuuagaccc

SEQ ID NO: 128029 - RNA, 20 nt, Artificial Sequence
  MKO10128029_B_Zfp352
  gRNA
gggcgcuguugagcugugua

SEQ ID NO: 128030 - RNA, 20 nt, Artificial Sequence
  MKO10128030_B_Zfp352
  gRNA
ccaauuggacuugucaccug

SEQ ID NO: 128031 - RNA, 20 nt, Artificial Sequence
  MKO10128031_B_Zfp354a
  gRNA
gaugucgcuucccauugcuc

SEQ ID NO: 128032 - RNA, 20 nt, Artificial Sequence
  MKO10128032_B_Zfp354a
  gRNA
ucaccgagagagaagccucc

SEQ ID NO: 128033 - RNA, 20 nt, Artificial Sequence
  MKO10128033_B_Zfp354a
  gRNA
gugaucucccugcugcagca

SEQ ID NO: 128034 - RNA, 20 nt, Artificial Sequence
  MKO10128034_B_Zfp354b
  gRNA
gucggugacguuugaagacg

SEQ ID NO: 128035 - RNA, 20 nt, Artificial Sequence
  MKO10128035_B_Zfp354b
  gRNA
uucuucuccuuguugcaaca

SEQ ID NO: 128036 - RNA, 20 nt, Artificial Sequence
  MKO10128036_B_Zfp354b
  gRNA
ugagcauggcuccagagcaa

SEQ ID NO: 128037 - RNA, 20 nt, Artificial Sequence
  MKO10128037_B_Zfp354c
  gRNA
ucaccuaggcaggugucuuc

SEQ ID NO: 128038 - RNA, 20 nt, Artificial Sequence
  MKO10128038_B_Zfp354c
  gRNA
gccucuuacccagcgaggcc

SEQ ID NO: 128039 - RNA, 20 nt, Artificial Sequence
  MKO10128039_B_Zfp354c
  gRNA
ggaaauggcuguggauuugc

SEQ ID NO: 128040 - RNA, 20 nt, Artificial Sequence
  MKO10128040_B_Zfp358
  gRNA
ggcgcucgccagaaugcacg

SEQ ID NO: 128041 - RNA, 20 nt, Artificial Sequence
  MKO10128041_B_Zfp358
  gRNA
cgccgugcgugcgcaggugu

SEQ ID NO: 128042 - RNA, 20 nt, Artificial Sequence
  MKO10128042_B_Zfp358
  gRNA
gaggucgaaacucgaagaca

SEQ ID NO: 128043 - RNA, 20 nt, Artificial Sequence
  MKO10128043_B_Zfp35
  gRNA
caagaccaucacuuucuguc

SEQ ID NO: 128044 - RNA, 20 nt, Artificial Sequence
  MKO10128044_B_Zfp35
  gRNA
cuucagucagcgcucugauc

SEQ ID NO: 128045 - RNA, 20 nt, Artificial Sequence
  MKO10128045_B_Zfp35
  gRNA
ggugagacuaagaucaagau

SEQ ID NO: 128046 - RNA, 20 nt, Artificial Sequence
  MKO10128046_B_Zfp362
  gRNA
gcacccaccugguauguugc

SEQ ID NO: 128047 - RNA, 20 nt, Artificial Sequence
  MKO10128047_B_Zfp362
  gRNA
uguugucccguaccccaucc

SEQ ID NO: 128048 - RNA, 20 nt, Artificial Sequence
  MKO10128048_B_Zfp362
  gRNA
cuccggugagaccgcaaagg

SEQ ID NO: 128049 - RNA, 20 nt, Artificial Sequence
  MKO10128049_B_Zfp365
  gRNA
ucacagacaucccaucgaac

SEQ ID NO: 128050 - RNA, 20 nt, Artificial Sequence
  MKO10128050_B_Zfp365
  gRNA
ggccuuggcgggcugcaucc

SEQ ID NO: 128051 - RNA, 20 nt, Artificial Sequence
  MKO10128051_B_Zfp365
  gRNA
caucugggcuuccuguucga

SEQ ID NO: 128052 - RNA, 20 nt, Artificial Sequence
  MKO10128052_B_Zfp366
  gRNA
gccaauguuccaguccgacg

SEQ ID NO: 128053 - RNA, 20 nt, Artificial Sequence
  MKO10128053_B_Zfp366
  gRNA
ccccuucagcgugaacuuac

SEQ ID NO: 128054 - RNA, 20 nt, Artificial Sequence
  MKO10128054_B_Zfp366
  gRNA
gaaccugacccgccacauga

SEQ ID NO: 128055 - RNA, 20 nt, Artificial Sequence
  MKO10128055_B_Zfp367
  gRNA
ucucucuucagccgggcaua

SEQ ID NO: 128056 - RNA, 20 nt, Artificial Sequence
  MKO10128056_B_Zfp367
  gRNA
agaagaguggcgcccagcgc

SEQ ID NO: 128057 - RNA, 20 nt, Artificial Sequence
  MKO10128057_B_Zfp367
  gRNA
cacagucuggguagucacac

SEQ ID NO: 128058 - RNA, 20 nt, Artificial Sequence
  MKO10128058_B_Zfp369
  gRNA
cucaauaacaugauuucagu

SEQ ID NO: 128059 - RNA, 20 nt, Artificial Sequence
  MKO10128059_B_Zfp369
  gRNA
ccuaccgcuagagaacacug

SEQ ID NO: 128060 - RNA, 20 nt, Artificial Sequence
  MKO10128060_B_Zfp369
  gRNA
cuguccucaguguucucuag

SEQ ID NO: 128061 - RNA, 20 nt, Artificial Sequence
  MKO10128061_B_Zfp36l1
  gRNA
auucggacaugggccggaag

SEQ ID NO: 128062 - RNA, 20 nt, Artificial Sequence
  MKO10128062_B_Zfp36l1
  gRNA
agagugaccgagugccugcg

SEQ ID NO: 128063 - RNA, 20 nt, Artificial Sequence
  MKO10128063_B_Zfp36l1
  gRNA
ccugagcgccgaugaccucu

SEQ ID NO: 128064 - RNA, 20 nt, Artificial Sequence
  MKO10128064_B_Zfp36l2
  gRNA
caagaagucgauaucguaga

SEQ ID NO: 128065 - RNA, 20 nt, Artificial Sequence
  MKO10128065_B_Zfp36l2
  gRNA
gacccacaacuucgccgccg

SEQ ID NO: 128066 - RNA, 20 nt, Artificial Sequence
  MKO10128066_B_Zfp36l2
  gRNA
gaccgcucguucagcgagaa

SEQ ID NO: 128067 - RNA, 20 nt, Artificial Sequence
  MKO10128067_B_Zfp36l3
  gRNA
ccgcccgcucaacacuaaug

SEQ ID NO: 128068 - RNA, 20 nt, Artificial Sequence
  MKO10128068_B_Zfp36l3
  gRNA
aggcuauguucgccauuccg

SEQ ID NO: 128069 - RNA, 20 nt, Artificial Sequence
  MKO10128069_B_Zfp36l3
  gRNA
uugaccgacaggaagcccga

SEQ ID NO: 128070 - RNA, 20 nt, Artificial Sequence
  MKO10128070_B_Zfp36
  gRNA
guagauggcagagagaucca

SEQ ID NO: 128071 - RNA, 20 nt, Artificial Sequence
  MKO10128071_B_Zfp36
  gRNA
gaaagcgggcguugucgcua

SEQ ID NO: 128072 - RNA, 20 nt, Artificial Sequence
  MKO10128072_B_Zfp36
  gRNA
caugaccugucauccgacca

SEQ ID NO: 128073 - RNA, 20 nt, Artificial Sequence
  MKO10128073_B_Zfp37
  gRNA
ucauagugcaucccauacca

SEQ ID NO: 128074 - RNA, 20 nt, Artificial Sequence
  MKO10128074_B_Zfp37
  gRNA
acaagacauagucuccgugu

SEQ ID NO: 128075 - RNA, 20 nt, Artificial Sequence
  MKO10128075_B_Zfp37
  gRNA
cacggagacuaugucuuguu

SEQ ID NO: 128076 - RNA, 20 nt, Artificial Sequence
  MKO10128076_B_Zfp382
  gRNA
guaccuagauagcucugacu

SEQ ID NO: 128077 - RNA, 20 nt, Artificial Sequence
  MKO10128077_B_Zfp382
  gRNA
gucacguccuugaaugacac

SEQ ID NO: 128078 - RNA, 20 nt, Artificial Sequence
  MKO10128078_B_Zfp382
  gRNA
aaaccucaacgccaugucca

SEQ ID NO: 128079 - RNA, 20 nt, Artificial Sequence
  MKO10128079_B_Zfp383
  gRNA
gguguucagugacgugucuc

SEQ ID NO: 128080 - RNA, 20 nt, Artificial Sequence
  MKO10128080_B_Zfp383
  gRNA
uuuguacaagucucucugcg

SEQ ID NO: 128081 - RNA, 20 nt, Artificial Sequence
  MKO10128081_B_Zfp383
  gRNA
cuucucacuuacccgagcac

SEQ ID NO: 128082 - RNA, 20 nt, Artificial Sequence
  MKO10128082_B_Zfp384
  gRNA
acucaccugcccugagacug

SEQ ID NO: 128083 - RNA, 20 nt, Artificial Sequence
  MKO10128083_B_Zfp384
  gRNA
aaggagucuccuguucucag

SEQ ID NO: 128084 - RNA, 20 nt, Artificial Sequence
  MKO10128084_B_Zfp384
  gRNA
ggcagggacaguuagcaaag

SEQ ID NO: 128085 - RNA, 20 nt, Artificial Sequence
  MKO10128085_B_Zfp385a
  gRNA
ucagauccgcuucaauucuc

SEQ ID NO: 128086 - RNA, 20 nt, Artificial Sequence
  MKO10128086_B_Zfp385a
  gRNA
caggguguaaccaaggguga

SEQ ID NO: 128087 - RNA, 20 nt, Artificial Sequence
  MKO10128087_B_Zfp385a
  gRNA
ugaaguucccccuucacccu

SEQ ID NO: 128088 - RNA, 20 nt, Artificial Sequence
  MKO10128088_B_Zfp385b
  gRNA
uccuuccaaggacagcgcaa

SEQ ID NO: 128089 - RNA, 20 nt, Artificial Sequence
  MKO10128089_B_Zfp385b
  gRNA
uuacucacuguguuaaaguu

SEQ ID NO: 128090 - RNA, 20 nt, Artificial Sequence
  MKO10128090_B_Zfp385b
  gRNA
gcagucauuaaccacacauu

SEQ ID NO: 128091 - RNA, 20 nt, Artificial Sequence
  MKO10128091_B_Zfp385c
  gRNA
ccgcagaugacagauguuac

SEQ ID NO: 128092 - RNA, 20 nt, Artificial Sequence
  MKO10128092_B_Zfp385c
  gRNA
ccucgaaacccgaccacaaa

SEQ ID NO: 128093 - RNA, 20 nt, Artificial Sequence
  MKO10128093_B_Zfp385c
  gRNA
agacaccacugucccguuug

SEQ ID NO: 128094 - RNA, 20 nt, Artificial Sequence
  MKO10128094_B_Zfp386
  gRNA
caagucgagucuuccuaucc

SEQ ID NO: 128095 - RNA, 20 nt, Artificial Sequence
  MKO10128095_B_Zfp386
  gRNA
gcugaccaagaauugaguag

SEQ ID NO: 128096 - RNA, 20 nt, Artificial Sequence
  MKO10128096_B_Zfp386
  gRNA
auaaaacuuuaaacguuacu

SEQ ID NO: 128097 - RNA, 20 nt, Artificial Sequence
  MKO10128097_B_Zfp395
  gRNA
gcugguucgucuaacaggaa

SEQ ID NO: 128098 - RNA, 20 nt, Artificial Sequence
  MKO10128098_B_Zfp395
  gRNA
ugaauccaggaagucggaug

SEQ ID NO: 128099 - RNA, 20 nt, Artificial Sequence
  MKO10128099_B_Zfp395
  gRNA
acgaaccagccccacgaaag

SEQ ID NO: 128100 - RNA, 20 nt, Artificial Sequence
  MKO10128100_B_Zfp397
  gRNA
gcucagcucucacuagacau

SEQ ID NO: 128101 - RNA, 20 nt, Artificial Sequence
  MKO10128101_B_Zfp397
  gRNA
caggucccagauaaucuaca

SEQ ID NO: 128102 - RNA, 20 nt, Artificial Sequence
  MKO10128102_B_Zfp397
  gRNA
auucaaccagcauccaaguc

SEQ ID NO: 128103 - RNA, 20 nt, Artificial Sequence
  MKO10128103_B_Zfp398
  gRNA
agcggcggucgccucagcca

SEQ ID NO: 128104 - RNA, 20 nt, Artificial Sequence
  MKO10128104_B_Zfp398
  gRNA
gcucacucucuuuagacucc

SEQ ID NO: 128105 - RNA, 20 nt, Artificial Sequence
  MKO10128105_B_Zfp398
  gRNA
aauccaagacagaauaucug

SEQ ID NO: 128106 - RNA, 20 nt, Artificial Sequence
  MKO10128106_B_Zfp39
  gRNA
gucccaaagcagagccgagc

SEQ ID NO: 128107 - RNA, 20 nt, Artificial Sequence
  MKO10128107_B_Zfp39
  gRNA
cuccaguaacuguaggugac

SEQ ID NO: 128108 - RNA, 20 nt, Artificial Sequence
  MKO10128108_B_Zfp39
  gRNA
uucacucacccaaggacucc

SEQ ID NO: 128109 - RNA, 20 nt, Artificial Sequence
  MKO10128109_B_Zfp3
  gRNA
uaguaagcucuauacucccc

SEQ ID NO: 128110 - RNA, 20 nt, Artificial Sequence
  MKO10128110_B_Zfp3
  gRNA
gccagcgcaugugcugccuc

SEQ ID NO: 128111 - RNA, 20 nt, Artificial Sequence
  MKO10128111_B_Zfp3
  gRNA
cgcuauggacucucauaugc

SEQ ID NO: 128112 - RNA, 20 nt, Artificial Sequence
  MKO10128112_B_Zfp407
  gRNA
gcacggaguuggcaccccaa

SEQ ID NO: 128113 - RNA, 20 nt, Artificial Sequence
  MKO10128113_B_Zfp407
  gRNA
cagcgaugaaagaccacuac

SEQ ID NO: 128114 - RNA, 20 nt, Artificial Sequence
  MKO10128114_B_Zfp407
  gRNA
gaguacaagugucacgucug

SEQ ID NO: 128115 - RNA, 20 nt, Artificial Sequence
  MKO10128115_B_Zfp408
  gRNA
uccccgcaagaggauucagc

SEQ ID NO: 128116 - RNA, 20 nt, Artificial Sequence
  MKO10128116_B_Zfp408
  gRNA
cccggcagcaaaguuccacu

SEQ ID NO: 128117 - RNA, 20 nt, Artificial Sequence
  MKO10128117_B_Zfp408
  gRNA
cuccucaauaccuccucgug

SEQ ID NO: 128118 - RNA, 20 nt, Artificial Sequence
  MKO10128118_B_Zfp40
  gRNA
cucucaaagagcucuauaca

SEQ ID NO: 128119 - RNA, 20 nt, Artificial Sequence
  MKO10128119_B_Zfp40
  gRNA
uucucugauagaugugcccc

SEQ ID NO: 128120 - RNA, 20 nt, Artificial Sequence
  MKO10128120_B_Zfp40
  gRNA
ccugagacagaaacucagaa

SEQ ID NO: 128121 - RNA, 20 nt, Artificial Sequence
  MKO10128121_B_Zfp410
  gRNA
cauucugaggccucggucac

SEQ ID NO: 128122 - RNA, 20 nt, Artificial Sequence
  MKO10128122_B_Zfp410
  gRNA
uugagcuucuucuccgcuug

SEQ ID NO: 128123 - RNA, 20 nt, Artificial Sequence
  MKO10128123_B_Zfp410
  gRNA
ggcccaugacagucugauug

SEQ ID NO: 128124 - RNA, 20 nt, Artificial Sequence
  MKO10128124_B_Zfp414
  gRNA
gcuuguaaugcagcuugccg

SEQ ID NO: 128125 - RNA, 20 nt, Artificial Sequence
  MKO10128125_B_Zfp414
  gRNA
cugugcuagaucacgaacac

SEQ ID NO: 128126 - RNA, 20 nt, Artificial Sequence
  MKO10128126_B_Zfp414
  gRNA
gggcaaccgaagguccucau

SEQ ID NO: 128127 - RNA, 20 nt, Artificial Sequence
  MKO10128127_B_Zfp418
  gRNA
acagggcuguguaaccuuug

SEQ ID NO: 128128 - RNA, 20 nt, Artificial Sequence
  MKO10128128_B_Zfp418
  gRNA
gauggcggcgcugaagcacc

SEQ ID NO: 128129 - RNA, 20 nt, Artificial Sequence
  MKO10128129_B_Zfp418
  gRNA
gguucccagaucuacagaaa

SEQ ID NO: 128130 - RNA, 20 nt, Artificial Sequence
  MKO10128130_B_Zfp41
  gRNA
cucaaagucaucuuuaaacg

SEQ ID NO: 128131 - RNA, 20 nt, Artificial Sequence
  MKO10128131_B_Zfp41
  gRNA
gcggggcuuucuuggcuucu

SEQ ID NO: 128132 - RNA, 20 nt, Artificial Sequence
  MKO10128132_B_Zfp41
  gRNA
cucguuuaaagaugacuuug

SEQ ID NO: 128133 - RNA, 20 nt, Artificial Sequence
  MKO10128133_B_Zfp420
  gRNA
uucucuguagaguaaccccg

SEQ ID NO: 128134 - RNA, 20 nt, Artificial Sequence
  MKO10128134_B_Zfp420
  gRNA
gagcaacaauccacgugcaa

SEQ ID NO: 128135 - RNA, 20 nt, Artificial Sequence
  MKO10128135_B_Zfp420
  gRNA
uaguugagacucacguguaa

SEQ ID NO: 128136 - RNA, 20 nt, Artificial Sequence
  MKO10128136_B_Zfp422
  gRNA
cagcccgccagcgacagaaa

SEQ ID NO: 128137 - RNA, 20 nt, Artificial Sequence
  MKO10128137_B_Zfp422
  gRNA
gcuucgagaaauacccccuu

SEQ ID NO: 128138 - RNA, 20 nt, Artificial Sequence
  MKO10128138_B_Zfp422
  gRNA
auuucucgaagcgccagcca

SEQ ID NO: 128139 - RNA, 20 nt, Artificial Sequence
  MKO10128139_B_Zfp423
  gRNA
acucuuaccgaucauguggu

SEQ ID NO: 128140 - RNA, 20 nt, Artificial Sequence
  MKO10128140_B_Zfp423
  gRNA
ucggaaaaccagccgugcgc

SEQ ID NO: 128141 - RNA, 20 nt, Artificial Sequence
  MKO10128141_B_Zfp423
  gRNA
ccaggccagcgagaaguccg

SEQ ID NO: 128142 - RNA, 20 nt, Artificial Sequence
  MKO10128142_B_Zfp426
  gRNA
cauauccaguagaaugcaaa

SEQ ID NO: 128143 - RNA, 20 nt, Artificial Sequence
  MKO10128143_B_Zfp426
  gRNA
ugauugccugacagaugauc

SEQ ID NO: 128144 - RNA, 20 nt, Artificial Sequence
  MKO10128144_B_Zfp426
  gRNA
gauuuaccugaucaucuguc

SEQ ID NO: 128145 - RNA, 20 nt, Artificial Sequence
  MKO10128145_B_Zfp428
  gRNA
gaugaugaagaccuuucccc

SEQ ID NO: 128146 - RNA, 20 nt, Artificial Sequence
  MKO10128146_B_Zfp428
  gRNA
cgaguuuccccagugcgaga

SEQ ID NO: 128147 - RNA, 20 nt, Artificial Sequence
  MKO10128147_B_Zfp428
  gRNA
gucauauucggggucaucag

SEQ ID NO: 128148 - RNA, 20 nt, Artificial Sequence
  MKO10128148_B_Zfp429
  gRNA
accuucuugucagagacaac

SEQ ID NO: 128149 - RNA, 20 nt, Artificial Sequence
  MKO10128149_B_Zfp429
  gRNA
uucaggaaauguuguccuuc

SEQ ID NO: 128150 - RNA, 20 nt, Artificial Sequence
  MKO10128150_B_Zfp429
  gRNA
aaugcucacccaggaacaca

SEQ ID NO: 128151 - RNA, 20 nt, Artificial Sequence
  MKO10128151_B_Zfp42
  gRNA
ccacaguacacaccgcccuc

SEQ ID NO: 128152 - RNA, 20 nt, Artificial Sequence
  MKO10128152_B_Zfp42
  gRNA
cuguggugucuuaucgaugc

SEQ ID NO: 128153 - RNA, 20 nt, Artificial Sequence
  MKO10128153_B_Zfp42
  gRNA
ggagcaaaaccuuucucgcc

SEQ ID NO: 128154 - RNA, 20 nt, Artificial Sequence
  MKO10128154_B_Zfp433
  gRNA
aaaguuauagaagacauaga

SEQ ID NO: 128155 - RNA, 20 nt, Artificial Sequence
  MKO10128155_B_Zfp433
  gRNA
uucuguguucuucuauacuu

SEQ ID NO: 128156 - RNA, 20 nt, Artificial Sequence
  MKO10128156_B_Zfp433
  gRNA
agguauaacaucugucauug

SEQ ID NO: 128157 - RNA, 20 nt, Artificial Sequence
  MKO10128157_B_Zfp438
  gRNA
gcaauuugacuucaucugcc

SEQ ID NO: 128158 - RNA, 20 nt, Artificial Sequence
  MKO10128158_B_Zfp438
  gRNA
acugucuuaccuugaucuuu

SEQ ID NO: 128159 - RNA, 20 nt, Artificial Sequence
  MKO10128159_B_Zfp438
  gRNA
ucaguaccaccaaaagauca

SEQ ID NO: 128160 - RNA, 20 nt, Artificial Sequence
  MKO10128160_B_Zfp442
  gRNA
gugcauaaaaaaacgcacac

SEQ ID NO: 128161 - RNA, 20 nt, Artificial Sequence
  MKO10128161_B_Zfp442
  gRNA
ugugcaugugaacuucacuc

SEQ ID NO: 128162 - RNA, 20 nt, Artificial Sequence
  MKO10128162_B_Zfp442
  gRNA
uauagcagcaagauuccugu

SEQ ID NO: 128163 - RNA, 20 nt, Artificial Sequence
  MKO10128163_B_Zfp444
  gRNA
cucauugcugacgacccauc

SEQ ID NO: 128164 - RNA, 20 nt, Artificial Sequence
  MKO10128164_B_Zfp444
  gRNA
cccugacgcucgacuccccg

SEQ ID NO: 128165 - RNA, 20 nt, Artificial Sequence
  MKO10128165_B_Zfp444
  gRNA
cgucagcaaugagggcaccu

SEQ ID NO: 128166 - RNA, 20 nt, Artificial Sequence
  MKO10128166_B_Zfp445
  gRNA
gaugcugaugcugcgccuga

SEQ ID NO: 128167 - RNA, 20 nt, Artificial Sequence
  MKO10128167_B_Zfp445
  gRNA
uuccaugugaagucuccaag

SEQ ID NO: 128168 - RNA, 20 nt, Artificial Sequence
  MKO10128168_B_Zfp445
  gRNA
ugacuauuuccaguuagaag

SEQ ID NO: 128169 - RNA, 20 nt, Artificial Sequence
  MKO10128169_B_Zfp446
  gRNA
cgaucuaucccggccuucag

SEQ ID NO: 128170 - RNA, 20 nt, Artificial Sequence
  MKO10128170_B_Zfp446
  gRNA
cgagggacaucuugaacauc

SEQ ID NO: 128171 - RNA, 20 nt, Artificial Sequence
  MKO10128171_B_Zfp446
  gRNA
accacugugucguacuucuc

SEQ ID NO: 128172 - RNA, 20 nt, Artificial Sequence
  MKO10128172_B_Zfp449
  gRNA
uguaaaggucagagcuacgc

SEQ ID NO: 128173 - RNA, 20 nt, Artificial Sequence
  MKO10128173_B_Zfp449
  gRNA
gcuugacaugaacuucccau

SEQ ID NO: 128174 - RNA, 20 nt, Artificial Sequence
  MKO10128174_B_Zfp449
  gRNA
uguuccuuagaacgcaucuu

SEQ ID NO: 128175 - RNA, 20 nt, Artificial Sequence
  MKO10128175_B_Zfp451
  gRNA
ugcuuuaacuuuggcucgcc

SEQ ID NO: 128176 - RNA, 20 nt, Artificial Sequence
  MKO10128176_B_Zfp451
  gRNA
agacuauauagaucaccaga

SEQ ID NO: 128177 - RNA, 20 nt, Artificial Sequence
  MKO10128177_B_Zfp451
  gRNA
uagaucaauguauuccaaaa

SEQ ID NO: 128178 - RNA, 20 nt, Artificial Sequence
  MKO10128178_B_Zfp454
  gRNA
ugagcuucacacgcagaucg

SEQ ID NO: 128179 - RNA, 20 nt, Artificial Sequence
  MKO10128179_B_Zfp454
  gRNA
ccuucacuagcaggucucuu

SEQ ID NO: 128180 - RNA, 20 nt, Artificial Sequence
  MKO10128180_B_Zfp454
  gRNA
aagcacggccacauccuuga

SEQ ID NO: 128181 - RNA, 20 nt, Artificial Sequence
  MKO10128181_B_Zfp455
  gRNA
cuacacaccuggguacacag

SEQ ID NO: 128182 - RNA, 20 nt, Artificial Sequence
  MKO10128182_B_Zfp455
  gRNA
aaugcucacccaggaacaca

SEQ ID NO: 128183 - RNA, 20 nt, Artificial Sequence
  MKO10128183_B_Zfp455
  gRNA
uucaggaaauguuguccuuc

SEQ ID NO: 128184 - RNA, 20 nt, Artificial Sequence
  MKO10128184_B_Zfp456
  gRNA
auugccuggagccugcucag

SEQ ID NO: 128185 - RNA, 20 nt, Artificial Sequence
  MKO10128185_B_Zfp456
  gRNA
ugcugucucuaagccauucc

SEQ ID NO: 128186 - RNA, 20 nt, Artificial Sequence
  MKO10128186_B_Zfp456
  gRNA
cuacauaccuggguacacag

SEQ ID NO: 128187 - RNA, 20 nt, Artificial Sequence
  MKO10128187_B_Zfp457
  gRNA
auugccaagguccugcucag

SEQ ID NO: 128188 - RNA, 20 nt, Artificial Sequence
  MKO10128188_B_Zfp457
  gRNA
cucaccugggugcacaguga

SEQ ID NO: 128189 - RNA, 20 nt, Artificial Sequence
  MKO10128189_B_Zfp457
  gRNA
ugcuucuucuaagccauacc

SEQ ID NO: 128190 - RNA, 20 nt, Artificial Sequence
  MKO10128190_B_Zfp458
  gRNA
aaugucuggguccugcucag

SEQ ID NO: 128191 - RNA, 20 nt, Artificial Sequence
  MKO10128191_B_Zfp458
  gRNA
uucaggacauguugucauuc

SEQ ID NO: 128192 - RNA, 20 nt, Artificial Sequence
  MKO10128192_B_Zfp458
  gRNA
ugcuucuucuaagccauacc

SEQ ID NO: 128193 - RNA, 20 nt, Artificial Sequence
  MKO10128193_B_Zfp459
  gRNA
cucuucugcagagaaaucaa

SEQ ID NO: 128194 - RNA, 20 nt, Artificial Sequence
  MKO10128194_B_Zfp459
  gRNA
ugcugacucuaagccacagc

SEQ ID NO: 128195 - RNA, 20 nt, Artificial Sequence
  MKO10128195_B_Zfp459
  gRNA
uccagaaaugucaccagcug

SEQ ID NO: 128196 - RNA, 20 nt, Artificial Sequence
  MKO10128196_B_Zfp462
  gRNA
cuacaaguguaaauucugcg

SEQ ID NO: 128197 - RNA, 20 nt, Artificial Sequence
  MKO10128197_B_Zfp462
  gRNA
ugucuucaaccggcuguugu

SEQ ID NO: 128198 - RNA, 20 nt, Artificial Sequence
  MKO10128198_B_Zfp462
  gRNA
cgccauaugcagacccauca

SEQ ID NO: 128199 - RNA, 20 nt, Artificial Sequence
  MKO10128199_B_Zfp467
  gRNA
acagccaacugacccaaguc

SEQ ID NO: 128200 - RNA, 20 nt, Artificial Sequence
  MKO10128200_B_Zfp467
  gRNA
ggcauuacugaacccauccc

SEQ ID NO: 128201 - RNA, 20 nt, Artificial Sequence
  MKO10128201_B_Zfp467
  gRNA
cccacucacccaaggaguuc

SEQ ID NO: 128202 - RNA, 20 nt, Artificial Sequence
  MKO10128202_B_Zfp46
  gRNA
auauggccauguaccucacu

SEQ ID NO: 128203 - RNA, 20 nt, Artificial Sequence
  MKO10128203_B_Zfp46
  gRNA
caagagaguucauaccgacu

SEQ ID NO: 128204 - RNA, 20 nt, Artificial Sequence
  MKO10128204_B_Zfp46
  gRNA
uccgcacugcacacauucgu

SEQ ID NO: 128205 - RNA, 20 nt, Artificial Sequence
  MKO10128205_B_Zfp472
  gRNA
uguuguuaccuauagagauc

SEQ ID NO: 128206 - RNA, 20 nt, Artificial Sequence
  MKO10128206_B_Zfp472
  gRNA
auuuaccucagguuucccuu

SEQ ID NO: 128207 - RNA, 20 nt, Artificial Sequence
  MKO10128207_B_Zfp472
  gRNA
guggcugugaacuucacucu

SEQ ID NO: 128208 - RNA, 20 nt, Artificial Sequence
  MKO10128208_B_Zfp473
  gRNA
cucccacuuaccaguacugg

SEQ ID NO: 128209 - RNA, 20 nt, Artificial Sequence
  MKO10128209_B_Zfp473
  gRNA
ucagcgucacaucccagaac

SEQ ID NO: 128210 - RNA, 20 nt, Artificial Sequence
  MKO10128210_B_Zfp473
  gRNA
acgaccuuaaaggagguugc

SEQ ID NO: 128211 - RNA, 20 nt, Artificial Sequence
  MKO10128211_B_Zfp474
  gRNA
ugcgccacuucuccaagcac

SEQ ID NO: 128212 - RNA, 20 nt, Artificial Sequence
  MKO10128212_B_Zfp474
  gRNA
uuccggauaugcuauauuug

SEQ ID NO: 128213 - RNA, 20 nt, Artificial Sequence
  MKO10128213_B_Zfp474
  gRNA
aacucccuagagagcugcgu

SEQ ID NO: 128214 - RNA, 20 nt, Artificial Sequence
  MKO10128214_B_Zfp488
  gRNA
caggucagcugucaggcgaa

SEQ ID NO: 128215 - RNA, 20 nt, Artificial Sequence
  MKO10128215_B_Zfp488
  gRNA
ccguuugccacgaguacuuc

SEQ ID NO: 128216 - RNA, 20 nt, Artificial Sequence
  MKO10128216_B_Zfp488
  gRNA
cuuucgccugacagcugacc

SEQ ID NO: 128217 - RNA, 20 nt, Artificial Sequence
  MKO10128217_B_Zfp493
  gRNA
ugcagaggagcgugaauguc

SEQ ID NO: 128218 - RNA, 20 nt, Artificial Sequence
  MKO10128218_B_Zfp493
  gRNA
gccugugucuucacauucca

SEQ ID NO: 128219 - RNA, 20 nt, Artificial Sequence
  MKO10128219_B_Zfp493
  gRNA
acugcugucauucagagaug

SEQ ID NO: 128220 - RNA, 20 nt, Artificial Sequence
  MKO10128220_B_Zfp503
  gRNA
cacgcccgucagccccaucg

SEQ ID NO: 128221 - RNA, 20 nt, Artificial Sequence
  MKO10128221_B_Zfp503
  gRNA
ggcggguaccccgucugccg

SEQ ID NO: 128222 - RNA, 20 nt, Artificial Sequence
  MKO10128222_B_Zfp503
  gRNA
cgccucgugcgcucaugauc

SEQ ID NO: 128223 - RNA, 20 nt, Artificial Sequence
  MKO10128223_B_Zfp507
  gRNA
caucacaccuauacuguuuc

SEQ ID NO: 128224 - RNA, 20 nt, Artificial Sequence
  MKO10128224_B_Zfp507
  gRNA
cuugcucguaguuguaguuc

SEQ ID NO: 128225 - RNA, 20 nt, Artificial Sequence
  MKO10128225_B_Zfp507
  gRNA
cucauucgaagcuacugaca

SEQ ID NO: 128226 - RNA, 20 nt, Artificial Sequence
  MKO10128226_B_Zfp511
  gRNA
aacagaugacagugacgcca

SEQ ID NO: 128227 - RNA, 20 nt, Artificial Sequence
  MKO10128227_B_Zfp511
  gRNA
cuucuauggcggcaaacacu

SEQ ID NO: 128228 - RNA, 20 nt, Artificial Sequence
  MKO10128228_B_Zfp511
  gRNA
uuugcuggauguccacaucc

SEQ ID NO: 128229 - RNA, 20 nt, Artificial Sequence
  MKO10128229_B_Zfp512
  gRNA
gaugucaggcgcaggugaaa

SEQ ID NO: 128230 - RNA, 20 nt, Artificial Sequence
  MKO10128230_B_Zfp512
  gRNA
uagggcccagugcuccauaa

SEQ ID NO: 128231 - RNA, 20 nt, Artificial Sequence
  MKO10128231_B_Zfp512
  gRNA
cuucuuagcucccacgaucc

SEQ ID NO: 128232 - RNA, 20 nt, Artificial Sequence
  MKO10128232_B_Zfp513
  gRNA
acgucauaugcugcgacaca

SEQ ID NO: 128233 - RNA, 20 nt, Artificial Sequence
  MKO10128233_B_Zfp513
  gRNA
acaaugccccgacgaucaga

SEQ ID NO: 128234 - RNA, 20 nt, Artificial Sequence
  MKO10128234_B_Zfp513
  gRNA
acugaagauuccuucgacga

SEQ ID NO: 128235 - RNA, 20 nt, Artificial Sequence
  MKO10128235_B_Zfp516
  gRNA
gcccaccuucgggcacacac

SEQ ID NO: 128236 - RNA, 20 nt, Artificial Sequence
  MKO10128236_B_Zfp516
  gRNA
gggagagaccauacuacccc

SEQ ID NO: 128237 - RNA, 20 nt, Artificial Sequence
  MKO10128237_B_Zfp516
  gRNA
ugguaccugugugugcccga

SEQ ID NO: 128238 - RNA, 20 nt, Artificial Sequence
  MKO10128238_B_Zfp518a
  gRNA
aguaguacuugcucccucgu

SEQ ID NO: 128239 - RNA, 20 nt, Artificial Sequence
  MKO10128239_B_Zfp518a
  gRNA
uuucucaccaguaacaccgu

SEQ ID NO: 128240 - RNA, 20 nt, Artificial Sequence
  MKO10128240_B_Zfp518a
  gRNA
aauacagcuuguuuaccguc

SEQ ID NO: 128241 - RNA, 20 nt, Artificial Sequence
  MKO10128241_B_Zfp518b
  gRNA
agggaugccgcugaccguua

SEQ ID NO: 128242 - RNA, 20 nt, Artificial Sequence
  MKO10128242_B_Zfp518b
  gRNA
guguccggcgguaccauaug

SEQ ID NO: 128243 - RNA, 20 nt, Artificial Sequence
  MKO10128243_B_Zfp518b
  gRNA
auguaccggaggccauuaaa

SEQ ID NO: 128244 - RNA, 20 nt, Artificial Sequence
  MKO10128244_B_Zfp51
  gRNA
uauaugaaagcaucacaagc

SEQ ID NO: 128245 - RNA, 20 nt, Artificial Sequence
  MKO10128245_B_Zfp51
  gRNA
gauggaggagacagucacua

SEQ ID NO: 128246 - RNA, 20 nt, Artificial Sequence
  MKO10128246_B_Zfp51
  gRNA
aaugccuggacucugaucag

SEQ ID NO: 128247 - RNA, 20 nt, Artificial Sequence
  MKO10128247_B_Zfp521
  gRNA
aaguuuggcgggggagucaa

SEQ ID NO: 128248 - RNA, 20 nt, Artificial Sequence
  MKO10128248_B_Zfp521
  gRNA
cuucgaagcugugcucuauc

SEQ ID NO: 128249 - RNA, 20 nt, Artificial Sequence
  MKO10128249_B_Zfp521
  gRNA
cauguggcaaaucacaugau

SEQ ID NO: 128250 - RNA, 20 nt, Artificial Sequence
  MKO10128250_B_Zfp523
  gRNA
gaccacugcguacauucacc

SEQ ID NO: 128251 - RNA, 20 nt, Artificial Sequence
  MKO10128251_B_Zfp523
  gRNA
caccuuucuguaucgucacc

SEQ ID NO: 128252 - RNA, 20 nt, Artificial Sequence
  MKO10128252_B_Zfp523
  gRNA
ggagaccgagcuuuccgcug

SEQ ID NO: 128253 - RNA, 20 nt, Artificial Sequence
  MKO10128253_B_Zfp524
  gRNA
ccgcaaucuuugcacacgug

SEQ ID NO: 128254 - RNA, 20 nt, Artificial Sequence
  MKO10128254_B_Zfp524
  gRNA
ucuucuguugaucgaugauc

SEQ ID NO: 128255 - RNA, 20 nt, Artificial Sequence
  MKO10128255_B_Zfp524
  gRNA
caaguggcuggaccguuuga

SEQ ID NO: 128256 - RNA, 20 nt, Artificial Sequence
  MKO10128256_B_Zfp526
  gRNA
gggggccgugcaccgcgcgc

SEQ ID NO: 128257 - RNA, 20 nt, Artificial Sequence
  MKO10128257_B_Zfp526
  gRNA
uggcaguaugggcccgucua

SEQ ID NO: 128258 - RNA, 20 nt, Artificial Sequence
  MKO10128258_B_Zfp526
  gRNA
ggcacgccacaaacaccgaa

SEQ ID NO: 128259 - RNA, 20 nt, Artificial Sequence
  MKO10128259_B_Zfp52
  gRNA
cugaccugggauguguuuac

SEQ ID NO: 128260 - RNA, 20 nt, Artificial Sequence
  MKO10128260_B_Zfp52
  gRNA
uggacuucucccaagaggaa

SEQ ID NO: 128261 - RNA, 20 nt, Artificial Sequence
  MKO10128261_B_Zfp52
  gRNA
gguagagaauuauagcaacc

SEQ ID NO: 128262 - RNA, 20 nt, Artificial Sequence
  MKO10128262_B_Zfp532
  gRNA
ucagcuugugcacgaugaag

SEQ ID NO: 128263 - RNA, 20 nt, Artificial Sequence
  MKO10128263_B_Zfp532
  gRNA
ugaagguccgccgggagucu

SEQ ID NO: 128264 - RNA, 20 nt, Artificial Sequence
  MKO10128264_B_Zfp532
  gRNA
agccgugggacguguagcac

SEQ ID NO: 128265 - RNA, 20 nt, Artificial Sequence
  MKO10128265_B_Zfp534
  gRNA
acagggucuguuaacuuuca

SEQ ID NO: 128266 - RNA, 20 nt, Artificial Sequence
  MKO10128266_B_Zfp534
  gRNA
uuccuccagugagaagucca

SEQ ID NO: 128267 - RNA, 20 nt, Artificial Sequence
  MKO10128267_B_Zfp534
  gRNA
cguggccuuggacuucucac

SEQ ID NO: 128268 - RNA, 20 nt, Artificial Sequence
  MKO10128268_B_Zfp536
  gRNA
cucgagaaugcacgaccacc

SEQ ID NO: 128269 - RNA, 20 nt, Artificial Sequence
  MKO10128269_B_Zfp536
  gRNA
augaaggacugcccguacug

SEQ ID NO: 128270 - RNA, 20 nt, Artificial Sequence
  MKO10128270_B_Zfp536
  gRNA
ccggacuucccaucaccuua

SEQ ID NO: 128271 - RNA, 20 nt, Artificial Sequence
  MKO10128271_B_Zfp53
  gRNA
cugaccugugacaugauuaa

SEQ ID NO: 128272 - RNA, 20 nt, Artificial Sequence
  MKO10128272_B_Zfp53
  gRNA
uggagcagaacaaagagacc

SEQ ID NO: 128273 - RNA, 20 nt, Artificial Sequence
  MKO10128273_B_Zfp53
  gRNA
uguggcuguggaauuccccc

SEQ ID NO: 128274 - RNA, 20 nt, Artificial Sequence
  MKO10128274_B_Zfp541
  gRNA
ccaggggccuuuaguagugc

SEQ ID NO: 128275 - RNA, 20 nt, Artificial Sequence
  MKO10128275_B_Zfp541
  gRNA
cuuucucgguguaaaacauc

SEQ ID NO: 128276 - RNA, 20 nt, Artificial Sequence
  MKO10128276_B_Zfp541
  gRNA
cuuugacuccauccagucug

SEQ ID NO: 128277 - RNA, 20 nt, Artificial Sequence
  MKO10128277_B_Zfp54
  gRNA
uucuucagucaacuuguccc

SEQ ID NO: 128278 - RNA, 20 nt, Artificial Sequence
  MKO10128278_B_Zfp54
  gRNA
uacagcaaccugguauaugu

SEQ ID NO: 128279 - RNA, 20 nt, Artificial Sequence
  MKO10128279_B_Zfp54
  gRNA
gccuucuaaagaauacauag

SEQ ID NO: 128280 - RNA, 20 nt, Artificial Sequence
  MKO10128280_B_Zfp551
  gRNA
aagcaaggaccaggucgccg

SEQ ID NO: 128281 - RNA, 20 nt, Artificial Sequence
  MKO10128281_B_Zfp551
  gRNA
agagugggugcuccuugaua

SEQ ID NO: 128282 - RNA, 20 nt, Artificial Sequence
  MKO10128282_B_Zfp551
  gRNA
accaggccaagcuccauaac

SEQ ID NO: 128283 - RNA, 20 nt, Artificial Sequence
  MKO10128283_B_Zfp553
  gRNA
gccacacucgccacagaucg

SEQ ID NO: 128284 - RNA, 20 nt, Artificial Sequence
  MKO10128284_B_Zfp553
  gRNA
ggccuacaggguccggccac

SEQ ID NO: 128285 - RNA, 20 nt, Artificial Sequence
  MKO10128285_B_Zfp553
  gRNA
ccagcaggaauccgagaucg

SEQ ID NO: 128286 - RNA, 20 nt, Artificial Sequence
  MKO10128286_B_Zfp558
  gRNA
uggaaaaacaguacaacugg

SEQ ID NO: 128287 - RNA, 20 nt, Artificial Sequence
  MKO10128287_B_Zfp558
  gRNA
ugcuuaccuggauggaugcc

SEQ ID NO: 128288 - RNA, 20 nt, Artificial Sequence
  MKO10128288_B_Zfp558
  gRNA
guucuugacaaguuuguuag

SEQ ID NO: 128289 - RNA, 20 nt, Artificial Sequence
  MKO10128289_B_Zfp560
  gRNA
gaaucucaccuaauguagcc

SEQ ID NO: 128290 - RNA, 20 nt, Artificial Sequence
  MKO10128290_B_Zfp560
  gRNA
gcuauacaacuuaaccccag

SEQ ID NO: 128291 - RNA, 20 nt, Artificial Sequence
  MKO10128291_B_Zfp560
  gRNA
gucaagaaaagaguucacca

SEQ ID NO: 128292 - RNA, 20 nt, Artificial Sequence
  MKO10128292_B_Zfp563
  gRNA
uaucguuaccuauagcaauu

SEQ ID NO: 128293 - RNA, 20 nt, Artificial Sequence
  MKO10128293_B_Zfp563
  gRNA
aagauguugaugaagauucu

SEQ ID NO: 128294 - RNA, 20 nt, Artificial Sequence
  MKO10128294_B_Zfp563
  gRNA
caucaacaucuuuacuccuc

SEQ ID NO: 128295 - RNA, 20 nt, Artificial Sequence
  MKO10128295_B_Zfp566
  gRNA
cauccuuacccauugagagc

SEQ ID NO: 128296 - RNA, 20 nt, Artificial Sequence
  MKO10128296_B_Zfp566
  gRNA
uaagaaagccuacgaagaug

SEQ ID NO: 128297 - RNA, 20 nt, Artificial Sequence
  MKO10128297_B_Zfp566
  gRNA
gaauucugugaugccguguc

SEQ ID NO: 128298 - RNA, 20 nt, Artificial Sequence
  MKO10128298_B_Zfp568
  gRNA
cauggagcgcuugucccaga

SEQ ID NO: 128299 - RNA, 20 nt, Artificial Sequence
  MKO10128299_B_Zfp568
  gRNA
cucgccaggaagaagaagac

SEQ ID NO: 128300 - RNA, 20 nt, Artificial Sequence
  MKO10128300_B_Zfp568
  gRNA
uccaacuugaagaucacauc

SEQ ID NO: 128301 - RNA, 20 nt, Artificial Sequence
  MKO10128301_B_Zfp574
  gRNA
uccccugcggucucgcccaa

SEQ ID NO: 128302 - RNA, 20 nt, Artificial Sequence
  MKO10128302_B_Zfp574
  gRNA
gaaaacggacuccgcacucc

SEQ ID NO: 128303 - RNA, 20 nt, Artificial Sequence
  MKO10128303_B_Zfp574
  gRNA
cccguuccuucuugcuacgc

SEQ ID NO: 128304 - RNA, 20 nt, Artificial Sequence
  MKO10128304_B_Zfp575
  gRNA
ggguggaagcgugaaguccg

SEQ ID NO: 128305 - RNA, 20 nt, Artificial Sequence
  MKO10128305_B_Zfp575
  gRNA
cgucgguggcguggugcgug

SEQ ID NO: 128306 - RNA, 20 nt, Artificial Sequence
  MKO10128306_B_Zfp575
  gRNA
aacgguggccgaaggccuug

SEQ ID NO: 128307 - RNA, 20 nt, Artificial Sequence
  MKO10128307_B_Zfp579
  gRNA
uucagugcgugcgcugccag

SEQ ID NO: 128308 - RNA, 20 nt, Artificial Sequence
  MKO10128308_B_Zfp579
  gRNA
gcacugaaaagggcgcgccc

SEQ ID NO: 128309 - RNA, 20 nt, Artificial Sequence
  MKO10128309_B_Zfp579
  gRNA
gggaguggaacagcccgcca

SEQ ID NO: 128310 - RNA, 20 nt, Artificial Sequence
  MKO10128310_B_Zfp57
  gRNA
cguggcagugucuuucaccc

SEQ ID NO: 128311 - RNA, 20 nt, Artificial Sequence
  MKO10128311_B_Zfp57
  gRNA
auuaccaaacaauggcagcu

SEQ ID NO: 128312 - RNA, 20 nt, Artificial Sequence
  MKO10128312_B_Zfp57
  gRNA
ucuucaugaacccguggugc

SEQ ID NO: 128313 - RNA, 20 nt, Artificial Sequence
  MKO10128313_B_Zfp580
  gRNA
cuacacguacacggugcagc

SEQ ID NO: 128314 - RNA, 20 nt, Artificial Sequence
  MKO10128314_B_Zfp580
  gRNA
cuauagcccuugcgaggacc

SEQ ID NO: 128315 - RNA, 20 nt, Artificial Sequence
  MKO10128315_B_Zfp580
  gRNA
cagcugcaccguguacgugu

SEQ ID NO: 128316 - RNA, 20 nt, Artificial Sequence
  MKO10128316_B_Zfp583
  gRNA
cugccuuacccagugacacc

SEQ ID NO: 128317 - RNA, 20 nt, Artificial Sequence
  MKO10128317_B_Zfp583
  gRNA
ggagcaagagacacaugucc

SEQ ID NO: 128318 - RNA, 20 nt, Artificial Sequence
  MKO10128318_B_Zfp583
  gRNA
auuggagaacuauaagagcc

SEQ ID NO: 128319 - RNA, 20 nt, Artificial Sequence
  MKO10128319_B_Zfp58
  gRNA
gcagcagccgcugugcaccc

SEQ ID NO: 128320 - RNA, 20 nt, Artificial Sequence
  MKO10128320_B_Zfp58
  gRNA
ccucacccaggaaauccaga

SEQ ID NO: 128321 - RNA, 20 nt, Artificial Sequence
  MKO10128321_B_Zfp58
  gRNA
gcuggagaauuacagccauc

SEQ ID NO: 128322 - RNA, 20 nt, Artificial Sequence
  MKO10128322_B_Zfp592
  gRNA
caagacugccaguaguacga

SEQ ID NO: 128323 - RNA, 20 nt, Artificial Sequence
  MKO10128323_B_Zfp592
  gRNA
cguacuacuggcagucuuga

SEQ ID NO: 128324 - RNA, 20 nt, Artificial Sequence
  MKO10128324_B_Zfp592
  gRNA
ccugcacuaugcccgaaaag

SEQ ID NO: 128325 - RNA, 20 nt, Artificial Sequence
  MKO10128325_B_Zfp593
  gRNA
uggaucggaaaugggucuuc

SEQ ID NO: 128326 - RNA, 20 nt, Artificial Sequence
  MKO10128326_B_Zfp593
  gRNA
cagguggacguguccaucuc

SEQ ID NO: 128327 - RNA, 20 nt, Artificial Sequence
  MKO10128327_B_Zfp593
  gRNA
gauccaaagaccacaagaaa

SEQ ID NO: 128328 - RNA, 20 nt, Artificial Sequence
  MKO10128328_B_Zfp595
  gRNA
uccagaaaugugacuagaua

SEQ ID NO: 128329 - RNA, 20 nt, Artificial Sequence
  MKO10128329_B_Zfp595
  gRNA
ggcuauguauuucucugcag

SEQ ID NO: 128330 - RNA, 20 nt, Artificial Sequence
  MKO10128330_B_Zfp595
  gRNA
aauguacagagaugugaugc

SEQ ID NO: 128331 - RNA, 20 nt, Artificial Sequence
  MKO10128331_B_Zfp597
  gRNA
ggcguccacgcuccccacau

SEQ ID NO: 128332 - RNA, 20 nt, Artificial Sequence
  MKO10128332_B_Zfp597
  gRNA
accacugcuauuugaagauc

SEQ ID NO: 128333 - RNA, 20 nt, Artificial Sequence
  MKO10128333_B_Zfp597
  gRNA
cugcugagggucuucugagc

SEQ ID NO: 128334 - RNA, 20 nt, Artificial Sequence
  MKO10128334_B_Zfp598
  gRNA
ucacuccggcgugagugccg

SEQ ID NO: 128335 - RNA, 20 nt, Artificial Sequence
  MKO10128335_B_Zfp598
  gRNA
gcugcuccaaguccccgaag

SEQ ID NO: 128336 - RNA, 20 nt, Artificial Sequence
  MKO10128336_B_Zfp598
  gRNA
aggauaccuugaggugcuug

SEQ ID NO: 128337 - RNA, 20 nt, Artificial Sequence
  MKO10128337_B_Zfp599
  gRNA
cagacucaccuagggacacc

SEQ ID NO: 128338 - RNA, 20 nt, Artificial Sequence
  MKO10128338_B_Zfp599
  gRNA
gugucgcagaagccucagac

SEQ ID NO: 128339 - RNA, 20 nt, Artificial Sequence
  MKO10128339_B_Zfp599
  gRNA
gaccagccagaaaaaucaca

SEQ ID NO: 128340 - RNA, 20 nt, Artificial Sequence
  MKO10128340_B_Zfp59
  gRNA
auggcugugaaugaagaaac

SEQ ID NO: 128341 - RNA, 20 nt, Artificial Sequence
  MKO10128341_B_Zfp59
  gRNA
cagcacuaauucucaagaca

SEQ ID NO: 128342 - RNA, 20 nt, Artificial Sequence
  MKO10128342_B_Zfp59
  gRNA
uucuucauucacagccaucc

SEQ ID NO: 128343 - RNA, 20 nt, Artificial Sequence
  MKO10128343_B_Zfp600
  gRNA
uuugcuccucaccaagaauc

SEQ ID NO: 128344 - RNA, 20 nt, Artificial Sequence
  MKO10128344_B_Zfp600
  gRNA
guccaaaaacacguccuuga

SEQ ID NO: 128345 - RNA, 20 nt, Artificial Sequence
  MKO10128345_B_Zfp600
  gRNA
acagugucuauuaaccuuca

SEQ ID NO: 128346 - RNA, 20 nt, Artificial Sequence
  MKO10128346_B_Zfp605
  gRNA
agcuagaucagcaagaguca

SEQ ID NO: 128347 - RNA, 20 nt, Artificial Sequence
  MKO10128347_B_Zfp605
  gRNA
agcggaagaugacagaauca

SEQ ID NO: 128348 - RNA, 20 nt, Artificial Sequence
  MKO10128348_B_Zfp605
  gRNA
cugcagcagccuugucuucu

SEQ ID NO: 128349 - RNA, 20 nt, Artificial Sequence
  MKO10128349_B_Zfp606
  gRNA
uauccuaaaagcaguugucc

SEQ ID NO: 128350 - RNA, 20 nt, Artificial Sequence
  MKO10128350_B_Zfp606
  gRNA
uauccuugcuccacugacca

SEQ ID NO: 128351 - RNA, 20 nt, Artificial Sequence
  MKO10128351_B_Zfp606
  gRNA
ucaccuuacccacagaaagu

SEQ ID NO: 128352 - RNA, 20 nt, Artificial Sequence
  MKO10128352_B_Zfp607
  gRNA
cagcuccaguucucaacaca

SEQ ID NO: 128353 - RNA, 20 nt, Artificial Sequence
  MKO10128353_B_Zfp607
  gRNA
caggcuuacccacugcgacc

SEQ ID NO: 128354 - RNA, 20 nt, Artificial Sequence
  MKO10128354_B_Zfp607
  gRNA
uucaggggucagugacauuu

SEQ ID NO: 128355 - RNA, 20 nt, Artificial Sequence
  MKO10128355_B_Zfp608
  gRNA
uagacugcaccaagcacgac

SEQ ID NO: 128356 - RNA, 20 nt, Artificial Sequence
  MKO10128356_B_Zfp608
  gRNA
cgaaccaaaagcuguucgac

SEQ ID NO: 128357 - RNA, 20 nt, Artificial Sequence
  MKO10128357_B_Zfp608
  gRNA
auggaggaacaaaaccuacg

SEQ ID NO: 128358 - RNA, 20 nt, Artificial Sequence
  MKO10128358_B_Zfp609
  gRNA
ggaaccagcgucaaccuuga

SEQ ID NO: 128359 - RNA, 20 nt, Artificial Sequence
  MKO10128359_B_Zfp609
  gRNA
cugcaagcuacccccaucug

SEQ ID NO: 128360 - RNA, 20 nt, Artificial Sequence
  MKO10128360_B_Zfp609
  gRNA
ccugccacacgaugccuuca

SEQ ID NO: 128361 - RNA, 20 nt, Artificial Sequence
  MKO10128361_B_Zfp60
  gRNA
caacucuaguucucaacaca

SEQ ID NO: 128362 - RNA, 20 nt, Artificial Sequence
  MKO10128362_B_Zfp60
  gRNA
auggcugugaagaaagaaac

SEQ ID NO: 128363 - RNA, 20 nt, Artificial Sequence
  MKO10128363_B_Zfp60
  gRNA
uucuuucuucacagccaucc

SEQ ID NO: 128364 - RNA, 20 nt, Artificial Sequence
  MKO10128364_B_Zfp612
  gRNA
acagaccaucccauuccguc

SEQ ID NO: 128365 - RNA, 20 nt, Artificial Sequence
  MKO10128365_B_Zfp612
  gRNA
gacagcagccaugaucccau

SEQ ID NO: 128366 - RNA, 20 nt, Artificial Sequence
  MKO10128366_B_Zfp612
  gRNA
gaacggacucccagggccuc

SEQ ID NO: 128367 - RNA, 20 nt, Artificial Sequence
  MKO10128367_B_Zfp616
  gRNA
gaagcauuuaucaaguagua

SEQ ID NO: 128368 - RNA, 20 nt, Artificial Sequence
  MKO10128368_B_Zfp616
  gRNA
uucaagaccuuauuauaccc

SEQ ID NO: 128369 - RNA, 20 nt, Artificial Sequence
  MKO10128369_B_Zfp616
  gRNA
caacacgauucaaaccauaa

SEQ ID NO: 128370 - RNA, 20 nt, Artificial Sequence
  MKO10128370_B_Zfp617
  gRNA
cucccauaccuauaucaugc

SEQ ID NO: 128371 - RNA, 20 nt, Artificial Sequence
  MKO10128371_B_Zfp617
  gRNA
gaaaaugcauacaaaaaucc

SEQ ID NO: 128372 - RNA, 20 nt, Artificial Sequence
  MKO10128372_B_Zfp617
  gRNA
uguggcugugaacuucaccc

SEQ ID NO: 128373 - RNA, 20 nt, Artificial Sequence
  MKO10128373_B_Zfp618
  gRNA
accuccuguauguagucguc

SEQ ID NO: 128374 - RNA, 20 nt, Artificial Sequence
  MKO10128374_B_Zfp618
  gRNA
guggacggagccagugcacc

SEQ ID NO: 128375 - RNA, 20 nt, Artificial Sequence
  MKO10128375_B_Zfp618
  gRNA
acagauacugaagccaccuc

SEQ ID NO: 128376 - RNA, 20 nt, Artificial Sequence
  MKO10128376_B_Zfp619
  gRNA
ccuauacauuaaugugaugc

SEQ ID NO: 128377 - RNA, 20 nt, Artificial Sequence
  MKO10128377_B_Zfp619
  gRNA
cuguuuauacuggucuucaa

SEQ ID NO: 128378 - RNA, 20 nt, Artificial Sequence
  MKO10128378_B_Zfp619
  gRNA
gaagaccaguauaaacagcc

SEQ ID NO: 128379 - RNA, 20 nt, Artificial Sequence
  MKO10128379_B_Zfp61
  gRNA
gccccgagggagagagauuc

SEQ ID NO: 128380 - RNA, 20 nt, Artificial Sequence
  MKO10128380_B_Zfp61
  gRNA
caaacgagauaaaccauacc

SEQ ID NO: 128381 - RNA, 20 nt, Artificial Sequence
  MKO10128381_B_Zfp61
  gRNA
aauucucaaccaucacaucu

SEQ ID NO: 128382 - RNA, 20 nt, Artificial Sequence
  MKO10128382_B_Zfp622
  gRNA
ucuccagcaauaccgagccc

SEQ ID NO: 128383 - RNA, 20 nt, Artificial Sequence
  MKO10128383_B_Zfp622
  gRNA
gaguagcuacccagacuaca

SEQ ID NO: 128384 - RNA, 20 nt, Artificial Sequence
  MKO10128384_B_Zfp622
  gRNA
gcaggauccugcugagcuug

SEQ ID NO: 128385 - RNA, 20 nt, Artificial Sequence
  MKO10128385_B_Zfp623
  gRNA
uccgcaucagaucucgcaca

SEQ ID NO: 128386 - RNA, 20 nt, Artificial Sequence
  MKO10128386_B_Zfp623
  gRNA
ucuacagaucgggaguguug

SEQ ID NO: 128387 - RNA, 20 nt, Artificial Sequence
  MKO10128387_B_Zfp623
  gRNA
gaguuucgagcuccgaauaa

SEQ ID NO: 128388 - RNA, 20 nt, Artificial Sequence
  MKO10128388_B_Zfp628
  gRNA
gccgcaggcacgaaguguua

SEQ ID NO: 128389 - RNA, 20 nt, Artificial Sequence
  MKO10128389_B_Zfp628
  gRNA
ucgcacagacguccaacuug

SEQ ID NO: 128390 - RNA, 20 nt, Artificial Sequence
  MKO10128390_B_Zfp628
  gRNA
gcucaccuguguggucccga

SEQ ID NO: 128391 - RNA, 20 nt, Artificial Sequence
  MKO10128391_B_Zfp629
  gRNA
caccucuaugagccucauuc

SEQ ID NO: 128392 - RNA, 20 nt, Artificial Sequence
  MKO10128392_B_Zfp629
  gRNA
guguaagagcuagucgaucg

SEQ ID NO: 128393 - RNA, 20 nt, Artificial Sequence
  MKO10128393_B_Zfp629
  gRNA
cgcagucggagcacacgaag

SEQ ID NO: 128394 - RNA, 20 nt, Artificial Sequence
  MKO10128394_B_Zfp62
  gRNA
uucuuaucagcaauaugagc

SEQ ID NO: 128395 - RNA, 20 nt, Artificial Sequence
  MKO10128395_B_Zfp62
  gRNA
ccucauaguagaucaucuuc

SEQ ID NO: 128396 - RNA, 20 nt, Artificial Sequence
  MKO10128396_B_Zfp62
  gRNA
ucaccuuguuuaguacaauu

SEQ ID NO: 128397 - RNA, 20 nt, Artificial Sequence
  MKO10128397_B_Zfp637
  gRNA
guucccaacagcuacccugc

SEQ ID NO: 128398 - RNA, 20 nt, Artificial Sequence
  MKO10128398_B_Zfp637
  gRNA
ggauccgcugauguguaacc

SEQ ID NO: 128399 - RNA, 20 nt, Artificial Sequence
  MKO10128399_B_Zfp637
  gRNA
ugugcacauccgcguccaca

SEQ ID NO: 128400 - RNA, 20 nt, Artificial Sequence
  MKO10128400_B_Zfp639
  gRNA
uuacacccuucucgcuauuc

SEQ ID NO: 128401 - RNA, 20 nt, Artificial Sequence
  MKO10128401_B_Zfp639
  gRNA
gacuugcccaaauuugcaga

SEQ ID NO: 128402 - RNA, 20 nt, Artificial Sequence
  MKO10128402_B_Zfp639
  gRNA
ggaauaagcagaauugcaga

SEQ ID NO: 128403 - RNA, 20 nt, Artificial Sequence
  MKO10128403_B_Zfp641
  gRNA
acuucuugcagccggauccc

SEQ ID NO: 128404 - RNA, 20 nt, Artificial Sequence
  MKO10128404_B_Zfp641
  gRNA
ggcacgcagugcugagccgc

SEQ ID NO: 128405 - RNA, 20 nt, Artificial Sequence
  MKO10128405_B_Zfp641
  gRNA
ucagggccuaguaacuauca

SEQ ID NO: 128406 - RNA, 20 nt, Artificial Sequence
  MKO10128406_B_Zfp644
  gRNA
caguucauugacucgaucug

SEQ ID NO: 128407 - RNA, 20 nt, Artificial Sequence
  MKO10128407_B_Zfp644
  gRNA
ggcgacuguugagcgccuuc

SEQ ID NO: 128408 - RNA, 20 nt, Artificial Sequence
  MKO10128408_B_Zfp644
  gRNA
caucauucugaucguaacuc

SEQ ID NO: 128409 - RNA, 20 nt, Artificial Sequence
  MKO10128409_B_Zfp646
  gRNA
uuccgaaccccucaccccag

SEQ ID NO: 128410 - RNA, 20 nt, Artificial Sequence
  MKO10128410_B_Zfp646
  gRNA
gugcccgccgucaguuccga

SEQ ID NO: 128411 - RNA, 20 nt, Artificial Sequence
  MKO10128411_B_Zfp646
  gRNA
ccuugcaauguacccgcaca

SEQ ID NO: 128412 - RNA, 20 nt, Artificial Sequence
  MKO10128412_B_Zfp647
  gRNA
ccaucaugacgugucgguag

SEQ ID NO: 128413 - RNA, 20 nt, Artificial Sequence
  MKO10128413_B_Zfp647
  gRNA
gccuguugugaucucccagc

SEQ ID NO: 128414 - RNA, 20 nt, Artificial Sequence
  MKO10128414_B_Zfp647
  gRNA
aucacaacaggcuuagaucc

SEQ ID NO: 128415 - RNA, 20 nt, Artificial Sequence
  MKO10128415_B_Zfp648
  gRNA
cugagugucaaacugcgagu

SEQ ID NO: 128416 - RNA, 20 nt, Artificial Sequence
  MKO10128416_B_Zfp648
  gRNA
cacggagaacucgcggccgc

SEQ ID NO: 128417 - RNA, 20 nt, Artificial Sequence
  MKO10128417_B_Zfp648
  gRNA
ucgagacucccccaaauuac

SEQ ID NO: 128418 - RNA, 20 nt, Artificial Sequence
  MKO10128418_B_Zfp64
  gRNA
ccauguucaaagacgaacuc

SEQ ID NO: 128419 - RNA, 20 nt, Artificial Sequence
  MKO10128419_B_Zfp64
  gRNA
ccagaguucgucuuugaaca

SEQ ID NO: 128420 - RNA, 20 nt, Artificial Sequence
  MKO10128420_B_Zfp64
  gRNA
ugccaguucaagaccgccua

SEQ ID NO: 128421 - RNA, 20 nt, Artificial Sequence
  MKO10128421_B_Zfp651
  gRNA
uccacucgcugcagcacucg

SEQ ID NO: 128422 - RNA, 20 nt, Artificial Sequence
  MKO10128422_B_Zfp651
  gRNA
cagcgacauacugcgcuuga

SEQ ID NO: 128423 - RNA, 20 nt, Artificial Sequence
  MKO10128423_B_Zfp651
  gRNA
gagcacaacaagauagugca

SEQ ID NO: 128424 - RNA, 20 nt, Artificial Sequence
  MKO10128424_B_Zfp652
  gRNA
ccucuucauguugggucggc

SEQ ID NO: 128425 - RNA, 20 nt, Artificial Sequence
  MKO10128425_B_Zfp652
  gRNA
cuucuucucgcaaauuucac

SEQ ID NO: 128426 - RNA, 20 nt, Artificial Sequence
  MKO10128426_B_Zfp652
  gRNA
ugcucaugugggagcggagc

SEQ ID NO: 128427 - RNA, 20 nt, Artificial Sequence
  MKO10128427_B_Zfp653
  gRNA
accagaugaccacguucuuc

SEQ ID NO: 128428 - RNA, 20 nt, Artificial Sequence
  MKO10128428_B_Zfp653
  gRNA
ucuccuccuugagcauauac

SEQ ID NO: 128429 - RNA, 20 nt, Artificial Sequence
  MKO10128429_B_Zfp653
  gRNA
ggaggaccuguauaugcuca

SEQ ID NO: 128430 - RNA, 20 nt, Artificial Sequence
  MKO10128430_B_Zfp654
  gRNA
uacuaagguaucguucauca

SEQ ID NO: 128431 - RNA, 20 nt, Artificial Sequence
  MKO10128431_B_Zfp654
  gRNA
ucggugcauguuaugcaaca

SEQ ID NO: 128432 - RNA, 20 nt, Artificial Sequence
  MKO10128432_B_Zfp654
  gRNA
gagaauccucaaacugccuu

SEQ ID NO: 128433 - RNA, 20 nt, Artificial Sequence
  MKO10128433_B_Zfp655
  gRNA
cauucagacugguucuccaa

SEQ ID NO: 128434 - RNA, 20 nt, Artificial Sequence
  MKO10128434_B_Zfp655
  gRNA
uccugcagaaaccgaagcuc

SEQ ID NO: 128435 - RNA, 20 nt, Artificial Sequence
  MKO10128435_B_Zfp655
  gRNA
cgggagugcucaucccagca

SEQ ID NO: 128436 - RNA, 20 nt, Artificial Sequence
  MKO10128436_B_Zfp658
  gRNA
ccaagcucccacauccuugu

SEQ ID NO: 128437 - RNA, 20 nt, Artificial Sequence
  MKO10128437_B_Zfp658
  gRNA
ugacaugaaauugucccaga

SEQ ID NO: 128438 - RNA, 20 nt, Artificial Sequence
  MKO10128438_B_Zfp658
  gRNA
ggugucucuggacggagucc

SEQ ID NO: 128439 - RNA, 20 nt, Artificial Sequence
  MKO10128439_B_Zfp65
  gRNA
ugaaugaaucuguuuauguc

SEQ ID NO: 128440 - RNA, 20 nt, Artificial Sequence
  MKO10128440_B_Zfp65
  gRNA
aaugccuagguccugcucag

SEQ ID NO: 128441 - RNA, 20 nt, Artificial Sequence
  MKO10128441_B_Zfp65
  gRNA
cuguacaaauuccacugagc

SEQ ID NO: 128442 - RNA, 20 nt, Artificial Sequence
  MKO10128442_B_Zfp661
  gRNA
gucuccgccuaccagauguc

SEQ ID NO: 128443 - RNA, 20 nt, Artificial Sequence
  MKO10128443_B_Zfp661
  gRNA
caccucaccugacaucuggu

SEQ ID NO: 128444 - RNA, 20 nt, Artificial Sequence
  MKO10128444_B_Zfp661
  gRNA
uugaacugaagaaucacauc

SEQ ID NO: 128445 - RNA, 20 nt, Artificial Sequence
  MKO10128445_B_Zfp663
  gRNA
ggggcuuacccacugcucgu

SEQ ID NO: 128446 - RNA, 20 nt, Artificial Sequence
  MKO10128446_B_Zfp663
  gRNA
accugagcugauaugcaagc

SEQ ID NO: 128447 - RNA, 20 nt, Artificial Sequence
  MKO10128447_B_Zfp663
  gRNA
uccagcuugcauaucagcuc

SEQ ID NO: 128448 - RNA, 20 nt, Artificial Sequence
  MKO10128448_B_Zfp664
  gRNA
ggacucuuugaugcaugcag

SEQ ID NO: 128449 - RNA, 20 nt, Artificial Sequence
  MKO10128449_B_Zfp664
  gRNA
ccccaguguggacucucaug

SEQ ID NO: 128450 - RNA, 20 nt, Artificial Sequence
  MKO10128450_B_Zfp664
  gRNA
ccgcacucacugcagacgua

SEQ ID NO: 128451 - RNA, 20 nt, Artificial Sequence
  MKO10128451_B_Zfp667
  gRNA
caugcagaaagauuuguacg

SEQ ID NO: 128452 - RNA, 20 nt, Artificial Sequence
  MKO10128452_B_Zfp667
  gRNA
gccaaauaucaucgccuugu

SEQ ID NO: 128453 - RNA, 20 nt, Artificial Sequence
  MKO10128453_B_Zfp667
  gRNA
cucguacaaaucuuucugca

SEQ ID NO: 128454 - RNA, 20 nt, Artificial Sequence
  MKO10128454_B_Zfp668
  gRNA
caugggugcgccgaugcuug

SEQ ID NO: 128455 - RNA, 20 nt, Artificial Sequence
  MKO10128455_B_Zfp668
  gRNA
cacucgcgacacacaaacug

SEQ ID NO: 128456 - RNA, 20 nt, Artificial Sequence
  MKO10128456_B_Zfp668
  gRNA
gguaacccuaacagccccgc

SEQ ID NO: 128457 - RNA, 20 nt, Artificial Sequence
  MKO10128457_B_Zfp672
  gRNA
cgugcggccuuucacccuga

SEQ ID NO: 128458 - RNA, 20 nt, Artificial Sequence
  MKO10128458_B_Zfp672
  gRNA
cagcagaccuacgugcacac

SEQ ID NO: 128459 - RNA, 20 nt, Artificial Sequence
  MKO10128459_B_Zfp672
  gRNA
uacaccugggaacgcaccga

SEQ ID NO: 128460 - RNA, 20 nt, Artificial Sequence
  MKO10128460_B_Zfp677
  gRNA
caagaaaugacagauucucc

SEQ ID NO: 128461 - RNA, 20 nt, Artificial Sequence
  MKO10128461_B_Zfp677
  gRNA
ucuguuggcauucaaagaug

SEQ ID NO: 128462 - RNA, 20 nt, Artificial Sequence
  MKO10128462_B_Zfp677
  gRNA
uuacaacaaccuggucucug

SEQ ID NO: 128463 - RNA, 20 nt, Artificial Sequence
  MKO10128463_B_Zfp687
  gRNA
cucgauucuuaugugugcgc

SEQ ID NO: 128464 - RNA, 20 nt, Artificial Sequence
  MKO10128464_B_Zfp687
  gRNA
acuuaaagacacugacacgc

SEQ ID NO: 128465 - RNA, 20 nt, Artificial Sequence
  MKO10128465_B_Zfp687
  gRNA
uaagugcuggucaaagugug

SEQ ID NO: 128466 - RNA, 20 nt, Artificial Sequence
  MKO10128466_B_Zfp688
  gRNA
gccgcggcgacccccugagc

SEQ ID NO: 128467 - RNA, 20 nt, Artificial Sequence
  MKO10128467_B_Zfp688
  gRNA
ccuguuccauccaagagaug

SEQ ID NO: 128468 - RNA, 20 nt, Artificial Sequence
  MKO10128468_B_Zfp688
  gRNA
caccucucggagcuccuccc

SEQ ID NO: 128469 - RNA, 20 nt, Artificial Sequence
  MKO10128469_B_Zfp689
  gRNA
ggccacguccacgaacuuca

SEQ ID NO: 128470 - RNA, 20 nt, Artificial Sequence
  MKO10128470_B_Zfp689
  gRNA
aggcuggaccuacucggaaa

SEQ ID NO: 128471 - RNA, 20 nt, Artificial Sequence
  MKO10128471_B_Zfp689
  gRNA
accagcagcccuagauccgc

SEQ ID NO: 128472 - RNA, 20 nt, Artificial Sequence
  MKO10128472_B_Zfp68
  gRNA
agggcacugcaaaaccaaac

SEQ ID NO: 128473 - RNA, 20 nt, Artificial Sequence
  MKO10128473_B_Zfp68
  gRNA
cuacagcaacuugcuguucu

SEQ ID NO: 128474 - RNA, 20 nt, Artificial Sequence
  MKO10128474_B_Zfp68
  gRNA
acucaccauuucuggcuucc

SEQ ID NO: 128475 - RNA, 20 nt, Artificial Sequence
  MKO10128475_B_Zfp691
  gRNA
ccggugauguacagccagcg

SEQ ID NO: 128476 - RNA, 20 nt, Artificial Sequence
  MKO10128476_B_Zfp691
  gRNA
ccagguggaugcgcucgugc

SEQ ID NO: 128477 - RNA, 20 nt, Artificial Sequence
  MKO10128477_B_Zfp691
  gRNA
ucccgaagcucaccugcccg

SEQ ID NO: 128478 - RNA, 20 nt, Artificial Sequence
  MKO10128478_B_Zfp692
  gRNA
ugcucagugacgccagccca

SEQ ID NO: 128479 - RNA, 20 nt, Artificial Sequence
  MKO10128479_B_Zfp692
  gRNA
cccaacuggcucaucugggg

SEQ ID NO: 128480 - RNA, 20 nt, Artificial Sequence
  MKO10128480_B_Zfp692
  gRNA
uggaaugugagcagcgagaa

SEQ ID NO: 128481 - RNA, 20 nt, Artificial Sequence
  MKO10128481_B_Zfp697
  gRNA
uaagaggggacucacgagag

SEQ ID NO: 128482 - RNA, 20 nt, Artificial Sequence
  MKO10128482_B_Zfp697
  gRNA
gcgcugcggcccuucgcaug

SEQ ID NO: 128483 - RNA, 20 nt, Artificial Sequence
  MKO10128483_B_Zfp697
  gRNA
uucgguuuggccggcgagug

SEQ ID NO: 128484 - RNA, 20 nt, Artificial Sequence
  MKO10128484_B_Zfp69
  gRNA
ucaccucccgauacaaaucc

SEQ ID NO: 128485 - RNA, 20 nt, Artificial Sequence
  MKO10128485_B_Zfp69
  gRNA
uuaccuaaaaugggauccuc

SEQ ID NO: 128486 - RNA, 20 nt, Artificial Sequence
  MKO10128486_B_Zfp69
  gRNA
gccuacugugauuucccagu

SEQ ID NO: 128487 - RNA, 20 nt, Artificial Sequence
  MKO10128487_B_Zfp703
  gRNA
ugauagggagccgguucgcc

SEQ ID NO: 128488 - RNA, 20 nt, Artificial Sequence
  MKO10128488_B_Zfp703
  gRNA
guuaguccccgagugugaca

SEQ ID NO: 128489 - RNA, 20 nt, Artificial Sequence
  MKO10128489_B_Zfp703
  gRNA
accacagcccucccgguuaa

SEQ ID NO: 128490 - RNA, 20 nt, Artificial Sequence
  MKO10128490_B_Zfp704
  gRNA
ucuucgaugagcccauuccg

SEQ ID NO: 128491 - RNA, 20 nt, Artificial Sequence
  MKO10128491_B_Zfp704
  gRNA
agcccuccugugcggccuaa

SEQ ID NO: 128492 - RNA, 20 nt, Artificial Sequence
  MKO10128492_B_Zfp704
  gRNA
guccucugauugaaacguga

SEQ ID NO: 128493 - RNA, 20 nt, Artificial Sequence
  MKO10128493_B_Zfp706
  gRNA
gccugaacaucagccaauuc

SEQ ID NO: 128494 - RNA, 20 nt, Artificial Sequence
  MKO10128494_B_Zfp706
  gRNA
gaaacaaggacaugaccaaa

SEQ ID NO: 128495 - RNA, 20 nt, Artificial Sequence
  MKO10128495_B_Zfp706
  gRNA
cagcuuuggcagcagccuuu

SEQ ID NO: 128496 - RNA, 20 nt, Artificial Sequence
  MKO10128496_B_Zfp707
  gRNA
agcuaacggcgaugcuccuc

SEQ ID NO: 128497 - RNA, 20 nt, Artificial Sequence
  MKO10128497_B_Zfp707
  gRNA
augagccauggguugaugac

SEQ ID NO: 128498 - RNA, 20 nt, Artificial Sequence
  MKO10128498_B_Zfp707
  gRNA
agugucucaguccuagccag

SEQ ID NO: 128499 - RNA, 20 nt, Artificial Sequence
  MKO10128499_B_Zfp708
  gRNA
ccacaucuguaaaugacaga

SEQ ID NO: 128500 - RNA, 20 nt, Artificial Sequence
  MKO10128500_B_Zfp708
  gRNA
ugugaagaggaaggcaucag

SEQ ID NO: 128501 - RNA, 20 nt, Artificial Sequence
  MKO10128501_B_Zfp708
  gRNA
uggagcagaguucagaucug

SEQ ID NO: 128502 - RNA, 20 nt, Artificial Sequence
  MKO10128502_B_Zfp709
  gRNA
cuaugaguugaaccaaugug

SEQ ID NO: 128503 - RNA, 20 nt, Artificial Sequence
  MKO10128503_B_Zfp709
  gRNA
cagucauaccuauagcagcc

SEQ ID NO: 128504 - RNA, 20 nt, Artificial Sequence
  MKO10128504_B_Zfp709
  gRNA
cucugugagcuuucaagaug

SEQ ID NO: 128505 - RNA, 20 nt, Artificial Sequence
  MKO10128505_B_Zfp710
  gRNA
aaaccugagccggcacauga

SEQ ID NO: 128506 - RNA, 20 nt, Artificial Sequence
  MKO10128506_B_Zfp710
  gRNA
ugcugauccacaccagcguc

SEQ ID NO: 128507 - RNA, 20 nt, Artificial Sequence
  MKO10128507_B_Zfp710
  gRNA
caaccgcauguacaaccugc

SEQ ID NO: 128508 - RNA, 20 nt, Artificial Sequence
  MKO10128508_B_Zfp711
  gRNA
gguguccuaccauaugaugc

SEQ ID NO: 128509 - RNA, 20 nt, Artificial Sequence
  MKO10128509_B_Zfp711
  gRNA
aacuucuucugacaccauug

SEQ ID NO: 128510 - RNA, 20 nt, Artificial Sequence
  MKO10128510_B_Zfp711
  gRNA
ccgaaugcagcgagagaaaa

SEQ ID NO: 128511 - RNA, 20 nt, Artificial Sequence
  MKO10128511_B_Zfp712
  gRNA
ugcagcuuccuucacauucc

SEQ ID NO: 128512 - RNA, 20 nt, Artificial Sequence
  MKO10128512_B_Zfp712
  gRNA
uucaggaaaugcucucuuuc

SEQ ID NO: 128513 - RNA, 20 nt, Artificial Sequence
  MKO10128513_B_Zfp712
  gRNA
gaaccuuacccaggaacaca

SEQ ID NO: 128514 - RNA, 20 nt, Artificial Sequence
  MKO10128514_B_Zfp715
  gRNA
gcuccucugcacccaauggc

SEQ ID NO: 128515 - RNA, 20 nt, Artificial Sequence
  MKO10128515_B_Zfp715
  gRNA
auggcucaccuugacaucuc

SEQ ID NO: 128516 - RNA, 20 nt, Artificial Sequence
  MKO10128516_B_Zfp715
  gRNA
ggguauuccauucccagucc

SEQ ID NO: 128517 - RNA, 20 nt, Artificial Sequence
  MKO10128517_B_Zfp719
  gRNA
caugcucacccacugacaag

SEQ ID NO: 128518 - RNA, 20 nt, Artificial Sequence
  MKO10128518_B_Zfp719
  gRNA
cugccagaugccccagcagu

SEQ ID NO: 128519 - RNA, 20 nt, Artificial Sequence
  MKO10128519_B_Zfp719
  gRNA
cuacagccaccucuugucag

SEQ ID NO: 128520 - RNA, 20 nt, Artificial Sequence
  MKO10128520_B_Zfp72
  gRNA
uuccagaaaugugaccagau

SEQ ID NO: 128521 - RNA, 20 nt, Artificial Sequence
  MKO10128521_B_Zfp72
  gRNA
uuacagcaaccuugucucuc

SEQ ID NO: 128522 - RNA, 20 nt, Artificial Sequence
  MKO10128522_B_Zfp72
  gRNA
gaugcucacccagagagaca

SEQ ID NO: 128523 - RNA, 20 nt, Artificial Sequence
  MKO10128523_B_Zfp735
  gRNA
uucucuccaucaacaaucca

SEQ ID NO: 128524 - RNA, 20 nt, Artificial Sequence
  MKO10128524_B_Zfp735
  gRNA
aaugucuggauucugccaag

SEQ ID NO: 128525 - RNA, 20 nt, Artificial Sequence
  MKO10128525_B_Zfp735
  gRNA
agcagagaugugugcuucac

SEQ ID NO: 128526 - RNA, 20 nt, Artificial Sequence
  MKO10128526_B_Zfp738
  gRNA
uaacacacccgggagcauag

SEQ ID NO: 128527 - RNA, 20 nt, Artificial Sequence
  MKO10128527_B_Zfp738
  gRNA
cuguacagauccaacugagc

SEQ ID NO: 128528 - RNA, 20 nt, Artificial Sequence
  MKO10128528_B_Zfp738
  gRNA
ucugacauggagguuggugc

SEQ ID NO: 128529 - RNA, 20 nt, Artificial Sequence
  MKO10128529_B_Zfp740
  gRNA
uaaaucccgcaaccgcaaag

SEQ ID NO: 128530 - RNA, 20 nt, Artificial Sequence
  MKO10128530_B_Zfp740
  gRNA
cucucguuucuuccgacaag

SEQ ID NO: 128531 - RNA, 20 nt, Artificial Sequence
  MKO10128531_B_Zfp740
  gRNA
cgccacuguguacccgcuug

SEQ ID NO: 128532 - RNA, 20 nt, Artificial Sequence
  MKO10128532_B_Zfp746
  gRNA
cacggcucuuccccaauauc

SEQ ID NO: 128533 - RNA, 20 nt, Artificial Sequence
  MKO10128533_B_Zfp746
  gRNA
ggccucagccaguuggacuc

SEQ ID NO: 128534 - RNA, 20 nt, Artificial Sequence
  MKO10128534_B_Zfp746
  gRNA
uggauucuucggcuuccccc

SEQ ID NO: 128535 - RNA, 20 nt, Artificial Sequence
  MKO10128535_B_Zfp747
  gRNA
ccgccuguguucuguaaacc

SEQ ID NO: 128536 - RNA, 20 nt, Artificial Sequence
  MKO10128536_B_Zfp747
  gRNA
ccaaaccagcgcucaucagc

SEQ ID NO: 128537 - RNA, 20 nt, Artificial Sequence
  MKO10128537_B_Zfp747
  gRNA
uccacccagcugaugagcgc

SEQ ID NO: 128538 - RNA, 20 nt, Artificial Sequence
  MKO10128538_B_Zfp748
  gRNA
acuugucucuucucauucaa

SEQ ID NO: 128539 - RNA, 20 nt, Artificial Sequence
  MKO10128539_B_Zfp748
  gRNA
gauucucacccaggaacaca

SEQ ID NO: 128540 - RNA, 20 nt, Artificial Sequence
  MKO10128540_B_Zfp748
  gRNA
agugccuggagccugcucag

SEQ ID NO: 128541 - RNA, 20 nt, Artificial Sequence
  MKO10128541_B_Zfp74
  gRNA
cuagcaucacauuccuauau

SEQ ID NO: 128542 - RNA, 20 nt, Artificial Sequence
  MKO10128542_B_Zfp74
  gRNA
uccaacuugaaaaucacuuc

SEQ ID NO: 128543 - RNA, 20 nt, Artificial Sequence
  MKO10128543_B_Zfp74
  gRNA
agaggaaaugaccgagucug

SEQ ID NO: 128544 - RNA, 20 nt, Artificial Sequence
  MKO10128544_B_Zfp750
  gRNA
cauguaugcaagcaacgccc

SEQ ID NO: 128545 - RNA, 20 nt, Artificial Sequence
  MKO10128545_B_Zfp750
  gRNA
ucuaaucugccgaucccuua

SEQ ID NO: 128546 - RNA, 20 nt, Artificial Sequence
  MKO10128546_B_Zfp750
  gRNA
gccacucaaucuguccguga

SEQ ID NO: 128547 - RNA, 20 nt, Artificial Sequence
  MKO10128547_B_Zfp758
  gRNA
acagggucuguuaacauuca

SEQ ID NO: 128548 - RNA, 20 nt, Artificial Sequence
  MKO10128548_B_Zfp758
  gRNA
uguggcaguggacuucucac

SEQ ID NO: 128549 - RNA, 20 nt, Artificial Sequence
  MKO10128549_B_Zfp758
  gRNA
auucaucauagacuacauuc

SEQ ID NO: 128550 - RNA, 20 nt, Artificial Sequence
  MKO10128550_B_Zfp759
  gRNA
acuugacucuucacaucuag

SEQ ID NO: 128551 - RNA, 20 nt, Artificial Sequence
  MKO10128551_B_Zfp759
  gRNA
uauaccugaguacauagaga

SEQ ID NO: 128552 - RNA, 20 nt, Artificial Sequence
  MKO10128552_B_Zfp759
  gRNA
aauaccuggguccuccucag

SEQ ID NO: 128553 - RNA, 20 nt, Artificial Sequence
  MKO10128553_B_Zfp760
  gRNA
uacaucaacuuggucucugu

SEQ ID NO: 128554 - RNA, 20 nt, Artificial Sequence
  MKO10128554_B_Zfp760
  gRNA
cuguaacaaguacagcuacc

SEQ ID NO: 128555 - RNA, 20 nt, Artificial Sequence
  MKO10128555_B_Zfp760
  gRNA
guacacuauuaugucugauu

SEQ ID NO: 128556 - RNA, 20 nt, Artificial Sequence
  MKO10128556_B_Zfp763
  gRNA
uccaacagagcccacucucc

SEQ ID NO: 128557 - RNA, 20 nt, Artificial Sequence
  MKO10128557_B_Zfp763
  gRNA
augcuaaugucagaagucug

SEQ ID NO: 128558 - RNA, 20 nt, Artificial Sequence
  MKO10128558_B_Zfp763
  gRNA
guggcugugaacuucagucc

SEQ ID NO: 128559 - RNA, 20 nt, Artificial Sequence
  MKO10128559_B_Zfp764
  gRNA
guccgcgaagcucacagccu

SEQ ID NO: 128560 - RNA, 20 nt, Artificial Sequence
  MKO10128560_B_Zfp764
  gRNA
caccucuggauccugugcac

SEQ ID NO: 128561 - RNA, 20 nt, Artificial Sequence
  MKO10128561_B_Zfp764
  gRNA
acccugugcacaggauccag

SEQ ID NO: 128562 - RNA, 20 nt, Artificial Sequence
  MKO10128562_B_Zfp768
  gRNA
ugugcacagucccaacgcag

SEQ ID NO: 128563 - RNA, 20 nt, Artificial Sequence
  MKO10128563_B_Zfp768
  gRNA
cagcaccaucgcgugcauag

SEQ ID NO: 128564 - RNA, 20 nt, Artificial Sequence
  MKO10128564_B_Zfp768
  gRNA
gggggauaagugcugaccgu

SEQ ID NO: 128565 - RNA, 20 nt, Artificial Sequence
  MKO10128565_B_Zfp770
  gRNA
gucuuaccucgccaacgcac

SEQ ID NO: 128566 - RNA, 20 nt, Artificial Sequence
  MKO10128566_B_Zfp770
  gRNA
cuuuagacaacucguucauc

SEQ ID NO: 128567 - RNA, 20 nt, Artificial Sequence
  MKO10128567_B_Zfp770
  gRNA
aaccaagccccucgcacugu

SEQ ID NO: 128568 - RNA, 20 nt, Artificial Sequence
  MKO10128568_B_Zfp771
  gRNA
caagaugccuggcgaacagc

SEQ ID NO: 128569 - RNA, 20 nt, Artificial Sequence
  MKO10128569_B_Zfp771
  gRNA
gucgcucgcccguaugcgug

SEQ ID NO: 128570 - RNA, 20 nt, Artificial Sequence
  MKO10128570_B_Zfp771
  gRNA
cuucggcggaaguucgugcc

SEQ ID NO: 128571 - RNA, 20 nt, Artificial Sequence
  MKO10128571_B_Zfp772
  gRNA
agaugacucagcugaagucu

SEQ ID NO: 128572 - RNA, 20 nt, Artificial Sequence
  MKO10128572_B_Zfp772
  gRNA
acuucagcugagucaucuca

SEQ ID NO: 128573 - RNA, 20 nt, Artificial Sequence
  MKO10128573_B_Zfp772
  gRNA
ucaggacugcuuauccuuug

SEQ ID NO: 128574 - RNA, 20 nt, Artificial Sequence
  MKO10128574_B_Zfp773
  gRNA
ccucucgcgccuuccaguuc

SEQ ID NO: 128575 - RNA, 20 nt, Artificial Sequence
  MKO10128575_B_Zfp773
  gRNA
ucuguaccaccaggugauga

SEQ ID NO: 128576 - RNA, 20 nt, Artificial Sequence
  MKO10128576_B_Zfp773
  gRNA
guagauagccacaucacuaa

SEQ ID NO: 128577 - RNA, 20 nt, Artificial Sequence
  MKO10128577_B_Zfp775
  gRNA
ugcagggauggagaguggcc

SEQ ID NO: 128578 - RNA, 20 nt, Artificial Sequence
  MKO10128578_B_Zfp775
  gRNA
cuaaaacagcgaccgcaguc

SEQ ID NO: 128579 - RNA, 20 nt, Artificial Sequence
  MKO10128579_B_Zfp775
  gRNA
gcacaugcccgaaaccgccu

SEQ ID NO: 128580 - RNA, 20 nt, Artificial Sequence
  MKO10128580_B_Zfp777
  gRNA
cucgcacuccgcccaccguc

SEQ ID NO: 128581 - RNA, 20 nt, Artificial Sequence
  MKO10128581_B_Zfp777
  gRNA
uggcaucgugauuaagaucg

SEQ ID NO: 128582 - RNA, 20 nt, Artificial Sequence
  MKO10128582_B_Zfp777
  gRNA
agacuaugcaauauccaaac

SEQ ID NO: 128583 - RNA, 20 nt, Artificial Sequence
  MKO10128583_B_Zfp780b
  gRNA
caacucuaauucucaagaca

SEQ ID NO: 128584 - RNA, 20 nt, Artificial Sequence
  MKO10128584_B_Zfp780b
  gRNA
uucaggggucagugacauuu

SEQ ID NO: 128585 - RNA, 20 nt, Artificial Sequence
  MKO10128585_B_Zfp780b
  gRNA
caggcuuacccacugcgacc

SEQ ID NO: 128586 - RNA, 20 nt, Artificial Sequence
  MKO10128586_B_Zfp781
  gRNA
aggaauaauaucugucacuc

SEQ ID NO: 128587 - RNA, 20 nt, Artificial Sequence
  MKO10128587_B_Zfp781
  gRNA
accacauucauuacauucau

SEQ ID NO: 128588 - RNA, 20 nt, Artificial Sequence
  MKO10128588_B_Zfp781
  gRNA
ugaacuucaccaaagaagag

SEQ ID NO: 128589 - RNA, 20 nt, Artificial Sequence
  MKO10128589_B_Zfp784
  gRNA
ucacagagcaugcaucggaa

SEQ ID NO: 128590 - RNA, 20 nt, Artificial Sequence
  MKO10128590_B_Zfp784
  gRNA
ccccuguaugcacccgcucg

SEQ ID NO: 128591 - RNA, 20 nt, Artificial Sequence
  MKO10128591_B_Zfp784
  gRNA
cucgcauaucugaggagcgu

SEQ ID NO: 128592 - RNA, 20 nt, Artificial Sequence
  MKO10128592_B_Zfp786
  gRNA
caaagggccgcucgggccug

SEQ ID NO: 128593 - RNA, 20 nt, Artificial Sequence
  MKO10128593_B_Zfp786
  gRNA
agagaugagagucucguaau

SEQ ID NO: 128594 - RNA, 20 nt, Artificial Sequence
  MKO10128594_B_Zfp786
  gRNA
ccaaaccagaacuaauaucc

SEQ ID NO: 128595 - RNA, 20 nt, Artificial Sequence
  MKO10128595_B_Zfp787
  gRNA
cucaccuggguucucaugac

SEQ ID NO: 128596 - RNA, 20 nt, Artificial Sequence
  MKO10128596_B_Zfp787
  gRNA
cacaccgcgcaccagccgac

SEQ ID NO: 128597 - RNA, 20 nt, Artificial Sequence
  MKO10128597_B_Zfp787
  gRNA
cgauggcgagggcauuauug

SEQ ID NO: 128598 - RNA, 20 nt, Artificial Sequence
  MKO10128598_B_Zfp788
  gRNA
uucucuuaccgacacaagca

SEQ ID NO: 128599 - RNA, 20 nt, Artificial Sequence
  MKO10128599_B_Zfp788
  gRNA
ugugcucaucuuccaugcuu

SEQ ID NO: 128600 - RNA, 20 nt, Artificial Sequence
  MKO10128600_B_Zfp788
  gRNA
aagaugagcacacaaauccu

SEQ ID NO: 128601 - RNA, 20 nt, Artificial Sequence
  MKO10128601_B_Zfp78
  gRNA
cuaccggaacuuggucucug

SEQ ID NO: 128602 - RNA, 20 nt, Artificial Sequence
  MKO10128602_B_Zfp78
  gRNA
acuggcugaauccugcucag

SEQ ID NO: 128603 - RNA, 20 nt, Artificial Sequence
  MKO10128603_B_Zfp78
  gRNA
cuccuucccauguuccaaua

SEQ ID NO: 128604 - RNA, 20 nt, Artificial Sequence
  MKO10128604_B_Zfp790
  gRNA
ucaccugggcaaaaucugcu

SEQ ID NO: 128605 - RNA, 20 nt, Artificial Sequence
  MKO10128605_B_Zfp790
  gRNA
gguaaugacauucagagaug

SEQ ID NO: 128606 - RNA, 20 nt, Artificial Sequence
  MKO10128606_B_Zfp790
  gRNA
cuacagccaccuugucucag

SEQ ID NO: 128607 - RNA, 20 nt, Artificial Sequence
  MKO10128607_B_Zfp791
  gRNA
uguacugauuugaaacaucc

SEQ ID NO: 128608 - RNA, 20 nt, Artificial Sequence
  MKO10128608_B_Zfp791
  gRNA
uuguagaguuucuucuguac

SEQ ID NO: 128609 - RNA, 20 nt, Artificial Sequence
  MKO10128609_B_Zfp791
  gRNA
aaaucaguacagaauccaag

SEQ ID NO: 128610 - RNA, 20 nt, Artificial Sequence
  MKO10128610_B_Zfp799
  gRNA
uugaggaaccuguccuauau

SEQ ID NO: 128611 - RNA, 20 nt, Artificial Sequence
  MKO10128611_B_Zfp799
  gRNA
cugcgauucccgcugucagu

SEQ ID NO: 128612 - RNA, 20 nt, Artificial Sequence
  MKO10128612_B_Zfp799
  gRNA
ucguccugugucuuugacug

SEQ ID NO: 128613 - RNA, 20 nt, Artificial Sequence
  MKO10128613_B_Zfp7
  gRNA
uuaagccggaauugaucucc

SEQ ID NO: 128614 - RNA, 20 nt, Artificial Sequence
  MKO10128614_B_Zfp7
  gRNA
ggcugugcacuucucucgag

SEQ ID NO: 128615 - RNA, 20 nt, Artificial Sequence
  MKO10128615_B_Zfp7
  gRNA
gcaccaaggauuugccagac

SEQ ID NO: 128616 - RNA, 20 nt, Artificial Sequence
  MKO10128616_B_Zfp800
  gRNA
cuuccauguaguuuauaucc

SEQ ID NO: 128617 - RNA, 20 nt, Artificial Sequence
  MKO10128617_B_Zfp800
  gRNA
uuaugccguagucucuuuag

SEQ ID NO: 128618 - RNA, 20 nt, Artificial Sequence
  MKO10128618_B_Zfp800
  gRNA
guaauccucuaaagagacua

SEQ ID NO: 128619 - RNA, 20 nt, Artificial Sequence
  MKO10128619_B_Zfp804a
  gRNA
acuccaacgucuucacaagc

SEQ ID NO: 128620 - RNA, 20 nt, Artificial Sequence
  MKO10128620_B_Zfp804a
  gRNA
agcuccacgcaucucagcaa

SEQ ID NO: 128621 - RNA, 20 nt, Artificial Sequence
  MKO10128621_B_Zfp804a
  gRNA
gacaauguaguaacacucca

SEQ ID NO: 128622 - RNA, 20 nt, Artificial Sequence
  MKO10128622_B_Zfp804b
  gRNA
acggagauccauucuugcag

SEQ ID NO: 128623 - RNA, 20 nt, Artificial Sequence
  MKO10128623_B_Zfp804b
  gRNA
caagaauggaucuccgucuc

SEQ ID NO: 128624 - RNA, 20 nt, Artificial Sequence
  MKO10128624_B_Zfp804b
  gRNA
uuaugaccacgcucauaagc

SEQ ID NO: 128625 - RNA, 20 nt, Artificial Sequence
  MKO10128625_B_Zfp808
  gRNA
ucuagaaugcagugacuuau

SEQ ID NO: 128626 - RNA, 20 nt, Artificial Sequence
  MKO10128626_B_Zfp808
  gRNA
gacaauguucuucaauauuu

SEQ ID NO: 128627 - RNA, 20 nt, Artificial Sequence
  MKO10128627_B_Zfp808
  gRNA
aaaguucuagaagacacaga

SEQ ID NO: 128628 - RNA, 20 nt, Artificial Sequence
  MKO10128628_B_Zfp809
  gRNA
augacgggauguugucccuu

SEQ ID NO: 128629 - RNA, 20 nt, Artificial Sequence
  MKO10128629_B_Zfp809
  gRNA
gccuagcagaagcuucaagc

SEQ ID NO: 128630 - RNA, 20 nt, Artificial Sequence
  MKO10128630_B_Zfp809
  gRNA
accuaaguugaucuucaauu

SEQ ID NO: 128631 - RNA, 20 nt, Artificial Sequence
  MKO10128631_B_Zfp810
  gRNA
cucauucacagggcacugca

SEQ ID NO: 128632 - RNA, 20 nt, Artificial Sequence
  MKO10128632_B_Zfp810
  gRNA
cugacucacccaaggacacc

SEQ ID NO: 128633 - RNA, 20 nt, Artificial Sequence
  MKO10128633_B_Zfp810
  gRNA
ccauacagcaaaugaagaac

SEQ ID NO: 128634 - RNA, 20 nt, Artificial Sequence
  MKO10128634_B_Zfp811
  gRNA
acacuaggacaucaugucuc

SEQ ID NO: 128635 - RNA, 20 nt, Artificial Sequence
  MKO10128635_B_Zfp811
  gRNA
ucugcuggaucuaucccaaa

SEQ ID NO: 128636 - RNA, 20 nt, Artificial Sequence
  MKO10128636_B_Zfp811
  gRNA
uugagaaaugugguuuccau

SEQ ID NO: 128637 - RNA, 20 nt, Artificial Sequence
  MKO10128637_B_Zfp819
  gRNA
ggagcaggacgggccgugug

SEQ ID NO: 128638 - RNA, 20 nt, Artificial Sequence
  MKO10128638_B_Zfp819
  gRNA
agguugauuucccacaucag

SEQ ID NO: 128639 - RNA, 20 nt, Artificial Sequence
  MKO10128639_B_Zfp819
  gRNA
ccucaagaugaagaaaguua

SEQ ID NO: 128640 - RNA, 20 nt, Artificial Sequence
  MKO10128640_B_Zfp81
  gRNA
caacaaagcccacucuccua

SEQ ID NO: 128641 - RNA, 20 nt, Artificial Sequence
  MKO10128641_B_Zfp81
  gRNA
guggcugugaacuucaccuu

SEQ ID NO: 128642 - RNA, 20 nt, Artificial Sequence
  MKO10128642_B_Zfp81
  gRNA
ucaaauuucuccuaauauuu

SEQ ID NO: 128643 - RNA, 20 nt, Artificial Sequence
  MKO10128643_B_Zfp820
  gRNA
cacugaccugaggaacauuu

SEQ ID NO: 128644 - RNA, 20 nt, Artificial Sequence
  MKO10128644_B_Zfp820
  gRNA
aaugucuugauugugcucag

SEQ ID NO: 128645 - RNA, 20 nt, Artificial Sequence
  MKO10128645_B_Zfp820
  gRNA
acagggucaguuaacauuca

SEQ ID NO: 128646 - RNA, 20 nt, Artificial Sequence
  MKO10128646_B_Zfp821
  gRNA
aguccugaucucguaguugu

SEQ ID NO: 128647 - RNA, 20 nt, Artificial Sequence
  MKO10128647_B_Zfp821
  gRNA
gcugauugcacauguguacc

SEQ ID NO: 128648 - RNA, 20 nt, Artificial Sequence
  MKO10128648_B_Zfp821
  gRNA
cccgacucccacagucuagc

SEQ ID NO: 128649 - RNA, 20 nt, Artificial Sequence
  MKO10128649_B_Zfp825
  gRNA
agcagcgcucaaagaagaca

SEQ ID NO: 128650 - RNA, 20 nt, Artificial Sequence
  MKO10128650_B_Zfp825
  gRNA
ugugcgugugaacuucacug

SEQ ID NO: 128651 - RNA, 20 nt, Artificial Sequence
  MKO10128651_B_Zfp825
  gRNA
uaccuauagcagugauguuc

SEQ ID NO: 128652 - RNA, 20 nt, Artificial Sequence
  MKO10128652_B_Zfp827
  gRNA
cuccagcuacguguucagcc

SEQ ID NO: 128653 - RNA, 20 nt, Artificial Sequence
  MKO10128653_B_Zfp827
  gRNA
uuaccuugaaugcugccgac

SEQ ID NO: 128654 - RNA, 20 nt, Artificial Sequence
  MKO10128654_B_Zfp827
  gRNA
ggcuggcguugcaccuuugc

SEQ ID NO: 128655 - RNA, 20 nt, Artificial Sequence
  MKO10128655_B_Zfp82
  gRNA
cucuuucccuugcuccagua

SEQ ID NO: 128656 - RNA, 20 nt, Artificial Sequence
  MKO10128656_B_Zfp82
  gRNA
caggcuugcaccgucacgcc

SEQ ID NO: 128657 - RNA, 20 nt, Artificial Sequence
  MKO10128657_B_Zfp82
  gRNA
uguguccauagccuucucgc

SEQ ID NO: 128658 - RNA, 20 nt, Artificial Sequence
  MKO10128658_B_Zfp830
  gRNA
ugaagcgaucguugcugaag

SEQ ID NO: 128659 - RNA, 20 nt, Artificial Sequence
  MKO10128659_B_Zfp830
  gRNA
auucgccaaguacaaccguc

SEQ ID NO: 128660 - RNA, 20 nt, Artificial Sequence
  MKO10128660_B_Zfp830
  gRNA
aacacucgcuugccucuccg

SEQ ID NO: 128661 - RNA, 20 nt, Artificial Sequence
  MKO10128661_B_Zfp831
  gRNA
auguggggaccugaccgucc

SEQ ID NO: 128662 - RNA, 20 nt, Artificial Sequence
  MKO10128662_B_Zfp831
  gRNA
cuuucaggucgaaauguaca

SEQ ID NO: 128663 - RNA, 20 nt, Artificial Sequence
  MKO10128663_B_Zfp831
  gRNA
gacuucgagacccaugucuc

SEQ ID NO: 128664 - RNA, 20 nt, Artificial Sequence
  MKO10128664_B_Zfp839
  gRNA
gacgcuguaugaacuucuuc

SEQ ID NO: 128665 - RNA, 20 nt, Artificial Sequence
  MKO10128665_B_Zfp839
  gRNA
ccuggagaucagcaacgaug

SEQ ID NO: 128666 - RNA, 20 nt, Artificial Sequence
  MKO10128666_B_Zfp839
  gRNA
cagcgcuggugcauacccuc

SEQ ID NO: 128667 - RNA, 20 nt, Artificial Sequence
  MKO10128667_B_Zfp846
  gRNA
cucaaaaaauccugaugcaa

SEQ ID NO: 128668 - RNA, 20 nt, Artificial Sequence
  MKO10128668_B_Zfp846
  gRNA
uugcacagagaagaucucca

SEQ ID NO: 128669 - RNA, 20 nt, Artificial Sequence
  MKO10128669_B_Zfp846
  gRNA
ucacagagaccucuacagag

SEQ ID NO: 128670 - RNA, 20 nt, Artificial Sequence
  MKO10128670_B_Zfp84
  gRNA
cuacagcaacuuugugucgc

SEQ ID NO: 128671 - RNA, 20 nt, Artificial Sequence
  MKO10128671_B_Zfp84
  gRNA
cuguauagcgaccucugcuc

SEQ ID NO: 128672 - RNA, 20 nt, Artificial Sequence
  MKO10128672_B_Zfp84
  gRNA
gccaucaauaauuucacugc

SEQ ID NO: 128673 - RNA, 20 nt, Artificial Sequence
  MKO10128673_B_Zfp850
  gRNA
cuacagcaaccucauugcag

SEQ ID NO: 128674 - RNA, 20 nt, Artificial Sequence
  MKO10128674_B_Zfp850
  gRNA
gaaacagacagguugagccc

SEQ ID NO: 128675 - RNA, 20 nt, Artificial Sequence
  MKO10128675_B_Zfp850
  gRNA
caugucuugagaauuagagc

SEQ ID NO: 128676 - RNA, 20 nt, Artificial Sequence
  MKO10128676_B_Zfp85
  gRNA
ccacaucugugaaugacaga

SEQ ID NO: 128677 - RNA, 20 nt, Artificial Sequence
  MKO10128677_B_Zfp85
  gRNA
ugcuuucucuaagccauacc

SEQ ID NO: 128678 - RNA, 20 nt, Artificial Sequence
  MKO10128678_B_Zfp85
  gRNA
uuccuacacaccuagaugga

SEQ ID NO: 128679 - RNA, 20 nt, Artificial Sequence
  MKO10128679_B_Zfp865
  gRNA
uggggcgacgguggccggau

SEQ ID NO: 128680 - RNA, 20 nt, Artificial Sequence
  MKO10128680_B_Zfp865
  gRNA
guagcggaaggucuugccgc

SEQ ID NO: 128681 - RNA, 20 nt, Artificial Sequence
  MKO10128681_B_Zfp865
  gRNA
gaaaccgaacgucuugccgc

SEQ ID NO: 128682 - RNA, 20 nt, Artificial Sequence
  MKO10128682_B_Zfp866
  gRNA
ugcaggaaccucgcugcgau

SEQ ID NO: 128683 - RNA, 20 nt, Artificial Sequence
  MKO10128683_B_Zfp866
  gRNA
gaagaugacugcaaaaauuu

SEQ ID NO: 128684 - RNA, 20 nt, Artificial Sequence
  MKO10128684_B_Zfp866
  gRNA
cauucuucucuucgauugca

SEQ ID NO: 128685 - RNA, 20 nt, Artificial Sequence
  MKO10128685_B_Zfp867
  gRNA
guuuauagccacaucgucaa

SEQ ID NO: 128686 - RNA, 20 nt, Artificial Sequence
  MKO10128686_B_Zfp867
  gRNA
gaugcgggacagcagaaauu

SEQ ID NO: 128687 - RNA, 20 nt, Artificial Sequence
  MKO10128687_B_Zfp867
  gRNA
gauuaccuuagauuugucug

SEQ ID NO: 128688 - RNA, 20 nt, Artificial Sequence
  MKO10128688_B_Zfp868
  gRNA
aaauccguucaugcauuuga

SEQ ID NO: 128689 - RNA, 20 nt, Artificial Sequence
  MKO10128689_B_Zfp868
  gRNA
acagcuuaccugaucaggcc

SEQ ID NO: 128690 - RNA, 20 nt, Artificial Sequence
  MKO10128690_B_Zfp868
  gRNA
aagagccugaaauaaaucua

SEQ ID NO: 128691 - RNA, 20 nt, Artificial Sequence
  MKO10128691_B_Zfp869
  gRNA
aagauccugaaguaaaucua

SEQ ID NO: 128692 - RNA, 20 nt, Artificial Sequence
  MKO10128692_B_Zfp869
  gRNA
aauuaccuuagauuuacuuc

SEQ ID NO: 128693 - RNA, 20 nt, Artificial Sequence
  MKO10128693_B_Zfp869
  gRNA
aucauggaggcagccauugu

SEQ ID NO: 128694 - RNA, 20 nt, Artificial Sequence
  MKO10128694_B_Zfp870
  gRNA
gaacguaccauuuccagccc

SEQ ID NO: 128695 - RNA, 20 nt, Artificial Sequence
  MKO10128695_B_Zfp870
  gRNA
cagaagguuauaaaugagua

SEQ ID NO: 128696 - RNA, 20 nt, Artificial Sequence
  MKO10128696_B_Zfp870
  gRNA
uguggcugugaaguucacgc

SEQ ID NO: 128697 - RNA, 20 nt, Artificial Sequence
  MKO10128697_B_Zfp871
  gRNA
ucaacauagcccacuccucc

SEQ ID NO: 128698 - RNA, 20 nt, Artificial Sequence
  MKO10128698_B_Zfp871
  gRNA
uugaggaaccuggcuucuau

SEQ ID NO: 128699 - RNA, 20 nt, Artificial Sequence
  MKO10128699_B_Zfp871
  gRNA
caacugaauccaacgcauga

SEQ ID NO: 128700 - RNA, 20 nt, Artificial Sequence
  MKO10128700_B_Zfp872
  gRNA
ucugcuggacgauucucaga

SEQ ID NO: 128701 - RNA, 20 nt, Artificial Sequence
  MKO10128701_B_Zfp872
  gRNA
auuggcaagaccagagcauu

SEQ ID NO: 128702 - RNA, 20 nt, Artificial Sequence
  MKO10128702_B_Zfp872
  gRNA
ugcacugaucccuaaugcuc

SEQ ID NO: 128703 - RNA, 20 nt, Artificial Sequence
  MKO10128703_B_Zfp873
  gRNA
ucaugaagaaugggcuuugc

SEQ ID NO: 128704 - RNA, 20 nt, Artificial Sequence
  MKO10128704_B_Zfp873
  gRNA
cagauuacugagccguguaa

SEQ ID NO: 128705 - RNA, 20 nt, Artificial Sequence
  MKO10128705_B_Zfp873
  gRNA
uuuguaucaagcacugccac

SEQ ID NO: 128706 - RNA, 20 nt, Artificial Sequence
  MKO10128706_B_Zfp874a
  gRNA
ugcuguugcuaaaccauacu

SEQ ID NO: 128707 - RNA, 20 nt, Artificial Sequence
  MKO10128707_B_Zfp874a
  gRNA
uuucagccaccuugauuucc

SEQ ID NO: 128708 - RNA, 20 nt, Artificial Sequence
  MKO10128708_B_Zfp874a
  gRNA
aauccucacccaggaaauca

SEQ ID NO: 128709 - RNA, 20 nt, Artificial Sequence
  MKO10128709_B_Zfp874b
  gRNA
cuucuacacaccugggaugg

SEQ ID NO: 128710 - RNA, 20 nt, Artificial Sequence
  MKO10128710_B_Zfp874b
  gRNA
ugcuguugcuaagccauacu

SEQ ID NO: 128711 - RNA, 20 nt, Artificial Sequence
  MKO10128711_B_Zfp874b
  gRNA
acuaccuggguccugcucag

SEQ ID NO: 128712 - RNA, 20 nt, Artificial Sequence
  MKO10128712_B_Zfp879
  gRNA
gccccuuacccagcgagacc

SEQ ID NO: 128713 - RNA, 20 nt, Artificial Sequence
  MKO10128713_B_Zfp879
  gRNA
ucuaacugagcgaugaccuu

SEQ ID NO: 128714 - RNA, 20 nt, Artificial Sequence
  MKO10128714_B_Zfp879
  gRNA
uuacucaccugaaccugggc

SEQ ID NO: 128715 - RNA, 20 nt, Artificial Sequence
  MKO10128715_B_Zfp87
  gRNA
gcuggucucuucacaacuga

SEQ ID NO: 128716 - RNA, 20 nt, Artificial Sequence
  MKO10128716_B_Zfp87
  gRNA
gaaccucacccaggaacaca

SEQ ID NO: 128717 - RNA, 20 nt, Artificial Sequence
  MKO10128717_B_Zfp87
  gRNA
uucaggaaaugcugucauuc

SEQ ID NO: 128718 - RNA, 20 nt, Artificial Sequence
  MKO10128718_B_Zfp882
  gRNA
ugcugaauucuucccaaaag

SEQ ID NO: 128719 - RNA, 20 nt, Artificial Sequence
  MKO10128719_B_Zfp882
  gRNA
gauugaaaccuugucuaugc

SEQ ID NO: 128720 - RNA, 20 nt, Artificial Sequence
  MKO10128720_B_Zfp882
  gRNA
ccgcacuucuuacaugugcc

SEQ ID NO: 128721 - RNA, 20 nt, Artificial Sequence
  MKO10128721_B_Zfp90
  gRNA
aauggccccgagaccuccga

SEQ ID NO: 128722 - RNA, 20 nt, Artificial Sequence
  MKO10128722_B_Zfp90
  gRNA
cucaccuggggcuuggccgu

SEQ ID NO: 128723 - RNA, 20 nt, Artificial Sequence
  MKO10128723_B_Zfp90
  gRNA
uacaaccaccuggugucgcu

SEQ ID NO: 128724 - RNA, 20 nt, Artificial Sequence
  MKO10128724_B_Zfp91
  gRNA
uucaagcauaccuuucaagg

SEQ ID NO: 128725 - RNA, 20 nt, Artificial Sequence
  MKO10128725_B_Zfp91
  gRNA
ccagaagaacaucagucucc

SEQ ID NO: 128726 - RNA, 20 nt, Artificial Sequence
  MKO10128726_B_Zfp91
  gRNA
gaaaaacuaacaacugauaa

SEQ ID NO: 128727 - RNA, 20 nt, Artificial Sequence
  MKO10128727_B_Zfp92
  gRNA
uacagccaucuggugucagu

SEQ ID NO: 128728 - RNA, 20 nt, Artificial Sequence
  MKO10128728_B_Zfp92
  gRNA
gggcuuugcccuuagaagag

SEQ ID NO: 128729 - RNA, 20 nt, Artificial Sequence
  MKO10128729_B_Zfp92
  gRNA
ccagcaucacuugcuuguag

SEQ ID NO: 128730 - RNA, 20 nt, Artificial Sequence
  MKO10128730_B_Zfp930
  gRNA
cuuuacuacacuucuuacau

SEQ ID NO: 128731 - RNA, 20 nt, Artificial Sequence
  MKO10128731_B_Zfp930
  gRNA
uccagcaaggcccacucuuc

SEQ ID NO: 128732 - RNA, 20 nt, Artificial Sequence
  MKO10128732_B_Zfp930
  gRNA
ccuugcuggaucauacccag

SEQ ID NO: 128733 - RNA, 20 nt, Artificial Sequence
  MKO10128733_B_Zfp931
  gRNA
accacaauguuuacauucau

SEQ ID NO: 128734 - RNA, 20 nt, Artificial Sequence
  MKO10128734_B_Zfp931
  gRNA
cgugcaugugaacuucacuc

SEQ ID NO: 128735 - RNA, 20 nt, Artificial Sequence
  MKO10128735_B_Zfp931
  gRNA
uauagcugugagauuccuau

SEQ ID NO: 128736 - RNA, 20 nt, Artificial Sequence
  MKO10128736_B_Zfp932
  gRNA
ugaacuucacucaagaagaa

SEQ ID NO: 128737 - RNA, 20 nt, Artificial Sequence
  MKO10128737_B_Zfp932
  gRNA
aaauuaccuuccaugucuuc

SEQ ID NO: 128738 - RNA, 20 nt, Artificial Sequence
  MKO10128738_B_Zfp932
  gRNA
ugugaaagcuccagaagaca

SEQ ID NO: 128739 - RNA, 20 nt, Artificial Sequence
  MKO10128739_B_Zfp933
  gRNA
cugucuuaccuauggcacug

SEQ ID NO: 128740 - RNA, 20 nt, Artificial Sequence
  MKO10128740_B_Zfp933
  gRNA
uacaggaaccucagugccau

SEQ ID NO: 128741 - RNA, 20 nt, Artificial Sequence
  MKO10128741_B_Zfp933
  gRNA
ugucaaagcucuagaagacg

SEQ ID NO: 128742 - RNA, 20 nt, Artificial Sequence
  MKO10128742_B_Zfp934
  gRNA
uugcgagcaagcugaaagau

SEQ ID NO: 128743 - RNA, 20 nt, Artificial Sequence
  MKO10128743_B_Zfp934
  gRNA
gucgccacguuguagaucgc

SEQ ID NO: 128744 - RNA, 20 nt, Artificial Sequence
  MKO10128744_B_Zfp934
  gRNA
cuagaaugcagugacuuaug

SEQ ID NO: 128745 - RNA, 20 nt, Artificial Sequence
  MKO10128745_B_Zfp935
  gRNA
gaauauagagaugaccguau

SEQ ID NO: 128746 - RNA, 20 nt, Artificial Sequence
  MKO10128746_B_Zfp935
  gRNA
cauauuuaccuauagcauug

SEQ ID NO: 128747 - RNA, 20 nt, Artificial Sequence
  MKO10128747_B_Zfp935
  gRNA
aaaguucuagaagacacaga

SEQ ID NO: 128748 - RNA, 20 nt, Artificial Sequence
  MKO10128748_B_Zfp936
  gRNA
cugguucaaugcuguagcug

SEQ ID NO: 128749 - RNA, 20 nt, Artificial Sequence
  MKO10128749_B_Zfp936
  gRNA
uuguaaagucucuucugaga

SEQ ID NO: 128750 - RNA, 20 nt, Artificial Sequence
  MKO10128750_B_Zfp936
  gRNA
augugcauguacacuucacu

SEQ ID NO: 128751 - RNA, 20 nt, Artificial Sequence
  MKO10128751_B_Zfp937
  gRNA
ugugcaugugaacuucacuc

SEQ ID NO: 128752 - RNA, 20 nt, Artificial Sequence
  MKO10128752_B_Zfp937
  gRNA
gaacuuugaaaauguucuuc

SEQ ID NO: 128753 - RNA, 20 nt, Artificial Sequence
  MKO10128753_B_Zfp937
  gRNA
auuauauuuaggcuacaguu

SEQ ID NO: 128754 - RNA, 20 nt, Artificial Sequence
  MKO10128754_B_Zfp938
  gRNA
ucucuacaaagaugucaugc

SEQ ID NO: 128755 - RNA, 20 nt, Artificial Sequence
  MKO10128755_B_Zfp938
  gRNA
ugucaaaguucuagaagaca

SEQ ID NO: 128756 - RNA, 20 nt, Artificial Sequence
  MKO10128756_B_Zfp938
  gRNA
ggaaaaucuccuguccgucc

SEQ ID NO: 128757 - RNA, 20 nt, Artificial Sequence
  MKO10128757_B_Zfp939
  gRNA
uccucuguccgcagcuuugc

SEQ ID NO: 128758 - RNA, 20 nt, Artificial Sequence
  MKO10128758_B_Zfp939
  gRNA
uuccaguuggagcauggauu

SEQ ID NO: 128759 - RNA, 20 nt, Artificial Sequence
  MKO10128759_B_Zfp939
  gRNA
gcacaaacucacccaagaac

SEQ ID NO: 128760 - RNA, 20 nt, Artificial Sequence
  MKO10128760_B_Zfp93
  gRNA
uguggcuguugucuucagcg

SEQ ID NO: 128761 - RNA, 20 nt, Artificial Sequence
  MKO10128761_B_Zfp93
  gRNA
gagaacaaugaccaaguuac

SEQ ID NO: 128762 - RNA, 20 nt, Artificial Sequence
  MKO10128762_B_Zfp93
  gRNA
cuccagacagccgucauccu

SEQ ID NO: 128763 - RNA, 20 nt, Artificial Sequence
  MKO10128763_B_Zfp940
  gRNA
gagacaaggggaccuuaucc

SEQ ID NO: 128764 - RNA, 20 nt, Artificial Sequence
  MKO10128764_B_Zfp940
  gRNA
gaaucuuacccacugagacg

SEQ ID NO: 128765 - RNA, 20 nt, Artificial Sequence
  MKO10128765_B_Zfp940
  gRNA
cucaucccucaaaaucaucc

SEQ ID NO: 128766 - RNA, 20 nt, Artificial Sequence
  MKO10128766_B_Zfp941
  gRNA
gccacaucaucaaaugucau

SEQ ID NO: 128767 - RNA, 20 nt, Artificial Sequence
  MKO10128767_B_Zfp941
  gRNA
ucagaaaaggucucccgucg

SEQ ID NO: 128768 - RNA, 20 nt, Artificial Sequence
  MKO10128768_B_Zfp941
  gRNA
ucgcuccaggacgaaugcua

SEQ ID NO: 128769 - RNA, 20 nt, Artificial Sequence
  MKO10128769_B_Zfp942
  gRNA
ucagggucuguuaagauuca

SEQ ID NO: 128770 - RNA, 20 nt, Artificial Sequence
  MKO10128770_B_Zfp942
  gRNA
aagaagaaugaaugcuuccc

SEQ ID NO: 128771 - RNA, 20 nt, Artificial Sequence
  MKO10128771_B_Zfp942
  gRNA
uguggcaguggacuucucac

SEQ ID NO: 128772 - RNA, 20 nt, Artificial Sequence
  MKO10128772_B_Zfp943
  gRNA
aagaagaaugaaugcuucuc

SEQ ID NO: 128773 - RNA, 20 nt, Artificial Sequence
  MKO10128773_B_Zfp943
  gRNA
cauacaaugcccucugagca

SEQ ID NO: 128774 - RNA, 20 nt, Artificial Sequence
  MKO10128774_B_Zfp943
  gRNA
uagcucuguaagauguacuu

SEQ ID NO: 128775 - RNA, 20 nt, Artificial Sequence
  MKO10128775_B_Zfp944
  gRNA
aagaagaauggauguuuccc

SEQ ID NO: 128776 - RNA, 20 nt, Artificial Sequence
  MKO10128776_B_Zfp944
  gRNA
acagggucaguuaacauuca

SEQ ID NO: 128777 - RNA, 20 nt, Artificial Sequence
  MKO10128777_B_Zfp944
  gRNA
cguggcuguggacuucucac

SEQ ID NO: 128778 - RNA, 20 nt, Artificial Sequence
  MKO10128778_B_Zfp945
  gRNA
auaggaacuguuaacauuca

SEQ ID NO: 128779 - RNA, 20 nt, Artificial Sequence
  MKO10128779_B_Zfp945
  gRNA
acccuggauggugaagagag

SEQ ID NO: 128780 - RNA, 20 nt, Artificial Sequence
  MKO10128780_B_Zfp945
  gRNA
aagaagaaugacagcuucuu

SEQ ID NO: 128781 - RNA, 20 nt, Artificial Sequence
  MKO10128781_B_Zfp946
  gRNA
uucucugcuaaauguuucca

SEQ ID NO: 128782 - RNA, 20 nt, Artificial Sequence
  MKO10128782_B_Zfp946
  gRNA
cguggcuguggaauucucac

SEQ ID NO: 128783 - RNA, 20 nt, Artificial Sequence
  MKO10128783_B_Zfp946
  gRNA
aagcuaaacagacauagaac

SEQ ID NO: 128784 - RNA, 20 nt, Artificial Sequence
  MKO10128784_B_Zfp947
  gRNA
cguggcuaugcacuucucac

SEQ ID NO: 128785 - RNA, 20 nt, Artificial Sequence
  MKO10128785_B_Zfp947
  gRNA
uucucuccuaaaugcuccuc

SEQ ID NO: 128786 - RNA, 20 nt, Artificial Sequence
  MKO10128786_B_Zfp947
  gRNA
cacugaccugaggagcauuu

SEQ ID NO: 128787 - RNA, 20 nt, Artificial Sequence
  MKO10128787_B_Zfp948
  gRNA
uuuguacauugacgugaugg

SEQ ID NO: 128788 - RNA, 20 nt, Artificial Sequence
  MKO10128788_B_Zfp948
  gRNA
aucuccaguaaacaugucca

SEQ ID NO: 128789 - RNA, 20 nt, Artificial Sequence
  MKO10128789_B_Zfp948
  gRNA
cugaccuuggacauguuuac

SEQ ID NO: 128790 - RNA, 20 nt, Artificial Sequence
  MKO10128790_B_Zfp949
  gRNA
acgcucagaagaugcuguac

SEQ ID NO: 128791 - RNA, 20 nt, Artificial Sequence
  MKO10128791_B_Zfp949
  gRNA
ccugcaaacaagacucugcc

SEQ ID NO: 128792 - RNA, 20 nt, Artificial Sequence
  MKO10128792_B_Zfp949
  gRNA
ccuggcagagucuuguuugc

SEQ ID NO: 128793 - RNA, 20 nt, Artificial Sequence
  MKO10128793_B_Zfp94
  gRNA
cguggccguggucuucagug

SEQ ID NO: 128794 - RNA, 20 nt, Artificial Sequence
  MKO10128794_B_Zfp94
  gRNA
cuccuccucacugaagacca

SEQ ID NO: 128795 - RNA, 20 nt, Artificial Sequence
  MKO10128795_B_Zfp94
  gRNA
gaguauggagacccgacuaa

SEQ ID NO: 128796 - RNA, 20 nt, Artificial Sequence
  MKO10128796_B_Zfp951
  gRNA
cuagaaugcagugacauaug

SEQ ID NO: 128797 - RNA, 20 nt, Artificial Sequence
  MKO10128797_B_Zfp951
  gRNA
cagucuuaccuauagcucug

SEQ ID NO: 128798 - RNA, 20 nt, Artificial Sequence
  MKO10128798_B_Zfp951
  gRNA
ucucaaacuucuagaagaca

SEQ ID NO: 128799 - RNA, 20 nt, Artificial Sequence
  MKO10128799_B_Zfp952
  gRNA
gcaggagccugugaccuuug

SEQ ID NO: 128800 - RNA, 20 nt, Artificial Sequence
  MKO10128800_B_Zfp952
  gRNA
aagacaacuaccaaaaucuc

SEQ ID NO: 128801 - RNA, 20 nt, Artificial Sequence
  MKO10128801_B_Zfp952
  gRNA
uaugcaucaaaagcagagaa

SEQ ID NO: 128802 - RNA, 20 nt, Artificial Sequence
  MKO10128802_B_Zfp953
  gRNA
gcagacaucucuauguacuc

SEQ ID NO: 128803 - RNA, 20 nt, Artificial Sequence
  MKO10128803_B_Zfp953
  gRNA
uguuuccucuacgccauacc

SEQ ID NO: 128804 - RNA, 20 nt, Artificial Sequence
  MKO10128804_B_Zfp953
  gRNA
cuguauaauuuccacugagc

SEQ ID NO: 128805 - RNA, 20 nt, Artificial Sequence
  MKO10128805_B_Zfp954
  gRNA
gcagggcugcguguccuuug

SEQ ID NO: 128806 - RNA, 20 nt, Artificial Sequence
  MKO10128806_B_Zfp954
  gRNA
gauucaugauucaacucagg

SEQ ID NO: 128807 - RNA, 20 nt, Artificial Sequence
  MKO10128807_B_Zfp954
  gRNA
ccuguaccagacugugauga

SEQ ID NO: 128808 - RNA, 20 nt, Artificial Sequence
  MKO10128808_B_Zfp955a
  gRNA
cacagcuccagagaaacucg

SEQ ID NO: 128809 - RNA, 20 nt, Artificial Sequence
  MKO10128809_B_Zfp955a
  gRNA
uuaggguccagugaccuuug

SEQ ID NO: 128810 - RNA, 20 nt, Artificial Sequence
  MKO10128810_B_Zfp955a
  gRNA
gaugcaucggaagcagaaga

SEQ ID NO: 128811 - RNA, 20 nt, Artificial Sequence
  MKO10128811_B_Zfp955b
  gRNA
caaauuaccucaaguuucuc

SEQ ID NO: 128812 - RNA, 20 nt, Artificial Sequence
  MKO10128812_B_Zfp955b
  gRNA
cacagcuccagagaaacuug

SEQ ID NO: 128813 - RNA, 20 nt, Artificial Sequence
  MKO10128813_B_Zfp955b
  gRNA
gaugcaucggaagcagaaga

SEQ ID NO: 128814 - RNA, 20 nt, Artificial Sequence
  MKO10128814_B_Zfp956
  gRNA
cgugaggugcuaggcucucu

SEQ ID NO: 128815 - RNA, 20 nt, Artificial Sequence
  MKO10128815_B_Zfp956
  gRNA
cacucggggcagauuccagc

SEQ ID NO: 128816 - RNA, 20 nt, Artificial Sequence
  MKO10128816_B_Zfp956
  gRNA
cugguuccaggacuggcaua

SEQ ID NO: 128817 - RNA, 20 nt, Artificial Sequence
  MKO10128817_B_Zfp957
  gRNA
accccucccuauagcaacac

SEQ ID NO: 128818 - RNA, 20 nt, Artificial Sequence
  MKO10128818_B_Zfp957
  gRNA
cucuccccagcaacgaauuu

SEQ ID NO: 128819 - RNA, 20 nt, Artificial Sequence
  MKO10128819_B_Zfp957
  gRNA
ucggcacaaaagugcuucua

SEQ ID NO: 128820 - RNA, 20 nt, Artificial Sequence
  MKO10128820_B_Zfp958
  gRNA
cuaauauugacuccauuuau

SEQ ID NO: 128821 - RNA, 20 nt, Artificial Sequence
  MKO10128821_B_Zfp958
  gRNA
gaccuuugaugaugugcaug

SEQ ID NO: 128822 - RNA, 20 nt, Artificial Sequence
  MKO10128822_B_Zfp958
  gRNA
gaaaauguucuucaauaguu

SEQ ID NO: 128823 - RNA, 20 nt, Artificial Sequence
  MKO10128823_B_Zfp959
  gRNA
uuaggaugcaaugaccuaug

SEQ ID NO: 128824 - RNA, 20 nt, Artificial Sequence
  MKO10128824_B_Zfp959
  gRNA
ugucaaaguucuagaagaca

SEQ ID NO: 128825 - RNA, 20 nt, Artificial Sequence
  MKO10128825_B_Zfp959
  gRNA
uguagagugacucacucuau

SEQ ID NO: 128826 - RNA, 20 nt, Artificial Sequence
  MKO10128826_B_Zfp960
  gRNA
caaucuuaccuauggcagug

SEQ ID NO: 128827 - RNA, 20 nt, Artificial Sequence
  MKO10128827_B_Zfp960
  gRNA
agugacguacuaugaugucc

SEQ ID NO: 128828 - RNA, 20 nt, Artificial Sequence
  MKO10128828_B_Zfp960
  gRNA
cugucuucuaggcuauaacu

SEQ ID NO: 128829 - RNA, 20 nt, Artificial Sequence
  MKO10128829_B_Zfp961
  gRNA
gauaaagccuuuacgugccu

SEQ ID NO: 128830 - RNA, 20 nt, Artificial Sequence
  MKO10128830_B_Zfp961
  gRNA
ugcgcuuuacccaagaagag

SEQ ID NO: 128831 - RNA, 20 nt, Artificial Sequence
  MKO10128831_B_Zfp961
  gRNA
uacagaagucaaauuccuau

SEQ ID NO: 128832 - RNA, 20 nt, Artificial Sequence
  MKO10128832_B_Zfp963
  gRNA
augccuuauaggaaacagau

SEQ ID NO: 128833 - RNA, 20 nt, Artificial Sequence
  MKO10128833_B_Zfp963
  gRNA
uuaggccucagugagcuuug

SEQ ID NO: 128834 - RNA, 20 nt, Artificial Sequence
  MKO10128834_B_Zfp963
  gRNA
uaucauuaccuaucguagcg

SEQ ID NO: 128835 - RNA, 20 nt, Artificial Sequence
  MKO10128835_B_Zfp964
  gRNA
aguucucauguaccgcugaa

SEQ ID NO: 128836 - RNA, 20 nt, Artificial Sequence
  MKO10128836_B_Zfp964
  gRNA
gaagaccauuguauaaaucc

SEQ ID NO: 128837 - RNA, 20 nt, Artificial Sequence
  MKO10128837_B_Zfp964
  gRNA
uacaauggucuuccaaguuc

SEQ ID NO: 128838 - RNA, 20 nt, Artificial Sequence
  MKO10128838_B_Zfp97
  gRNA
caaucuuaccuauggcagug

SEQ ID NO: 128839 - RNA, 20 nt, Artificial Sequence
  MKO10128839_B_Zfp97
  gRNA
agugacguacuaugaugucc

SEQ ID NO: 128840 - RNA, 20 nt, Artificial Sequence
  MKO10128840_B_Zfp97
  gRNA
cugucuucuaggcuauaacu

SEQ ID NO: 128841 - RNA, 20 nt, Artificial Sequence
  MKO10128841_B_Zfp9
  gRNA
aucauuaacagguuaucgug

SEQ ID NO: 128842 - RNA, 20 nt, Artificial Sequence
  MKO10128842_B_Zfp9
  gRNA
cucagggacccgugacauua

SEQ ID NO: 128843 - RNA, 20 nt, Artificial Sequence
  MKO10128843_B_Zfp9
  gRNA
agccuguugcuccugauguu

SEQ ID NO: 128844 - RNA, 20 nt, Artificial Sequence
  MKO10128844_B_Zfpl1
  gRNA
ccaccacuuaccauuaaagc

SEQ ID NO: 128845 - RNA, 20 nt, Artificial Sequence
  MKO10128845_B_Zfpl1
  gRNA
ugcgccugcuuucuauagcc

SEQ ID NO: 128846 - RNA, 20 nt, Artificial Sequence
  MKO10128846_B_Zfpl1
  gRNA
ccugcaggcgcuguguuucg

SEQ ID NO: 128847 - RNA, 20 nt, Artificial Sequence
  MKO10128847_B_Zfpm1
  gRNA
cuugggggcuccucuauggc

SEQ ID NO: 128848 - RNA, 20 nt, Artificial Sequence
  MKO10128848_B_Zfpm1
  gRNA
cggcuucuucaguuaggacc

SEQ ID NO: 128849 - RNA, 20 nt, Artificial Sequence
  MKO10128849_B_Zfpm1
  gRNA
uggaugagagcugcuggcua

SEQ ID NO: 128850 - RNA, 20 nt, Artificial Sequence
  MKO10128850_B_Zfpm2
  gRNA
ggacuugaacaauaauuccu

SEQ ID NO: 128851 - RNA, 20 nt, Artificial Sequence
  MKO10128851_B_Zfpm2
  gRNA
ugcugacugcugguccuaaa

SEQ ID NO: 128852 - RNA, 20 nt, Artificial Sequence
  MKO10128852_B_Zfpm2
  gRNA
gucacauccagaagccauuu

SEQ ID NO: 128853 - RNA, 20 nt, Artificial Sequence
  MKO10128853_B_Zfr2
  gRNA
uccccucaugugcgcagcau

SEQ ID NO: 128854 - RNA, 20 nt, Artificial Sequence
  MKO10128854_B_Zfr2
  gRNA
uggucacagcuaccgagaga

SEQ ID NO: 128855 - RNA, 20 nt, Artificial Sequence
  MKO10128855_B_Zfr2
  gRNA
uaccuggugggcggaugcag

SEQ ID NO: 128856 - RNA, 20 nt, Artificial Sequence
  MKO10128856_B_Zfr
  gRNA
uuacuaucauaagcuacagc

SEQ ID NO: 128857 - RNA, 20 nt, Artificial Sequence
  MKO10128857_B_Zfr
  gRNA
auacucaagcgcagcaagcu

SEQ ID NO: 128858 - RNA, 20 nt, Artificial Sequence
  MKO10128858_B_Zfr
  gRNA
gaagaugccaaaauggcgac

SEQ ID NO: 128859 - RNA, 20 nt, Artificial Sequence
  MKO10128859_B_Zfx
  gRNA
acaauaguauucgcguuccc

SEQ ID NO: 128860 - RNA, 20 nt, Artificial Sequence
  MKO10128860_B_Zfx
  gRNA
cacuugcuguucaugcacug

SEQ ID NO: 128861 - RNA, 20 nt, Artificial Sequence
  MKO10128861_B_Zfx
  gRNA
gcuugcuuaguggaugaugc

SEQ ID NO: 128862 - RNA, 20 nt, Artificial Sequence
  MKO10128862_B_Zfy1
  gRNA
ccuagcaaagcagaucuuga

SEQ ID NO: 128863 - RNA, 20 nt, Artificial Sequence
  MKO10128863_B_Zfy1
  gRNA
gucagccagugauucucaaa

SEQ ID NO: 128864 - RNA, 20 nt, Artificial Sequence
  MKO10128864_B_Zfy1
  gRNA
ugacauauaaauguugacuc

SEQ ID NO: 128865 - RNA, 20 nt, Artificial Sequence
  MKO10128865_B_Zfy2
  gRNA
ccuagcaaaacagaucauga

SEQ ID NO: 128866 - RNA, 20 nt, Artificial Sequence
  MKO10128866_B_Zfy2
  gRNA
aagcugaagucacugaucag

SEQ ID NO: 128867 - RNA, 20 nt, Artificial Sequence
  MKO10128867_B_Zfy2
  gRNA
aguuucugacucugcauuca

SEQ ID NO: 128868 - RNA, 20 nt, Artificial Sequence
  MKO10128868_B_Zfyve16
  gRNA
cucugguuaccuucaacauu

SEQ ID NO: 128869 - RNA, 20 nt, Artificial Sequence
  MKO10128869_B_Zfyve16
  gRNA
gacuuaagacaagaaccacc

SEQ ID NO: 128870 - RNA, 20 nt, Artificial Sequence
  MKO10128870_B_Zfyve16
  gRNA
guaucugcaacuucaccauu

SEQ ID NO: 128871 - RNA, 20 nt, Artificial Sequence
  MKO10128871_B_Zfyve19
  gRNA
caaguucacccucuucaaga

SEQ ID NO: 128872 - RNA, 20 nt, Artificial Sequence
  MKO10128872_B_Zfyve19
  gRNA
cacucgccuccuucuugaag

SEQ ID NO: 128873 - RNA, 20 nt, Artificial Sequence
  MKO10128873_B_Zfyve19
  gRNA
cugucuuagcuucagcgcuc

SEQ ID NO: 128874 - RNA, 20 nt, Artificial Sequence
  MKO10128874_B_Zfyve1
  gRNA
gagcaggugaaguacucguc

SEQ ID NO: 128875 - RNA, 20 nt, Artificial Sequence
  MKO10128875_B_Zfyve1
  gRNA
ucaccuugcagguauagacg

SEQ ID NO: 128876 - RNA, 20 nt, Artificial Sequence
  MKO10128876_B_Zfyve1
  gRNA
aaaaugaacugugcgccauc

SEQ ID NO: 128877 - RNA, 20 nt, Artificial Sequence
  MKO10128877_B_Zfyve20
  gRNA
uauugacuucaacaacauag

SEQ ID NO: 128878 - RNA, 20 nt, Artificial Sequence
  MKO10128878_B_Zfyve20
  gRNA
uaugaaucauucaguuaugg

SEQ ID NO: 128879 - RNA, 20 nt, Artificial Sequence
  MKO10128879_B_Zfyve20
  gRNA
acugagacuucaaagauuag

SEQ ID NO: 128880 - RNA, 20 nt, Artificial Sequence
  MKO10128880_B_Zfyve21
  gRNA
ucguuacaggugcuugguuc

SEQ ID NO: 128881 - RNA, 20 nt, Artificial Sequence
  MKO10128881_B_Zfyve21
  gRNA
aagacgacaaaccauggucu

SEQ ID NO: 128882 - RNA, 20 nt, Artificial Sequence
  MKO10128882_B_Zfyve21
  gRNA
ucuggugaugaagucaaacu

SEQ ID NO: 128883 - RNA, 20 nt, Artificial Sequence
  MKO10128883_B_Zfyve26
  gRNA
cuuaccuuaaggauggucuc

SEQ ID NO: 128884 - RNA, 20 nt, Artificial Sequence
  MKO10128884_B_Zfyve26
  gRNA
cuccugacccagcccacgcg

SEQ ID NO: 128885 - RNA, 20 nt, Artificial Sequence
  MKO10128885_B_Zfyve26
  gRNA
ucaacccucagagauuagcc

SEQ ID NO: 128886 - RNA, 20 nt, Artificial Sequence
  MKO10128886_B_Zfyve27
  gRNA
ucgggaccugagugggccgg

SEQ ID NO: 128887 - RNA, 20 nt, Artificial Sequence
  MKO10128887_B_Zfyve27
  gRNA
aucccgcuggggcucgccuc

SEQ ID NO: 128888 - RNA, 20 nt, Artificial Sequence
  MKO10128888_B_Zfyve27
  gRNA
ccuuacccucguucaaagug

SEQ ID NO: 128889 - RNA, 20 nt, Artificial Sequence
  MKO10128889_B_Zfyve28
  gRNA
cagccaguuccgcuccuguc

SEQ ID NO: 128890 - RNA, 20 nt, Artificial Sequence
  MKO10128890_B_Zfyve28
  gRNA
aacuugacgcagaaaucccg

SEQ ID NO: 128891 - RNA, 20 nt, Artificial Sequence
  MKO10128891_B_Zfyve28
  gRNA
cagggaguacuaugugcagc

SEQ ID NO: 128892 - RNA, 20 nt, Artificial Sequence
  MKO10128892_B_Zfyve9
  gRNA
augaaccuuauuccugaaga

SEQ ID NO: 128893 - RNA, 20 nt, Artificial Sequence
  MKO10128893_B_Zfyve9
  gRNA
gugacagauuacacacacuc

SEQ ID NO: 128894 - RNA, 20 nt, Artificial Sequence
  MKO10128894_B_Zfyve9
  gRNA
auaguagaacaguauucagc

SEQ ID NO: 128895 - RNA, 20 nt, Artificial Sequence
  MKO10128895_B_Zg16
  gRNA
uagauucuauuagccugcac

SEQ ID NO: 128896 - RNA, 20 nt, Artificial Sequence
  MKO10128896_B_Zg16
  gRNA
ucacuuacuggaauuagcag

SEQ ID NO: 128897 - RNA, 20 nt, Artificial Sequence
  MKO10128897_B_Zg16
  gRNA
aggcacaaagaaggacuaag

SEQ ID NO: 128898 - RNA, 20 nt, Artificial Sequence
  MKO10128898_B_Zglp1
  gRNA
acaccccucugcaaugccug

SEQ ID NO: 128899 - RNA, 20 nt, Artificial Sequence
  MKO10128899_B_Zglp1
  gRNA
ccguuguuccaguugcuggc

SEQ ID NO: 128900 - RNA, 20 nt, Artificial Sequence
  MKO10128900_B_Zglp1
  gRNA
cccuccagguacaagaaaua

SEQ ID NO: 128901 - RNA, 20 nt, Artificial Sequence
  MKO10128901_B_Zgpau
  gRNA
agaagauugagcggacccaa

SEQ ID NO: 128902 - RNA, 20 nt, Artificial Sequence
  MKO10128902_B_Zgpau
  gRNA
gucccaguguccaccgugcu

SEQ ID NO: 128903 - RNA, 20 nt, Artificial Sequence
  MKO10128903_B_Zgpau
  gRNA
caugcuguaguguugccuag

SEQ ID NO: 128904 - RNA, 20 nt, Artificial Sequence
  MKO10128904_B_Zhx1
  gRNA
uccagaucuugagcugauau

SEQ ID NO: 128905 - RNA, 20 nt, Artificial Sequence
  MKO10128905_B_Zhx1
  gRNA
uccgugaacuucuucaucgc

SEQ ID NO: 128906 - RNA, 20 nt, Artificial Sequence
  MKO10128906_B_Zhx1
  gRNA
guuaucaccugugcuaaccc

SEQ ID NO: 128907 - RNA, 20 nt, Artificial Sequence
  MKO10128907_B_Zhx2
  gRNA
uuuggaggccgccgucagcc

SEQ ID NO: 128908 - RNA, 20 nt, Artificial Sequence
  MKO10128908_B_Zhx2
  gRNA
ccacgcuaccaagucuggcg

SEQ ID NO: 128909 - RNA, 20 nt, Artificial Sequence
  MKO10128909_B_Zhx2
  gRNA
agugaugggcacgacguggu

SEQ ID NO: 128910 - RNA, 20 nt, Artificial Sequence
  MKO10128910_B_Zhx3
  gRNA
gaaccacuuccgcaccucuc

SEQ ID NO: 128911 - RNA, 20 nt, Artificial Sequence
  MKO10128911_B_Zhx3
  gRNA
uaccgaguugacguccagac

SEQ ID NO: 128912 - RNA, 20 nt, Artificial Sequence
  MKO10128912_B_Zhx3
  gRNA
gcugccucgcugcucgcauc

SEQ ID NO: 128913 - RNA, 20 nt, Artificial Sequence
  MKO10128913_B_Zic1
  gRNA
acuuaucgcacaucuugcaa

SEQ ID NO: 128914 - RNA, 20 nt, Artificial Sequence
  MKO10128914_B_Zic1
  gRNA
cgacucauaccccgagcugg

SEQ ID NO: 128915 - RNA, 20 nt, Artificial Sequence
  MKO10128915_B_Zic1
  gRNA
gcgcgcuguggccggcugug

SEQ ID NO: 128916 - RNA, 20 nt, Artificial Sequence
  MKO10128916_B_Zic2
  gRNA
ugcugccagaacccgcgccu

SEQ ID NO: 128917 - RNA, 20 nt, Artificial Sequence
  MKO10128917_B_Zic2
  gRNA
gcuucgccaacagcagcgac

SEQ ID NO: 128918 - RNA, 20 nt, Artificial Sequence
  MKO10128918_B_Zic2
  gRNA
caugugcuuccgcaacgagc

SEQ ID NO: 128919 - RNA, 20 nt, Artificial Sequence
  MKO10128919_B_Zic3
  gRNA
ugcuaguuugaacugcagaa

SEQ ID NO: 128920 - RNA, 20 nt, Artificial Sequence
  MKO10128920_B_Zic3
  gRNA
ccuuucaaaugugaauucga

SEQ ID NO: 128921 - RNA, 20 nt, Artificial Sequence
  MKO10128921_B_Zic3
  gRNA
aggaaguccaggguuguggc

SEQ ID NO: 128922 - RNA, 20 nt, Artificial Sequence
  MKO10128922_B_Zic4
  gRNA
cucacggccgcuuucuaacg

SEQ ID NO: 128923 - RNA, 20 nt, Artificial Sequence
  MKO10128923_B_Zic4
  gRNA
gcgucgcccucguuagaaag

SEQ ID NO: 128924 - RNA, 20 nt, Artificial Sequence
  MKO10128924_B_Zic4
  gRNA
aaugaaauacaagacuuccc

SEQ ID NO: 128925 - RNA, 20 nt, Artificial Sequence
  MKO10128925_B_Zic5
  gRNA
ccuuucaaaugugaauuuga

SEQ ID NO: 128926 - RNA, 20 nt, Artificial Sequence
  MKO10128926_B_Zic5
  gRNA
ucacggcuccguagccgugc

SEQ ID NO: 128927 - RNA, 20 nt, Artificial Sequence
  MKO10128927_B_Zic5
  gRNA
ccggagggaccuuuccgcca

SEQ ID NO: 128928 - RNA, 20 nt, Artificial Sequence
  MKO10128928_B_Zik1
  gRNA
aguucugcagcauaacacug

SEQ ID NO: 128929 - RNA, 20 nt, Artificial Sequence
  MKO10128929_B_Zik1
  gRNA
cauauccauuucugcaguca

SEQ ID NO: 128930 - RNA, 20 nt, Artificial Sequence
  MKO10128930_B_Zik1
  gRNA
gguguccaugacugcagaaa

SEQ ID NO: 128931 - RNA, 20 nt, Artificial Sequence
  MKO10128931_B_Zim1
  gRNA
gccaaagagaacgauguucc

SEQ ID NO: 128932 - RNA, 20 nt, Artificial Sequence
  MKO10128932_B_Zim1
  gRNA
uggcuuaccuuguaccaggu

SEQ ID NO: 128933 - RNA, 20 nt, Artificial Sequence
  MKO10128933_B_Zim1
  gRNA
ucaagccaaaguugaucacc

SEQ ID NO: 128934 - RNA, 20 nt, Artificial Sequence
  MKO10128934_B_Zkscan14
  gRNA
cugaagcacuccccgcauuc

SEQ ID NO: 128935 - RNA, 20 nt, Artificial Sequence
  MKO10128935_B_Zkscan14
  gRNA
auguggcugaaucucugacc

SEQ ID NO: 128936 - RNA, 20 nt, Artificial Sequence
  MKO10128936_B_Zkscan14
  gRNA
agauucagccacauccuuga

SEQ ID NO: 128937 - RNA, 20 nt, Artificial Sequence
  MKO10128937_B_Zkscan16
  gRNA
uuccgcaguuugcaaagagg

SEQ ID NO: 128938 - RNA, 20 nt, Artificial Sequence
  MKO10128938_B_Zkscan16
  gRNA
aucucaaagagagcuauaua

SEQ ID NO: 128939 - RNA, 20 nt, Artificial Sequence
  MKO10128939_B_Zkscan16
  gRNA
agcagacuuacacguggcuc

SEQ ID NO: 128940 - RNA, 20 nt, Artificial Sequence
  MKO10128940_B_Zkscan17
  gRNA
ucgccaucgucaaucaccac

SEQ ID NO: 128941 - RNA, 20 nt, Artificial Sequence
  MKO10128941_B_Zkscan17
  gRNA
gaaccgagucuccccauuua

SEQ ID NO: 128942 - RNA, 20 nt, Artificial Sequence
  MKO10128942_B_Zkscan17
  gRNA
ugcacaacgaacgcaucuug

SEQ ID NO: 128943 - RNA, 20 nt, Artificial Sequence
  MKO10128943_B_Zkscan1
  gRNA
acuauugaccgcagauuccc

SEQ ID NO: 128944 - RNA, 20 nt, Artificial Sequence
  MKO10128944_B_Zkscan1
  gRNA
uguuauuaaaguuugcgcuc

SEQ ID NO: 128945 - RNA, 20 nt, Artificial Sequence
  MKO10128945_B_Zkscan1
  gRNA
auagugcagaugccaucgcc

SEQ ID NO: 128946 - RNA, 20 nt, Artificial Sequence
  MKO10128946_B_Zkscan2
  gRNA
cauaggccauuaccuaagaa

SEQ ID NO: 128947 - RNA, 20 nt, Artificial Sequence
  MKO10128947_B_Zkscan2
  gRNA
cgaugaggaagugacaaccc

SEQ ID NO: 128948 - RNA, 20 nt, Artificial Sequence
  MKO10128948_B_Zkscan2
  gRNA
uuccugucccuagugaugag

SEQ ID NO: 128949 - RNA, 20 nt, Artificial Sequence
  MKO10128949_B_Zkscan3
  gRNA
gcaggaacuccuuugcucca

SEQ ID NO: 128950 - RNA, 20 nt, Artificial Sequence
  MKO10128950_B_Zkscan3
  gRNA
ugaauccugcucuguccauc

SEQ ID NO: 128951 - RNA, 20 nt, Artificial Sequence
  MKO10128951_B_Zkscan3
  gRNA
cagaugaaccucuacaaaga

SEQ ID NO: 128952 - RNA, 20 nt, Artificial Sequence
  MKO10128952_B_Zkscan4
  gRNA
cuucugcagaccgagcguuu

SEQ ID NO: 128953 - RNA, 20 nt, Artificial Sequence
  MKO10128953_B_Zkscan4
  gRNA
uucacagcaaaagugccgcc

SEQ ID NO: 128954 - RNA, 20 nt, Artificial Sequence
  MKO10128954_B_Zkscan4
  gRNA
gagcuucaacaucuuccccc

SEQ ID NO: 128955 - RNA, 20 nt, Artificial Sequence
  MKO10128955_B_Zkscan5
  gRNA
cucuaaguguauaacugccc

SEQ ID NO: 128956 - RNA, 20 nt, Artificial Sequence
  MKO10128956_B_Zkscan5
  gRNA
cggcgaagucagcgaccuga

SEQ ID NO: 128957 - RNA, 20 nt, Artificial Sequence
  MKO10128957_B_Zkscan5
  gRNA
agcuggcugagagcaucgcg

SEQ ID NO: 128958 - RNA, 20 nt, Artificial Sequence
  MKO10128958_B_Zkscan6
  gRNA
gucaaauucuccuucucgaa

SEQ ID NO: 128959 - RNA, 20 nt, Artificial Sequence
  MKO10128959_B_Zkscan6
  gRNA
cucacuggaaguggcaccuc

SEQ ID NO: 128960 - RNA, 20 nt, Artificial Sequence
  MKO10128960_B_Zkscan6
  gRNA
guuccuucugaguagaaucc

SEQ ID NO: 128961 - RNA, 20 nt, Artificial Sequence
  MKO10128961_B_Zkscan7
  gRNA
gguaagagaugagcacggcc

SEQ ID NO: 128962 - RNA, 20 nt, Artificial Sequence
  MKO10128962_B_Zkscan7
  gRNA
ggaggaucuaagagugcacc

SEQ ID NO: 128963 - RNA, 20 nt, Artificial Sequence
  MKO10128963_B_Zkscan7
  gRNA
caagcccugauuggagguug

SEQ ID NO: 128964 - RNA, 20 nt, Artificial Sequence
  MKO10128964_B_Zkscan8
  gRNA
aaggauuguacgugaauacu

SEQ ID NO: 128965 - RNA, 20 nt, Artificial Sequence
  MKO10128965_B_Zkscan8
  gRNA
agcuacuuacuggccgcccu

SEQ ID NO: 128966 - RNA, 20 nt, Artificial Sequence
  MKO10128966_B_Zkscan8
  gRNA
auacagaaacauguucuccc

SEQ ID NO: 128967 - RNA, 20 nt, Artificial Sequence
  MKO10128967_B_Zmau1
  gRNA
guuauugugaagccuccucc

SEQ ID NO: 128968 - RNA, 20 nt, Artificial Sequence
  MKO10128968_B_Zmau1
  gRNA
gcuucacaauaacagacuuc

SEQ ID NO: 128969 - RNA, 20 nt, Artificial Sequence
  MKO10128969_B_Zmau1
  gRNA
aacaaagcgaagugccuggu

SEQ ID NO: 128970 - RNA, 20 nt, Artificial Sequence
  MKO10128970_B_Zmau2
  gRNA
agaugaauaugagaagcucg

SEQ ID NO: 128971 - RNA, 20 nt, Artificial Sequence
  MKO10128971_B_Zmau2
  gRNA
aaccagugcagccugucaag

SEQ ID NO: 128972 - RNA, 20 nt, Artificial Sequence
  MKO10128972_B_Zmau2
  gRNA
cccccuacagacaaaaaacu

SEQ ID NO: 128973 - RNA, 20 nt, Artificial Sequence
  MKO10128973_B_Zmau3
  gRNA
ccaugccaagagacuccguc

SEQ ID NO: 128974 - RNA, 20 nt, Artificial Sequence
  MKO10128974_B_Zmau3
  gRNA
uuucaccagggacuccgcag

SEQ ID NO: 128975 - RNA, 20 nt, Artificial Sequence
  MKO10128975_B_Zmau3
  gRNA
ccagacggagucucuuggca

SEQ ID NO: 128976 - RNA, 20 nt, Artificial Sequence
  MKO10128976_B_Zmau4
  gRNA
uguauuacaugcuucacccc

SEQ ID NO: 128977 - RNA, 20 nt, Artificial Sequence
  MKO10128977_B_Zmau4
  gRNA
aaggcaaaauccacgccaaa

SEQ ID NO: 128978 - RNA, 20 nt, Artificial Sequence
  MKO10128978_B_Zmau4
  gRNA
ggugaagcauguaauacagc

SEQ ID NO: 128979 - RNA, 20 nt, Artificial Sequence
  MKO10128979_B_Zmau5
  gRNA
gacaguacggaccacccucc

SEQ ID NO: 128980 - RNA, 20 nt, Artificial Sequence
  MKO10128980_B_Zmau5
  gRNA
caugucagaacaagaucugc

SEQ ID NO: 128981 - RNA, 20 nt, Artificial Sequence
  MKO10128981_B_Zmau5
  gRNA
ccguacuguccaaaguccag

SEQ ID NO: 128982 - RNA, 20 nt, Artificial Sequence
  MKO10128982_B_Zmiz1
  gRNA
gagacccucgagccuuccag

SEQ ID NO: 128983 - RNA, 20 nt, Artificial Sequence
  MKO10128983_B_Zmiz1
  gRNA
ucaccgucaggcagcccaug

SEQ ID NO: 128984 - RNA, 20 nt, Artificial Sequence
  MKO10128984_B_Zmiz1
  gRNA
cucccucuccguggucacca

SEQ ID NO: 128985 - RNA, 20 nt, Artificial Sequence
  MKO10128985_B_Zmiz2
  gRNA
cuccugcagggcagccaccg

SEQ ID NO: 128986 - RNA, 20 nt, Artificial Sequence
  MKO10128986_B_Zmiz2
  gRNA
accacagacagugacccagc

SEQ ID NO: 128987 - RNA, 20 nt, Artificial Sequence
  MKO10128987_B_Zmiz2
  gRNA
agcaagagcuacguacagca

SEQ ID NO: 128988 - RNA, 20 nt, Artificial Sequence
  MKO10128988_B_Zmpste24
  gRNA
aacaacuaaugugaacagcc

SEQ ID NO: 128989 - RNA, 20 nt, Artificial Sequence
  MKO10128989_B_Zmpste24
  gRNA
acugcccagaaagucuccag

SEQ ID NO: 128990 - RNA, 20 nt, Artificial Sequence
  MKO10128990_B_Zmpste24
  gRNA
aaaaguauuguacagacucc

SEQ ID NO: 128991 - RNA, 20 nt, Artificial Sequence
  MKO10128991_B_Zmym1
  gRNA
aguaaauaaucauguugacc

SEQ ID NO: 128992 - RNA, 20 nt, Artificial Sequence
  MKO10128992_B_Zmym1
  gRNA
acgcucaugaugacaucugu

SEQ ID NO: 128993 - RNA, 20 nt, Artificial Sequence
  MKO10128993_B_Zmym1
  gRNA
gaagaucuaaguauucuggg

SEQ ID NO: 128994 - RNA, 20 nt, Artificial Sequence
  MKO10128994_B_Zmym2
  gRNA
cugcuuuaacagauaccgaa

SEQ ID NO: 128995 - RNA, 20 nt, Artificial Sequence
  MKO10128995_B_Zmym2
  gRNA
gcaauucauuaucagaccau

SEQ ID NO: 128996 - RNA, 20 nt, Artificial Sequence
  MKO10128996_B_Zmym2
  gRNA
uagccauccaagcuuccuga

SEQ ID NO: 128997 - RNA, 20 nt, Artificial Sequence
  MKO10128997_B_Zmym3
  gRNA
uaugcugcagcgaguggcau

SEQ ID NO: 128998 - RNA, 20 nt, Artificial Sequence
  MKO10128998_B_Zmym3
  gRNA
auccuacuuacugcucucag

SEQ ID NO: 128999 - RNA, 20 nt, Artificial Sequence
  MKO10128999_B_Zmym3
  gRNA
uccacaaccucaggcuuugg

SEQ ID NO: 129000 - RNA, 20 nt, Artificial Sequence
  MKO10129000_B_Zmym4
  gRNA
cuuaucaugaacgugaaaaa

SEQ ID NO: 129001 - RNA, 20 nt, Artificial Sequence
  MKO10129001_B_Zmym4
  gRNA
cuuacccuaaaguuuguuuc

SEQ ID NO: 129002 - RNA, 20 nt, Artificial Sequence
  MKO10129002_B_Zmym4
  gRNA
aaaacccagaaacaaacuuu

SEQ ID NO: 129003 - RNA, 20 nt, Artificial Sequence
  MKO10129003_B_Zmym5
  gRNA
ucccgguaggaucgauguca

SEQ ID NO: 129004 - RNA, 20 nt, Artificial Sequence
  MKO10129004_B_Zmym5
  gRNA
uuugcaguucaucacaaucc

SEQ ID NO: 129005 - RNA, 20 nt, Artificial Sequence
  MKO10129005_B_Zmym5
  gRNA
uauauucgucagcacaauuc

SEQ ID NO: 129006 - RNA, 20 nt, Artificial Sequence
  MKO10129006_B_Zmym6
  gRNA
cccgaagccacucuaugccu

SEQ ID NO: 129007 - RNA, 20 nt, Artificial Sequence
  MKO10129007_B_Zmym6
  gRNA
guuguuaccauauauaccag

SEQ ID NO: 129008 - RNA, 20 nt, Artificial Sequence
  MKO10129008_B_Zmym6
  gRNA
cuuaccgagagaagugucac

SEQ ID NO: 129009 - RNA, 20 nt, Artificial Sequence
  MKO10129009_B_Zmynd10
  gRNA
cuugcauagggguacugucc

SEQ ID NO: 129010 - RNA, 20 nt, Artificial Sequence
  MKO10129010_B_Zmynd10
  gRNA
ucuucgacagguacaccaug

SEQ ID NO: 129011 - RNA, 20 nt, Artificial Sequence
  MKO10129011_B_Zmynd10
  gRNA
caugguugauuagcaguucc

SEQ ID NO: 129012 - RNA, 20 nt, Artificial Sequence
  MKO10129012_B_Zmynd11
  gRNA
ugacgucccuaccauacaag

SEQ ID NO: 129013 - RNA, 20 nt, Artificial Sequence
  MKO10129013_B_Zmynd11
  gRNA
agguauaugucccgagucca

SEQ ID NO: 129014 - RNA, 20 nt, Artificial Sequence
  MKO10129014_B_Zmynd11
  gRNA
cauguuaccucuuguauggu

SEQ ID NO: 129015 - RNA, 20 nt, Artificial Sequence
  MKO10129015_B_Zmynd12
  gRNA
cgcuuccgcaugaacgugca

SEQ ID NO: 129016 - RNA, 20 nt, Artificial Sequence
  MKO10129016_B_Zmynd12
  gRNA
cagugguccugugcaucaga

SEQ ID NO: 129017 - RNA, 20 nt, Artificial Sequence
  MKO10129017_B_Zmynd12
  gRNA
caugcccuucuacaacucag

SEQ ID NO: 129018 - RNA, 20 nt, Artificial Sequence
  MKO10129018_B_Zmynd15
  gRNA
aagccccgacagcuuaccgu

SEQ ID NO: 129019 - RNA, 20 nt, Artificial Sequence
  MKO10129019_B_Zmynd15
  gRNA
augacgugagccaccgauuc

SEQ ID NO: 129020 - RNA, 20 nt, Artificial Sequence
  MKO10129020_B_Zmynd15
  gRNA
cgucuccuacgguaagcugu

SEQ ID NO: 129021 - RNA, 20 nt, Artificial Sequence
  MKO10129021_B_Zmynd19
  gRNA
gaagacccaccuuuguuugc

SEQ ID NO: 129022 - RNA, 20 nt, Artificial Sequence
  MKO10129022_B_Zmynd19
  gRNA
cucaucgaucaguguguauu

SEQ ID NO: 129023 - RNA, 20 nt, Artificial Sequence
  MKO10129023_B_Zmynd19
  gRNA
aggauaaugacacucauagu

SEQ ID NO: 129024 - RNA, 20 nt, Artificial Sequence
  MKO10129024_B_Zmynd8
  gRNA
uggaugagucuuggggcgaa

SEQ ID NO: 129025 - RNA, 20 nt, Artificial Sequence
  MKO10129025_B_Zmynd8
  gRNA
cagguaggacaguuguucaa

SEQ ID NO: 129026 - RNA, 20 nt, Artificial Sequence
  MKO10129026_B_Zmynd8
  gRNA
auuccagaagccuguuccau

SEQ ID NO: 129027 - RNA, 20 nt, Artificial Sequence
  MKO10129027_B_Znf512b
  gRNA
gggccguaugcuccauucuc

SEQ ID NO: 129028 - RNA, 20 nt, Artificial Sequence
  MKO10129028_B_Znf512b
  gRNA
cccagggugcuaucucagau

SEQ ID NO: 129029 - RNA, 20 nt, Artificial Sequence
  MKO10129029_B_Znf512b
  gRNA
ccacugaguacagauccuag

SEQ ID NO: 129030 - RNA, 20 nt, Artificial Sequence
  MKO10129030_B_Znfx1
  gRNA
uccgcccacucgcacaaugc

SEQ ID NO: 129031 - RNA, 20 nt, Artificial Sequence
  MKO10129031_B_Znfx1
  gRNA
ccucaugagugggcccgugc

SEQ ID NO: 129032 - RNA, 20 nt, Artificial Sequence
  MKO10129032_B_Znfx1
  gRNA
cucccgaaggacaccgugca

SEQ ID NO: 129033 - RNA, 20 nt, Artificial Sequence
  MKO10129033_B_Znhit1
  gRNA
gacgcuggggccgagauggg

SEQ ID NO: 129034 - RNA, 20 nt, Artificial Sequence
  MKO10129034_B_Znhit1
  gRNA
accacuuuaaacuucgcuuc

SEQ ID NO: 129035 - RNA, 20 nt, Artificial Sequence
  MKO10129035_B_Znhit1
  gRNA
uccggaagcgaaguuuaaag

SEQ ID NO: 129036 - RNA, 20 nt, Artificial Sequence
  MKO10129036_B_Znhit2
  gRNA
gcgguaaaagucuucggcgc

SEQ ID NO: 129037 - RNA, 20 nt, Artificial Sequence
  MKO10129037_B_Znhit2
  gRNA
agcguaggcgaacagcacgu

SEQ ID NO: 129038 - RNA, 20 nt, Artificial Sequence
  MKO10129038_B_Znhit2
  gRNA
ugccgcgaacagagaucuug

SEQ ID NO: 129039 - RNA, 20 nt, Artificial Sequence
  MKO10129039_B_Znhit3
  gRNA
uugcucuccucagaccucac

SEQ ID NO: 129040 - RNA, 20 nt, Artificial Sequence
  MKO10129040_B_Znhit3
  gRNA
ugauuuccucaacagugaug

SEQ ID NO: 129041 - RNA, 20 nt, Artificial Sequence
  MKO10129041_B_Znhit3
  gRNA
accuuugugcuucugaaaac

SEQ ID NO: 129042 - RNA, 20 nt, Artificial Sequence
  MKO10129042_B_Znhit6
  gRNA
cguggcaagaacggcagaca

SEQ ID NO: 129043 - RNA, 20 nt, Artificial Sequence
  MKO10129043_B_Znhit6
  gRNA
caggaaaagcgcaugcagcg

SEQ ID NO: 129044 - RNA, 20 nt, Artificial Sequence
  MKO10129044_B_Znhit6
  gRNA
ucuuacaggugugagacuug

SEQ ID NO: 129045 - RNA, 20 nt, Artificial Sequence
  MKO10129045_B_Znrd1as
  gRNA
accaggaucuucuucuccag

SEQ ID NO: 129046 - RNA, 20 nt, Artificial Sequence
  MKO10129046_B_Znrd1as
  gRNA
agaaggccagcagucuccac

SEQ ID NO: 129047 - RNA, 20 nt, Artificial Sequence
  MKO10129047_B_Znrd1as
  gRNA
aacaucuacuuuaauccuac

SEQ ID NO: 129048 - RNA, 20 nt, Artificial Sequence
  MKO10129048_B_Znrd1
  gRNA
gacaggcgcugcccucgaug

SEQ ID NO: 129049 - RNA, 20 nt, Artificial Sequence
  MKO10129049_B_Znrd1
  gRNA
accacuggucccuguaauuc

SEQ ID NO: 129050 - RNA, 20 nt, Artificial Sequence
  MKO10129050_B_Znrd1
  gRNA
cagcuuguugaacacuacug

SEQ ID NO: 129051 - RNA, 20 nt, Artificial Sequence
  MKO10129051_B_Znrf1
  gRNA
ccccauuuguuccaagucug

SEQ ID NO: 129052 - RNA, 20 nt, Artificial Sequence
  MKO10129052_B_Znrf1
  gRNA
gccugugcaucuaucacaaa

SEQ ID NO: 129053 - RNA, 20 nt, Artificial Sequence
  MKO10129053_B_Znrf1
  gRNA
acuccagcugcauagacuca

SEQ ID NO: 129054 - RNA, 20 nt, Artificial Sequence
  MKO10129054_B_Znrf2
  gRNA
aagccaagaauaacguauaa

SEQ ID NO: 129055 - RNA, 20 nt, Artificial Sequence
  MKO10129055_B_Znrf2
  gRNA
ugccuguguauauaucauaa

SEQ ID NO: 129056 - RNA, 20 nt, Artificial Sequence
  MKO10129056_B_Znrf2
  gRNA
acccuuuaugauauauacac

SEQ ID NO: 129057 - RNA, 20 nt, Artificial Sequence
  MKO10129057_B_Znrf3
  gRNA
gucucuuagaugcacccacu

SEQ ID NO: 129058 - RNA, 20 nt, Artificial Sequence
  MKO10129058_B_Znrf3
  gRNA
aaauccagaagccaucgacc

SEQ ID NO: 129059 - RNA, 20 nt, Artificial Sequence
  MKO10129059_B_Znrf3
  gRNA
agcagaaaguagcucgagca

SEQ ID NO: 129060 - RNA, 20 nt, Artificial Sequence
  MKO10129060_B_Znrf4
  gRNA
ucggggcaggguuccgcgug

SEQ ID NO: 129061 - RNA, 20 nt, Artificial Sequence
  MKO10129061_B_Znrf4
  gRNA
cagcacgaacagcguagaug

SEQ ID NO: 129062 - RNA, 20 nt, Artificial Sequence
  MKO10129062_B_Znrf4
  gRNA
caucuacgcuguucgugcug

SEQ ID NO: 129063 - RNA, 20 nt, Artificial Sequence
  MKO10129063_B_Zp1
  gRNA
agcggugccagguagccucc

SEQ ID NO: 129064 - RNA, 20 nt, Artificial Sequence
  MKO10129064_B_Zp1
  gRNA
ggggcauccguugggggcau

SEQ ID NO: 129065 - RNA, 20 nt, Artificial Sequence
  MKO10129065_B_Zp1
  gRNA
uccuuaccuucucuagaacg

SEQ ID NO: 129066 - RNA, 20 nt, Artificial Sequence
  MKO10129066_B_Zp2
  gRNA
uuugaacugcacuuaugcuc

SEQ ID NO: 129067 - RNA, 20 nt, Artificial Sequence
  MKO10129067_B_Zp2
  gRNA
uacuacauacccaccacaga

SEQ ID NO: 129068 - RNA, 20 nt, Artificial Sequence
  MKO10129068_B_Zp2
  gRNA
aaaauggaauccuucugugg

SEQ ID NO: 129069 - RNA, 20 nt, Artificial Sequence
  MKO10129069_B_Zp3r
  gRNA
cuacagagccaaacguguac

SEQ ID NO: 129070 - RNA, 20 nt, Artificial Sequence
  MKO10129070_B_Zp3r
  gRNA
ugacucucuugaagccguga

SEQ ID NO: 129071 - RNA, 20 nt, Artificial Sequence
  MKO10129071_B_Zp3r
  gRNA
gagucaacaaccuucccauc

SEQ ID NO: 129072 - RNA, 20 nt, Artificial Sequence
  MKO10129072_B_Zp3
  gRNA
gaggaguucgggucuggcaa

SEQ ID NO: 129073 - RNA, 20 nt, Artificial Sequence
  MKO10129073_B_Zp3
  gRNA
ggaauacauccaccgugaac

SEQ ID NO: 129074 - RNA, 20 nt, Artificial Sequence
  MKO10129074_B_Zp3
  gRNA
ggcuuucucucuucgccuga

SEQ ID NO: 129075 - RNA, 20 nt, Artificial Sequence
  MKO10129075_B_Zpbp2
  gRNA
gggguccacuguuucuuuau

SEQ ID NO: 129076 - RNA, 20 nt, Artificial Sequence
  MKO10129076_B_Zpbp2
  gRNA
cuaaaucuuaggcgagagau

SEQ ID NO: 129077 - RNA, 20 nt, Artificial Sequence
  MKO10129077_B_Zpbp2
  gRNA
accccaccuauuuauggacu

SEQ ID NO: 129078 - RNA, 20 nt, Artificial Sequence
  MKO10129078_B_Zpbp
  gRNA
cuuaaucaaggauauuucac

SEQ ID NO: 129079 - RNA, 20 nt, Artificial Sequence
  MKO10129079_B_Zpbp
  gRNA
ucagugaaucuugagucaag

SEQ ID NO: 129080 - RNA, 20 nt, Artificial Sequence
  MKO10129080_B_Zpbp
  gRNA
acugcacaagugaccuccac

SEQ ID NO: 129081 - RNA, 20 nt, Artificial Sequence
  MKO10129081_B_Zpld1
  gRNA
uaauagguguccacaauucc

SEQ ID NO: 129082 - RNA, 20 nt, Artificial Sequence
  MKO10129082_B_Zpld1
  gRNA
uuucugaauaucccgagaaa

SEQ ID NO: 129083 - RNA, 20 nt, Artificial Sequence
  MKO10129083_B_Zpld1
  gRNA
aaaauuaaucuucaucguaa

SEQ ID NO: 129084 - RNA, 20 nt, Artificial Sequence
  MKO10129084_B_Zranb1
  gRNA
augacaaagacucggugcuu

SEQ ID NO: 129085 - RNA, 20 nt, Artificial Sequence
  MKO10129085_B_Zranb1
  gRNA
cugaacugacagagcaaauc

SEQ ID NO: 129086 - RNA, 20 nt, Artificial Sequence
  MKO10129086_B_Zranb1
  gRNA
guaacauuuacauuaccagc

SEQ ID NO: 129087 - RNA, 20 nt, Artificial Sequence
  MKO10129087_B_Zranb2
  gRNA
ucccccagcuuucaucaucu

SEQ ID NO: 129088 - RNA, 20 nt, Artificial Sequence
  MKO10129088_B_Zranb2
  gRNA
ucgaccacaucuguuacagc

SEQ ID NO: 129089 - RNA, 20 nt, Artificial Sequence
  MKO10129089_B_Zranb2
  gRNA
ucuucuaauuuagcauacuu

SEQ ID NO: 129090 - RNA, 20 nt, Artificial Sequence
  MKO10129090_B_Zranb3
  gRNA
cacugaacacgcagaacuuc

SEQ ID NO: 129091 - RNA, 20 nt, Artificial Sequence
  MKO10129091_B_Zranb3
  gRNA
ucccacaaaaauuuggaacu

SEQ ID NO: 129092 - RNA, 20 nt, Artificial Sequence
  MKO10129092_B_Zranb3
  gRNA
augacgacauugauuuccuc

SEQ ID NO: 129093 - RNA, 20 nt, Artificial Sequence
  MKO10129093_B_Zrsr1
  gRNA
agcuucucuaaauucguugu

SEQ ID NO: 129094 - RNA, 20 nt, Artificial Sequence
  MKO10129094_B_Zrsr1
  gRNA
uuucuaccaugacgugcugc

SEQ ID NO: 129095 - RNA, 20 nt, Artificial Sequence
  MKO10129095_B_Zrsr1
  gRNA
uacacauugccccgcagaug

SEQ ID NO: 129096 - RNA, 20 nt, Artificial Sequence
  MKO10129096_B_Zrsr2
  gRNA
aagaagaggaagcucgaaaa

SEQ ID NO: 129097 - RNA, 20 nt, Artificial Sequence
  MKO10129097_B_Zrsr2
  gRNA
uacagaauuggcacagaaag

SEQ ID NO: 129098 - RNA, 20 nt, Artificial Sequence
  MKO10129098_B_Zrsr2
  gRNA
uuccuauaccucaguuucug

SEQ ID NO: 129099 - RNA, 20 nt, Artificial Sequence
  MKO10129099_B_Zscan10
  gRNA
ggcuuaccaagaggguuugc

SEQ ID NO: 129100 - RNA, 20 nt, Artificial Sequence
  MKO10129100_B_Zscan10
  gRNA
gcucauuggccaauuugaac

SEQ ID NO: 129101 - RNA, 20 nt, Artificial Sequence
  MKO10129101_B_Zscan10
  gRNA
cuucucugagguauccucaa

SEQ ID NO: 129102 - RNA, 20 nt, Artificial Sequence
  MKO10129102_B_Zscan12
  gRNA
cccgggguccagaaguuucc

SEQ ID NO: 129103 - RNA, 20 nt, Artificial Sequence
  MKO10129103_B_Zscan12
  gRNA
acuugcaggccgugaagccc

SEQ ID NO: 129104 - RNA, 20 nt, Artificial Sequence
  MKO10129104_B_Zscan12
  gRNA
cggccugcaaguucacaccc

SEQ ID NO: 129105 - RNA, 20 nt, Artificial Sequence
  MKO10129105_B_Zscan18
  gRNA
ugugcgguggaaaaccugcc

SEQ ID NO: 129106 - RNA, 20 nt, Artificial Sequence
  MKO10129106_B_Zscan18
  gRNA
cagcuccccuucuaccagcu

SEQ ID NO: 129107 - RNA, 20 nt, Artificial Sequence
  MKO10129107_B_Zscan18
  gRNA
uccacaggggccucuacagu

SEQ ID NO: 129108 - RNA, 20 nt, Artificial Sequence
  MKO10129108_B_Zscan20
  gRNA
guccccacgaucaccuccug

SEQ ID NO: 129109 - RNA, 20 nt, Artificial Sequence
  MKO10129109_B_Zscan20
  gRNA
ucguggggacagugcgugcc

SEQ ID NO: 129110 - RNA, 20 nt, Artificial Sequence
  MKO10129110_B_Zscan20
  gRNA
ucuccaaugcucgccaucuu

SEQ ID NO: 129111 - RNA, 20 nt, Artificial Sequence
  MKO10129111_B_Zscan21
  gRNA
cacagcagagcacccgaagc

SEQ ID NO: 129112 - RNA, 20 nt, Artificial Sequence
  MKO10129112_B_Zscan21
  gRNA
uugggucucaguacugcuua

SEQ ID NO: 129113 - RNA, 20 nt, Artificial Sequence
  MKO10129113_B_Zscan21
  gRNA
ccagcccuaaauaugaguuu

SEQ ID NO: 129114 - RNA, 20 nt, Artificial Sequence
  MKO10129114_B_Zscan22
  gRNA
caggugggcaacgcgacuga

SEQ ID NO: 129115 - RNA, 20 nt, Artificial Sequence
  MKO10129115_B_Zscan22
  gRNA
aagcgcaaucgugcagccuc

SEQ ID NO: 129116 - RNA, 20 nt, Artificial Sequence
  MKO10129116_B_Zscan22
  gRNA
cuaaggggugcuucgaguca

SEQ ID NO: 129117 - RNA, 20 nt, Artificial Sequence
  MKO10129117_B_Zscan25
  gRNA
auuccuugcagccacguccc

SEQ ID NO: 129118 - RNA, 20 nt, Artificial Sequence
  MKO10129118_B_Zscan25
  gRNA
uacguggacucacaggauug

SEQ ID NO: 129119 - RNA, 20 nt, Artificial Sequence
  MKO10129119_B_Zscan25
  gRNA
ccagcucagauugacugcuu

SEQ ID NO: 129120 - RNA, 20 nt, Artificial Sequence
  MKO10129120_B_Zscan26
  gRNA
uuggcgagccagccccucgc

SEQ ID NO: 129121 - RNA, 20 nt, Artificial Sequence
  MKO10129121_B_Zscan26
  gRNA
gcaagggauggcacuggccu

SEQ ID NO: 129122 - RNA, 20 nt, Artificial Sequence
  MKO10129122_B_Zscan26
  gRNA
gugcccugucauguucaauc

SEQ ID NO: 129123 - RNA, 20 nt, Artificial Sequence
  MKO10129123_B_Zscan29
  gRNA
auccaaccuggacaccacau

SEQ ID NO: 129124 - RNA, 20 nt, Artificial Sequence
  MKO10129124_B_Zscan29
  gRNA
uccucaccgcuccuuugaaa

SEQ ID NO: 129125 - RNA, 20 nt, Artificial Sequence
  MKO10129125_B_Zscan29
  gRNA
gacaccccugaaaucaucac

SEQ ID NO: 129126 - RNA, 20 nt, Artificial Sequence
  MKO10129126_B_Zscan2
  gRNA
uaccacugugccgaaaaguc

SEQ ID NO: 129127 - RNA, 20 nt, Artificial Sequence
  MKO10129127_B_Zscan2
  gRNA
gcuccgcgcucauuacgcac

SEQ ID NO: 129128 - RNA, 20 nt, Artificial Sequence
  MKO10129128_B_Zscan2
  gRNA
gaugcaccagcgagcgcacu

SEQ ID NO: 129129 - RNA, 20 nt, Artificial Sequence
  MKO10129129_B_Zscan4b
  gRNA
ggccaauaaucuaucuugug

SEQ ID NO: 129130 - RNA, 20 nt, Artificial Sequence
  MKO10129130_B_Zscan4b
  gRNA
aaugcuacugaaguaaaugu

SEQ ID NO: 129131 - RNA, 20 nt, Artificial Sequence
  MKO10129131_B_Zscan4b
  gRNA
agauacuucagucagaucug

SEQ ID NO: 129132 - RNA, 20 nt, Artificial Sequence
  MKO10129132_B_Zscan4c
  gRNA
cagguccauguuucaaugca

SEQ ID NO: 129133 - RNA, 20 nt, Artificial Sequence
  MKO10129133_B_Zscan4c
  gRNA
agauaguucagucagaucug

SEQ ID NO: 129134 - RNA, 20 nt, Artificial Sequence
  MKO10129134_B_Zscan4c
  gRNA
aaugcuacugaagcaaaugu

SEQ ID NO: 129135 - RNA, 20 nt, Artificial Sequence
  MKO10129135_B_Zscan4d
  gRNA
uguccuugcagugcccaaug

SEQ ID NO: 129136 - RNA, 20 nt, Artificial Sequence
  MKO10129136_B_Zscan4d
  gRNA
uagguccauguuucaaugca

SEQ ID NO: 129137 - RNA, 20 nt, Artificial Sequence
  MKO10129137_B_Zscan4d
  gRNA
ggccaauaaucuaucuugug

SEQ ID NO: 129138 - RNA, 20 nt, Artificial Sequence
  MKO10129138_B_Zscan4e
  gRNA
cagguccauguuucaaugca

SEQ ID NO: 129139 - RNA, 20 nt, Artificial Sequence
  MKO10129139_B_Zscan4e
  gRNA
ggccaauaaucuaucuugug

SEQ ID NO: 129140 - RNA, 20 nt, Artificial Sequence
  MKO10129140_B_Zscan4e
  gRNA
aaugcuacugaaguaaaugu

SEQ ID NO: 129141 - RNA, 20 nt, Artificial Sequence
  MKO10129141_B_Zscan4f
  gRNA
ggccaauaaucuaucuugug

SEQ ID NO: 129142 - RNA, 20 nt, Artificial Sequence
  MKO10129142_B_Zscan4f
  gRNA
cagguccauguuucaaugca

SEQ ID NO: 129143 - RNA, 20 nt, Artificial Sequence
  MKO10129143_B_Zscan4f
  gRNA
agauaguucagucagaucug

SEQ ID NO: 129144 - RNA, 20 nt, Artificial Sequence
  MKO10129144_B_Zscan5b
  gRNA
gggacaggaaacgccacaac

SEQ ID NO: 129145 - RNA, 20 nt, Artificial Sequence
  MKO10129145_B_Zscan5b
  gRNA
ugccgccagauagcccuguc

SEQ ID NO: 129146 - RNA, 20 nt, Artificial Sequence
  MKO10129146_B_Zscan5b
  gRNA
cuccuucggcaucccagcgu

SEQ ID NO: 129147 - RNA, 20 nt, Artificial Sequence
  MKO10129147_B_Zswim1
  gRNA
gaacuggccgacaacuggau

SEQ ID NO: 129148 - RNA, 20 nt, Artificial Sequence
  MKO10129148_B_Zswim1
  gRNA
agcgucgcuacagcacccuc

SEQ ID NO: 129149 - RNA, 20 nt, Artificial Sequence
  MKO10129149_B_Zswim1
  gRNA
gcucuuacagcacugcagcg

SEQ ID NO: 129150 - RNA, 20 nt, Artificial Sequence
  MKO10129150_B_Zswim2
  gRNA
cuuggaccugauguaucccc

SEQ ID NO: 129151 - RNA, 20 nt, Artificial Sequence
  MKO10129151_B_Zswim2
  gRNA
agacggcuaccuuaagcaga

SEQ ID NO: 129152 - RNA, 20 nt, Artificial Sequence
  MKO10129152_B_Zswim2
  gRNA
uuccccccucuucagaaacg

SEQ ID NO: 129153 - RNA, 20 nt, Artificial Sequence
  MKO10129153_B_Zswim3
  gRNA
cgcuuccauaaccucaacaa

SEQ ID NO: 129154 - RNA, 20 nt, Artificial Sequence
  MKO10129154_B_Zswim3
  gRNA
agauguccacaaucuugcgc

SEQ ID NO: 129155 - RNA, 20 nt, Artificial Sequence
  MKO10129155_B_Zswim3
  gRNA
augucuacacaaacucccgc

SEQ ID NO: 129156 - RNA, 20 nt, Artificial Sequence
  MKO10129156_B_Zswim4
  gRNA
gcccacgggugaaugguacc

SEQ ID NO: 129157 - RNA, 20 nt, Artificial Sequence
  MKO10129157_B_Zswim4
  gRNA
uucugugccugcacccgcug

SEQ ID NO: 129158 - RNA, 20 nt, Artificial Sequence
  MKO10129158_B_Zswim4
  gRNA
ugcgggagaugcuucgagca

SEQ ID NO: 129159 - RNA, 20 nt, Artificial Sequence
  MKO10129159_B_Zswim5
  gRNA
cacucucucucuaccggauc

SEQ ID NO: 129160 - RNA, 20 nt, Artificial Sequence
  MKO10129160_B_Zswim5
  gRNA
acugcagaaguggagcgacc

SEQ ID NO: 129161 - RNA, 20 nt, Artificial Sequence
  MKO10129161_B_Zswim5
  gRNA
ggagagcgcauugguaaugu

SEQ ID NO: 129162 - RNA, 20 nt, Artificial Sequence
  MKO10129162_B_Zswim6
  gRNA
gcaccgggaccccgucggug

SEQ ID NO: 129163 - RNA, 20 nt, Artificial Sequence
  MKO10129163_B_Zswim6
  gRNA
guauugacgaugagaacugc

SEQ ID NO: 129164 - RNA, 20 nt, Artificial Sequence
  MKO10129164_B_Zswim6
  gRNA
gacagaaccugcaauacaac

SEQ ID NO: 129165 - RNA, 20 nt, Artificial Sequence
  MKO10129165_B_Zswim7
  gRNA
ugggcacgagcaguaaugac

SEQ ID NO: 129166 - RNA, 20 nt, Artificial Sequence
  MKO10129166_B_Zswim7
  gRNA
acucuuccguaacacugaga

SEQ ID NO: 129167 - RNA, 20 nt, Artificial Sequence
  MKO10129167_B_Zswim7
  gRNA
gcaacugacagaccuauuga

SEQ ID NO: 129168 - RNA, 20 nt, Artificial Sequence
  MKO10129168_B_Zswim8
  gRNA
uccaaaaagcaauucggagu

SEQ ID NO: 129169 - RNA, 20 nt, Artificial Sequence
  MKO10129169_B_Zswim8
  gRNA
guaccacuguggcgcucaga

SEQ ID NO: 129170 - RNA, 20 nt, Artificial Sequence
  MKO10129170_B_Zswim8
  gRNA
cgaauguccucuucauucuc

SEQ ID NO: 129171 - RNA, 20 nt, Artificial Sequence
  MKO10129171_B_Zufsp
  gRNA
auagcuauugguauugauga

SEQ ID NO: 129172 - RNA, 20 nt, Artificial Sequence
  MKO10129172_B_Zufsp
  gRNA
auucucuaucacuagaacac

SEQ ID NO: 129173 - RNA, 20 nt, Artificial Sequence
  MKO10129173_B_Zufsp
  gRNA
cucuaugacugucccaugug

SEQ ID NO: 129174 - RNA, 20 nt, Artificial Sequence
  MKO10129174_B_Zw10
  gRNA
gcagaacauacuguaccacc

SEQ ID NO: 129175 - RNA, 20 nt, Artificial Sequence
  MKO10129175_B_Zw10
  gRNA
guuauacucuucaauagcag

SEQ ID NO: 129176 - RNA, 20 nt, Artificial Sequence
  MKO10129176_B_Zw10
  gRNA
uacaaaccugaagcagcagc

SEQ ID NO: 129177 - RNA, 20 nt, Artificial Sequence
  MKO10129177_B_Zwilch
  gRNA
gcucauaccucauagaugaa

SEQ ID NO: 129178 - RNA, 20 nt, Artificial Sequence
  MKO10129178_B_Zwilch
  gRNA
ccgucacaucucacccaaag

SEQ ID NO: 129179 - RNA, 20 nt, Artificial Sequence
  MKO10129179_B_Zwilch
  gRNA
aggccacuggccuuaccugu

SEQ ID NO: 129180 - RNA, 20 nt, Artificial Sequence
  MKO10129180_B_Zwint
  gRNA
gccuuacaggguucuggcug

SEQ ID NO: 129181 - RNA, 20 nt, Artificial Sequence
  MKO10129181_B_Zwint
  gRNA
ucuucagaagccagagcauc

SEQ ID NO: 129182 - RNA, 20 nt, Artificial Sequence
  MKO10129182_B_Zwint
  gRNA
cauaaacuccuccaugaucu

SEQ ID NO: 129183 - RNA, 20 nt, Artificial Sequence
  MKO10129183_B_Zxdb
  gRNA
ggagacaucguccaugucca

SEQ ID NO: 129184 - RNA, 20 nt, Artificial Sequence
  MKO10129184_B_Zxdb
  gRNA
agcagcggcggcggcagagg

SEQ ID NO: 129185 - RNA, 20 nt, Artificial Sequence
  MKO10129185_B_Zxdb
  gRNA
gugcugguagccagccaccg

SEQ ID NO: 129186 - RNA, 20 nt, Artificial Sequence
  MKO10129186_B_Zxdc
  gRNA
cccauaaucgagcccacuuc

SEQ ID NO: 129187 - RNA, 20 nt, Artificial Sequence
  MKO10129187_B_Zxdc
  gRNA
gacuugccacaaccuucaac

SEQ ID NO: 129188 - RNA, 20 nt, Artificial Sequence
  MKO10129188_B_Zxdc
  gRNA
auucacuugcgaagucacac

SEQ ID NO: 129189 - RNA, 20 nt, Artificial Sequence
  MKO10129189_B_Zyg11a
  gRNA
uggccaguuccuggcguguu

SEQ ID NO: 129190 - RNA, 20 nt, Artificial Sequence
  MKO10129190_B_Zyg11a
  gRNA
aucucugccaacagacgaac

SEQ ID NO: 129191 - RNA, 20 nt, Artificial Sequence
  MKO10129191_B_Zyg11a
  gRNA
ucacaaagcacgaccuguuc

SEQ ID NO: 129192 - RNA, 20 nt, Artificial Sequence
  MKO10129192_B_Zyg11b
  gRNA
uuagcucccgaacgacaucc

SEQ ID NO: 129193 - RNA, 20 nt, Artificial Sequence
  MKO10129193_B_Zyg11b
  gRNA
acaucagcgaggagccggac

SEQ ID NO: 129194 - RNA, 20 nt, Artificial Sequence
  MKO10129194_B_Zyg11b
  gRNA
uucugcucagcacgccaaga

SEQ ID NO: 129195 - RNA, 20 nt, Artificial Sequence
  MKO10129195_B_Zyx
  gRNA
gccccuuacccgggcuuuga

SEQ ID NO: 129196 - RNA, 20 nt, Artificial Sequence
  MKO10129196_B_Zyx
  gRNA
ggcagguuugguacuaggcu

SEQ ID NO: 129197 - RNA, 20 nt, Artificial Sequence
  MKO10129197_B_Zyx
  gRNA
acuggagcaaacuuaggugc

SEQ ID NO: 129198 - RNA, 20 nt, Artificial Sequence
  MKO10129198_B_Zzef1
  gRNA
ccccugaagauuggcuccac

SEQ ID NO: 129199 - RNA, 20 nt, Artificial Sequence
  MKO10129199_B_Zzef1
  gRNA
cuccaguggagccaaucuuc

SEQ ID NO: 129200 - RNA, 20 nt, Artificial Sequence
  MKO10129200_B_Zzef1
  gRNA
gcacaucacgaacuuccugc

SEQ ID NO: 129201 - RNA, 20 nt, Artificial Sequence
  MKO10129201_B_Zzz3
  gRNA
aacaccgcaaaagacauacu

SEQ ID NO: 129202 - RNA, 20 nt, Artificial Sequence
  MKO10129202_B_Zzz3
  gRNA
cugagccucaaguacagcaa

SEQ ID NO: 129203 - RNA, 20 nt, Artificial Sequence
  MKO10129203_B_Zzz3
  gRNA
ccgagaccuucaaccagcug

SEQ ID NO: 129204 - RNA, 20 nt, Artificial Sequence
  MKO10129204_B_a
  gRNA
caagcgucuccucgagugcc

SEQ ID NO: 129205 - RNA, 20 nt, Artificial Sequence
  MKO10129205_B_a
  gRNA
ggaagaccucuuccgcuucu

SEQ ID NO: 129206 - RNA, 20 nt, Artificial Sequence
  MKO10129206_B_a
  gRNA
gcagaaaagaagccgagaag

SEQ ID NO: 129207 - RNA, 20 nt, Artificial Sequence
  MKO10129207_B_l7Rn6
  gRNA
acagauccucccaugcccuc

SEQ ID NO: 129208 - RNA, 20 nt, Artificial Sequence
  MKO10129208_B_l7Rn6
  gRNA
aauguucaucccagcaaaug

SEQ ID NO: 129209 - RNA, 20 nt, Artificial Sequence
  MKO10129209_B_l7Rn6
  gRNA
uagcacagaacccccucuuu

SEQ ID NO: 129210 - protein, 8 aa, Artificial Sequence
  cOVA peptide
SIINFEKL

SEQ ID NO: 129211 - DNA, 19 bp, Artificial Sequence
  primer
cccgaggggacccagagag

SEQ ID NO: 129212 - DNA, 22 bp, Artificial Sequence
  primer
caattcccactcctttcaagac

SEQ ID NO: 129213 - DNA, 6686 bp, Artificial Sequence
  vector pSC017_pLKO-U6-sgBsmBI-EFS-Thy11CO-spA
  gRNA
ttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccagagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggagacggacgtctctgttttagagctagaaatagcaagttaaaataaggctagtccgttatcaacttgaaaaagtggcaccgagtcggtgcttttttaagcttggcgtaactagatcttgagacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggcgccggctcgagggggcccggggaattcgctagctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggaccggttctagacgtacggccaccatgaacccagccatcagcgtcgctctcctgctctcagtcttgcaggtgtcccgagggcagaaggtgaccagcctgacagcctgcctggtgaaccaaaaccttcgcctggactgccgccatgagaataacaccaaggataactccatccagcatgagttcagcctgacccgagagaagaggaagcacgtgctctcaggcacccttgggatacccgagcacacgtaccgctcccgcgtcaccctctccaaccagccctatatcaaggtccttaccctagccaacttcaccaccaaggatgagggcgactacttttgtgagcttcgcgtaagtggcgcgaatcccatgagctccaataaaagtatcagtgtgtatagagacaagctggtcaagtgtggcggcataagcctgctggttcagaacacatcctggatgctgctgctgctgctttccctctccctcctccaagccctggacttcatttctctgtgaagcgctaataaaagatctttattttcattagatctgtgtgttggttttttgtgtgacgtgcggtcgactttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtacgtatagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagc

SEQ ID NO: 129214 - DNA, 6696 bp, Artificial Sequence
  pSC008_pLKO-U6-BsmBI-chRNA(+85)-EFS-Thy11
  vector
ttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccagagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggagacggacgtctctgttttagagctagaaatagcaagttaaaataaggctagtccgttatcaacttgaaaaagtggcaccgagtcggtgcttttttaagcttggcgtaactagatcttgagacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggcgccggctcgagggggcccggggaattcgctagctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggaccggttctagacgtacggccaccatgaacccagccatcagcgtcgctctcctgctctcagtcttgcaggtgtcccgagggcagaaggtgaccagcctgacagcctgcctggtgaaccaaaaccttcgcctggactgccgccatgagaataacaccaaggataactccatccagcatgagttcagcctgacccgagagaagaggaagcacgtgctctcaggcacccttgggatacccgagcacacgtaccgctcccgcgtcaccctctccaaccagccctatatcaaggtccttaccctagccaacttcaccaccaaggatgagggcgactacttttgtgagcttcgcgtctcgggcgcgaatcccatgagctccaataaaagtatcagtgtgtatagagacaagctggtcaagtgtggcggcataagcctgctggttcagaacacatcctggatgctgctgctgctgctttccctctccctcctccaagccctggacttcatttctctgtgaagcgctaataaaagatctttattttcattagatctgtgtgttggttttttgtgtggtaactcgagacgtgcggtcgactttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtacgtatagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagc

SEQ ID NO: 129215 - DNA, 7021 bp, Artificial Sequence
  pSC021_pLKO-U6-sgBsmBI-PGK-Thy11CO-spA.sbd
  vector
ttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccagagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggagacggacgtctctgttttagagctagaaatagcaagttaaaataaggctagtccgttatcaacttgaaaaagtggcaccgagtcggtgcttttttaagcttggcgtaactagatcttgagacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggcgccggctcgagggggcccggggaattcgctagcgtctgaagaggagtttacgtccagccaagcttaggatctcgacctcgaaattctaccgggtaggggaggcgcttttcccaaggcagtctggagcatgcgctttagcagccccgctggcacttggcgctacacaagtggcctctggcctcgcacacattccacatccaccggtagcgccaaccggctccgttctttggtggccccttcgcgccaccttctactcctcccctagtcaggaagttcccccccgccccgcagctcgcgtcgtgcaggacgtgacaaatggaagtagcatgtcacactagtctcgtgcagatggacagcaccgctgagcaatggaagcgggtaggcctttggggcagcggccaatagcagctttgctccttcgctttctgggctcagcagctgggaagggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcatccatctagatctcgagcagctgaagcttaaccggttctagacgtacggccaccatgaacccagccatcagcgtcgctctcctgctctcagtcttgcaggtgtcccgagggcagaaggtgaccagcctgacagcctgcctggtgaaccaaaaccttcgcctggactgccgccatgagaataacaccaaggataactccatccagcatgagttcagcctgacccgagagaagaggaagcacgtgctctcaggcacccttgggatacccgagcacacgtaccgctcccgcgtcaccctctccaaccagccctatatcaaggtccttaccctagccaacttcaccaccaaggatgagggcgactacttttgtgagcttcgcgtaagtggcgcgaatcccatgagctccaataaaagtatcagtgtgtatagagacaagctggtcaagtgtggcggcataagcctgctggttcagaacacatcctggatgctgctgctgctgctttccctctccctcctccaagccctggacttcatttctctgtgaagcgctaataaaagatctttattttcattagatctgtgtgttggttttttgtgtgacgtgcggtcgactttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtacgtatagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagc

SEQ ID NO: 129216 - DNA, 9271 bp, Artificial Sequence
  pMD02: lenti-pLKO-U6-sgBsmBI-EFS-mCherry-2A-cOVA
  vector
ttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccagagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggagacggacgtctctgttttagagctagaaatagcaagttaaaataaggctagtccgttatcaacttgaaaaagtggcaccgagtcggtgcttttttaagcttggcgtaactagatcttgagacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggcgccggctcgagggggcccgggtgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgacgtacggccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagggcagtggagagggcagaggaagtctgctaacatgcggtgacgtcgaggagaatcctggcccaatgggctccatcggcgcagcaagcatggaattttgttttgatgtattcaaggagctcatcaattcctgggtagaaagtcagacaaatggaattatcagaaatgtccttcagccaagctccgtggattctcaaactgcaatggttctggttaatgccattgtcttcaaaggactgtgggagaaaacatttaaggatgaagacacacaagcaatgcctttcagagtgactgagcaagaaagcaaacctgtgcagatgatgtaccagattggtttatttagagtggcatcaatggcttctgagaaaatgaagatcctggagcttccatttgccagtgggacaatgagcatgttggtgctgttgcctgatgaagtctcaggccttgagcagcttgagagtataatcaactttgaaaaactgactgaatggaccagttctaatgttatggaagagaggaagatcaaagtgtacttacctcgcatgaagatggaggaaaaatacaacctcacatctgtcttaatggctatgggcattactgacgtgtttagctcttcagccaatctgtctggcatctcctcagcagagagcctgaagatatctcaagctgtccatgcagcacatgcagaaatcaatgaagcaggcagagaggtggtagggtcagcagaggctggagtggatgctgcaagcgtctctgaagaatttagggctgaccatccattcctcttctgtatcaagcacatcgcaaccaacgccgttctcttctttggcagatgtgtttccccttaaacgcgttaagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcgtcgactttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtacgtatagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagc

SEQ ID NO: 129217 - DNA, 5196 bp, Artificial Sequence
  pLY005SB_pAAV-U6sg(BbsI)-EFS-SB100X
  vector
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgttctagactatacagttgaagtcggaagtttacatacacttaagttggagtcattaaaactcgtttttcaactactccacaaatttcttgttaacaaacaatagttttggcaagtcagttaggacatctactttgtgcatgacacaagtcatttttccaacaattgtttacagacagattatttcacttataattcactgtatcacaattccagtgggtcagaagtttacatacactaagttgactgtgcctttaaacagcttggaaaattccagaaaatgatgtcatggctttagagaggatccgagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgggtcttcgagaagacctgttttagagctagaaatagcaagttaaaataaggctagtccgttatcaacttgaaaaagtggcaccgagtcggtgcttttttggctagctggccgcgtttaaacgtcgactaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggctcgagatgggaaaatcaaaagaaatcagccaagacctcagaaaaagaattgtagacctccacaagtctggttcatccttgggagcaatttccaaacgcctggcggtaccacgttcatctgtacaaacaatagtacgcaagtataaacaccatgggaccacgcagccgtcataccgctcaggaaggagacgcgttctgtctcctagagatgaacgtactttggtgcgaaaagtgcaaatcaatcccagaacaacagcaaaggaccttgtgaagatgctggaggaaacaggtacaaaagtatctatatccacagtaaaacgagtcctatatcgacataacctgaaaggccactcagcaaggaagaagccactgctccaaaaccgacataagaaagccagactacggtttgcaactgcacatggggacaaagatcgtactttttggagaaatgtcctctggtctgatgaaacaaaaatagaactgtttggccataatgaccatcgttatgtttggaggaagaagggggaggcttgcaagccgaagaacaccatcccaaccgtgaagcacgggggtggcagcatcatgttgtgggggtgctttgctgcaggagggactggtgcacttcacaaaatagatggcatcatggacgcggtgcagtatgtggatatattgaagcaacatctcaagacatcagtcaggaagttaaagcttggtcgcaaatgggttttccaacacgacaatgaccccaagcatacttccaaagttgtggcaaaatggcttaaggacaacaaagtcaaggtattggagtggccatcacaaagccctgacctcaatcctatagaaaatttgtgggcagaactgaaaaagcgtgtgcgagcaaggaggcctacaaacctgactcagttacaccagctctgtcaggaggaatgggccaaaattcacccaaattattgtgggaagcttgtggaaggctacccgaaacgtttgacccaagttaaacaatttaaaggcaatgctaccaaatactaggggccctaaccgcgggaataaaagatctttattttcattagatctgtgtgttggttttttgtgtgaattcttgagtgtatgtaaacttctgacccactgggaatgtgatgaaagaaataaaagctgaaatgaatcattctctctactattattctgatatttcacattcttaaaataaagtggtgatcctaactgacctaagacagggaatttttactaggattaaatgtcaggaattgtgaaaaagtgagtttaaatgtatttggctaaggtgtatgtaaacttccgacttcaactgtataggcatgcggtaaccacgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 129218 - DNA, 5745 bp, Artificial Sequence
  pLY017SB_pAAV-U6sg(BbsI)-EFS-Thy1
  vector
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgttctagactatacagttgaagtcggaagtttacatacacttaagttggagtcattaaaactcgtttttcaactactccacaaatttcttgttaacaaacaatagttttggcaagtcagttaggacatctactttgtgcatgacacaagtcatttttccaacaattgtttacagacagattatttcacttataattcactgtatcacaattccagtgggtcagaagtttacatacactaagttgactgtgcctttaaacagcttggaaaattccagaaaatgatgtcatggctttagagaggatccgagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgggtcttcgagaagacctgttttagagctagaaatagcaagttaaaataaggctagtccgttatcaacttgaaaaagtggcaccgagtcggtgcttttttggctagctggccgcgtttaaacgtcgactaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggctcgagatgaacccagccatcagcgtcgctctcctgctctcagtcttgcaggtgtcccgagggcagaaggtgaccagcctgacagcctgcctggtgaaccaaaaccttcgcctggactgccgccatgagaataacaccaaggataactccatccagcatgagttcagcctgacccgagagaagaggaagcacgtgctctcaggcacccttgggatacccgagcacacgtaccgctcccgcgtcaccctctccaaccagccctatatcaaggtccttaccctagccaacttcaccaccaaggatgagggcgactacttttgtgagcttcgcgtgtcgggcgcgaatcccatgagctccaataaaagtatcagtgtgtatagagacaagctggtcaagtgtggcggcataagcctgctggttcagaacacatcctggatgctgctgctgctgctttccctctccctcctccaagccctggacttcatttctctgggcagtggagagggcagaggaagtctgctaacatgcggtgacgtcgaggagaatcctggcccaatgggaaaatcaaaagaaatcagccaagacctcagaaaaagaattgtagacctccacaagtctggttcatccttgggagcaatttccaaacgcctggcggtaccacgttcatctgtacaaacaatagtacgcaagtataaacaccatgggaccacgcagccgtcataccgctcaggaaggagacgcgttctgtctcctagagatgaacgtactttggtgcgaaaagtgcaaatcaatcccagaacaacagcaaaggaccttgtgaagatgctggaggaaacaggtacaaaagtatctatatccacagtaaaacgagtcctatatcgacataacctgaaaggccactcagcaaggaagaagccactgctccaaaaccgacataagaaagccagactacggtttgcaactgcacatggggacaaagatcgtactttttggagaaatgtcctctggtctgatgaaacaaaaatagaactgtttggccataatgaccatcgttatgtttggaggaagaagggggaggcttgcaagccgaagaacaccatcccaaccgtgaagcacgggggtggcagcatcatgttgtgggggtgctttgctgcaggagggactggtgcacttcacaaaatagatggcatcatggacgcggtgcagtatgtggatatattgaagcaacatctcaagacatcagtcaggaagttaaagcttggtcgcaaatgggttttccaacacgacaatgaccccaagcatacttccaaagttgtggcaaaatggcttaaggacaacaaagtcaaggtattggagtggccatcacaaagccctgacctcaatcctatagaaaatttgtgggcagaactgaaaaagcgtgtgcgagcaaggaggcctacaaacctgactcagttacaccagctctgtcaggaggaatgggccaaaattcacccaaattattgtgggaagcttgtggaaggctacccgaaacgtttgacccaagttaaacaatttaaaggcaatgctaccaaatactaggggccctaaccgcgggaataaaagatctttattttcattagatctgtgtgttggttttttgtgtgaattcttgagtgtatgtaaacttctgacccactgggaatgtgatgaaagaaataaaagctgaaatgaatcattctctctactattattctgatatttcacattcttaaaataaagtggtgatcctaactgacctaagacagggaatttttactaggattaaatgtcaggaattgtgaaaaagtgagtttaaatgtatttggctaaggtgtatgtaaacttccgacttcaactgtataggcatgcggtaaccacgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 129219 - DNA, 3274 bp, Artificial Sequence
  pSC026b_pAAV-U6sgbbSapI-XD011bb
  vector
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgttctagaagagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggaagagcgagctcttctgttttagagctagaaatagcaagttaaaataaggctagtccgttatcaacttgaaaaagtggcaccgagtcggtgcttttttggtaccgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 129220 - DNA, 4128 bp, Artificial Sequence
  pSC025d_pAAV-U6sgbbSapI-EFS-Thy1
  vector
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgttctagaagagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggaagagcgagctcttctgttttagagctagaaatagcaagttaaaataaggctagtccgttatcaacttgaaaaagtggcaccgagtcggtgcttttttggtacctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggcaccggttctagacgtacggccaccatgaacccagccatcagcgtcgctctcctgctctcagtcttgcaggtgtcccgagggcagaaggtgaccagcctgacagcctgcctggtgaaccaaaaccttcgcctggactgccgccatgagaataacaccaaggataactccatccagcatgagttcagcctgacccgagagaagaggaagcacgtgctctcaggcacccttgggatacccgagcacacgtaccgctcccgcgtcaccctctccaaccagccctatatcaaggtccttaccctagccaacttcaccaccaaggatgagggcgactacttttgtgagcttcgcgtaagtggcgcgaatcccatgagctccaataaaagtatcagtgtgtatagagacaagctggtcaagtgtggcggcataagcctgctggttcagaacacatcctggatgctgctgctgctgctttccctctccctcctccaagccctggacttcatttctctgtgaagcgcttaagaattcgatatcaagcttaataaaagatctttattttcattagatctgtgtgttggttttttgtgtggtaaccacgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 129221 - DNA, 4397 bp, Artificial Sequence
  pSC031_pAAV-U6sgbbSapI-EFS-GFP-NLS
  vector
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgttctagaagagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggaagagcgagctcttctgttttagagctagaaatagcaagttaaaataaggctagtccgttatcaacttgaaaaagtggcaccgagtcggtgcttttttggtacctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggaccggttctagacgtacggccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagaagcgtcctgctgctactaagaaagctggtcaagctaagaaaaagaaataagaattcgatatcaagcttaataaaagatctttattttcattagatctgtgtgttggttttttgtgtggtaaccacgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 129222 - RNA, 20 nt, Artificial Sequence
  mmSKRIPTE0000001_Msh2_1
  gRNA
uauccagauucgucuuacga

SEQ ID NO: 129223 - RNA, 20 nt, Artificial Sequence
  mmSKRIPTE0000002_Msh2_2
  gRNA
agaaauacgaagguaucgug

SEQ ID NO: 129224 - RNA, 20 nt, Artificial Sequence
  mmSKRIPTE0000003_Msh2_3
  gRNA
cgguagacucccacccaccg

SEQ ID NO: 129225 - RNA, 20 nt, Artificial Sequence
  mmSKRIPTE0000004_Msh2_4
  gRNA
ccuuaauaaaugcagcccgg

SEQ ID NO: 129226 - RNA, 20 nt, Artificial Sequence
  mmSKRIPTE0000005_Msh2_5
  gRNA
aacauacauucgucagaccg

SEQ ID NO: 129227 - RNA, 20 nt, Artificial Sequence
  mmSKRIPTE0000006_Msh2_6
  gRNA
cgcccagguuuccggcaacg

SEQ ID NO: 129228 - RNA, 20 nt, Artificial Sequence
  mmSKRIPTE0000007_Msh2_7
  gRNA
gcgccguguaaaagucgccg

SEQ ID NO: 129229 - RNA, 20 nt, Artificial Sequence
  mmSKRIPTE0000008_Msh2_8
  gRNA
uauaccgcucacuaaaggug

SEQ ID NO: 129230 - RNA, 20 nt, Artificial Sequence
  mmSKRIPTE0000009_Msh2_9
  gRNA
acgucgacauauauuacuug

SEQ ID NO: 129231 - RNA, 20 nt, Artificial Sequence
  mmSKRIPTE0000010_Flot1_1
  gRNA
ucuaucucuacuacggccgc

SEQ ID NO: 129232 - RNA, 20 nt, Artificial Sequence
  mmSKRIPTE0000011_Flot1_2
  gRNA
caccagugggauacacaacg

SEQ ID NO: 129233 - RNA, 20 nt, Artificial Sequence
  mmSKRIPTE0000012_Flot1_3
  gRNA
gugcccucuacagaugcgag

SEQ ID NO: 129234 - RNA, 20 nt, Artificial Sequence
  mmSKRIPTE0000013_Flot1_4
  gRNA
uggccugagcggucucauug

SEQ ID NO: 129235 - RNA, 20 nt, Artificial Sequence
  mmSKRIPTE0000014_Flot1_5
  gRNA
caaagcucucccgcgcccag

SEQ ID NO: 129236 - RNA, 20 nt, Artificial Sequence
  mmSKRIPTE0000015_Flot1_6
  gRNA
uguagugcugcggacccgag

SEQ ID NO: 129237 - RNA, 20 nt, Artificial Sequence
  mmSKRIPTE0000016_Flot1_7
  gRNA
uauaaggcaggaccguagcg

SEQ ID NO: 129238 - RNA, 20 nt, Artificial Sequence
  mmSKRIPTE0000017_Flot1_8
  gRNA
acgacaucgaggucaacacc

SEQ ID NO: 129239 - RNA, 20 nt, Artificial Sequence
  mmSKRIPTE0000018_Flot1_9
  gRNA
cucagccaauaagaucacgc

SEQ ID NO: 129240 - RNA, 20 nt, Artificial Sequence
  mmSKRIPTE0000019_Smad6_1
  gRNA
uugcgcaacaaucagcgccg

SEQ ID NO: 129241 - RNA, 20 nt, Artificial Sequence
  mmSKRIPTE0000020_Smad6_2
  gRNA
caaaccucgcugggaccgcg

SEQ ID NO: 129242 - RNA, 20 nt, Artificial Sequence
  mmSKRIPTE0000021_Smad6_3
  gRNA
uucuccucaaacgcacacug

SEQ ID NO: 129243 - RNA, 20 nt, Artificial Sequence
  mmSKRIPTE0000022_Smad6_4
  gRNA
ggaggcagccaaugacuccg

SEQ ID NO: 129244 - RNA, 20 nt, Artificial Sequence
  mmSKRIPTE0000023_Smad6_5
  gRNA
uagacacuuuggcggcuccg

SEQ ID NO: 129245 - RNA, 20 nt, Artificial Sequence
  mmSKRIPTE0000024_Smad6_6
  gRNA
aagcgacccagcgcagcgug

SEQ ID NO: 129246 - RNA, 20 nt, Artificial Sequence
  mmSKRIPTE0000025_Smad6_7
  gRNA
aaugcaauccaccgaagcag

SEQ ID NO: 129247 - RNA, 20 nt, Artificial Sequence
  mmSKRIPTE0000026_Smad6_8
  gRNA
ggcaagucucuccugaacgc

SEQ ID NO: 129248 - RNA, 20 nt, Artificial Sequence
  mmSKRIPTE0000027_Smad6_9
  gRNA
aguccagagaaagagccgcc

SEQ ID NO: 129249 - RNA, 20 nt, Artificial Sequence
  mmSKRIPTE0000028_Tbk1_1
  gRNA
aaccgacugugguuaaaccg

SEQ ID NO: 129250 - RNA, 20 nt, Artificial Sequence
  mmSKRIPTE0000029_Tbk1_2
  gRNA
ucuaaacggcagcgaccccg

SEQ ID NO: 129251 - RNA, 20 nt, Artificial Sequence
  mmSKRIPTE0000030_Tbk1_3
  gRNA
cacaaauccaaggagucgug

SEQ ID NO: 129252 - RNA, 20 nt, Artificial Sequence
  mmSKRIPTE0000031_Tbk1_4
  gRNA
guaucaagacuauacuaacg

SEQ ID NO: 129253 - RNA, 20 nt, Artificial Sequence
  mmSKRIPTE0000032_Tbk1_5
  gRNA
guccuacuucaagcuaaccg

SEQ ID NO: 129254 - RNA, 20 nt, Artificial Sequence
  mmSKRIPTE0000033_Tbk1_6
  gRNA
gagcuuaauugguaacaaug

SEQ ID NO: 129255 - RNA, 20 nt, Artificial Sequence
  mmSKRIPTE0000034_Tbk1_7
  gRNA
gcacucggucacgugcuccg

SEQ ID NO: 129256 - RNA, 20 nt, Artificial Sequence
  mmSKRIPTE0000035_Tbk1_8
  gRNA
uaauucuugauagagcagca

SEQ ID NO: 129257 - RNA, 20 nt, Artificial Sequence
  mmSKRIPTE0000036_Tbk1_9
  gRNA
cgggaacaacucaauaccgu

SEQ ID NO: 129258 - RNA, 20 nt, Artificial Sequence
  mmSKRIPTE0000037_Tbx1_1
  gRNA
aaguugguguaagcuaaccg

SEQ ID NO: 129259 - RNA, 20 nt, Artificial Sequence
  mmSKRIPTE0000038_Tbx1_2
  gRNA
ucuccgccgugucuaguccg

SEQ ID NO: 129260 - RNA, 20 nt, Artificial Sequence
  mmSKRIPTE0000039_Tbx1_3
  gRNA
cgccuacgaccacuaccucg

SEQ ID NO: 129261 - RNA, 20 nt, Artificial Sequence
  mmSKRIPTE0000040_Tbx1_4
  gRNA
acacuaccacccggacucgc

SEQ ID NO: 129262 - RNA, 20 nt, Artificial Sequence
  mmSKRIPTE0000041_Tbx1_5
  gRNA
guggaucagcuccagccacg

SEQ ID NO: 129263 - RNA, 20 nt, Artificial Sequence
  mmSKRIPTE0000042_Tbx1_6
  gRNA
ucuaauucgaaugggccggg

SEQ ID NO: 129264 - RNA, 20 nt, Artificial Sequence
  mmSKRIPTE0000043_Tbx1_7
  gRNA
ucugaagcacugacgcccgg

SEQ ID NO: 129265 - RNA, 20 nt, Artificial Sequence
  mmSKRIPTE0000044_Tbx1_8
  gRNA
gcguccuuggauggcccucg

SEQ ID NO: 129266 - RNA, 20 nt, Artificial Sequence
  mmSKRIPTE0000045_Tbx1_9
  gRNA
gcagcgcacggaucguagcg

SEQ ID NO: 129267 - RNA, 20 nt, Artificial Sequence
  mmSKRIPTE0000046_Ptpn2_1
  gRNA
ugguugccgacauggcggcg

SEQ ID NO: 129268 - RNA, 20 nt, Artificial Sequence
  mmSKRIPTE0000047_Ptpn2_2
  gRNA
ucuacggaaacguauucgag

SEQ ID NO: 129269 - RNA, 20 nt, Artificial Sequence
  mmSKRIPTE0000048_Ptpn2_3
  gRNA
cgcgagcggaacuaccacag

SEQ ID NO: 129270 - RNA, 20 nt, Artificial Sequence
  mmSKRIPTE0000049_Ptpn2_4
  gRNA
guugagccaagccggccuug

SEQ ID NO: 129271 - RNA, 20 nt, Artificial Sequence
  mmSKRIPTE0000050_Ptpn2_5
  gRNA
ccguggugcauuaaucucaa

SEQ ID NO: 129272 - RNA, 20 nt, Artificial Sequence
  mmSKRIPTE0000051_Ptpn2_6
  gRNA
uccacgacguccgacccacg

SEQ ID NO: 129273 - RNA, 20 nt, Artificial Sequence
  mmSKRIPTE0000052_Ptpn2_7
  gRNA
cgcucuccccggauagagcg

SEQ ID NO: 129274 - RNA, 20 nt, Artificial Sequence
  mmSKRIPTE0000053_Ptpn2_8
  gRNA
ugcggguagucacuacacuc

SEQ ID NO: 129275 - RNA, 20 nt, Artificial Sequence
  mmSKRIPTE0000054_Ptpn2_9
  gRNA
auagcuagccccagaguuug

SEQ ID NO: 129276 - RNA, 20 nt, Artificial Sequence
  mmSKRIPTE0000055_Cd74_1
  gRNA
ugacccaggagacuacccgc

SEQ ID NO: 129277 - RNA, 20 nt, Artificial Sequence
  mmSKRIPTE0000056_Cd74_2
  gRNA
uaacauucacgacaccccug

SEQ ID NO: 129278 - RNA, 20 nt, Artificial Sequence
  mmSKRIPTE0000057_Cd74_3
  gRNA
uccccaguccauguacguag

SEQ ID NO: 129279 - RNA, 20 nt, Artificial Sequence
  mmSKRIPTE0000058_Cd74_4
  gRNA
aacccuuauauccuauccgu

SEQ ID NO: 129280 - RNA, 20 nt, Artificial Sequence
  mmSKRIPTE0000059_Cd74_5
  gRNA
guacuaccugagcuuagcag

SEQ ID NO: 129281 - RNA, 20 nt, Artificial Sequence
  mmSKRIPTE0000060_Cd74_6
  gRNA
uuaccguucucgucgcacuu

SEQ ID NO: 129282 - RNA, 20 nt, Artificial Sequence
  mmSKRIPTE0000061_Cd74_7
  gRNA
ggucccucccaguauacaug

SEQ ID NO: 129283 - RNA, 20 nt, Artificial Sequence
  mmSKRIPTE0000062_Cd74_8
  gRNA
cucaaacccucccaauagug

SEQ ID NO: 129284 - RNA, 20 nt, Artificial Sequence
  mmSKRIPTE0000063_Cd74_9
  gRNA
ggaugcccuacccuuaaccu

SEQ ID NO: 129285 - RNA, 20 nt, Artificial Sequence
  mmSKRIPTE0000064_Fkbp1a_1
  gRNA
aagaacgagcccucacagcg

SEQ ID NO: 129286 - RNA, 20 nt, Artificial Sequence
  mmSKRIPTE0000065_Fkbp1a_2
  gRNA
uuauuacugcggcgucuccg

SEQ ID NO: 129287 - RNA, 20 nt, Artificial Sequence
  mmSKRIPTE0000066_Fkbp1a_3
  gRNA
aaagcgcggccagaccugcg

SEQ ID NO: 129288 - RNA, 20 nt, Artificial Sequence
  mmSKRIPTE0000067_Fkbp1a_4
  gRNA
accccaugucccguucggcg

SEQ ID NO: 129289 - RNA, 20 nt, Artificial Sequence
  mmSKRIPTE0000068_Fkbp1a_5
  gRNA
cguccgcccugaacggugug

SEQ ID NO: 129290 - RNA, 20 nt, Artificial Sequence
  mmSKRIPTE0000069_Fkbp1a_6
  gRNA
acuaugccuauggagccacc

SEQ ID NO: 129291 - RNA, 20 nt, Artificial Sequence
  mmSKRIPTE0000070_Fkbp1a_7
  gRNA
gcgcucacaucccugaagcg

SEQ ID NO: 129292 - RNA, 20 nt, Artificial Sequence
  mmSKRIPTE0000071_Fkbp1a_8
  gRNA
gggggcauuaggcguaacuc

SEQ ID NO: 129293 - RNA, 20 nt, Artificial Sequence
  mmSKRIPTE0000072_Fkbp1a_9
  gRNA
acaauaaugacuucgcaagu

SEQ ID NO: 129294 - RNA, 20 nt, Artificial Sequence
  mmSKRIPTE0000073_Tgfb2_1
  gRNA
guaauuauuagacggcacga

SEQ ID NO: 129295 - RNA, 20 nt, Artificial Sequence
  mmSKRIPTE0000074_Tgfb2_2
  gRNA
cggcuccggauagucuuccg

SEQ ID NO: 129296 - RNA, 20 nt, Artificial Sequence
  mmSKRIPTE0000075_Tgfb2_3
  gRNA
ucuccgagugagccgcuccg

SEQ ID NO: 129297 - RNA, 20 nt, Artificial Sequence
  mmSKRIPTE0000076_Tgfb2_4
  gRNA
aacgaagcgaucaggacccg

SEQ ID NO: 129298 - RNA, 20 nt, Artificial Sequence
  mmSKRIPTE0000077_Tgfb2_5
  gRNA
auacaguucaauccgcugcu

SEQ ID NO: 129299 - RNA, 20 nt, Artificial Sequence
  mmSKRIPTE0000078_Tgfb2_6
  gRNA
cgccuacguggaucacccug

SEQ ID NO: 129300 - RNA, 20 nt, Artificial Sequence
  mmSKRIPTE0000079_Tgfb2_7
  gRNA
aguucaaagaccgagcggcu

SEQ ID NO: 129301 - RNA, 20 nt, Artificial Sequence
  mmSKRIPTE0000080_Tgfb2_8
  gRNA
augacucagaauaacacgag

SEQ ID NO: 129302 - RNA, 20 nt, Artificial Sequence
  mmSKRIPTE0000081_Tgfb2_9
  gRNA
aaacaggaaaauccguucag

SEQ ID NO: 129303 - RNA, 20 nt, Artificial Sequence
  mmSKRIPTE0000082_Fyn_1
  gRNA
cggugacggugacggcacug

SEQ ID NO: 129304 - RNA, 20 nt, Artificial Sequence
  mmSKRIPTE0000083_Fyn_2
  gRNA
guggauacuauaucacaacg

SEQ ID NO: 129305 - RNA, 20 nt, Artificial Sequence
  mmSKRIPTE0000084_Fyn_3
  gRNA
caacugguacagcauuacuc

SEQ ID NO: 129306 - RNA, 20 nt, Artificial Sequence
  mmSKRIPTE0000085_Fyn_4
  gRNA
gucacggaguacaugagcaa

SEQ ID NO: 129307 - RNA, 20 nt, Artificial Sequence
  mmSKRIPTE0000086_Fyn_5
  gRNA
uuccacacuagaugacgagu

SEQ ID NO: 129308 - RNA, 20 nt, Artificial Sequence
  mmSKRIPTE0000087_Fyn_6
  gRNA
ccucacauauggccaacacg

SEQ ID NO: 129309 - RNA, 20 nt, Artificial Sequence
  mmSKRIPTE0000088_Fyn_7
  gRNA
uugaacagcucguaaguuug

SEQ ID NO: 129310 - RNA, 20 nt, Artificial Sequence
  mmSKRIPTE0000089_Fyn_8
  gRNA
caugugcgucgaaucuccug

SEQ ID NO: 129311 - RNA, 20 nt, Artificial Sequence
  mmSKRIPTE0000090_Fyn_9
  gRNA
aauaggcuaucacagcacga

SEQ ID NO: 129312 - RNA, 20 nt, Artificial Sequence
  mmSKRIPTE0000091_Iugb3_1
  gRNA
gucucauuaagucccccggu

SEQ ID NO: 129313 - RNA, 20 nt, Artificial Sequence
  mmSKRIPTE0000092_Iugb3_2
  gRNA
cgauacaggcuuguccacga

SEQ ID NO: 129314 - RNA, 20 nt, Artificial Sequence
  mmSKRIPTE0000093_Iugb3_3
  gRNA
augaggcccgaucacucuag

SEQ ID NO: 129315 - RNA, 20 nt, Artificial Sequence
  mmSKRIPTE0000094_Iugb3_4
  gRNA
gcccuggguacccuaaaucg

SEQ ID NO: 129316 - RNA, 20 nt, Artificial Sequence
  mmSKRIPTE0000095_Iugb3_5
  gRNA
ucaagauuggagacacggug

SEQ ID NO: 129317 - RNA, 20 nt, Artificial Sequence
  mmSKRIPTE0000096_Iugb3_6
  gRNA
uucuccuucagguuacaucg

SEQ ID NO: 129318 - RNA, 20 nt, Artificial Sequence
  mmSKRIPTE0000097_Iugb3_7
  gRNA
ccguaaucgagaugccccag

SEQ ID NO: 129319 - RNA, 20 nt, Artificial Sequence
  mmSKRIPTE0000098_Iugb3_8
  gRNA
gcggucuccucuagugaacg

SEQ ID NO: 129320 - RNA, 20 nt, Artificial Sequence
  mmSKRIPTE0000099_Iugb3_9
  gRNA
cuccugcguccgcuacaaag

SEQ ID NO: 129321 - RNA, 20 nt, Artificial Sequence
  mmSKRIPTE0000100_Bad_1
  gRNA
gccacaguucguacccagcg

SEQ ID NO: 129322 - RNA, 20 nt, Artificial Sequence
  mmSKRIPTE0000101_Bad_2
  gRNA
ugcgugcaauagccacggag

SEQ ID NO: 129323 - RNA, 20 nt, Artificial Sequence
  mmSKRIPTE0000102_Bad_3
  gRNA
agggauagagauccggauug

SEQ ID NO: 129324 - RNA, 20 nt, Artificial Sequence
  mmSKRIPTE0000103_Bad_4
  gRNA
uuucgaaguaaaucccgggu

SEQ ID NO: 129325 - RNA, 20 nt, Artificial Sequence
  mmSKRIPTE0000104_Bad_5
  gRNA
cgggcgcccuuagaacugga

SEQ ID NO: 129326 - RNA, 20 nt, Artificial Sequence
  mmSKRIPTE0000105_Bad_6
  gRNA
gaaggcauaaaccgggacug

SEQ ID NO: 129327 - RNA, 20 nt, Artificial Sequence
  mmSKRIPTE0000106_Bad_7
  gRNA
gaggaagaagaggcaacccg

SEQ ID NO: 129328 - RNA, 20 nt, Artificial Sequence
  mmSKRIPTE0000107_Bad_8
  gRNA
cccgacaugcccuagaucaa

SEQ ID NO: 129329 - RNA, 20 nt, Artificial Sequence
  mmSKRIPTE0000108_Bad_9
  gRNA
uuuggggaguugagcuaccg

SEQ ID NO: 129330 - RNA, 20 nt, Artificial Sequence
  mmSKRIPTE0000109_Adam8_1
  gRNA
gaacuguuacaaucaccccg

SEQ ID NO: 129331 - RNA, 20 nt, Artificial Sequence
  mmSKRIPTE0000110_Adam8_2
  gRNA
gcuuuaucuuccuagcggug

SEQ ID NO: 129332 - RNA, 20 nt, Artificial Sequence
  mmSKRIPTE0000111_Adam8_3
  gRNA
gucugcaggaucaaccggug

SEQ ID NO: 129333 - RNA, 20 nt, Artificial Sequence
  mmSKRIPTE0000112_Adam8_4
  gRNA
gagcacucggaagcucuccg

SEQ ID NO: 129334 - RNA, 20 nt, Artificial Sequence
  mmSKRIPTE0000113_Adam8_5
  gRNA
aggcaucgucaucuaccgaa

SEQ ID NO: 129335 - RNA, 20 nt, Artificial Sequence
  mmSKRIPTE0000114_Adam8_6
  gRNA
cuaccuagaaguuacuucgg

SEQ ID NO: 129336 - RNA, 20 nt, Artificial Sequence
  mmSKRIPTE0000115_Adam8_7
  gRNA
cuccaaacguccacaaacga

SEQ ID NO: 129337 - RNA, 20 nt, Artificial Sequence
  mmSKRIPTE0000116_Adam8_8
  gRNA
uggccaaucacuggaccgcg

SEQ ID NO: 129338 - RNA, 20 nt, Artificial Sequence
  mmSKRIPTE0000117_Adam8_9
  gRNA
gugcaacuuaucacgugagu

SEQ ID NO: 129339 - RNA, 20 nt, Artificial Sequence
  mmSKRIPTE0000118_Psen1_1
  gRNA
agucagcuucuauacccgga

SEQ ID NO: 129340 - RNA, 20 nt, Artificial Sequence
  mmSKRIPTE0000119_Psen1_2
  gRNA
ggguggccucucgaucagag

SEQ ID NO: 129341 - RNA, 20 nt, Artificial Sequence
  mmSKRIPTE0000120_Psen1_3
  gRNA
uacgccugcugcagucgaag

SEQ ID NO: 129342 - RNA, 20 nt, Artificial Sequence
  mmSKRIPTE0000121_Psen1_4
  gRNA
ccacccgcacuacuggacug

SEQ ID NO: 129343 - RNA, 20 nt, Artificial Sequence
  mmSKRIPTE0000122_Psen1_5
  gRNA
auacuccgcccucuggaacg

SEQ ID NO: 129344 - RNA, 20 nt, Artificial Sequence
  mmSKRIPTE0000123_Psen1_6
  gRNA
acuguccaggagguuccgug

SEQ ID NO: 129345 - RNA, 20 nt, Artificial Sequence
  mmSKRIPTE0000124_Psen1_7
  gRNA
gaggauaacaacaagcuacg

SEQ ID NO: 129346 - RNA, 20 nt, Artificial Sequence
  mmSKRIPTE0000125_Psen1_8
  gRNA
guguaaguggauauacgcag

SEQ ID NO: 129347 - RNA, 20 nt, Artificial Sequence
  mmSKRIPTE0000126_Psen1_9
  gRNA
gcauucuggaaguaggacaa

SEQ ID NO: 129348 - RNA, 20 nt, Artificial Sequence
  mmSKRIPTE0000127_Gaua3_1
  gRNA
cugaguagcaaggagcguag

SEQ ID NO: 129349 - RNA, 20 nt, Artificial Sequence
  mmSKRIPTE0000128_Gaua3_2
  gRNA
cuacuacggaaacuccguca

SEQ ID NO: 129350 - RNA, 20 nt, Artificial Sequence
  mmSKRIPTE0000129_Gaua3_3
  gRNA
gcgccaagguggacucaccg

SEQ ID NO: 129351 - RNA, 20 nt, Artificial Sequence
  mmSKRIPTE0000130_Gaua3_4
  gRNA
caaacauacgcuaaucuccg

SEQ ID NO: 129352 - RNA, 20 nt, Artificial Sequence
  mmSKRIPTE0000131_Gaua3_5
  gRNA
guaccaucucgccgccacag

SEQ ID NO: 129353 - RNA, 20 nt, Artificial Sequence
  mmSKRIPTE0000132_Gaua3_6
  gRNA
acacgcacgcgaagacccgg

SEQ ID NO: 129354 - RNA, 20 nt, Artificial Sequence
  mmSKRIPTE0000133_Gaua3_7
  gRNA
uccaagacguccauccacca

SEQ ID NO: 129355 - RNA, 20 nt, Artificial Sequence
  mmSKRIPTE0000134_Gaua3_8
  gRNA
aaggaaagcgugugaaaacg

SEQ ID NO: 129356 - RNA, 20 nt, Artificial Sequence
  mmSKRIPTE0000135_Gaua3_9
  gRNA
cucgccaacucuaagacgaa

SEQ ID NO: 129357 - RNA, 20 nt, Artificial Sequence
  mmSKRIPTE0000136_Asxl2_1
  gRNA
guacaguagugacggccgcg

SEQ ID NO: 129358 - RNA, 20 nt, Artificial Sequence
  mmSKRIPTE0000137_Asxl2_2
  gRNA
ucgugcgcaagggcucgaug

SEQ ID NO: 129359 - RNA, 20 nt, Artificial Sequence
  mmSKRIPTE0000138_Asxl2_3
  gRNA
uggcgauucucagugauacg

SEQ ID NO: 129360 - RNA, 20 nt, Artificial Sequence
  mmSKRIPTE0000139_Asxl2_4
  gRNA
augcugcacacaaacucccg

SEQ ID NO: 129361 - RNA, 20 nt, Artificial Sequence
  mmSKRIPTE0000140_Asxl2_5
  gRNA
gugcgugcguacaaaaaccc

SEQ ID NO: 129362 - RNA, 20 nt, Artificial Sequence
  mmSKRIPTE0000141_Asxl2_6
  gRNA
uggcaggcauccgcaccaug

SEQ ID NO: 129363 - RNA, 20 nt, Artificial Sequence
  mmSKRIPTE0000142_Asxl2_7
  gRNA
acguuuaauacacauaacug

SEQ ID NO: 129364 - RNA, 20 nt, Artificial Sequence
  mmSKRIPTE0000143_Asxl2_8
  gRNA
uccugaugacaauaguaucg

SEQ ID NO: 129365 - RNA, 20 nt, Artificial Sequence
  mmSKRIPTE0000144_Asxl2_9
  gRNA
agucagucagaaccgacaug

SEQ ID NO: 129366 - RNA, 20 nt, Artificial Sequence
  mmSKRIPTE0000145_Otulin_1
  gRNA
acgcuuacggaagcgcucug

SEQ ID NO: 129367 - RNA, 20 nt, Artificial Sequence
  mmSKRIPTE0000146_Otulin_2
  gRNA
acuuccauaaggcgaguccg

SEQ ID NO: 129368 - RNA, 20 nt, Artificial Sequence
  mmSKRIPTE0000147_Otulin_3
  gRNA
cggcagacuaaagagacgcg

SEQ ID NO: 129369 - RNA, 20 nt, Artificial Sequence
  mmSKRIPTE0000148_Otulin_4
  gRNA
augguuccccgacucauccg

SEQ ID NO: 129370 - RNA, 20 nt, Artificial Sequence
  mmSKRIPTE0000149_Otulin_5
  gRNA
acuuuggugugauuucagcg

SEQ ID NO: 129371 - RNA, 20 nt, Artificial Sequence
  mmSKRIPTE0000150_Otulin_6
  gRNA
gguagccgaccugaaaccga

SEQ ID NO: 129372 - RNA, 20 nt, Artificial Sequence
  mmSKRIPTE0000151_Otulin_7
  gRNA
acgcccgcguucaugaaaug

SEQ ID NO: 129373 - RNA, 20 nt, Artificial Sequence
  mmSKRIPTE0000152_Otulin_8
  gRNA
acuuggcugaaauagacgua

SEQ ID NO: 129374 - RNA, 20 nt, Artificial Sequence
  mmSKRIPTE0000153_Otulin_9
  gRNA
gcugcaggucaaaggucgcg

SEQ ID NO: 129375 - RNA, 20 nt, Artificial Sequence
  mmSKRIPTE0000154_Fbn1_1
  gRNA
uuaauggcacugauugcgcg

SEQ ID NO: 129376 - RNA, 20 nt, Artificial Sequence
  mmSKRIPTE0000155_Fbn1_2
  gRNA
acacgguacuuggcgccgcg

SEQ ID NO: 129377 - RNA, 20 nt, Artificial Sequence
  mmSKRIPTE0000156_Fbn1_3
  gRNA
ugauuguagucacgacaacg

SEQ ID NO: 129378 - RNA, 20 nt, Artificial Sequence
  mmSKRIPTE0000157_Fbn1_4
  gRNA
gaauuacccagcaucccgcg

SEQ ID NO: 129379 - RNA, 20 nt, Artificial Sequence
  mmSKRIPTE0000158_Fbn1_5
  gRNA
ugcgcggacgauacuugaag

SEQ ID NO: 129380 - RNA, 20 nt, Artificial Sequence
  mmSKRIPTE0000159_Fbn1_6
  gRNA
uuggaccgugcacacacgau

SEQ ID NO: 129381 - RNA, 20 nt, Artificial Sequence
  mmSKRIPTE0000160_Fbn1_7
  gRNA
gucaugaauccucggccgug

SEQ ID NO: 129382 - RNA, 20 nt, Artificial Sequence
  mmSKRIPTE0000161_Fbn1_8
  gRNA
cgcguggcgcaguuacucgg

SEQ ID NO: 129383 - RNA, 20 nt, Artificial Sequence
  mmSKRIPTE0000162_Fbn1_9
  gRNA
gaagaguguuuguguuaacg

SEQ ID NO: 129384 - RNA, 20 nt, Artificial Sequence
  mmSKRIPTE0000163_Foxo3_1
  gRNA
cuguguuggagccuaguccg

SEQ ID NO: 129385 - RNA, 20 nt, Artificial Sequence
  mmSKRIPTE0000164_Foxo3_2
  gRNA
cagucggggagagacgcgau

SEQ ID NO: 129386 - RNA, 20 nt, Artificial Sequence
  mmSKRIPTE0000165_Foxo3_3
  gRNA
cucaaccuaggaugacggcg

SEQ ID NO: 129387 - RNA, 20 nt, Artificial Sequence
  mmSKRIPTE0000166_Foxo3_4
  gRNA
auagauuuggaauccucacu

SEQ ID NO: 129388 - RNA, 20 nt, Artificial Sequence
  mmSKRIPTE0000167_Foxo3_5
  gRNA
auucgcucgcgucucccggg

SEQ ID NO: 129389 - RNA, 20 nt, Artificial Sequence
  mmSKRIPTE0000168_Foxo3_6
  gRNA
ucaccaacucgacgacacaa

SEQ ID NO: 129390 - RNA, 20 nt, Artificial Sequence
  mmSKRIPTE0000169_Foxo3_7
  gRNA
uuucauagagagucuccgga

SEQ ID NO: 129391 - RNA, 20 nt, Artificial Sequence
  mmSKRIPTE0000170_Foxo3_8
  gRNA
caggagcguggccgacucug

SEQ ID NO: 129392 - RNA, 20 nt, Artificial Sequence
  mmSKRIPTE0000171_Foxo3_9
  gRNA
ggcgccggagcuuugcaacg

SEQ ID NO: 129393 - RNA, 20 nt, Artificial Sequence
  mmSKRIPTE0000172_Myh9_1
  gRNA
caucguacagaacgucagug

SEQ ID NO: 129394 - RNA, 20 nt, Artificial Sequence
  mmSKRIPTE0000173_Myh9_2
  gRNA
ggggaggguaacacuacuag

SEQ ID NO: 129395 - RNA, 20 nt, Artificial Sequence
  mmSKRIPTE0000174_Myh9_3
  gRNA
acuacacgagcugaaccacg

SEQ ID NO: 129396 - RNA, 20 nt, Artificial Sequence
  mmSKRIPTE0000175_Myh9_4
  gRNA
gcugguacucacgaaucgag

SEQ ID NO: 129397 - RNA, 20 nt, Artificial Sequence
  mmSKRIPTE0000176_Myh9_5
  gRNA
cagccuaggaacgacauccg

SEQ ID NO: 129398 - RNA, 20 nt, Artificial Sequence
  mmSKRIPTE0000177_Myh9_6
  gRNA
ccucauggguacccacggaa

SEQ ID NO: 129399 - RNA, 20 nt, Artificial Sequence
  mmSKRIPTE0000178_Myh9_7
  gRNA
acucgccgaauuguucggaa

SEQ ID NO: 129400 - RNA, 20 nt, Artificial Sequence
  mmSKRIPTE0000179_Myh9_8
  gRNA
augaguuuaucaauuacaca

SEQ ID NO: 129401 - RNA, 20 nt, Artificial Sequence
  mmSKRIPTE0000180_Myh9_9
  gRNA
auucgcuuaauuacgcugca

SEQ ID NO: 129402 - RNA, 20 nt, Artificial Sequence
  mmSKRIPTE0000181_Dock7_1
  gRNA
guugugauuagaaucgccaa

SEQ ID NO: 129403 - RNA, 20 nt, Artificial Sequence
  mmSKRIPTE0000182_Dock7_2
  gRNA
uaaguguauuaaaagccgcc

SEQ ID NO: 129404 - RNA, 20 nt, Artificial Sequence
  mmSKRIPTE0000183_Dock7_3
  gRNA
cucauguuaccguugacgug

SEQ ID NO: 129405 - RNA, 20 nt, Artificial Sequence
  mmSKRIPTE0000184_Dock7_4
  gRNA
uguuaacaacacaggacucg

SEQ ID NO: 129406 - RNA, 20 nt, Artificial Sequence
  mmSKRIPTE0000185_Dock7_5
  gRNA
uugaugcuaaaucgaccccu

SEQ ID NO: 129407 - RNA, 20 nt, Artificial Sequence
  mmSKRIPTE0000186_Dock7_6
  gRNA
uugcuggcgaugucgugucg

SEQ ID NO: 129408 - RNA, 20 nt, Artificial Sequence
  mmSKRIPTE0000187_Dock7_7
  gRNA
uauccgacugggguuucgag

SEQ ID NO: 129409 - RNA, 20 nt, Artificial Sequence
  mmSKRIPTE0000188_Dock7_8
  gRNA
acggccuucucauaucagcg

SEQ ID NO: 129410 - RNA, 20 nt, Artificial Sequence
  mmSKRIPTE0000189_Dock7_9
  gRNA
caggguaccguaaugcgccg

SEQ ID NO: 129411 - RNA, 20 nt, Artificial Sequence
  mmSKRIPTE0000190_Setd1a_1
  gRNA
cggcuccaccaguuacggca

SEQ ID NO: 129412 - RNA, 20 nt, Artificial Sequence
  mmSKRIPTE0000191_Setd1a_2
  gRNA
gcagccccuguguaacacgc

SEQ ID NO: 129413 - RNA, 20 nt, Artificial Sequence
  mmSKRIPTE0000192_Setd1a_3
  gRNA
ugaaguggacuccgucauag

SEQ ID NO: 129414 - RNA, 20 nt, Artificial Sequence
  mmSKRIPTE0000193_Setd1a_4
  gRNA
acucacccgcucguggcgag

SEQ ID NO: 129415 - RNA, 20 nt, Artificial Sequence
  mmSKRIPTE0000194_Setd1a_5
  gRNA
cuuaaacuuaggaaccggga

SEQ ID NO: 129416 - RNA, 20 nt, Artificial Sequence
  mmSKRIPTE0000195_Setd1a_6
  gRNA
cggagccguauccaugagug

SEQ ID NO: 129417 - RNA, 20 nt, Artificial Sequence
  mmSKRIPTE0000196_Setd1a_7
  gRNA
uucacaaagucauagaugug

SEQ ID NO: 129418 - RNA, 20 nt, Artificial Sequence
  mmSKRIPTE0000197_Setd1a_8
  gRNA
acucuuggcccagucuacga

SEQ ID NO: 129419 - RNA, 20 nt, Artificial Sequence
  mmSKRIPTE0000198_Setd1a_9
  gRNA
ggacucaaaguauacccccg

SEQ ID NO: 129420 - RNA, 20 nt, Artificial Sequence
  mmSKRIPTE0000199_Jarid2_1
  gRNA
cgggcacgguagguucaccg

SEQ ID NO: 129421 - RNA, 20 nt, Artificial Sequence
  mmSKRIPTE0000200_Jarid2_2
  gRNA
ucggcuguccuauugccgcg

SEQ ID NO: 129422 - RNA, 20 nt, Artificial Sequence
  mmSKRIPTE0000201_Jarid2_3
  gRNA
cauagcaagcagacacuccg

SEQ ID NO: 129423 - RNA, 20 nt, Artificial Sequence
  mmSKRIPTE0000202_Jarid2_4
  gRNA
cagaacucaccucaucguag

SEQ ID NO: 129424 - RNA, 20 nt, Artificial Sequence
  mmSKRIPTE0000203_Jarid2_5
  gRNA
uccccgcaagagagcgaccg

SEQ ID NO: 129425 - RNA, 20 nt, Artificial Sequence
  mmSKRIPTE0000204_Jarid2_6
  gRNA
ccgucgacgagaccccggaa

SEQ ID NO: 129426 - RNA, 20 nt, Artificial Sequence
  mmSKRIPTE0000205_Jarid2_7
  gRNA
gcaacagcacaguggcggau

SEQ ID NO: 129427 - RNA, 20 nt, Artificial Sequence
  mmSKRIPTE0000206_Jarid2_8
  gRNA
cuguacaggaauucugacgg

SEQ ID NO: 129428 - RNA, 20 nt, Artificial Sequence
  mmSKRIPTE0000207_Jarid2_9
  gRNA
cucgcgaagggggagaaccg

SEQ ID NO: 129429 - RNA, 20 nt, Artificial Sequence
  mmSKRIPTE0000208_Clec4d_1
  gRNA
gagaguaacgugcauccgag

SEQ ID NO: 129430 - RNA, 20 nt, Artificial Sequence
  mmSKRIPTE0000209_Clec4d_2
  gRNA
caauguaagugcuuacucag

SEQ ID NO: 129431 - RNA, 20 nt, Artificial Sequence
  mmSKRIPTE0000210_Clec4d_3
  gRNA
ucccucaucuuauggcagag

SEQ ID NO: 129432 - RNA, 20 nt, Artificial Sequence
  mmSKRIPTE0000211_Clec4d_4
  gRNA
aaacaacagcgaagacgcaa

SEQ ID NO: 129433 - RNA, 20 nt, Artificial Sequence
  mmSKRIPTE0000212_Clec4d_5
  gRNA
uaggcugauaaggaggaacg

SEQ ID NO: 129434 - RNA, 20 nt, Artificial Sequence
  mmSKRIPTE0000213_Clec4d_6
  gRNA
acgcuggacgagaggaagug

SEQ ID NO: 129435 - RNA, 20 nt, Artificial Sequence
  mmSKRIPTE0000214_Clec4d_7
  gRNA
guauauugguuggggcuaag

SEQ ID NO: 129436 - RNA, 20 nt, Artificial Sequence
  mmSKRIPTE0000215_Clec4d_8
  gRNA
guguggggacuuuaacugug

SEQ ID NO: 129437 - RNA, 20 nt, Artificial Sequence
  mmSKRIPTE0000216_Clec4d_9
  gRNA
cucacaguguaauguaccag

SEQ ID NO: 129438 - RNA, 20 nt, Artificial Sequence
  mmSKRIPTE0000217_Creb1_1
  gRNA
cuucaaaugcaagaauugcg

SEQ ID NO: 129439 - RNA, 20 nt, Artificial Sequence
  mmSKRIPTE0000218_Creb1_2
  gRNA
caaaauccucucguccaccg

SEQ ID NO: 129440 - RNA, 20 nt, Artificial Sequence
  mmSKRIPTE0000219_Creb1_3
  gRNA
cggaggcuccaucuuuaccg

SEQ ID NO: 129441 - RNA, 20 nt, Artificial Sequence
  mmSKRIPTE0000220_Creb1_4
  gRNA
agguuccgccaguagcgcgg

SEQ ID NO: 129442 - RNA, 20 nt, Artificial Sequence
  mmSKRIPTE0000221_Creb1_5
  gRNA
gugcuggaacucauugacgg

SEQ ID NO: 129443 - RNA, 20 nt, Artificial Sequence
  mmSKRIPTE0000222_Creb1_6
  gRNA
gugaacacauuaaccaacga

SEQ ID NO: 129444 - RNA, 20 nt, Artificial Sequence
  mmSKRIPTE0000223_Creb1_7
  gRNA
aaugguaguacccggcugag

SEQ ID NO: 129445 - RNA, 20 nt, Artificial Sequence
  mmSKRIPTE0000224_Creb1_8
  gRNA
cgaacaaagaauaauggcgg

SEQ ID NO: 129446 - RNA, 20 nt, Artificial Sequence
  mmSKRIPTE0000225_Creb1_9
  gRNA
gaccaccacagaaaacucug

SEQ ID NO: 129447 - RNA, 20 nt, Artificial Sequence
  mmSKRIPTE0000226_Hk1_1
  gRNA
agaaccgucuacgccaacug

SEQ ID NO: 129448 - RNA, 20 nt, Artificial Sequence
  mmSKRIPTE0000227_Hk1_2
  gRNA
cuguuggucaucguagccgc

SEQ ID NO: 129449 - RNA, 20 nt, Artificial Sequence
  mmSKRIPTE0000228_Hk1_3
  gRNA
cuuuguccacgugaucagua

SEQ ID NO: 129450 - RNA, 20 nt, Artificial Sequence
  mmSKRIPTE0000229_Hk1_4
  gRNA
cacguuugauugucucacug

SEQ ID NO: 129451 - RNA, 20 nt, Artificial Sequence
  mmSKRIPTE0000230_Hk1_5
  gRNA
auuacauuauggaaacggca

SEQ ID NO: 129452 - RNA, 20 nt, Artificial Sequence
  mmSKRIPTE0000231_Hk1_6
  gRNA
guaauaugccaguaguugcg

SEQ ID NO: 129453 - RNA, 20 nt, Artificial Sequence
  mmSKRIPTE0000232_Hk1_7
  gRNA
ccgacaauccaaaauagacg

SEQ ID NO: 129454 - RNA, 20 nt, Artificial Sequence
  mmSKRIPTE0000233_Hk1_8
  gRNA
uuccccacguaaggagcgcg

SEQ ID NO: 129455 - RNA, 20 nt, Artificial Sequence
  mmSKRIPTE0000234_Hk1_9
  gRNA
ugccacugccacucuccgag

SEQ ID NO: 129456 - RNA, 20 nt, Artificial Sequence
  mmSKRIPTE0000235_Ccl24_1
  gRNA
acgccguggcaauagcaccg

SEQ ID NO: 129457 - RNA, 20 nt, Artificial Sequence
  mmSKRIPTE0000236_Ccl24_2
  gRNA
ccgagugguuagcuaccagu

SEQ ID NO: 129458 - RNA, 20 nt, Artificial Sequence
  mmSKRIPTE0000237_Ccl24_3
  gRNA
gucaguauccagccugccgu

SEQ ID NO: 129459 - RNA, 20 nt, Artificial Sequence
  mmSKRIPTE0000238_Ccl24_4
  gRNA
agccacacaagagauaacac

SEQ ID NO: 129460 - RNA, 20 nt, Artificial Sequence
  mmSKRIPTE0000239_Ccl24_5
  gRNA
uccucacccaggaaacuagg

SEQ ID NO: 129461 - RNA, 20 nt, Artificial Sequence
  mmSKRIPTE0000240_Ccl24_6
  gRNA
gcccagaagucucaccuaug

SEQ ID NO: 129462 - RNA, 20 nt, Artificial Sequence
  mmSKRIPTE0000241_Ccl24_7
  gRNA
cuccagggucccgaacucca

SEQ ID NO: 129463 - RNA, 20 nt, Artificial Sequence
  mmSKRIPTE0000242_Ccl24_8
  gRNA
aggauacaugaagcccugcg

SEQ ID NO: 129464 - RNA, 20 nt, Artificial Sequence
  mmSKRIPTE0000243_Ccl24_9
  gRNA
gaaaaucguugagcauucug

SEQ ID NO: 129465 - RNA, 20 nt, Artificial Sequence
  mmSKRIPTE0000244_Ephb1_1
  gRNA
aggcaucuuaccaauaagcg

SEQ ID NO: 129466 - RNA, 20 nt, Artificial Sequence
  mmSKRIPTE0000245_Ephb1_2
  gRNA
uacuaaucacggcuuauacg

SEQ ID NO: 129467 - RNA, 20 nt, Artificial Sequence
  mmSKRIPTE0000246_Ephb1_3
  gRNA
uggcccauucucauaccuca

SEQ ID NO: 129468 - RNA, 20 nt, Artificial Sequence
  mmSKRIPTE0000247_Ephb1_4
  gRNA
acagguaugcuccagacccg

SEQ ID NO: 129469 - RNA, 20 nt, Artificial Sequence
  mmSKRIPTE0000248_Ephb1_5
  gRNA
aacccgaaaacaucacgucg

SEQ ID NO: 129470 - RNA, 20 nt, Artificial Sequence
  mmSKRIPTE0000249_Ephb1_6
  gRNA
ucugaggaugagugcacccg

SEQ ID NO: 129471 - RNA, 20 nt, Artificial Sequence
  mmSKRIPTE0000250_Ephb1_7
  gRNA
aaguagauucccauacaucg

SEQ ID NO: 129472 - RNA, 20 nt, Artificial Sequence
  mmSKRIPTE0000251_Ephb1_8
  gRNA
aauucuacguggugccagug

SEQ ID NO: 129473 - RNA, 20 nt, Artificial Sequence
  mmSKRIPTE0000252_Ephb1_9
  gRNA
gcuacagcggagccuacggg

SEQ ID NO: 129474 - RNA, 20 nt, Artificial Sequence
  mmSKRIPTE0000253_Tyro3_1
  gRNA
gugacucggauagcccuccg

SEQ ID NO: 129475 - RNA, 20 nt, Artificial Sequence
  mmSKRIPTE0000254_Tyro3_2
  gRNA
acuauagcuaagaagcggcg

SEQ ID NO: 129476 - RNA, 20 nt, Artificial Sequence
  mmSKRIPTE0000255_Tyro3_3
  gRNA
acaauccucaccgcuacaag

SEQ ID NO: 129477 - RNA, 20 nt, Artificial Sequence
  mmSKRIPTE0000256_Tyro3_4
  gRNA
uaugcuccaccaacgugaca

SEQ ID NO: 129478 - RNA, 20 nt, Artificial Sequence
  mmSKRIPTE0000257_Tyro3_5
  gRNA
cuuugcccaacauccgaccg

SEQ ID NO: 129479 - RNA, 20 nt, Artificial Sequence
  mmSKRIPTE0000258_Tyro3_6
  gRNA
ucagcagcgaggaguccccg

SEQ ID NO: 129480 - RNA, 20 nt, Artificial Sequence
  mmSKRIPTE0000259_Tyro3_7
  gRNA
uaggagguucuauccaaggu

SEQ ID NO: 129481 - RNA, 20 nt, Artificial Sequence
  mmSKRIPTE0000260_Tyro3_8
  gRNA
cuucacugccacuuucacga

SEQ ID NO: 129482 - RNA, 20 nt, Artificial Sequence
  mmSKRIPTE0000261_Tyro3_9
  gRNA
cugagucgguacgaauggca

SEQ ID NO: 129483 - RNA, 20 nt, Artificial Sequence
  mmSKRIPTE0000262_Kdr_1
  gRNA
caccguguacuccagcgacg

SEQ ID NO: 129484 - RNA, 20 nt, Artificial Sequence
  mmSKRIPTE0000263_Kdr_2
  gRNA
acuaggaacgugauaaccag

SEQ ID NO: 129485 - RNA, 20 nt, Artificial Sequence
  mmSKRIPTE0000264_Kdr_3
  gRNA
uucacagacuguaaguacgc

SEQ ID NO: 129486 - RNA, 20 nt, Artificial Sequence
  mmSKRIPTE0000265_Kdr_4
  gRNA
uggcaagaagggacgcacga

SEQ ID NO: 129487 - RNA, 20 nt, Artificial Sequence
  mmSKRIPTE0000266_Kdr_5
  gRNA
ugagacuauaggcaaauacc

SEQ ID NO: 129488 - RNA, 20 nt, Artificial Sequence
  mmSKRIPTE0000267_Kdr_6
  gRNA
gcagucgguccgucccagag

SEQ ID NO: 129489 - RNA, 20 nt, Artificial Sequence
  mmSKRIPTE0000268_Kdr_7
  gRNA
aauaguuuaucugaccagag

SEQ ID NO: 129490 - RNA, 20 nt, Artificial Sequence
  mmSKRIPTE0000269_Kdr_8
  gRNA
acacaauucagagcgaugug

SEQ ID NO: 129491 - RNA, 20 nt, Artificial Sequence
  mmSKRIPTE0000270_Kdr_9
  gRNA
aaggcuuucucaccgaucug

SEQ ID NO: 129492 - RNA, 20 nt, Artificial Sequence
  mmSKRIPTE0000271_Bmp4_1
  gRNA
caaaggcacaggauuguccg

SEQ ID NO: 129493 - RNA, 20 nt, Artificial Sequence
  mmSKRIPTE0000272_Bmp4_2
  gRNA
cgucauuccggauuacauga

SEQ ID NO: 129494 - RNA, 20 nt, Artificial Sequence
  mmSKRIPTE0000273_Bmp4_3
  gRNA
aaagcccaguaaauagacga

SEQ ID NO: 129495 - RNA, 20 nt, Artificial Sequence
  mmSKRIPTE0000274_Bmp4_4
  gRNA
cgucgcuccgaauggcacua

SEQ ID NO: 129496 - RNA, 20 nt, Artificial Sequence
  mmSKRIPTE0000275_Bmp4_5
  gRNA
uccaucacaaugugacacgg

SEQ ID NO: 129497 - RNA, 20 nt, Artificial Sequence
  mmSKRIPTE0000276_Bmp4_6
  gRNA
cacucccuugagguaacgau

SEQ ID NO: 129498 - RNA, 20 nt, Artificial Sequence
  mmSKRIPTE0000277_Bmp4_7
  gRNA
ugaaauggaaguccgacggg

SEQ ID NO: 129499 - RNA, 20 nt, Artificial Sequence
  mmSKRIPTE0000278_Bmp4_8
  gRNA
gccgagauucagggccacgc

SEQ ID NO: 129500 - RNA, 20 nt, Artificial Sequence
  mmSKRIPTE0000279_Bmp4_9
  gRNA
uggguccacgugacuccuag

SEQ ID NO: 129501 - RNA, 20 nt, Artificial Sequence
  mmSKRIPTE0000280_Vav1_1
  gRNA
caggucgugccuagucagag

SEQ ID NO: 129502 - RNA, 20 nt, Artificial Sequence
  mmSKRIPTE0000281_Vav1_2
  gRNA
ugacuguaacugucgccccg

SEQ ID NO: 129503 - RNA, 20 nt, Artificial Sequence
  mmSKRIPTE0000282_Vav1_3
  gRNA
ugaggucguaagaguccccg

SEQ ID NO: 129504 - RNA, 20 nt, Artificial Sequence
  mmSKRIPTE0000283_Vav1_4
  gRNA
guaccaucagcagaucccgu

SEQ ID NO: 129505 - RNA, 20 nt, Artificial Sequence
  mmSKRIPTE0000284_Vav1_5
  gRNA
gggaggaacccacgucaaag

SEQ ID NO: 129506 - RNA, 20 nt, Artificial Sequence
  mmSKRIPTE0000285_Vav1_6
  gRNA
cuucugguaagggcugcuau

SEQ ID NO: 129507 - RNA, 20 nt, Artificial Sequence
  mmSKRIPTE0000286_Vav1_7
  gRNA
gagaccuguccgcucuagug

SEQ ID NO: 129508 - RNA, 20 nt, Artificial Sequence
  mmSKRIPTE0000287_Vav1_8
  gRNA
cggcgguggugaaggaacga

SEQ ID NO: 129509 - RNA, 20 nt, Artificial Sequence
  mmSKRIPTE0000288_Vav1_9
  gRNA
gggcccgacuggauaaaggc

SEQ ID NO: 129510 - RNA, 20 nt, Artificial Sequence
  mmSKRIPTE0000289_L3mbtl3_1
  gRNA
gcugggauaccagcgacagu

SEQ ID NO: 129511 - RNA, 20 nt, Artificial Sequence
  mmSKRIPTE0000290_L3mbtl3_2
  gRNA
agauaacaacauagucagcg

SEQ ID NO: 129512 - RNA, 20 nt, Artificial Sequence
  mmSKRIPTE0000291_L3mbtl3_3
  gRNA
ccacccguuuggucggagcg

SEQ ID NO: 129513 - RNA, 20 nt, Artificial Sequence
  mmSKRIPTE0000292_L3mbtl3_4
  gRNA
aguuggcaccacuaaccgau

SEQ ID NO: 129514 - RNA, 20 nt, Artificial Sequence
  mmSKRIPTE0000293_L3mbtl3_5
  gRNA
ucuccagauauucaccccgu

SEQ ID NO: 129515 - RNA, 20 nt, Artificial Sequence
  mmSKRIPTE0000294_L3mbtl3_6
  gRNA
aggcaaacuugagagcggcg

SEQ ID NO: 129516 - RNA, 20 nt, Artificial Sequence
  mmSKRIPTE0000295_L3mbtl3_7
  gRNA
aggcacuacaucuaaugcag

SEQ ID NO: 129517 - RNA, 20 nt, Artificial Sequence
  mmSKRIPTE0000296_L3mbtl3_8
  gRNA
ggaagucugaugacgcacga

SEQ ID NO: 129518 - RNA, 20 nt, Artificial Sequence
  mmSKRIPTE0000297_L3mbtl3_9
  gRNA
aguuuaccuucguguccccg

SEQ ID NO: 129519 - RNA, 20 nt, Artificial Sequence
  mmSKRIPTE0000298_Map4k2_1
  gRNA
uugaggccuaggcgucaucg

SEQ ID NO: 129520 - RNA, 20 nt, Artificial Sequence
  mmSKRIPTE0000299_Map4k2_2
  gRNA
auccucucaaugaaccggug

SEQ ID NO: 129521 - RNA, 20 nt, Artificial Sequence
  mmSKRIPTE0000300_Map4k2_3
  gRNA
ggaacguacugccgguauag

SEQ ID NO: 129522 - RNA, 20 nt, Artificial Sequence
  mmSKRIPTE0000301_Map4k2_4
  gRNA
gucaugcgcccagauaugug

SEQ ID NO: 129523 - RNA, 20 nt, Artificial Sequence
  mmSKRIPTE0000302_Map4k2_5
  gRNA
ugacggugucacgggccuag

SEQ ID NO: 129524 - RNA, 20 nt, Artificial Sequence
  mmSKRIPTE0000303_Map4k2_6
  gRNA
agcuaagagauaagacgcgu

SEQ ID NO: 129525 - RNA, 20 nt, Artificial Sequence
  mmSKRIPTE0000304_Map4k2_7
  gRNA
agcaucagcuuacacucgag

SEQ ID NO: 129526 - RNA, 20 nt, Artificial Sequence
  mmSKRIPTE0000305_Map4k2_8
  gRNA
uggguucacccugugacucg

SEQ ID NO: 129527 - RNA, 20 nt, Artificial Sequence
  mmSKRIPTE0000306_Map4k2_9
  gRNA
ccgaagccucgauaccaacg

SEQ ID NO: 129528 - RNA, 20 nt, Artificial Sequence
  mmSKRIPTE0000307_Il16_1
  gRNA
uggugcagaaucaaucggca

SEQ ID NO: 129529 - RNA, 20 nt, Artificial Sequence
  mmSKRIPTE0000308_Il16_2
  gRNA
ucagcaaggagauaaccgac

SEQ ID NO: 129530 - RNA, 20 nt, Artificial Sequence
  mmSKRIPTE0000309_Il16_3
  gRNA
caggguuaggucuuuccgag

SEQ ID NO: 129531 - RNA, 20 nt, Artificial Sequence
  mmSKRIPTE0000310_Il16_4
  gRNA
gguauccaacuaacccccag

SEQ ID NO: 129532 - RNA, 20 nt, Artificial Sequence
  mmSKRIPTE0000311_Il16_5
  gRNA
ugucaucuuagcugacccag

SEQ ID NO: 129533 - RNA, 20 nt, Artificial Sequence
  mmSKRIPTE0000312_Il16_6
  gRNA
acacaauccgaggauacuca

SEQ ID NO: 129534 - RNA, 20 nt, Artificial Sequence
  mmSKRIPTE0000313_Il16_7
  gRNA
acagcuuagugauaauaccc

SEQ ID NO: 129535 - RNA, 20 nt, Artificial Sequence
  mmSKRIPTE0000314_Il16_8
  gRNA
guuugcugcauagucgcaag

SEQ ID NO: 129536 - RNA, 20 nt, Artificial Sequence
  mmSKRIPTE0000315_Il16_9
  gRNA
ggacuaugaaagccacccca

SEQ ID NO: 129537 - RNA, 20 nt, Artificial Sequence
  mmSKRIPTE0000316_Eomes_1
  gRNA
uacucgcuggagagugcucg

SEQ ID NO: 129538 - RNA, 20 nt, Artificial Sequence
  mmSKRIPTE0000317_Eomes_2
  gRNA
ggcgugacaagccaccgcug

SEQ ID NO: 129539 - RNA, 20 nt, Artificial Sequence
  mmSKRIPTE0000318_Eomes_3
  gRNA
gcuguccauggaguagcgcg

SEQ ID NO: 129540 - RNA, 20 nt, Artificial Sequence
  mmSKRIPTE0000319_Eomes_4
  gRNA
uacccaccugcggaccugcg

SEQ ID NO: 129541 - RNA, 20 nt, Artificial Sequence
  mmSKRIPTE0000320_Eomes_5
  gRNA
ccguuauaauaucgggcuug

SEQ ID NO: 129542 - RNA, 20 nt, Artificial Sequence
  mmSKRIPTE0000321_Eomes_6
  gRNA
gaacgccguaccgaccucca

SEQ ID NO: 129543 - RNA, 20 nt, Artificial Sequence
  mmSKRIPTE0000322_Eomes_7
  gRNA
cucaccccaacagagcgaag

SEQ ID NO: 129544 - RNA, 20 nt, Artificial Sequence
  mmSKRIPTE0000323_Eomes_8
  gRNA
cugagccugagagucaagcg

SEQ ID NO: 129545 - RNA, 20 nt, Artificial Sequence
  mmSKRIPTE0000324_Eomes_9
  gRNA
gacugcaacacuaucaucug

SEQ ID NO: 129546 - RNA, 20 nt, Artificial Sequence
  mmSKRIPTE0000325_Thbs1_1
  gRNA
uuaccaagcguauugcagag

SEQ ID NO: 129547 - RNA, 20 nt, Artificial Sequence
  mmSKRIPTE0000326_Thbs1_2
  gRNA
cggggcucaguaacccggag

SEQ ID NO: 129548 - RNA, 20 nt, Artificial Sequence
  mmSKRIPTE0000327_Thbs1_3
  gRNA
gucacaccgaauaggcucga

SEQ ID NO: 129549 - RNA, 20 nt, Artificial Sequence
  mmSKRIPTE0000328_Thbs1_4
  gRNA
gcauuaaacucaucauaacc

SEQ ID NO: 129550 - RNA, 20 nt, Artificial Sequence
  mmSKRIPTE0000329_Thbs1_5
  gRNA
gacaugaaauacgagugucg

SEQ ID NO: 129551 - RNA, 20 nt, Artificial Sequence
  mmSKRIPTE0000330_Thbs1_6
  gRNA
cagguugucaucacaccacg

SEQ ID NO: 129552 - RNA, 20 nt, Artificial Sequence
  mmSKRIPTE0000331_Thbs1_7
  gRNA
gcaacucucccuucuagacg

SEQ ID NO: 129553 - RNA, 20 nt, Artificial Sequence
  mmSKRIPTE0000332_Thbs1_8
  gRNA
cggccaucaccuaaggucaa

SEQ ID NO: 129554 - RNA, 20 nt, Artificial Sequence
  mmSKRIPTE0000333_Thbs1_9
  gRNA
uaacccagaacccgaagggu

SEQ ID NO: 129555 - RNA, 20 nt, Artificial Sequence
  mmSKRIPTE0000334_Ltf_1
  gRNA
uuacuacacgaguaacuccg

SEQ ID NO: 129556 - RNA, 20 nt, Artificial Sequence
  mmSKRIPTE0000335_Ltf_2
  gRNA
ucuuagcacgauacucaacg

SEQ ID NO: 129557 - RNA, 20 nt, Artificial Sequence
  mmSKRIPTE0000336_Ltf_3
  gRNA
ucugcugcauugauauaccg

SEQ ID NO: 129558 - RNA, 20 nt, Artificial Sequence
  mmSKRIPTE0000337_Ltf_4
  gRNA
gcauugucgcaaucauggua

SEQ ID NO: 129559 - RNA, 20 nt, Artificial Sequence
  mmSKRIPTE0000338_Ltf_5
  gRNA
auagccacaacacagucacg

SEQ ID NO: 129560 - RNA, 20 nt, Artificial Sequence
  mmSKRIPTE0000339_Ltf_6
  gRNA
gccccggacucacuacuaug

SEQ ID NO: 129561 - RNA, 20 nt, Artificial Sequence
  mmSKRIPTE0000340_Ltf_7
  gRNA
ugugcacccaugguuccaug

SEQ ID NO: 129562 - RNA, 20 nt, Artificial Sequence
  mmSKRIPTE0000341_Ltf_8
  gRNA
agcuaacacuccaacccgag

SEQ ID NO: 129563 - RNA, 20 nt, Artificial Sequence
  mmSKRIPTE0000342_Ltf_9
  gRNA
augagguguccccgaccaug

SEQ ID NO: 129564 - RNA, 20 nt, Artificial Sequence
  mmSKRIPTE0000343_Prkch_1
  gRNA
aggucgacacuaagacggca

SEQ ID NO: 129565 - RNA, 20 nt, Artificial Sequence
  mmSKRIPTE0000344_Prkch_2
  gRNA
acgauucuaggucggaaagg

SEQ ID NO: 129566 - RNA, 20 nt, Artificial Sequence
  mmSKRIPTE0000345_Prkch_3
  gRNA
caccugucauacucauagug

SEQ ID NO: 129567 - RNA, 20 nt, Artificial Sequence
  mmSKRIPTE0000346_Prkch_4
  gRNA
ccgugcucguuucuacgccg

SEQ ID NO: 129568 - RNA, 20 nt, Artificial Sequence
  mmSKRIPTE0000347_Prkch_5
  gRNA
cgguccuaaacaaaacgugu

SEQ ID NO: 129569 - RNA, 20 nt, Artificial Sequence
  mmSKRIPTE0000348_Prkch_6
  gRNA
acuguugacgcgacagccgu

SEQ ID NO: 129570 - RNA, 20 nt, Artificial Sequence
  mmSKRIPTE0000349_Prkch_7
  gRNA
cugguucucagcucaccgag

SEQ ID NO: 129571 - RNA, 20 nt, Artificial Sequence
  mmSKRIPTE0000350_Prkch_8
  gRNA
aguucauggccacguaccug

SEQ ID NO: 129572 - RNA, 20 nt, Artificial Sequence
  mmSKRIPTE0000351_Prkch_9
  gRNA
agaaagaggagauauuagug

SEQ ID NO: 129573 - RNA, 20 nt, Artificial Sequence
  mmSKRIPTE0000352_Tlr9_1
  gRNA
uauaaccagaacuucugccg

SEQ ID NO: 129574 - RNA, 20 nt, Artificial Sequence
  mmSKRIPTE0000353_Tlr9_2
  gRNA
ugucagacaaucgcaucagu

SEQ ID NO: 129575 - RNA, 20 nt, Artificial Sequence
  mmSKRIPTE0000354_Tlr9_3
  gRNA
cagcucguuauacacccagu

SEQ ID NO: 129576 - RNA, 20 nt, Artificial Sequence
  mmSKRIPTE0000355_Tlr9_4
  gRNA
uagaucacuacaagauagag

SEQ ID NO: 129577 - RNA, 20 nt, Artificial Sequence
  mmSKRIPTE0000356_Tlr9_5
  gRNA
cuccaacaguaagucuacga

SEQ ID NO: 129578 - RNA, 20 nt, Artificial Sequence
  mmSKRIPTE0000357_Tlr9_6
  gRNA
ccacaacauucucaagacgg

SEQ ID NO: 129579 - RNA, 20 nt, Artificial Sequence
  mmSKRIPTE0000358_Tlr9_7
  gRNA
aagauagguaguugucucgg

SEQ ID NO: 129580 - RNA, 20 nt, Artificial Sequence
  mmSKRIPTE0000359_Tlr9_8
  gRNA
gaugcugccgcagagaaacg

SEQ ID NO: 129581 - RNA, 20 nt, Artificial Sequence
  mmSKRIPTE0000360_Tlr9_9
  gRNA
auugcgcacuugccaaauag

SEQ ID NO: 129582 - RNA, 20 nt, Artificial Sequence
  mmSKRIPTE0000361_Fnip1_1
  gRNA
uauucaguaaccgaacacgu

SEQ ID NO: 129583 - RNA, 20 nt, Artificial Sequence
  mmSKRIPTE0000362_Fnip1_2
  gRNA
aagcucuucagcaagcggag

SEQ ID NO: 129584 - RNA, 20 nt, Artificial Sequence
  mmSKRIPTE0000363_Fnip1_3
  gRNA
gcacuccugaucaggcggag

SEQ ID NO: 129585 - RNA, 20 nt, Artificial Sequence
  mmSKRIPTE0000364_Fnip1_4
  gRNA
aaaauucaucagauccggug

SEQ ID NO: 129586 - RNA, 20 nt, Artificial Sequence
  mmSKRIPTE0000365_Fnip1_5
  gRNA
uggcgacgagccguaucacg

SEQ ID NO: 129587 - RNA, 20 nt, Artificial Sequence
  mmSKRIPTE0000366_Fnip1_6
  gRNA
gauacuacugccaguccgug

SEQ ID NO: 129588 - RNA, 20 nt, Artificial Sequence
  mmSKRIPTE0000367_Fnip1_7
  gRNA
uggcucacggguccgucacg

SEQ ID NO: 129589 - RNA, 20 nt, Artificial Sequence
  mmSKRIPTE0000368_Fnip1_8
  gRNA
uuuaccaucagcuaguggca

SEQ ID NO: 129590 - RNA, 20 nt, Artificial Sequence
  mmSKRIPTE0000369_Fnip1_9
  gRNA
cgaucagucgaaucugacuu

SEQ ID NO: 129591 - RNA, 20 nt, Artificial Sequence
  mmSKRIPTE0000370_Cblb_1
  gRNA
gagcuggucauaguccugcg

SEQ ID NO: 129592 - RNA, 20 nt, Artificial Sequence
  mmSKRIPTE0000371_Cblb_2
  gRNA
cugcuauagauucagacgug

SEQ ID NO: 129593 - RNA, 20 nt, Artificial Sequence
  mmSKRIPTE0000372_Cblb_3
  gRNA
gcacuucgugccuuaccgcg

SEQ ID NO: 129594 - RNA, 20 nt, Artificial Sequence
  mmSKRIPTE0000373_Cblb_4
  gRNA
gaugggaugucgcauccucg

SEQ ID NO: 129595 - RNA, 20 nt, Artificial Sequence
  mmSKRIPTE0000374_Cblb_5
  gRNA
agagauugcccagaauaacg

SEQ ID NO: 129596 - RNA, 20 nt, Artificial Sequence
  mmSKRIPTE0000375_Cblb_6
  gRNA
aggacucaguccaagcguag

SEQ ID NO: 129597 - RNA, 20 nt, Artificial Sequence
  mmSKRIPTE0000376_Cblb_7
  gRNA
aaagccccaugggcccgaag

SEQ ID NO: 129598 - RNA, 20 nt, Artificial Sequence
  mmSKRIPTE0000377_Cblb_8
  gRNA
gcuaguaaaccauuaaccgc

SEQ ID NO: 129599 - RNA, 20 nt, Artificial Sequence
  mmSKRIPTE0000378_Cblb_9
  gRNA
aaguaaguucacuugcaggg

SEQ ID NO: 129600 - RNA, 20 nt, Artificial Sequence
  mmSKRIPTE0000379_Abl1_1
  gRNA
gagcgggaucccuuuguacg

SEQ ID NO: 129601 - RNA, 20 nt, Artificial Sequence
  mmSKRIPTE0000380_Abl1_2
  gRNA
gugaggugcuacgaggacca

SEQ ID NO: 129602 - RNA, 20 nt, Artificial Sequence
  mmSKRIPTE0000381_Abl1_3
  gRNA
gcaguggaaacaccacaacg

SEQ ID NO: 129603 - RNA, 20 nt, Artificial Sequence
  mmSKRIPTE0000382_Abl1_4
  gRNA
ucggaggacacguacagcug

SEQ ID NO: 129604 - RNA, 20 nt, Artificial Sequence
  mmSKRIPTE0000383_Abl1_5
  gRNA
agaucuccaacauggucccg

SEQ ID NO: 129605 - RNA, 20 nt, Artificial Sequence
  mmSKRIPTE0000384_Abl1_6
  gRNA
cuuggguuauaaucacaaug

SEQ ID NO: 129606 - RNA, 20 nt, Artificial Sequence
  mmSKRIPTE0000385_Abl1_7
  gRNA
aaacacggggcagagugccg

SEQ ID NO: 129607 - RNA, 20 nt, Artificial Sequence
  mmSKRIPTE0000386_Abl1_8
  gRNA
ccuuacgcgcaucuccucag

SEQ ID NO: 129608 - RNA, 20 nt, Artificial Sequence
  mmSKRIPTE0000387_Abl1_9
  gRNA
agaucagcgacauuguccgg

SEQ ID NO: 129609 - RNA, 20 nt, Artificial Sequence
  mmSKRIPTE0000388_Ada_1
  gRNA
caaacccaaaguaagcaccg

SEQ ID NO: 129610 - RNA, 20 nt, Artificial Sequence
  mmSKRIPTE0000389_Ada_2
  gRNA
acugacgguacgcuugugca

SEQ ID NO: 129611 - RNA, 20 nt, Artificial Sequence
  mmSKRIPTE0000390_Ada_3
  gRNA
acuguccccagaaucaggcu

SEQ ID NO: 129612 - RNA, 20 nt, Artificial Sequence
  mmSKRIPTE0000391_Ada_4
  gRNA
cccacgaaaccuccaccaug

SEQ ID NO: 129613 - RNA, 20 nt, Artificial Sequence
  mmSKRIPTE0000392_Ada_5
  gRNA
ccgauggcucucagagaccg

SEQ ID NO: 129614 - RNA, 20 nt, Artificial Sequence
  mmSKRIPTE0000393_Ada_6
  gRNA
augucgagcgagagacgaug

SEQ ID NO: 129615 - RNA, 20 nt, Artificial Sequence
  mmSKRIPTE0000394_Ada_7
  gRNA
ggggugacguccccucugug

SEQ ID NO: 129616 - RNA, 20 nt, Artificial Sequence
  mmSKRIPTE0000395_Ada_8
  gRNA
ccaccucauaggcuuccacg

SEQ ID NO: 129617 - RNA, 20 nt, Artificial Sequence
  mmSKRIPTE0000396_Ada_9
  gRNA
auucaucggaccguccacgc

SEQ ID NO: 129618 - RNA, 20 nt, Artificial Sequence
  mmSKRIPTE0000397_Zfp335_1
  gRNA
ugaaugcuacaccuugagcg

SEQ ID NO: 129619 - RNA, 20 nt, Artificial Sequence
  mmSKRIPTE0000398_Zfp335_2
  gRNA
guacacgcggugguaacagg

SEQ ID NO: 129620 - RNA, 20 nt, Artificial Sequence
  mmSKRIPTE0000399_Zfp335_3
  gRNA
ccgacugacagcgaagcgcg

SEQ ID NO: 129621 - RNA, 20 nt, Artificial Sequence
  mmSKRIPTE0000400_Zfp335_4
  gRNA
ccacacaugugcgauaaggu

SEQ ID NO: 129622 - RNA, 20 nt, Artificial Sequence
  mmSKRIPTE0000401_Zfp335_5
  gRNA
gaaguggcaugacgucacgc

SEQ ID NO: 129623 - RNA, 20 nt, Artificial Sequence
  mmSKRIPTE0000402_Zfp335_6
  gRNA
gcacucgucugacccuagag

SEQ ID NO: 129624 - RNA, 20 nt, Artificial Sequence
  mmSKRIPTE0000403_Zfp335_7
  gRNA
ucccuaccgcaccuuccgcg

SEQ ID NO: 129625 - RNA, 20 nt, Artificial Sequence
  mmSKRIPTE0000404_Zfp335_8
  gRNA
uugaggcucagucauccgag

SEQ ID NO: 129626 - RNA, 20 nt, Artificial Sequence
  mmSKRIPTE0000405_Zfp335_9
  gRNA
aacguggcccaaaucccgau

SEQ ID NO: 129627 - RNA, 20 nt, Artificial Sequence
  mmSKRIPTE0000406_Skil_1
  gRNA
gaacuuaguagccaccgucg

SEQ ID NO: 129628 - RNA, 20 nt, Artificial Sequence
  mmSKRIPTE0000407_Skil_2
  gRNA
cgaaugcaugacgaacgucu

SEQ ID NO: 129629 - RNA, 20 nt, Artificial Sequence
  mmSKRIPTE0000408_Skil_3
  gRNA
cauucuagaaagcucaaccg

SEQ ID NO: 129630 - RNA, 20 nt, Artificial Sequence
  mmSKRIPTE0000409_Skil_4
  gRNA
uuacccagacgucucacuug

SEQ ID NO: 129631 - RNA, 20 nt, Artificial Sequence
  mmSKRIPTE0000410_Skil_5
  gRNA
ccccagucugaaacacacgc

SEQ ID NO: 129632 - RNA, 20 nt, Artificial Sequence
  mmSKRIPTE0000411_Skil_6
  gRNA
aaucguuuaaagcaccagug

SEQ ID NO: 129633 - RNA, 20 nt, Artificial Sequence
  mmSKRIPTE0000412_Skil_7
  gRNA
ggggcuuugagucagccaag

SEQ ID NO: 129634 - RNA, 20 nt, Artificial Sequence
  mmSKRIPTE0000413_Skil_8
  gRNA
ggucaacgugaucagcccac

SEQ ID NO: 129635 - RNA, 20 nt, Artificial Sequence
  mmSKRIPTE0000414_Skil_9
  gRNA
agucggugacaugcucuccu

SEQ ID NO: 129636 - RNA, 20 nt, Artificial Sequence
  mmSKRIPTE0000415_Ripk2_1
  gRNA
aaggacuuaaggacucgccg

SEQ ID NO: 129637 - RNA, 20 nt, Artificial Sequence
  mmSKRIPTE0000416_Ripk2_2
  gRNA
accaagcugaggauacguag

SEQ ID NO: 129638 - RNA, 20 nt, Artificial Sequence
  mmSKRIPTE0000417_Ripk2_3
  gRNA
auugaacggaguuagcugug

SEQ ID NO: 129639 - RNA, 20 nt, Artificial Sequence
  mmSKRIPTE0000418_Ripk2_4
  gRNA
agucugacgcacguccagga

SEQ ID NO: 129640 - RNA, 20 nt, Artificial Sequence
  mmSKRIPTE0000419_Ripk2_5
  gRNA
gaccugcacuaccucagccg

SEQ ID NO: 129641 - RNA, 20 nt, Artificial Sequence
  mmSKRIPTE0000420_Ripk2_6
  gRNA
gagaucaugagaccucgaug

SEQ ID NO: 129642 - RNA, 20 nt, Artificial Sequence
  mmSKRIPTE0000421_Ripk2_7
  gRNA
ugccgacgagaccgugccag

SEQ ID NO: 129643 - RNA, 20 nt, Artificial Sequence
  mmSKRIPTE0000422_Ripk2_8
  gRNA
cuauaaauuccuccuaggag

SEQ ID NO: 129644 - RNA, 20 nt, Artificial Sequence
  mmSKRIPTE0000423_Ripk2_9
  gRNA
cguucauggcuccggcugcg

SEQ ID NO: 129645 - RNA, 20 nt, Artificial Sequence
  mmSKRIPTE0000424_Igbp1_1
  gRNA
ccuuuaaggcuaaaaccgcg

SEQ ID NO: 129646 - RNA, 20 nt, Artificial Sequence
  mmSKRIPTE0000425_Igbp1_2
  gRNA
uacggaguauuacccgaccg

SEQ ID NO: 129647 - RNA, 20 nt, Artificial Sequence
  mmSKRIPTE0000426_Igbp1_3
  gRNA
ucauggcacaccuaguggga

SEQ ID NO: 129648 - RNA, 20 nt, Artificial Sequence
  mmSKRIPTE0000427_Igbp1_4
  gRNA
aggcagucagccguacacga

SEQ ID NO: 129649 - RNA, 20 nt, Artificial Sequence
  mmSKRIPTE0000428_Igbp1_5
  gRNA
caguagucgaagcaguacac

SEQ ID NO: 129650 - RNA, 20 nt, Artificial Sequence
  mmSKRIPTE0000429_Igbp1_6
  gRNA
ggucuguucaaagaaccgga

SEQ ID NO: 129651 - RNA, 20 nt, Artificial Sequence
  mmSKRIPTE0000430_Igbp1_7
  gRNA
uacuaaagaugggcuccacg

SEQ ID NO: 129652 - RNA, 20 nt, Artificial Sequence
  mmSKRIPTE0000431_Igbp1_8
  gRNA
acugagccauguugaaccug

SEQ ID NO: 129653 - RNA, 20 nt, Artificial Sequence
  mmSKRIPTE0000432_Igbp1_9
  gRNA
acgacuuuaaaacaagcggc

SEQ ID NO: 129654 - RNA, 20 nt, Artificial Sequence
  mmSKRIPTE0000433_Adcyap1_1
  gRNA
aguaguuggacgccccagcg

SEQ ID NO: 129655 - RNA, 20 nt, Artificial Sequence
  mmSKRIPTE0000434_Adcyap1_2
  gRNA
auuccagcgcagaaacucga

SEQ ID NO: 129656 - RNA, 20 nt, Artificial Sequence
  mmSKRIPTE0000435_Adcyap1_3
  gRNA
ggcguaagcgucacgcagcg

SEQ ID NO: 129657 - RNA, 20 nt, Artificial Sequence
  mmSKRIPTE0000436_Adcyap1_4
  gRNA
gggaaacaaagaaugcgacg

SEQ ID NO: 129658 - RNA, 20 nt, Artificial Sequence
  mmSKRIPTE0000437_Adcyap1_5
  gRNA
ggagaaccuaggcggcagcg

SEQ ID NO: 129659 - RNA, 20 nt, Artificial Sequence
  mmSKRIPTE0000438_Adcyap1_6
  gRNA
aaggcgugugcaucauucga

SEQ ID NO: 129660 - RNA, 20 nt, Artificial Sequence
  mmSKRIPTE0000439_Adcyap1_7
  gRNA
guagacgcacaaaacuagga

SEQ ID NO: 129661 - RNA, 20 nt, Artificial Sequence
  mmSKRIPTE0000440_Adcyap1_8
  gRNA
agucacaguauucccgccag

SEQ ID NO: 129662 - RNA, 20 nt, Artificial Sequence
  mmSKRIPTE0000441_Adcyap1_9
  gRNA
cugugaagaugccguccgag

SEQ ID NO: 129663 - RNA, 20 nt, Artificial Sequence
  mmSKRIPTE0000442_Nfe2l2_1
  gRNA
gcaauggcuaguccgagcag

SEQ ID NO: 129664 - RNA, 20 nt, Artificial Sequence
  mmSKRIPTE0000443_Nfe2l2_2
  gRNA
auuugcuuagaggacacccg

SEQ ID NO: 129665 - RNA, 20 nt, Artificial Sequence
  mmSKRIPTE0000444_Nfe2l2_3
  gRNA
gagccaggacuacgacggca

SEQ ID NO: 129666 - RNA, 20 nt, Artificial Sequence
  mmSKRIPTE0000445_Nfe2l2_4
  gRNA
gagaacggaagguuacaacg

SEQ ID NO: 129667 - RNA, 20 nt, Artificial Sequence
  mmSKRIPTE0000446_Nfe2l2_5
  gRNA
cucggaccccacucucgucg

SEQ ID NO: 129668 - RNA, 20 nt, Artificial Sequence
  mmSKRIPTE0000447_Nfe2l2_6
  gRNA
gagcuuggaaucgcguacag

SEQ ID NO: 129669 - RNA, 20 nt, Artificial Sequence
  mmSKRIPTE0000448_Nfe2l2_7
  gRNA
agaagguuucuaucaaucga

SEQ ID NO: 129670 - RNA, 20 nt, Artificial Sequence
  mmSKRIPTE0000449_Nfe2l2_8
  gRNA
gguccuuguuccgcccccag

SEQ ID NO: 129671 - RNA, 20 nt, Artificial Sequence
  mmSKRIPTE0000450_Nfe2l2_9
  gRNA
gauugcugugcguccagacg

SEQ ID NO: 129672 - RNA, 20 nt, Artificial Sequence
  mmSKRIPTE0000451_Tek_1
  gRNA
cucaaggagugguagcaucg

SEQ ID NO: 129673 - RNA, 20 nt, Artificial Sequence
  mmSKRIPTE0000452_Tek_2
  gRNA
cccgcauuaagauaucgcau

SEQ ID NO: 129674 - RNA, 20 nt, Artificial Sequence
  mmSKRIPTE0000453_Tek_3
  gRNA
cuuacuccgaacaaucagcc

SEQ ID NO: 129675 - RNA, 20 nt, Artificial Sequence
  mmSKRIPTE0000454_Tek_4
  gRNA
aaggcgcucucgcgccagug

SEQ ID NO: 129676 - RNA, 20 nt, Artificial Sequence
  mmSKRIPTE0000455_Tek_5
  gRNA
cuacugcggcaugacgugcg

SEQ ID NO: 129677 - RNA, 20 nt, Artificial Sequence
  mmSKRIPTE0000456_Tek_6
  gRNA
ccgagcuagagucaacacca

SEQ ID NO: 129678 - RNA, 20 nt, Artificial Sequence
  mmSKRIPTE0000457_Tek_7
  gRNA
uacugguguaagucuuaccc

SEQ ID NO: 129679 - RNA, 20 nt, Artificial Sequence
  mmSKRIPTE0000458_Tek_8
  gRNA
ggacugauauaucagcguag

SEQ ID NO: 129680 - RNA, 20 nt, Artificial Sequence
  mmSKRIPTE0000459_Tek_9
  gRNA
ccccuggcauagauacugug

SEQ ID NO: 129681 - RNA, 20 nt, Artificial Sequence
  mmSKRIPTE0000460_Suau2_1
  gRNA
cggaccaagauagcgaacag

SEQ ID NO: 129682 - RNA, 20 nt, Artificial Sequence
  mmSKRIPTE0000461_Suau2_2
  gRNA
cacaccguagagcagcggca

SEQ ID NO: 129683 - RNA, 20 nt, Artificial Sequence
  mmSKRIPTE0000462_Suau2_3
  gRNA
aaucacugaagucggcggug

SEQ ID NO: 129684 - RNA, 20 nt, Artificial Sequence
  mmSKRIPTE0000463_Suau2_4
  gRNA
gcacgcucagaagagcggag

SEQ ID NO: 129685 - RNA, 20 nt, Artificial Sequence
  mmSKRIPTE0000464_Suau2_5
  gRNA
ucggcguuccgggaucggug

SEQ ID NO: 129686 - RNA, 20 nt, Artificial Sequence
  mmSKRIPTE0000465_Suau2_6
  gRNA
gccaaugagagugacacgcg

SEQ ID NO: 129687 - RNA, 20 nt, Artificial Sequence
  mmSKRIPTE0000466_Suau2_7
  gRNA
cacaacugcuauuacuaaug

SEQ ID NO: 129688 - RNA, 20 nt, Artificial Sequence
  mmSKRIPTE0000467_Suau2_8
  gRNA
aaguuuauuaugacguacga

SEQ ID NO: 129689 - RNA, 20 nt, Artificial Sequence
  mmSKRIPTE0000468_Suau2_9
  gRNA
gguuggccgauuaaccaccc

SEQ ID NO: 129690 - RNA, 20 nt, Artificial Sequence
  mmSKRIPTE0000469_Tgfb3_1
  gRNA
ggucccgcuacuucguccag

SEQ ID NO: 129691 - RNA, 20 nt, Artificial Sequence
  mmSKRIPTE0000470_Tgfb3_2
  gRNA
auccggucgaaguaucugug

SEQ ID NO: 129692 - RNA, 20 nt, Artificial Sequence
  mmSKRIPTE0000471_Tgfb3_3
  gRNA
ugcuacaugccaaguauccg

SEQ ID NO: 129693 - RNA, 20 nt, Artificial Sequence
  mmSKRIPTE0000472_Tgfb3_4
  gRNA
gugaguccucugguucgacg

SEQ ID NO: 129694 - RNA, 20 nt, Artificial Sequence
  mmSKRIPTE0000473_Tgfb3_5
  gRNA
gaaaugggaguuccaccgag

SEQ ID NO: 129695 - RNA, 20 nt, Artificial Sequence
  mmSKRIPTE0000474_Tgfb3_6
  gRNA
ccaggccgauacgucauggg

SEQ ID NO: 129696 - RNA, 20 nt, Artificial Sequence
  mmSKRIPTE0000475_Tgfb3_7
  gRNA
ucacugacacugugcgcgag

SEQ ID NO: 129697 - RNA, 20 nt, Artificial Sequence
  mmSKRIPTE0000476_Tgfb3_8
  gRNA
uaagagggcugcauuacccg

SEQ ID NO: 129698 - RNA, 20 nt, Artificial Sequence
  mmSKRIPTE0000477_Tgfb3_9
  gRNA
gggacgugggucaucaccga

SEQ ID NO: 129699 - RNA, 20 nt, Artificial Sequence
  mmSKRIPTE0000478_Apc_1
  gRNA
gcgguuaccucgcuuagaug

SEQ ID NO: 129700 - RNA, 20 nt, Artificial Sequence
  mmSKRIPTE0000479_Apc_2
  gRNA
uugagcguaguuucacuccg

SEQ ID NO: 129701 - RNA, 20 nt, Artificial Sequence
  mmSKRIPTE0000480_Apc_3
  gRNA
aggcacacgugaccgacaug

SEQ ID NO: 129702 - RNA, 20 nt, Artificial Sequence
  mmSKRIPTE0000481_Apc_4
  gRNA
aguuaaaguacaccguguug

SEQ ID NO: 129703 - RNA, 20 nt, Artificial Sequence
  mmSKRIPTE0000482_Apc_5
  gRNA
aacucucuccagaaugcgca

SEQ ID NO: 129704 - RNA, 20 nt, Artificial Sequence
  mmSKRIPTE0000483_Apc_6
  gRNA
uaccauggaaauuaucaccu

SEQ ID NO: 129705 - RNA, 20 nt, Artificial Sequence
  mmSKRIPTE0000484_Apc_7
  gRNA
caacgguuuaaggcagucca

SEQ ID NO: 129706 - RNA, 20 nt, Artificial Sequence
  mmSKRIPTE0000485_Apc_8
  gRNA
gcuguuaaagagcagaaccg

SEQ ID NO: 129707 - RNA, 20 nt, Artificial Sequence
  mmSKRIPTE0000486_Apc_9
  gRNA
gaagauguguguagucaaug

SEQ ID NO: 129708 - RNA, 20 nt, Artificial Sequence
  mmSKRIPTE0000487_Ak7_1
  gRNA
aucccaacacccuauccucg

SEQ ID NO: 129709 - RNA, 20 nt, Artificial Sequence
  mmSKRIPTE0000488_Ak7_2
  gRNA
agcgaggaaaccguaagcga

SEQ ID NO: 129710 - RNA, 20 nt, Artificial Sequence
  mmSKRIPTE0000489_Ak7_3
  gRNA
uuagagcagcgucaccugug

SEQ ID NO: 129711 - RNA, 20 nt, Artificial Sequence
  mmSKRIPTE0000490_Ak7_4
  gRNA
gggaggccucuuacccugcg

SEQ ID NO: 129712 - RNA, 20 nt, Artificial Sequence
  mmSKRIPTE0000491_Ak7_5
  gRNA
ugugcugauuggaaaugccg

SEQ ID NO: 129713 - RNA, 20 nt, Artificial Sequence
  mmSKRIPTE0000492_Ak7_6
  gRNA
ucuccuccuuagcaaccgac

SEQ ID NO: 129714 - RNA, 20 nt, Artificial Sequence
  mmSKRIPTE0000493_Ak7_7
  gRNA
ugugcucagacguccuaacg

SEQ ID NO: 129715 - RNA, 20 nt, Artificial Sequence
  mmSKRIPTE0000494_Ak7_8
  gRNA
gaugucaugcacgaaucugu

SEQ ID NO: 129716 - RNA, 20 nt, Artificial Sequence
  mmSKRIPTE0000495_Ak7_9
  gRNA
ucaaaacuccacuuagcacg

SEQ ID NO: 129717 - RNA, 20 nt, Artificial Sequence
  mmSKRIPTE0000496_Nfil3_1
  gRNA
cuaacacacaucucucggcg

SEQ ID NO: 129718 - RNA, 20 nt, Artificial Sequence
  mmSKRIPTE0000497_Nfil3_2
  gRNA
ggacgagcaugagccugcga

SEQ ID NO: 129719 - RNA, 20 nt, Artificial Sequence
  mmSKRIPTE0000498_Nfil3_3
  gRNA
gauuucuugggcauacgccg

SEQ ID NO: 129720 - RNA, 20 nt, Artificial Sequence
  mmSKRIPTE0000499_Nfil3_4
  gRNA
gcaccucccaaacuaccggg

SEQ ID NO: 129721 - RNA, 20 nt, Artificial Sequence
  mmSKRIPTE0000500_Nfil3_5
  gRNA
ucuguuccacuugaucggau

SEQ ID NO: 129722 - RNA, 20 nt, Artificial Sequence
  mmSKRIPTE0000501_Nfil3_6
  gRNA
acucaggaaagccccgcaca

SEQ ID NO: 129723 - RNA, 20 nt, Artificial Sequence
  mmSKRIPTE0000502_Nfil3_7
  gRNA
cgaagccgagaucgguugug

SEQ ID NO: 129724 - RNA, 20 nt, Artificial Sequence
  mmSKRIPTE0000503_Nfil3_8
  gRNA
ucguccuacagaccggaugg

SEQ ID NO: 129725 - RNA, 20 nt, Artificial Sequence
  mmSKRIPTE0000504_Nfil3_9
  gRNA
aaaacaaauccucggcgugu

SEQ ID NO: 129726 - RNA, 20 nt, Artificial Sequence
  mmSKRIPTE0000505_Nov_1
  gRNA
augaucacagcaacauacgu

SEQ ID NO: 129727 - RNA, 20 nt, Artificial Sequence
  mmSKRIPTE0000506_Nov_2
  gRNA
uccagggacgcaaaaccggu

SEQ ID NO: 129728 - RNA, 20 nt, Artificial Sequence
  mmSKRIPTE0000507_Nov_3
  gRNA
agagugucucuuaauuacgu

SEQ ID NO: 129729 - RNA, 20 nt, Artificial Sequence
  mmSKRIPTE0000508_Nov_4
  gRNA
gcauugagcagacgacggag

SEQ ID NO: 129730 - RNA, 20 nt, Artificial Sequence
  mmSKRIPTE0000509_Nov_5
  gRNA
cgcaggucggugauauacug

SEQ ID NO: 129731 - RNA, 20 nt, Artificial Sequence
  mmSKRIPTE0000510_Nov_6
  gRNA
gugacuagggcugaagacga

SEQ ID NO: 129732 - RNA, 20 nt, Artificial Sequence
  mmSKRIPTE0000511_Nov_7
  gRNA
caaguugaccuaccccaaca

SEQ ID NO: 129733 - RNA, 20 nt, Artificial Sequence
  mmSKRIPTE0000512_Nov_8
  gRNA
aucuguaguucacaauggga

SEQ ID NO: 129734 - RNA, 20 nt, Artificial Sequence
  mmSKRIPTE0000513_Nov_9
  gRNA
gauggggucauuuaccgcaa

SEQ ID NO: 129735 - RNA, 20 nt, Artificial Sequence
  mmSKRIPTE0000514_Src_1
  gRNA
augugggacauacgguagug

SEQ ID NO: 129736 - RNA, 20 nt, Artificial Sequence
  mmSKRIPTE0000515_Src_2
  gRNA
ucuaguaccgagucccucgu

SEQ ID NO: 129737 - RNA, 20 nt, Artificial Sequence
  mmSKRIPTE0000516_Src_3
  gRNA
agccaaguauguuacaugcg

SEQ ID NO: 129738 - RNA, 20 nt, Artificial Sequence
  mmSKRIPTE0000517_Src_4
  gRNA
acuuuggcaagaucacuaga

SEQ ID NO: 129739 - RNA, 20 nt, Artificial Sequence
  mmSKRIPTE0000518_Src_5
  gRNA
gcccucggaaaacgugcacg

SEQ ID NO: 129740 - RNA, 20 nt, Artificial Sequence
  mmSKRIPTE0000519_Src_6
  gRNA
ucccugucggggagagacgu

SEQ ID NO: 129741 - RNA, 20 nt, Artificial Sequence
  mmSKRIPTE0000520_Src_7
  gRNA
gauguagcguacacucauug

SEQ ID NO: 129742 - RNA, 20 nt, Artificial Sequence
  mmSKRIPTE0000521_Src_8
  gRNA
gauucguaaacuggaaagcg

SEQ ID NO: 129743 - RNA, 20 nt, Artificial Sequence
  mmSKRIPTE0000522_Src_9
  gRNA
aggggcgacagaaauccccg

SEQ ID NO: 129744 - RNA, 20 nt, Artificial Sequence
  mmSKRIPTE0000523_Pde5a_1
  gRNA
cugugucaucugauuccacg

SEQ ID NO: 129745 - RNA, 20 nt, Artificial Sequence
  mmSKRIPTE0000524_Pde5a_2
  gRNA
cauacugcccgucuaucggg

SEQ ID NO: 129746 - RNA, 20 nt, Artificial Sequence
  mmSKRIPTE0000525_Pde5a_3
  gRNA
aggguuuaguaaucgcagag

SEQ ID NO: 129747 - RNA, 20 nt, Artificial Sequence
  mmSKRIPTE0000526_Pde5a_4
  gRNA
acgcucauauaaauuaaucg

SEQ ID NO: 129748 - RNA, 20 nt, Artificial Sequence
  mmSKRIPTE0000527_Pde5a_5
  gRNA
acaccguggaaccuccaucg

SEQ ID NO: 129749 - RNA, 20 nt, Artificial Sequence
  mmSKRIPTE0000528_Pde5a_6
  gRNA
acugugccuaacauacggag

SEQ ID NO: 129750 - RNA, 20 nt, Artificial Sequence
  mmSKRIPTE0000529_Pde5a_7
  gRNA
agccaugacuuggaucaucg

SEQ ID NO: 129751 - RNA, 20 nt, Artificial Sequence
  mmSKRIPTE0000530_Pde5a_8
  gRNA
caaacagucuucggauacgu

SEQ ID NO: 129752 - RNA, 20 nt, Artificial Sequence
  mmSKRIPTE0000531_Pde5a_9
  gRNA
auccguuuagaguggaacaa

SEQ ID NO: 129753 - RNA, 20 nt, Artificial Sequence
  mmSKRIPTE0000532_Fancd2_1
  gRNA
aguaacgucacgccacggcg

SEQ ID NO: 129754 - RNA, 20 nt, Artificial Sequence
  mmSKRIPTE0000533_Fancd2_2
  gRNA
uaugauacguauaacccgug

SEQ ID NO: 129755 - RNA, 20 nt, Artificial Sequence
  mmSKRIPTE0000534_Fancd2_3
  gRNA
cagcuccaguuagagccgag

SEQ ID NO: 129756 - RNA, 20 nt, Artificial Sequence
  mmSKRIPTE0000535_Fancd2_4
  gRNA
acuccaauaccuugucuacg

SEQ ID NO: 129757 - RNA, 20 nt, Artificial Sequence
  mmSKRIPTE0000536_Fancd2_5
  gRNA
aacuuucaacugguuccgag

SEQ ID NO: 129758 - RNA, 20 nt, Artificial Sequence
  mmSKRIPTE0000537_Fancd2_6
  gRNA
agcgggaaagucgaaaacga

SEQ ID NO: 129759 - RNA, 20 nt, Artificial Sequence
  mmSKRIPTE0000538_Fancd2_7
  gRNA
guaaugguuugaauagaucg

SEQ ID NO: 129760 - RNA, 20 nt, Artificial Sequence
  mmSKRIPTE0000539_Fancd2_8
  gRNA
gccugucaucauuguccccg

SEQ ID NO: 129761 - RNA, 20 nt, Artificial Sequence
  mmSKRIPTE0000540_Fancd2_9
  gRNA
caaccacuuccuauacaggg

SEQ ID NO: 129762 - RNA, 20 nt, Artificial Sequence
  mmSKRIPTE0000541_Psen2_1
  gRNA
uggcuggagcuacuaccgca

SEQ ID NO: 129763 - RNA, 20 nt, Artificial Sequence
  mmSKRIPTE0000542_Psen2_2
  gRNA
gaagcaggccaucugaacgc

SEQ ID NO: 129764 - RNA, 20 nt, Artificial Sequence
  mmSKRIPTE0000543_Psen2_3
  gRNA
gguucuaacagagcagcgug

SEQ ID NO: 129765 - RNA, 20 nt, Artificial Sequence
  mmSKRIPTE0000544_Psen2_4
  gRNA
agacagguagcaccgaaggg

SEQ ID NO: 129766 - RNA, 20 nt, Artificial Sequence
  mmSKRIPTE0000545_Psen2_5
  gRNA
gauggaaguaucucucucga

SEQ ID NO: 129767 - RNA, 20 nt, Artificial Sequence
  mmSKRIPTE0000546_Psen2_6
  gRNA
aauccugagacuagcccgaa

SEQ ID NO: 129768 - RNA, 20 nt, Artificial Sequence
  mmSKRIPTE0000547_Psen2_7
  gRNA
ggaccgcuacgcaugcagug

SEQ ID NO: 129769 - RNA, 20 nt, Artificial Sequence
  mmSKRIPTE0000548_Psen2_8
  gRNA
uagcggccacugcuaccaca

SEQ ID NO: 129770 - RNA, 20 nt, Artificial Sequence
  mmSKRIPTE0000549_Psen2_9
  gRNA
gguggcauguucaugcgaug

SEQ ID NO: 129771 - RNA, 20 nt, Artificial Sequence
  mmSKRIPTE0000550_Trdc_1
  gRNA
guaucuagcuuaaagccggu

SEQ ID NO: 129772 - RNA, 20 nt, Artificial Sequence
  mmSKRIPTE0000551_Trdc_2
  gRNA
gcccuaacaacucaauaccg

SEQ ID NO: 129773 - RNA, 20 nt, Artificial Sequence
  mmSKRIPTE0000552_Trdc_3
  gRNA
agcgaaaaguagccucaaug

SEQ ID NO: 129774 - RNA, 20 nt, Artificial Sequence
  mmSKRIPTE0000553_Trdc_4
  gRNA
aguccaugcuguuccccgug

SEQ ID NO: 129775 - RNA, 20 nt, Artificial Sequence
  mmSKRIPTE0000554_Trdc_5
  gRNA
cagugugaagugacuaccag

SEQ ID NO: 129776 - RNA, 20 nt, Artificial Sequence
  mmSKRIPTE0000555_Trdc_6
  gRNA
aguuauuagauacagacucg

SEQ ID NO: 129777 - RNA, 20 nt, Artificial Sequence
  mmSKRIPTE0000556_Trdc_7
  gRNA
uauggcuggaaacgaaacca

SEQ ID NO: 129778 - RNA, 20 nt, Artificial Sequence
  mmSKRIPTE0000557_Trdc_8
  gRNA
acuaauacacaguaaugacu

SEQ ID NO: 129779 - RNA, 20 nt, Artificial Sequence
  mmSKRIPTE0000558_Trdc_9
  gRNA
uuucucguugagacuccaag

SEQ ID NO: 129780 - RNA, 20 nt, Artificial Sequence
  mmSKRIPTE0000559_Bcl6_1
  gRNA
cagcaacaucuacucgccca

SEQ ID NO: 129781 - RNA, 20 nt, Artificial Sequence
  mmSKRIPTE0000560_Bcl6_2
  gRNA
cauggccuaccgaggucgug

SEQ ID NO: 129782 - RNA, 20 nt, Artificial Sequence
  mmSKRIPTE0000561_Bcl6_3
  gRNA
ccaaccucuaguguacacau

SEQ ID NO: 129783 - RNA, 20 nt, Artificial Sequence
  mmSKRIPTE0000562_Bcl6_4
  gRNA
uaccauguacguaaaccccg

SEQ ID NO: 129784 - RNA, 20 nt, Artificial Sequence
  mmSKRIPTE0000563_Bcl6_5
  gRNA
guccuaaaauaagaccggag

SEQ ID NO: 129785 - RNA, 20 nt, Artificial Sequence
  mmSKRIPTE0000564_Bcl6_6
  gRNA
caaggugcaauaccgcgugu

SEQ ID NO: 129786 - RNA, 20 nt, Artificial Sequence
  mmSKRIPTE0000565_Bcl6_7
  gRNA
ccguguaaaaaggcaccgug

SEQ ID NO: 129787 - RNA, 20 nt, Artificial Sequence
  mmSKRIPTE0000566_Bcl6_8
  gRNA
gggacaaggccguacccgug

SEQ ID NO: 129788 - RNA, 20 nt, Artificial Sequence
  mmSKRIPTE0000567_Bcl6_9
  gRNA
gggguggaaacucuauacac

SEQ ID NO: 129789 - RNA, 20 nt, Artificial Sequence
  mmSKRIPTE0000568_Prkce_1
  gRNA
gcucuggcuguguaggacga

SEQ ID NO: 129790 - RNA, 20 nt, Artificial Sequence
  mmSKRIPTE0000569_Prkce_2
  gRNA
acggacccgaagaaccagcg

SEQ ID NO: 129791 - RNA, 20 nt, Artificial Sequence
  mmSKRIPTE0000570_Prkce_3
  gRNA
aguaggaauaucguccugcg

SEQ ID NO: 129792 - RNA, 20 nt, Artificial Sequence
  mmSKRIPTE0000571_Prkce_4
  gRNA
gccaugaacccaaacaaacg

SEQ ID NO: 129793 - RNA, 20 nt, Artificial Sequence
  mmSKRIPTE0000572_Prkce_5
  gRNA
ccggagggaugcaugucgag

SEQ ID NO: 129794 - RNA, 20 nt, Artificial Sequence
  mmSKRIPTE0000573_Prkce_6
  gRNA
acuucugagcuuccguacgg

SEQ ID NO: 129795 - RNA, 20 nt, Artificial Sequence
  mmSKRIPTE0000574_Prkce_7
  gRNA
cauccguucaacaauacgcu

SEQ ID NO: 129796 - RNA, 20 nt, Artificial Sequence
  mmSKRIPTE0000575_Prkce_8
  gRNA
acaaggggaagggacuacgu

SEQ ID NO: 129797 - RNA, 20 nt, Artificial Sequence
  mmSKRIPTE0000576_Prkce_9
  gRNA
cucuagaaagaaacgcuacg

SEQ ID NO: 129798 - RNA, 20 nt, Artificial Sequence
  mmSKRIPTE0000577_Suap1_1
  gRNA
ugcuggcaacacguucaggu

SEQ ID NO: 129799 - RNA, 20 nt, Artificial Sequence
  mmSKRIPTE0000578_Suap1_2
  gRNA
ucuuuacagguugauucggg

SEQ ID NO: 129800 - RNA, 20 nt, Artificial Sequence
  mmSKRIPTE0000579_Suap1_3
  gRNA
guauaacccaaacagaaacg

SEQ ID NO: 129801 - RNA, 20 nt, Artificial Sequence
  mmSKRIPTE0000580_Suap1_4
  gRNA
gaaugucaaauaaagcaacg

SEQ ID NO: 129802 - RNA, 20 nt, Artificial Sequence
  mmSKRIPTE0000581_Suap1_5
  gRNA
cuacuccaucacuauccggc

SEQ ID NO: 129803 - RNA, 20 nt, Artificial Sequence
  mmSKRIPTE0000582_Suap1_6
  gRNA
aucguaaguagagccugaug

SEQ ID NO: 129804 - RNA, 20 nt, Artificial Sequence
  mmSKRIPTE0000583_Suap1_7
  gRNA
cguugaucaugacauaagag

SEQ ID NO: 129805 - RNA, 20 nt, Artificial Sequence
  mmSKRIPTE0000584_Suap1_8
  gRNA
ccacauuauucugagaacgu

SEQ ID NO: 129806 - RNA, 20 nt, Artificial Sequence
  mmSKRIPTE0000585_Suap1_9
  gRNA
cuuuccuggaagauccugcg

SEQ ID NO: 129807 - RNA, 20 nt, Artificial Sequence
  mmSKRIPTE0000586_Myo1e_1
  gRNA
caucggggacuacaucggga

SEQ ID NO: 129808 - RNA, 20 nt, Artificial Sequence
  mmSKRIPTE0000587_Myo1e_2
  gRNA
gaaguggcugcacguuaucg

SEQ ID NO: 129809 - RNA, 20 nt, Artificial Sequence
  mmSKRIPTE0000588_Myo1e_3
  gRNA
uuauggccugauacgcccug

SEQ ID NO: 129810 - RNA, 20 nt, Artificial Sequence
  mmSKRIPTE0000589_Myo1e_4
  gRNA
aauuucggacuacugaaccg

SEQ ID NO: 129811 - RNA, 20 nt, Artificial Sequence
  mmSKRIPTE0000590_Myo1e_5
  gRNA
uaaaucugguguaaguagcg

SEQ ID NO: 129812 - RNA, 20 nt, Artificial Sequence
  mmSKRIPTE0000591_Myo1e_6
  gRNA
ugguggacggguagacuacg

SEQ ID NO: 129813 - RNA, 20 nt, Artificial Sequence
  mmSKRIPTE0000592_Myo1e_7
  gRNA
gagccucauugcuguccccg

SEQ ID NO: 129814 - RNA, 20 nt, Artificial Sequence
  mmSKRIPTE0000593_Myo1e_8
  gRNA
gcucugccaaugguaccggu

SEQ ID NO: 129815 - RNA, 20 nt, Artificial Sequence
  mmSKRIPTE0000594_Myo1e_9
  gRNA
agugggcaacuaugccgccg

SEQ ID NO: 129816 - RNA, 20 nt, Artificial Sequence
  mmSKRIPTE0000595_Wnt3a_1
  gRNA
agcacuaagagguauccgag

SEQ ID NO: 129817 - RNA, 20 nt, Artificial Sequence
  mmSKRIPTE0000596_Wnt3a_2
  gRNA
cggaugcaggcuaucauacg

SEQ ID NO: 129818 - RNA, 20 nt, Artificial Sequence
  mmSKRIPTE0000597_Wnt3a_3
  gRNA
gagcccugucgggucaagag

SEQ ID NO: 129819 - RNA, 20 nt, Artificial Sequence
  mmSKRIPTE0000598_Wnt3a_4
  gRNA
guaugaacuucggagacaug

SEQ ID NO: 129820 - RNA, 20 nt, Artificial Sequence
  mmSKRIPTE0000599_Wnt3a_5
  gRNA
ggagcaggguucauuccgag

SEQ ID NO: 129821 - RNA, 20 nt, Artificial Sequence
  mmSKRIPTE0000600_Wnt3a_6
  gRNA
ggaaccguaagcccaccagg

SEQ ID NO: 129822 - RNA, 20 nt, Artificial Sequence
  mmSKRIPTE0000601_Wnt3a_7
  gRNA
uuucaccgggauguccagug

SEQ ID NO: 129823 - RNA, 20 nt, Artificial Sequence
  mmSKRIPTE0000602_Wnt3a_8
  gRNA
cgguggugcaguuccaacgc

SEQ ID NO: 129824 - RNA, 20 nt, Artificial Sequence
  mmSKRIPTE0000603_Wnt3a_9
  gRNA
accuugaaguacguguaacg

SEQ ID NO: 129825 - RNA, 20 nt, Artificial Sequence
  mmSKRIPTE0000604_Ppargc1b_1
  gRNA
gacgugggugcagaaccgcg

SEQ ID NO: 129826 - RNA, 20 nt, Artificial Sequence
  mmSKRIPTE0000605_Ppargc1b_2
  gRNA
uaaugcgucccagaguauga

SEQ ID NO: 129827 - RNA, 20 nt, Artificial Sequence
  mmSKRIPTE0000606_Ppargc1b_3
  gRNA
guaccggauaaguagccccg

SEQ ID NO: 129828 - RNA, 20 nt, Artificial Sequence
  mmSKRIPTE0000607_Ppargc1b_4
  gRNA
aggagcccaagaaccuacgu

SEQ ID NO: 129829 - RNA, 20 nt, Artificial Sequence
  mmSKRIPTE0000608_Ppargc1b_5
  gRNA
uggacgagcuuucacuggug

SEQ ID NO: 129830 - RNA, 20 nt, Artificial Sequence
  mmSKRIPTE0000609_Ppargc1b_6
  gRNA
uagacuaaaucugccacccg

SEQ ID NO: 129831 - RNA, 20 nt, Artificial Sequence
  mmSKRIPTE0000610_Ppargc1b_7
  gRNA
ccagcuaaguauccagauag

SEQ ID NO: 129832 - RNA, 20 nt, Artificial Sequence
  mmSKRIPTE0000611_Ppargc1b_8
  gRNA
caacuaucucucugacacgc

SEQ ID NO: 129833 - RNA, 20 nt, Artificial Sequence
  mmSKRIPTE0000612_Ppargc1b_9
  gRNA
ggaccccagaucacuuacga

SEQ ID NO: 129834 - RNA, 20 nt, Artificial Sequence
  mmSKRIPTE0000613_Rnf41_1
  gRNA
agggcuaacccgagacagcg

SEQ ID NO: 129835 - RNA, 20 nt, Artificial Sequence
  mmSKRIPTE0000614_Rnf41_2
  gRNA
cccacugcugcuacgcaacg

SEQ ID NO: 129836 - RNA, 20 nt, Artificial Sequence
  mmSKRIPTE0000615_Rnf41_3
  gRNA
agcagaacaagcuauucgag

SEQ ID NO: 129837 - RNA, 20 nt, Artificial Sequence
  mmSKRIPTE0000616_Rnf41_4
  gRNA
ccgaguuaaauagagaggcg

SEQ ID NO: 129838 - RNA, 20 nt, Artificial Sequence
  mmSKRIPTE0000617_Rnf41_5
  gRNA
caguucaguagggaacccgu

SEQ ID NO: 129839 - RNA, 20 nt, Artificial Sequence
  mmSKRIPTE0000618_Rnf41_6
  gRNA
uggacagacuuggaucggau

SEQ ID NO: 129840 - RNA, 20 nt, Artificial Sequence
  mmSKRIPTE0000619_Rnf41_7
  gRNA
gccugguuucuccggacgcg

SEQ ID NO: 129841 - RNA, 20 nt, Artificial Sequence
  mmSKRIPTE0000620_Rnf41_8
  gRNA
cccaaacccucuaaccagug

SEQ ID NO: 129842 - RNA, 20 nt, Artificial Sequence
  mmSKRIPTE0000621_Rnf41_9
  gRNA
ugggcgagcuucuaacccug

SEQ ID NO: 129843 - RNA, 20 nt, Artificial Sequence
  mmSKRIPTE0000622_Gpi1_1
  gRNA
cugccggcaaggucgccuag

SEQ ID NO: 129844 - RNA, 20 nt, Artificial Sequence
  mmSKRIPTE0000623_Gpi1_2
  gRNA
acugcccucucgauuagccg

SEQ ID NO: 129845 - RNA, 20 nt, Artificial Sequence
  mmSKRIPTE0000624_Gpi1_3
  gRNA
gcggccgcaugggaugacau

SEQ ID NO: 129846 - RNA, 20 nt, Artificial Sequence
  mmSKRIPTE0000625_Gpi1_4
  gRNA
gguaucagggacguccagug

SEQ ID NO: 129847 - RNA, 20 nt, Artificial Sequence
  mmSKRIPTE0000626_Gpi1_5
  gRNA
agggcgaugcugauaacggu

SEQ ID NO: 129848 - RNA, 20 nt, Artificial Sequence
  mmSKRIPTE0000627_Gpi1_6
  gRNA
ggaggauugaucguuaugag

SEQ ID NO: 129849 - RNA, 20 nt, Artificial Sequence
  mmSKRIPTE0000628_Gpi1_7
  gRNA
acuuaccguguucguagaca

SEQ ID NO: 129850 - RNA, 20 nt, Artificial Sequence
  mmSKRIPTE0000629_Gpi1_8
  gRNA
aagagacccuccgacugugu

SEQ ID NO: 129851 - RNA, 20 nt, Artificial Sequence
  mmSKRIPTE0000630_Gpi1_9
  gRNA
ugucggcuuaugacgaaaca

SEQ ID NO: 129852 - RNA, 20 nt, Artificial Sequence
  mmSKRIPTE0000631_Jam3_1
  gRNA
uaacuacauccggacgagug

SEQ ID NO: 129853 - RNA, 20 nt, Artificial Sequence
  mmSKRIPTE0000632_Jam3_2
  gRNA
caguuuccauagcgaccacg

SEQ ID NO: 129854 - RNA, 20 nt, Artificial Sequence
  mmSKRIPTE0000633_Jam3_3
  gRNA
ccgaaaccgcuauuccaccg

SEQ ID NO: 129855 - RNA, 20 nt, Artificial Sequence
  mmSKRIPTE0000634_Jam3_4
  gRNA
ucacccuaauccccauaaug

SEQ ID NO: 129856 - RNA, 20 nt, Artificial Sequence
  mmSKRIPTE0000635_Jam3_5
  gRNA
gaucuggaaugugacacgau

SEQ ID NO: 129857 - RNA, 20 nt, Artificial Sequence
  mmSKRIPTE0000636_Jam3_6
  gRNA
auccagcaaccgaaacccag

SEQ ID NO: 129858 - RNA, 20 nt, Artificial Sequence
  mmSKRIPTE0000637_Jam3_7
  gRNA
cccgcuaaguucaucgacag

SEQ ID NO: 129859 - RNA, 20 nt, Artificial Sequence
  mmSKRIPTE0000638_Jam3_8
  gRNA
aucacgucuuucauacaggg

SEQ ID NO: 129860 - RNA, 20 nt, Artificial Sequence
  mmSKRIPTE0000639_Jam3_9
  gRNA
aaucaacagaggcaacacgg

SEQ ID NO: 129861 - RNA, 20 nt, Artificial Sequence
  mmSKRIPTE0000640_Acur3_1
  gRNA
gaaccaagucaguuccagcg

SEQ ID NO: 129862 - RNA, 20 nt, Artificial Sequence
  mmSKRIPTE0000641_Acur3_2
  gRNA
uggauggggucuaaucaucg

SEQ ID NO: 129863 - RNA, 20 nt, Artificial Sequence
  mmSKRIPTE0000642_Acur3_3
  gRNA
acagauaaauuuacgaaccg

SEQ ID NO: 129864 - RNA, 20 nt, Artificial Sequence
  mmSKRIPTE0000643_Acur3_4
  gRNA
cggcaugggcaaaacaaacg

SEQ ID NO: 129865 - RNA, 20 nt, Artificial Sequence
  mmSKRIPTE0000644_Acur3_5
  gRNA
ccucgcacugccuuuccgcg

SEQ ID NO: 129866 - RNA, 20 nt, Artificial Sequence
  mmSKRIPTE0000645_Acur3_6
  gRNA
ucccuaccaagggcccugag

SEQ ID NO: 129867 - RNA, 20 nt, Artificial Sequence
  mmSKRIPTE0000646_Acur3_7
  gRNA
cucccacuuccgguuccggg

SEQ ID NO: 129868 - RNA, 20 nt, Artificial Sequence
  mmSKRIPTE0000647_Acur3_8
  gRNA
accuguuaaagaguuacuag

SEQ ID NO: 129869 - RNA, 20 nt, Artificial Sequence
  mmSKRIPTE0000648_Acur3_9
  gRNA
gugacaauuuagacacggua

SEQ ID NO: 129870 - RNA, 20 nt, Artificial Sequence
  mmSKRIPTE0000649_Ltb_1
  gRNA
auaacgacccguacccgaug

SEQ ID NO: 129871 - RNA, 20 nt, Artificial Sequence
  mmSKRIPTE0000650_Ltb_2
  gRNA
ggugcuaucuaucacccgaa

SEQ ID NO: 129872 - RNA, 20 nt, Artificial Sequence
  mmSKRIPTE0000651_Ltb_3
  gRNA
agguaauagacgccguccug

SEQ ID NO: 129873 - RNA, 20 nt, Artificial Sequence
  mmSKRIPTE0000652_Ltb_4
  gRNA
uggccuuagagccaggacgu

SEQ ID NO: 129874 - RNA, 20 nt, Artificial Sequence
  mmSKRIPTE0000653_Ltb_5
  gRNA
caggcuaggauugccuggag

SEQ ID NO: 129875 - RNA, 20 nt, Artificial Sequence
  mmSKRIPTE0000654_Ltb_6
  gRNA
cagaccagacauucccucug

SEQ ID NO: 129876 - RNA, 20 nt, Artificial Sequence
  mmSKRIPTE0000655_Ltb_7
  gRNA
ucgggccgugaucucuaggu

SEQ ID NO: 129877 - RNA, 20 nt, Artificial Sequence
  mmSKRIPTE0000656_Ltb_8
  gRNA
caaaggacucucgcuuacug

SEQ ID NO: 129878 - RNA, 20 nt, Artificial Sequence
  mmSKRIPTE0000657_Ltb_9
  gRNA
cagacucagaacuaggaccg

SEQ ID NO: 129879 - RNA, 20 nt, Artificial Sequence
  mmSKRIPTE0000658_Gaua2_1
  gRNA
uggagcgauagguccuaccg

SEQ ID NO: 129880 - RNA, 20 nt, Artificial Sequence
  mmSKRIPTE0000659_Gaua2_2
  gRNA
gcugcgcauucaauacggcg

SEQ ID NO: 129881 - RNA, 20 nt, Artificial Sequence
  mmSKRIPTE0000660_Gaua2_3
  gRNA
guuccaucggagcuucacug

SEQ ID NO: 129882 - RNA, 20 nt, Artificial Sequence
  mmSKRIPTE0000661_Gaua2_4
  gRNA
gcaggggguaguguagcccg

SEQ ID NO: 129883 - RNA, 20 nt, Artificial Sequence
  mmSKRIPTE0000662_Gaua2_5
  gRNA
gucaguggccuguuaaccug

SEQ ID NO: 129884 - RNA, 20 nt, Artificial Sequence
  mmSKRIPTE0000663_Gaua2_6
  gRNA
gauacuugucaaccuuggag

SEQ ID NO: 129885 - RNA, 20 nt, Artificial Sequence
  mmSKRIPTE0000664_Gaua2_7
  gRNA
auggccccucuaucagacca

SEQ ID NO: 129886 - RNA, 20 nt, Artificial Sequence
  mmSKRIPTE0000665_Gaua2_8
  gRNA
ggcccucaggcaauaacccg

SEQ ID NO: 129887 - RNA, 20 nt, Artificial Sequence
  mmSKRIPTE0000666_Gaua2_9
  gRNA
cggucccaccuccgaaacag

SEQ ID NO: 129888 - RNA, 20 nt, Artificial Sequence
  mmSKRIPTE0000667_Ercc2_1
  gRNA
uuaguacuagagaucgacug

SEQ ID NO: 129889 - RNA, 20 nt, Artificial Sequence
  mmSKRIPTE0000668_Ercc2_2
  gRNA
ggcaugcgagaauggccgug

SEQ ID NO: 129890 - RNA, 20 nt, Artificial Sequence
  mmSKRIPTE0000669_Ercc2_3
  gRNA
ggcuacggcaguaaucccca

SEQ ID NO: 129891 - RNA, 20 nt, Artificial Sequence
  mmSKRIPTE0000670_Ercc2_4
  gRNA
gaugaugggagcauuaggug

SEQ ID NO: 129892 - RNA, 20 nt, Artificial Sequence
  mmSKRIPTE0000671_Ercc2_5
  gRNA
gcgggcccugagcaucuacg

SEQ ID NO: 129893 - RNA, 20 nt, Artificial Sequence
  mmSKRIPTE0000672_Ercc2_6
  gRNA
ccguccguagugguguacug

SEQ ID NO: 129894 - RNA, 20 nt, Artificial Sequence
  mmSKRIPTE0000673_Ercc2_7
  gRNA
ucuucaccgaguaucgagcc

SEQ ID NO: 129895 - RNA, 20 nt, Artificial Sequence
  mmSKRIPTE0000674_Ercc2_8
  gRNA
uggccccguauuccggcgaa

SEQ ID NO: 129896 - RNA, 20 nt, Artificial Sequence
  mmSKRIPTE0000675_Ercc2_9
  gRNA
gcuccugaauauucaacgag

SEQ ID NO: 129897 - RNA, 20 nt, Artificial Sequence
  mmSKRIPTE0000676_Irf8_1
  gRNA
gcguaaccucgucuuccacg

SEQ ID NO: 129898 - RNA, 20 nt, Artificial Sequence
  mmSKRIPTE0000677_Irf8_2
  gRNA
ggucaggccuaucucgagcg

SEQ ID NO: 129899 - RNA, 20 nt, Artificial Sequence
  mmSKRIPTE0000678_Irf8_3
  gRNA
gugacuaagagaauuccgaa

SEQ ID NO: 129900 - RNA, 20 nt, Artificial Sequence
  mmSKRIPTE0000679_Irf8_4
  gRNA
aguuuaccgaauuguccccg

SEQ ID NO: 129901 - RNA, 20 nt, Artificial Sequence
  mmSKRIPTE0000680_Irf8_5
  gRNA
aggauugagugcgaucaccg

SEQ ID NO: 129902 - RNA, 20 nt, Artificial Sequence
  mmSKRIPTE0000681_Irf8_6
  gRNA
cccuaacauaaagagccuag

SEQ ID NO: 129903 - RNA, 20 nt, Artificial Sequence
  mmSKRIPTE0000682_Irf8_7
  gRNA
gucggggacuagaucauacg

SEQ ID NO: 129904 - RNA, 20 nt, Artificial Sequence
  mmSKRIPTE0000683_Irf8_8
  gRNA
aagugaccacucaggcucgg

SEQ ID NO: 129905 - RNA, 20 nt, Artificial Sequence
  mmSKRIPTE0000684_Irf8_9
  gRNA
gguuacgcagucgcucugug

SEQ ID NO: 129906 - RNA, 20 nt, Artificial Sequence
  mmSKRIPTE0000685_Tirap_1
  gRNA
uaccucgccaccaacacacg

SEQ ID NO: 129907 - RNA, 20 nt, Artificial Sequence
  mmSKRIPTE0000686_Tirap_2
  gRNA
gcugggaaucuugagcgacg

SEQ ID NO: 129908 - RNA, 20 nt, Artificial Sequence
  mmSKRIPTE0000687_Tirap_3
  gRNA
cuauccaguucagcgcagag

SEQ ID NO: 129909 - RNA, 20 nt, Artificial Sequence
  mmSKRIPTE0000688_Tirap_4
  gRNA
cgagucugcaacccgcagcg

SEQ ID NO: 129910 - RNA, 20 nt, Artificial Sequence
  mmSKRIPTE0000689_Tirap_5
  gRNA
aucaggggagcguugucccg

SEQ ID NO: 129911 - RNA, 20 nt, Artificial Sequence
  mmSKRIPTE0000690_Tirap_6
  gRNA
uacaugaaucggaguuccgg

SEQ ID NO: 129912 - RNA, 20 nt, Artificial Sequence
  mmSKRIPTE0000691_Tirap_7
  gRNA
acuugcaccaggggucccga

SEQ ID NO: 129913 - RNA, 20 nt, Artificial Sequence
  mmSKRIPTE0000692_Tirap_8
  gRNA
uggauaccacuccucaagag

SEQ ID NO: 129914 - RNA, 20 nt, Artificial Sequence
  mmSKRIPTE0000693_Tirap_9
  gRNA
cuagucccuaauggcucgga

SEQ ID NO: 129915 - RNA, 20 nt, Artificial Sequence
  mmSKRIPTE0000694_Elf4_1
  gRNA
aguaacugccuaagcgagag

SEQ ID NO: 129916 - RNA, 20 nt, Artificial Sequence
  mmSKRIPTE0000695_Elf4_2
  gRNA
cuaggcucaguuacgaacag

SEQ ID NO: 129917 - RNA, 20 nt, Artificial Sequence
  mmSKRIPTE0000696_Elf4_3
  gRNA
acauuaaccaaagucgccag

SEQ ID NO: 129918 - RNA, 20 nt, Artificial Sequence
  mmSKRIPTE0000697_Elf4_4
  gRNA
ggucugaggaguuuauggau

SEQ ID NO: 129919 - RNA, 20 nt, Artificial Sequence
  mmSKRIPTE0000698_Elf4_5
  gRNA
accagcuagaaaauccugag

SEQ ID NO: 129920 - RNA, 20 nt, Artificial Sequence
  mmSKRIPTE0000699_Elf4_6
  gRNA
acuucuuggcuguugccgug

SEQ ID NO: 129921 - RNA, 20 nt, Artificial Sequence
  mmSKRIPTE0000700_Elf4_7
  gRNA
agaugggcuaugguacagcu

SEQ ID NO: 129922 - RNA, 20 nt, Artificial Sequence
  mmSKRIPTE0000701_Elf4_8
  gRNA
aguuugauaacaacccacca

SEQ ID NO: 129923 - RNA, 20 nt, Artificial Sequence
  mmSKRIPTE0000702_Elf4_9
  gRNA
gaucuggaugagguccacaa

SEQ ID NO: 129924 - RNA, 20 nt, Artificial Sequence
  mmSKRIPTE0000703_Btk_1
  gRNA
ccaauggugguggcguagug

SEQ ID NO: 129925 - RNA, 20 nt, Artificial Sequence
  mmSKRIPTE0000704_Btk_2
  gRNA
uuaucucgugcucgccacca

SEQ ID NO: 129926 - RNA, 20 nt, Artificial Sequence
  mmSKRIPTE0000705_Btk_3
  gRNA
aauccgguacaauagugacc

SEQ ID NO: 129927 - RNA, 20 nt, Artificial Sequence
  mmSKRIPTE0000706_Btk_4
  gRNA
agauagagcguccaccgcug

SEQ ID NO: 129928 - RNA, 20 nt, Artificial Sequence
  mmSKRIPTE0000707_Btk_5
  gRNA
uaauggcggaucaccccuug

SEQ ID NO: 129929 - RNA, 20 nt, Artificial Sequence
  mmSKRIPTE0000708_Btk_6
  gRNA
agguaucuaaucacccucug

SEQ ID NO: 129930 - RNA, 20 nt, Artificial Sequence
  mmSKRIPTE0000709_Btk_7
  gRNA
gccucgugguaacagugggu

SEQ ID NO: 129931 - RNA, 20 nt, Artificial Sequence
  mmSKRIPTE0000710_Btk_8
  gRNA
guggaggggccaauaugaug

SEQ ID NO: 129932 - RNA, 20 nt, Artificial Sequence
  mmSKRIPTE0000711_Btk_9
  gRNA
aaaaacgcgccuucuacugc

SEQ ID NO: 129933 - RNA, 20 nt, Artificial Sequence
  mmSKRIPTE0000712_Zbtb7a_1
  gRNA
ucuugcagcagcuaucgcac

SEQ ID NO: 129934 - RNA, 20 nt, Artificial Sequence
  mmSKRIPTE0000713_Zbtb7a_2
  gRNA
gccauaguggccguucugug

SEQ ID NO: 129935 - RNA, 20 nt, Artificial Sequence
  mmSKRIPTE0000714_Zbtb7a_3
  gRNA
acgcccuccauccaccugcg

SEQ ID NO: 129936 - RNA, 20 nt, Artificial Sequence
  mmSKRIPTE0000715_Zbtb7a_4
  gRNA
cgaaggagguaggagccgcg

SEQ ID NO: 129937 - RNA, 20 nt, Artificial Sequence
  mmSKRIPTE0000716_Zbtb7a_5
  gRNA
gagggcgaugcaaauuaccc

SEQ ID NO: 129938 - RNA, 20 nt, Artificial Sequence
  mmSKRIPTE0000717_Zbtb7a_6
  gRNA
gacagagaacugcuuacucg

SEQ ID NO: 129939 - RNA, 20 nt, Artificial Sequence
  mmSKRIPTE0000718_Zbtb7a_7
  gRNA
uuguggugaaccaaacacug

SEQ ID NO: 129940 - RNA, 20 nt, Artificial Sequence
  mmSKRIPTE0000719_Zbtb7a_8
  gRNA
gcagguugcgcuggucagug

SEQ ID NO: 129941 - RNA, 20 nt, Artificial Sequence
  mmSKRIPTE0000720_Zbtb7a_9
  gRNA
gggaaccuccagucuugcgg

SEQ ID NO: 129942 - RNA, 20 nt, Artificial Sequence
  mmSKRIPTE0000721_Creb3_1
  gRNA
aggcgcgugguacaguacac

SEQ ID NO: 129943 - RNA, 20 nt, Artificial Sequence
  mmSKRIPTE0000722_Creb3_2
  gRNA
guucggagguuggaucugcg

SEQ ID NO: 129944 - RNA, 20 nt, Artificial Sequence
  mmSKRIPTE0000723_Creb3_3
  gRNA
gcugaugaucguccucgcug

SEQ ID NO: 129945 - RNA, 20 nt, Artificial Sequence
  mmSKRIPTE0000724_Creb3_4
  gRNA
ugucuccaaaucuauucacg

SEQ ID NO: 129946 - RNA, 20 nt, Artificial Sequence
  mmSKRIPTE0000725_Creb3_5
  gRNA
ccucuuaccaacauacuccg

SEQ ID NO: 129947 - RNA, 20 nt, Artificial Sequence
  mmSKRIPTE0000726_Creb3_6
  gRNA
agaacaucccgcgauacuga

SEQ ID NO: 129948 - RNA, 20 nt, Artificial Sequence
  mmSKRIPTE0000727_Creb3_7
  gRNA
cuaccacagaccacgcccga

SEQ ID NO: 129949 - RNA, 20 nt, Artificial Sequence
  mmSKRIPTE0000728_Creb3_8
  gRNA
gcaaaccuuucagaaagcga

SEQ ID NO: 129950 - RNA, 20 nt, Artificial Sequence
  mmSKRIPTE0000729_Creb3_9
  gRNA
ucuaucgucagagcuaccca

SEQ ID NO: 129951 - RNA, 20 nt, Artificial Sequence
  mmSKRIPTE0000730_March1_1
  gRNA
uguguugauagaucggacag

SEQ ID NO: 129952 - RNA, 20 nt, Artificial Sequence
  mmSKRIPTE0000731_March1_2
  gRNA
ugcagucauccaccgccaag

SEQ ID NO: 129953 - RNA, 20 nt, Artificial Sequence
  mmSKRIPTE0000732_March1_3
  gRNA
uacgccuucaaguagugcag

SEQ ID NO: 129954 - RNA, 20 nt, Artificial Sequence
  mmSKRIPTE0000733_March1_4
  gRNA
ugucucuggcaucauuucgu

SEQ ID NO: 129955 - RNA, 20 nt, Artificial Sequence
  mmSKRIPTE0000734_March1_5
  gRNA
cgucaucgccgucaccugug

SEQ ID NO: 129956 - RNA, 20 nt, Artificial Sequence
  mmSKRIPTE0000735_March1_6
  gRNA
aguaccacuacacccucuag

SEQ ID NO: 129957 - RNA, 20 nt, Artificial Sequence
  mmSKRIPTE0000736_March1_7
  gRNA
acucaguaagggucauagug

SEQ ID NO: 129958 - RNA, 20 nt, Artificial Sequence
  mmSKRIPTE0000737_March1_8
  gRNA
guaaagucuacguccaacug

SEQ ID NO: 129959 - RNA, 20 nt, Artificial Sequence
  mmSKRIPTE0000738_March1_9
  gRNA
ggacugguggacaaagcgca

SEQ ID NO: 129960 - RNA, 20 nt, Artificial Sequence
  mmSKRIPTE0000739_Stk10_1
  gRNA
auacugccaaaccuccagug

SEQ ID NO: 129961 - RNA, 20 nt, Artificial Sequence
  mmSKRIPTE0000740_Stk10_2
  gRNA
cgagacgcugaagcuacgag

SEQ ID NO: 129962 - RNA, 20 nt, Artificial Sequence
  mmSKRIPTE0000741_Stk10_3
  gRNA
auagcaagccuaacaccccg

SEQ ID NO: 129963 - RNA, 20 nt, Artificial Sequence
  mmSKRIPTE0000742_Stk10_4
  gRNA
ggagacuguaguccgccggg

SEQ ID NO: 129964 - RNA, 20 nt, Artificial Sequence
  mmSKRIPTE0000743_Stk10_5
  gRNA
gacacgccacccacacggug

SEQ ID NO: 129965 - RNA, 20 nt, Artificial Sequence
  mmSKRIPTE0000744_Stk10_6
  gRNA
ggagcuucacgauauacggg

SEQ ID NO: 129966 - RNA, 20 nt, Artificial Sequence
  mmSKRIPTE0000745_Stk10_7
  gRNA
aagggacguuuguaggaucg

SEQ ID NO: 129967 - RNA, 20 nt, Artificial Sequence
  mmSKRIPTE0000746_Stk10_8
  gRNA
gagguacggugcccaaugug

SEQ ID NO: 129968 - RNA, 20 nt, Artificial Sequence
  mmSKRIPTE0000747_Stk10_9
  gRNA
guaugcauuuccaagcaccg

SEQ ID NO: 129969 - RNA, 20 nt, Artificial Sequence
  mmSKRIPTE0000748_Prkcb_1
  gRNA
aauuagggguaaacgcaccg

SEQ ID NO: 129970 - RNA, 20 nt, Artificial Sequence
  mmSKRIPTE0000749_Prkcb_2
  gRNA
cuagaagauuagauccacga

SEQ ID NO: 129971 - RNA, 20 nt, Artificial Sequence
  mmSKRIPTE0000750_Prkcb_3
  gRNA
caguacgacaguuaucagug

SEQ ID NO: 129972 - RNA, 20 nt, Artificial Sequence
  mmSKRIPTE0000751_Prkcb_4
  gRNA
augaaccuaaaguagcaacg

SEQ ID NO: 129973 - RNA, 20 nt, Artificial Sequence
  mmSKRIPTE0000752_Prkcb_5
  gRNA
uaaauauuagcugccucccg

SEQ ID NO: 129974 - RNA, 20 nt, Artificial Sequence
  mmSKRIPTE0000753_Prkcb_6
  gRNA
uuaagcuugaccacgagaug

SEQ ID NO: 129975 - RNA, 20 nt, Artificial Sequence
  mmSKRIPTE0000754_Prkcb_7
  gRNA
gacucgauacuagacaagug

SEQ ID NO: 129976 - RNA, 20 nt, Artificial Sequence
  mmSKRIPTE0000755_Prkcb_8
  gRNA
ccacggugguaacaccugag

SEQ ID NO: 129977 - RNA, 20 nt, Artificial Sequence
  mmSKRIPTE0000756_Prkcb_9
  gRNA
gaucccccagccauuaacgu

SEQ ID NO: 129978 - RNA, 20 nt, Artificial Sequence
  mmSKRIPTE0000757_Bmp6_1
  gRNA
ucucaaagcuacacgacgag

SEQ ID NO: 129979 - RNA, 20 nt, Artificial Sequence
  mmSKRIPTE0000758_Bmp6_2
  gRNA
acguucauaacaggcuggcg

SEQ ID NO: 129980 - RNA, 20 nt, Artificial Sequence
  mmSKRIPTE0000759_Bmp6_3
  gRNA
guccccacugacuagcgcgc

SEQ ID NO: 129981 - RNA, 20 nt, Artificial Sequence
  mmSKRIPTE0000760_Bmp6_4
  gRNA
cggucaugagaugagccccg

SEQ ID NO: 129982 - RNA, 20 nt, Artificial Sequence
  mmSKRIPTE0000761_Bmp6_5
  gRNA
uuaucucucauggucauccg

SEQ ID NO: 129983 - RNA, 20 nt, Artificial Sequence
  mmSKRIPTE0000762_Bmp6_6
  gRNA
cggguggagaagagacgacg

SEQ ID NO: 129984 - RNA, 20 nt, Artificial Sequence
  mmSKRIPTE0000763_Bmp6_7
  gRNA
uguccguggugcacaauaug

SEQ ID NO: 129985 - RNA, 20 nt, Artificial Sequence
  mmSKRIPTE0000764_Bmp6_8
  gRNA
uccuugucguacuccacuag

SEQ ID NO: 129986 - RNA, 20 nt, Artificial Sequence
  mmSKRIPTE0000765_Bmp6_9
  gRNA
aauuugauucuacaucucgu

SEQ ID NO: 129987 - RNA, 20 nt, Artificial Sequence
  mmSKRIPTE0000766_Wnt2b_1
  gRNA
caggacgugucuacacgggc

SEQ ID NO: 129988 - RNA, 20 nt, Artificial Sequence
  mmSKRIPTE0000767_Wnt2b_2
  gRNA
uggcgccccguagaacggag

SEQ ID NO: 129989 - RNA, 20 nt, Artificial Sequence
  mmSKRIPTE0000768_Wnt2b_3
  gRNA
uacugaccguugccuaacga

SEQ ID NO: 129990 - RNA, 20 nt, Artificial Sequence
  mmSKRIPTE0000769_Wnt2b_4
  gRNA
uucccuguuuaagucgaucg

SEQ ID NO: 129991 - RNA, 20 nt, Artificial Sequence
  mmSKRIPTE0000770_Wnt2b_5
  gRNA
gugacccauauacccgcggu

SEQ ID NO: 129992 - RNA, 20 nt, Artificial Sequence
  mmSKRIPTE0000771_Wnt2b_6
  gRNA
uguugaugacgucuaucagu

SEQ ID NO: 129993 - RNA, 20 nt, Artificial Sequence
  mmSKRIPTE0000772_Wnt2b_7
  gRNA
ggaaucuccgaacagccuag

SEQ ID NO: 129994 - RNA, 20 nt, Artificial Sequence
  mmSKRIPTE0000773_Wnt2b_8
  gRNA
ggcgaucuaggagacgccug

SEQ ID NO: 129995 - RNA, 20 nt, Artificial Sequence
  mmSKRIPTE0000774_Wnt2b_9
  gRNA
gccugcguuaugcaacccca

SEQ ID NO: 129996 - RNA, 20 nt, Artificial Sequence
  mmSKRIPTE0000775_Dhx9_1
  gRNA
aacaagaaguacaagcggug

SEQ ID NO: 129997 - RNA, 20 nt, Artificial Sequence
  mmSKRIPTE0000776_Dhx9_2
  gRNA
accuaauaaugagacucaug

SEQ ID NO: 129998 - RNA, 20 nt, Artificial Sequence
  mmSKRIPTE0000777_Dhx9_3
  gRNA
uuagccaggauucguccaag

SEQ ID NO: 129999 - RNA, 20 nt, Artificial Sequence
  mmSKRIPTE0000778_Dhx9_4
  gRNA
gaguaauaaguacuacaccc

SEQ ID NO: 130000 - RNA, 20 nt, Artificial Sequence
  mmSKRIPTE0000779_Dhx9_5
  gRNA
uaaaggugaguaugccaccg

SEQ ID NO: 130001 - RNA, 20 nt, Artificial Sequence
  mmSKRIPTE0000780_Dhx9_6
  gRNA
aagaacacaccucacccgca

SEQ ID NO: 130002 - RNA, 20 nt, Artificial Sequence
  mmSKRIPTE0000781_Dhx9_7
  gRNA
aauguacuguggaacuugug

SEQ ID NO: 130003 - RNA, 20 nt, Artificial Sequence
  mmSKRIPTE0000782_Dhx9_8
  gRNA
ccuggaccuacuugggaccg

SEQ ID NO: 130004 - RNA, 20 nt, Artificial Sequence
  mmSKRIPTE0000783_Dhx9_9
  gRNA
ccuuaugauagcauacauug

SEQ ID NO: 130005 - RNA, 20 nt, Artificial Sequence
  mmSKRIPTE0000784_Itpkb_1
  gRNA
cuguacuuauacaucgucgu

SEQ ID NO: 130006 - RNA, 20 nt, Artificial Sequence
  mmSKRIPTE0000785_Itpkb_2
  gRNA
gaguuugucccguaguggga

SEQ ID NO: 130007 - RNA, 20 nt, Artificial Sequence
  mmSKRIPTE0000786_Itpkb_3
  gRNA
aggaggcgcaugcuugacgu

SEQ ID NO: 130008 - RNA, 20 nt, Artificial Sequence
  mmSKRIPTE0000787_Itpkb_4
  gRNA
cguaggacauaaacaccccg

SEQ ID NO: 130009 - RNA, 20 nt, Artificial Sequence
  mmSKRIPTE0000788_Itpkb_5
  gRNA
cugauggcauuagccacuag

SEQ ID NO: 130010 - RNA, 20 nt, Artificial Sequence
  mmSKRIPTE0000789_Itpkb_6
  gRNA
cugcuugcuaauccaaggcg

SEQ ID NO: 130011 - RNA, 20 nt, Artificial Sequence
  mmSKRIPTE0000790_Itpkb_7
  gRNA
ggccuggcaugggaucaucg

SEQ ID NO: 130012 - RNA, 20 nt, Artificial Sequence
  mmSKRIPTE0000791_Itpkb_8
  gRNA
ugaugccccugacucccgug

SEQ ID NO: 130013 - RNA, 20 nt, Artificial Sequence
  mmSKRIPTE0000792_Itpkb_9
  gRNA
cauugcccgugaauucagag

SEQ ID NO: 130014 - RNA, 20 nt, Artificial Sequence
  mmSKRIPTE0000793_Myo1c_1
  gRNA
ucaccgagaauucagccgug

SEQ ID NO: 130015 - RNA, 20 nt, Artificial Sequence
  mmSKRIPTE0000794_Myo1c_2
  gRNA
guucccgucagguauaggug

SEQ ID NO: 130016 - RNA, 20 nt, Artificial Sequence
  mmSKRIPTE0000795_Myo1c_3
  gRNA
uucaggaccuagacuccugu

SEQ ID NO: 130017 - RNA, 20 nt, Artificial Sequence
  mmSKRIPTE0000796_Myo1c_4
  gRNA
uagaucuguaggucucggua

SEQ ID NO: 130018 - RNA, 20 nt, Artificial Sequence
  mmSKRIPTE0000797_Myo1c_5
  gRNA
cagcauauggaacgcuaccg

SEQ ID NO: 130019 - RNA, 20 nt, Artificial Sequence
  mmSKRIPTE0000798_Myo1c_6
  gRNA
ccccgaguagacaagcggag

SEQ ID NO: 130020 - RNA, 20 nt, Artificial Sequence
  mmSKRIPTE0000799_Myo1c_7
  gRNA
gagaacccacaguagugccg

SEQ ID NO: 130021 - RNA, 20 nt, Artificial Sequence
  mmSKRIPTE0000800_Myo1c_8
  gRNA
ccucaucaaagcgaccugag

SEQ ID NO: 130022 - RNA, 20 nt, Artificial Sequence
  mmSKRIPTE0000801_Myo1c_9
  gRNA
acgacgccaagcagccgggu

SEQ ID NO: 130023 - RNA, 20 nt, Artificial Sequence
  mmSKRIPTE0000802_Tnrc6c_1
  gRNA
agucaucauuaaaccugacg

SEQ ID NO: 130024 - RNA, 20 nt, Artificial Sequence
  mmSKRIPTE0000803_Tnrc6c_2
  gRNA
augcacauuacagaggcggu

SEQ ID NO: 130025 - RNA, 20 nt, Artificial Sequence
  mmSKRIPTE0000804_Tnrc6c_3
  gRNA
cuuaggagcagggcgcgucg

SEQ ID NO: 130026 - RNA, 20 nt, Artificial Sequence
  mmSKRIPTE0000805_Tnrc6c_4
  gRNA
augcaugucuacaggccgag

SEQ ID NO: 130027 - RNA, 20 nt, Artificial Sequence
  mmSKRIPTE0000806_Tnrc6c_5
  gRNA
acaaacggacugccaaacug

SEQ ID NO: 130028 - RNA, 20 nt, Artificial Sequence
  mmSKRIPTE0000807_Tnrc6c_6
  gRNA
acacaugauaccguaaggag

SEQ ID NO: 130029 - RNA, 20 nt, Artificial Sequence
  mmSKRIPTE0000808_Tnrc6c_7
  gRNA
augcugaggguuaauuggcg

SEQ ID NO: 130030 - RNA, 20 nt, Artificial Sequence
  mmSKRIPTE0000809_Tnrc6c_8
  gRNA
gccagccacagaucuuacgg

SEQ ID NO: 130031 - RNA, 20 nt, Artificial Sequence
  mmSKRIPTE0000810_Tnrc6c_9
  gRNA
ugcccgauuugccugcagag

SEQ ID NO: 130032 - RNA, 20 nt, Artificial Sequence
  mmSKRIPTE0000811_Ifih1_1
  gRNA
caccugugguaacaccagcg

SEQ ID NO: 130033 - RNA, 20 nt, Artificial Sequence
  mmSKRIPTE0000812_Ifih1_2
  gRNA
cguagacgacauauuaccag

SEQ ID NO: 130034 - RNA, 20 nt, Artificial Sequence
  mmSKRIPTE0000813_Ifih1_3
  gRNA
uguggguuugacauagcgcg

SEQ ID NO: 130035 - RNA, 20 nt, Artificial Sequence
  mmSKRIPTE0000814_Ifih1_4
  gRNA
cuccuaucccugaagcgaug

SEQ ID NO: 130036 - RNA, 20 nt, Artificial Sequence
  mmSKRIPTE0000815_Ifih1_5
  gRNA
uauuuccaaaguuaucggga

SEQ ID NO: 130037 - RNA, 20 nt, Artificial Sequence
  mmSKRIPTE0000816_Ifih1_6
  gRNA
augccgccuagaucuuuaga

SEQ ID NO: 130038 - RNA, 20 nt, Artificial Sequence
  mmSKRIPTE0000817_Ifih1_7
  gRNA
ggaugugugaguacguugag

SEQ ID NO: 130039 - RNA, 20 nt, Artificial Sequence
  mmSKRIPTE0000818_Ifih1_8
  gRNA
guggcucaggaguuaccgaa

SEQ ID NO: 130040 - RNA, 20 nt, Artificial Sequence
  mmSKRIPTE0000819_Ifih1_9
  gRNA
ugucacgaacgagauagcca

SEQ ID NO: 130041 - RNA, 20 nt, Artificial Sequence
  mmSKRIPTE0000820_Zfpm1_1
  gRNA
agggauccgacgaccuaggu

SEQ ID NO: 130042 - RNA, 20 nt, Artificial Sequence
  mmSKRIPTE0000821_Zfpm1_2
  gRNA
gugcacaaccggcuacagca

SEQ ID NO: 130043 - RNA, 20 nt, Artificial Sequence
  mmSKRIPTE0000822_Zfpm1_3
  gRNA
uacaggagcucaucgaucgg

SEQ ID NO: 130044 - RNA, 20 nt, Artificial Sequence
  mmSKRIPTE0000823_Zfpm1_4
  gRNA
aaggccacuacuacuauacg

SEQ ID NO: 130045 - RNA, 20 nt, Artificial Sequence
  mmSKRIPTE0000824_Zfpm1_5
  gRNA
aaaagacgagcgcuaguuug

SEQ ID NO: 130046 - RNA, 20 nt, Artificial Sequence
  mmSKRIPTE0000825_Zfpm1_6
  gRNA
guggguccuacgauuagacg

SEQ ID NO: 130047 - RNA, 20 nt, Artificial Sequence
  mmSKRIPTE0000826_Zfpm1_7
  gRNA
uauguguucaguccggacgc

SEQ ID NO: 130048 - RNA, 20 nt, Artificial Sequence
  mmSKRIPTE0000827_Zfpm1_8
  gRNA
guggaagcuuacgcgacaug

SEQ ID NO: 130049 - RNA, 20 nt, Artificial Sequence
  mmSKRIPTE0000828_Zfpm1_9
  gRNA
ccuagcgcaaggcuuaccug

SEQ ID NO: 130050 - RNA, 20 nt, Artificial Sequence
  mmSKRIPTE0000829_Dapk2_1
  gRNA
ugcaggcuacuacuaccucg

SEQ ID NO: 130051 - RNA, 20 nt, Artificial Sequence
  mmSKRIPTE0000830_Dapk2_2
  gRNA
ggagagcuggacgugcaccg

SEQ ID NO: 130052 - RNA, 20 nt, Artificial Sequence
  mmSKRIPTE0000831_Dapk2_3
  gRNA
aucuugagucuccaauagug

SEQ ID NO: 130053 - RNA, 20 nt, Artificial Sequence
  mmSKRIPTE0000832_Dapk2_4
  gRNA
cauauuugggcuccucaucg

SEQ ID NO: 130054 - RNA, 20 nt, Artificial Sequence
  mmSKRIPTE0000833_Dapk2_5
  gRNA
ggguccauagaugaaacgag

SEQ ID NO: 130055 - RNA, 20 nt, Artificial Sequence
  mmSKRIPTE0000834_Dapk2_6
  gRNA
gcgccaggacucaugacacg

SEQ ID NO: 130056 - RNA, 20 nt, Artificial Sequence
  mmSKRIPTE0000835_Dapk2_7
  gRNA
uuacugcucaacauucaggu

SEQ ID NO: 130057 - RNA, 20 nt, Artificial Sequence
  mmSKRIPTE0000836_Dapk2_8
  gRNA
aggcgguggaagguacguca

SEQ ID NO: 130058 - RNA, 20 nt, Artificial Sequence
  mmSKRIPTE0000837_Dapk2_9
  gRNA
ggcuaacccuacucaagugu

SEQ ID NO: 130059 - RNA, 20 nt, Artificial Sequence
  mmSKRIPTE0000838_Slc11a1_1
  gRNA
aaggucguggaggauccggu

SEQ ID NO: 130060 - RNA, 20 nt, Artificial Sequence
  mmSKRIPTE0000839_Slc11a1_2
  gRNA
gcguccucaugauuagugag

SEQ ID NO: 130061 - RNA, 20 nt, Artificial Sequence
  mmSKRIPTE0000840_Slc11a1_3
  gRNA
cugaggauaagcuccuaucg

SEQ ID NO: 130062 - RNA, 20 nt, Artificial Sequence
  mmSKRIPTE0000841_Slc11a1_4
  gRNA
caggccgggagucaguacga

SEQ ID NO: 130063 - RNA, 20 nt, Artificial Sequence
  mmSKRIPTE0000842_Slc11a1_5
  gRNA
ccuagcaugauaccguccag

SEQ ID NO: 130064 - RNA, 20 nt, Artificial Sequence
  mmSKRIPTE0000843_Slc11a1_6
  gRNA
agguggaccugccaguugcg

SEQ ID NO: 130065 - RNA, 20 nt, Artificial Sequence
  mmSKRIPTE0000844_Slc11a1_7
  gRNA
agggagguuuaauuacaaca

SEQ ID NO: 130066 - RNA, 20 nt, Artificial Sequence
  mmSKRIPTE0000845_Slc11a1_8
  gRNA
aaauggcccuggucccucgg

SEQ ID NO: 130067 - RNA, 20 nt, Artificial Sequence
  mmSKRIPTE0000846_Slc11a1_9
  gRNA
aggaacgaaggucaaaacug

SEQ ID NO: 130068 - RNA, 20 nt, Artificial Sequence
  mmSKRIPTE0000847_Prkd1_1
  gRNA
gguugagaauggucaucacg

SEQ ID NO: 130069 - RNA, 20 nt, Artificial Sequence
  mmSKRIPTE0000848_Prkd1_2
  gRNA
cauauuugugaucagcacgu

SEQ ID NO: 130070 - RNA, 20 nt, Artificial Sequence
  mmSKRIPTE0000849_Prkd1_3
  gRNA
guccguagcuacauuagcug

SEQ ID NO: 130071 - RNA, 20 nt, Artificial Sequence
  mmSKRIPTE0000850_Prkd1_4
  gRNA
guccauagaaaccacauucg

SEQ ID NO: 130072 - RNA, 20 nt, Artificial Sequence
  mmSKRIPTE0000851_Prkd1_5
  gRNA
gaucuggaagucuucgaagg

SEQ ID NO: 130073 - RNA, 20 nt, Artificial Sequence
  mmSKRIPTE0000852_Prkd1_6
  gRNA
gaggcaugagugacacggug

SEQ ID NO: 130074 - RNA, 20 nt, Artificial Sequence
  mmSKRIPTE0000853_Prkd1_7
  gRNA
agacacagucauuaacacgg

SEQ ID NO: 130075 - RNA, 20 nt, Artificial Sequence
  mmSKRIPTE0000854_Prkd1_8
  gRNA
cugcaaaguugguggacccg

SEQ ID NO: 130076 - RNA, 20 nt, Artificial Sequence
  mmSKRIPTE0000855_Prkd1_9
  gRNA
uuuccgggaaaguccgcgcg

SEQ ID NO: 130077 - RNA, 20 nt, Artificial Sequence
  mmSKRIPTE0000856_Jag2_1
  gRNA
ucucaguaucgaaagccggg

SEQ ID NO: 130078 - RNA, 20 nt, Artificial Sequence
  mmSKRIPTE0000857_Jag2_2
  gRNA
gccguccaccugauccacgc

SEQ ID NO: 130079 - RNA, 20 nt, Artificial Sequence
  mmSKRIPTE0000858_Jag2_3
  gRNA
aggauguaauuugcuccacg

SEQ ID NO: 130080 - RNA, 20 nt, Artificial Sequence
  mmSKRIPTE0000859_Jag2_4
  gRNA
ccacucacguaagugccccg

SEQ ID NO: 130081 - RNA, 20 nt, Artificial Sequence
  mmSKRIPTE0000860_Jag2_5
  gRNA
acugaaagggaaugacgacg

SEQ ID NO: 130082 - RNA, 20 nt, Artificial Sequence
  mmSKRIPTE0000861_Jag2_6
  gRNA
aggccaaggugacgcccacg

SEQ ID NO: 130083 - RNA, 20 nt, Artificial Sequence
  mmSKRIPTE0000862_Jag2_7
  gRNA
acuguuucguauagacaacc

SEQ ID NO: 130084 - RNA, 20 nt, Artificial Sequence
  mmSKRIPTE0000863_Jag2_8
  gRNA
ugacacucuggcaucccgcg

SEQ ID NO: 130085 - RNA, 20 nt, Artificial Sequence
  mmSKRIPTE0000864_Jag2_9
  gRNA
ccacaguggucauauucacg

SEQ ID NO: 130086 - RNA, 20 nt, Artificial Sequence
  mmSKRIPTE0000865_Lgals1_1
  gRNA
gacgucgacuagacccagcg

SEQ ID NO: 130087 - RNA, 20 nt, Artificial Sequence
  mmSKRIPTE0000866_Lgals1_2
  gRNA
agguggccucggacgccaag

SEQ ID NO: 130088 - RNA, 20 nt, Artificial Sequence
  mmSKRIPTE0000867_Lgals1_3
  gRNA
ugcaauuggcugaacucccg

SEQ ID NO: 130089 - RNA, 20 nt, Artificial Sequence
  mmSKRIPTE0000868_Lgals1_4
  gRNA
aggaccacuuaggacuagcu

SEQ ID NO: 130090 - RNA, 20 nt, Artificial Sequence
  mmSKRIPTE0000869_Lgals1_5
  gRNA
agacgcuuaagguuucaggg

SEQ ID NO: 130091 - RNA, 20 nt, Artificial Sequence
  mmSKRIPTE0000870_Lgals1_6
  gRNA
uggaccagcucagagccccg

SEQ ID NO: 130092 - RNA, 20 nt, Artificial Sequence
  mmSKRIPTE0000871_Lgals1_7
  gRNA
uccaguuaaaaaggucggag

SEQ ID NO: 130093 - RNA, 20 nt, Artificial Sequence
  mmSKRIPTE0000872_Lgals1_8
  gRNA
ccagcccgggagcaucacag

SEQ ID NO: 130094 - RNA, 20 nt, Artificial Sequence
  mmSKRIPTE0000873_Lgals1_9
  gRNA
ggggaaugucucaaaguucg

SEQ ID NO: 130095 - RNA, 20 nt, Artificial Sequence
  mmSKRIPTE0000874_Lcn2_1
  gRNA
gacuuccggagcgaucaggu

SEQ ID NO: 130096 - RNA, 20 nt, Artificial Sequence
  mmSKRIPTE0000875_Lcn2_2
  gRNA
aguccugacugagaucgcug

SEQ ID NO: 130097 - RNA, 20 nt, Artificial Sequence
  mmSKRIPTE0000876_Lcn2_3
  gRNA
ucaacuggccauuaccggug

SEQ ID NO: 130098 - RNA, 20 nt, Artificial Sequence
  mmSKRIPTE0000877_Lcn2_4
  gRNA
gaccucaaaguggaucccga

SEQ ID NO: 130099 - RNA, 20 nt, Artificial Sequence
  mmSKRIPTE0000878_Lcn2_5
  gRNA
gcacagggugaaaugccccg

SEQ ID NO: 130100 - RNA, 20 nt, Artificial Sequence
  mmSKRIPTE0000879_Lcn2_6
  gRNA
gacuaccccgcccaacaggg

SEQ ID NO: 130101 - RNA, 20 nt, Artificial Sequence
  mmSKRIPTE0000880_Lcn2_7
  gRNA
agugaguccugaauccggug

SEQ ID NO: 130102 - RNA, 20 nt, Artificial Sequence
  mmSKRIPTE0000881_Lcn2_8
  gRNA
ggaaucuggacuccucauca

SEQ ID NO: 130103 - RNA, 20 nt, Artificial Sequence
  mmSKRIPTE0000882_Lcn2_9
  gRNA
acauuguagcucuguaccug

SEQ ID NO: 130104 - RNA, 20 nt, Artificial Sequence
  mmSKRIPTE0000883_Prkd2_1
  gRNA
ucggaucuggaaauccucga

SEQ ID NO: 130105 - RNA, 20 nt, Artificial Sequence
  mmSKRIPTE0000884_Prkd2_2
  gRNA
acgaaccugaggaaacggau

SEQ ID NO: 130106 - RNA, 20 nt, Artificial Sequence
  mmSKRIPTE0000885_Prkd2_3
  gRNA
cugaggaucaguauggcgag

SEQ ID NO: 130107 - RNA, 20 nt, Artificial Sequence
  mmSKRIPTE0000886_Prkd2_4
  gRNA
cuaaggauguuaccuaagug

SEQ ID NO: 130108 - RNA, 20 nt, Artificial Sequence
  mmSKRIPTE0000887_Prkd2_5
  gRNA
agggagcguuaccgaaggcg

SEQ ID NO: 130109 - RNA, 20 nt, Artificial Sequence
  mmSKRIPTE0000888_Prkd2_6
  gRNA
uggccuaauggcuagcagca

SEQ ID NO: 130110 - RNA, 20 nt, Artificial Sequence
  mmSKRIPTE0000889_Prkd2_7
  gRNA
ucggcacgucugcgggaaca

SEQ ID NO: 130111 - RNA, 20 nt, Artificial Sequence
  mmSKRIPTE0000890_Prkd2_8
  gRNA
aggacgacgacgaggguggu

SEQ ID NO: 130112 - RNA, 20 nt, Artificial Sequence
  mmSKRIPTE0000891_Prkd2_9
  gRNA
ucacaggucgugaaagucgg

SEQ ID NO: 130113 - RNA, 20 nt, Artificial Sequence
  mmSKRIPTE0000892_Axl_1
  gRNA
aggccaaacucccuauccag

SEQ ID NO: 130114 - RNA, 20 nt, Artificial Sequence
  mmSKRIPTE0000893_Axl_2
  gRNA
ucagccgauuuccuugacgc

SEQ ID NO: 130115 - RNA, 20 nt, Artificial Sequence
  mmSKRIPTE0000894_Axl_3
  gRNA
cauggcgcuaacguucucag

SEQ ID NO: 130116 - RNA, 20 nt, Artificial Sequence
  mmSKRIPTE0000895_Axl_4
  gRNA
auuuccggaaugcgccacag

SEQ ID NO: 130117 - RNA, 20 nt, Artificial Sequence
  mmSKRIPTE0000896_Axl_5
  gRNA
guaaggaugaaacuucggag

SEQ ID NO: 130118 - RNA, 20 nt, Artificial Sequence
  mmSKRIPTE0000897_Axl_6
  gRNA
gguguaccccacacaaggag

SEQ ID NO: 130119 - RNA, 20 nt, Artificial Sequence
  mmSKRIPTE0000898_Axl_7
  gRNA
cuacaccagcaagagcgaug

SEQ ID NO: 130120 - RNA, 20 nt, Artificial Sequence
  mmSKRIPTE0000899_Axl_8
  gRNA
ggguaccggcuggcauaucg

SEQ ID NO: 130121 - RNA, 20 nt, Artificial Sequence
  mmSKRIPTE0000900_Axl_9
  gRNA
cucccacauugucacaccga

SEQ ID NO: 130122 - RNA, 20 nt, Artificial Sequence
  mmSKRIPTE0000901_Etv2_1
  gRNA
ugcgacgaaccuaagagucg

SEQ ID NO: 130123 - RNA, 20 nt, Artificial Sequence
  mmSKRIPTE0000902_Etv2_2
  gRNA
ccuggagcugcuccacgacg

SEQ ID NO: 130124 - RNA, 20 nt, Artificial Sequence
  mmSKRIPTE0000903_Etv2_3
  gRNA
guucucgcgauuuaggaccc

SEQ ID NO: 130125 - RNA, 20 nt, Artificial Sequence
  mmSKRIPTE0000904_Etv2_4
  gRNA
ucuguccagucucgcgacca

SEQ ID NO: 130126 - RNA, 20 nt, Artificial Sequence
  mmSKRIPTE0000905_Etv2_5
  gRNA
ccagacacgcagguucgaca

SEQ ID NO: 130127 - RNA, 20 nt, Artificial Sequence
  mmSKRIPTE0000906_Etv2_6
  gRNA
ccauaucauccugauaggcg

SEQ ID NO: 130128 - RNA, 20 nt, Artificial Sequence
  mmSKRIPTE0000907_Etv2_7
  gRNA
ggcuggagcaugaaaugucg

SEQ ID NO: 130129 - RNA, 20 nt, Artificial Sequence
  mmSKRIPTE0000908_Etv2_8
  gRNA
caaguacacauaccgcuucg

SEQ ID NO: 130130 - RNA, 20 nt, Artificial Sequence
  mmSKRIPTE0000909_Etv2_9
  gRNA
guucggacuacaccaccacg

SEQ ID NO: 130131 - RNA, 20 nt, Artificial Sequence
  mmSKRIPTE0000910_Nlrx1_1
  gRNA
acaacaccacggucugcacg

SEQ ID NO: 130132 - RNA, 20 nt, Artificial Sequence
  mmSKRIPTE0000911_Nlrx1_2
  gRNA
ggguacuggcaagagcacgu

SEQ ID NO: 130133 - RNA, 20 nt, Artificial Sequence
  mmSKRIPTE0000912_Nlrx1_3
  gRNA
gaaguuagcuuagagcgugu

SEQ ID NO: 130134 - RNA, 20 nt, Artificial Sequence
  mmSKRIPTE0000913_Nlrx1_4
  gRNA
ugagaugcaaggacccguug

SEQ ID NO: 130135 - RNA, 20 nt, Artificial Sequence
  mmSKRIPTE0000914_Nlrx1_5
  gRNA
gucggcuaaaccacucggug

SEQ ID NO: 130136 - RNA, 20 nt, Artificial Sequence
  mmSKRIPTE0000915_Nlrx1_6
  gRNA
accaugcgcccaaacacucg

SEQ ID NO: 130137 - RNA, 20 nt, Artificial Sequence
  mmSKRIPTE0000916_Nlrx1_7
  gRNA
cgccgucccuucugucagcg

SEQ ID NO: 130138 - RNA, 20 nt, Artificial Sequence
  mmSKRIPTE0000917_Nlrx1_8
  gRNA
ggcgggcacggugaacacga

SEQ ID NO: 130139 - RNA, 20 nt, Artificial Sequence
  mmSKRIPTE0000918_Nlrx1_9
  gRNA
ucucucugcccacaaccggg

SEQ ID NO: 130140 - RNA, 20 nt, Artificial Sequence
  mmSKRIPTE0000919_Traf3ip2_1
  gRNA
uagccgagauuccggaugag

SEQ ID NO: 130141 - RNA, 20 nt, Artificial Sequence
  mmSKRIPTE0000920_Traf3ip2_2
  gRNA
aaugaaccgaagcauucccg

SEQ ID NO: 130142 - RNA, 20 nt, Artificial Sequence
  mmSKRIPTE0000921_Traf3ip2_3
  gRNA
cuuuccuagagauucgagug

SEQ ID NO: 130143 - RNA, 20 nt, Artificial Sequence
  mmSKRIPTE0000922_Traf3ip2_4
  gRNA
cauugaccugaugcucacga

SEQ ID NO: 130144 - RNA, 20 nt, Artificial Sequence
  mmSKRIPTE0000923_Traf3ip2_5
  gRNA
guaugcaaaucucuacggag

SEQ ID NO: 130145 - RNA, 20 nt, Artificial Sequence
  mmSKRIPTE0000924_Traf3ip2_6
  gRNA
gaguuuaacucuauaaggag

SEQ ID NO: 130146 - RNA, 20 nt, Artificial Sequence
  mmSKRIPTE0000925_Traf3ip2_7
  gRNA
gagguccugcagguaacacg

SEQ ID NO: 130147 - RNA, 20 nt, Artificial Sequence
  mmSKRIPTE0000926_Traf3ip2_8
  gRNA
aggauaacuuacguggcacc

SEQ ID NO: 130148 - RNA, 20 nt, Artificial Sequence
  mmSKRIPTE0000927_Traf3ip2_9
  gRNA
uacgugaguuguuugcaucg

SEQ ID NO: 130149 - RNA, 20 nt, Artificial Sequence
  mmSKRIPTE0000928_Ptk2b_1
  gRNA
cuucagcucaguaucugucg

SEQ ID NO: 130150 - RNA, 20 nt, Artificial Sequence
  mmSKRIPTE0000929_Ptk2b_2
  gRNA
ucuggacaaaaaaaccgggu

SEQ ID NO: 130151 - RNA, 20 nt, Artificial Sequence
  mmSKRIPTE0000930_Ptk2b_3
  gRNA
agguuggugcucaggcaccg

SEQ ID NO: 130152 - RNA, 20 nt, Artificial Sequence
  mmSKRIPTE0000931_Ptk2b_4
  gRNA
guaucauuucccugccgaag

SEQ ID NO: 130153 - RNA, 20 nt, Artificial Sequence
  mmSKRIPTE0000932_Ptk2b_5
  gRNA
cccaccuccuggucuucgca

SEQ ID NO: 130154 - RNA, 20 nt, Artificial Sequence
  mmSKRIPTE0000933_Ptk2b_6
  gRNA
aggauccggggauagcagcg

SEQ ID NO: 130155 - RNA, 20 nt, Artificial Sequence
  mmSKRIPTE0000934_Ptk2b_7
  gRNA
ccucccuucaagcaugcccg

SEQ ID NO: 130156 - RNA, 20 nt, Artificial Sequence
  mmSKRIPTE0000935_Ptk2b_8
  gRNA
gggugucagccucaccacgg

SEQ ID NO: 130157 - RNA, 20 nt, Artificial Sequence
  mmSKRIPTE0000936_Ptk2b_9
  gRNA
gcgucacgugaucugcccaa

SEQ ID NO: 130158 - RNA, 20 nt, Artificial Sequence
  mmSKRIPTE0000937_Rab8b_1
  gRNA
aucucacauagguagcgacg

SEQ ID NO: 130159 - RNA, 20 nt, Artificial Sequence
  mmSKRIPTE0000938_Rab8b_2
  gRNA
aaaucccauaaagccucgcg

SEQ ID NO: 130160 - RNA, 20 nt, Artificial Sequence
  mmSKRIPTE0000939_Rab8b_3
  gRNA
gcuucaacagacuagccaca

SEQ ID NO: 130161 - RNA, 20 nt, Artificial Sequence
  mmSKRIPTE0000940_Rab8b_4
  gRNA
cuucuauagcccgugaacag

SEQ ID NO: 130162 - RNA, 20 nt, Artificial Sequence
  mmSKRIPTE0000941_Rab8b_5
  gRNA
gacucggguccuuacccgug

SEQ ID NO: 130163 - RNA, 20 nt, Artificial Sequence
  mmSKRIPTE0000942_Rab8b_6
  gRNA
ugaguaaacugcuugcacgg

SEQ ID NO: 130164 - RNA, 20 nt, Artificial Sequence
  mmSKRIPTE0000943_Rab8b_7
  gRNA
aggaccggaugguaucaaca

SEQ ID NO: 130165 - RNA, 20 nt, Artificial Sequence
  mmSKRIPTE0000944_Rab8b_8
  gRNA
ccaucugcgagaguuaacaa

SEQ ID NO: 130166 - RNA, 20 nt, Artificial Sequence
  mmSKRIPTE0000945_Rab8b_9
  gRNA
aaacgccauaguucccaugg

SEQ ID NO: 130167 - RNA, 20 nt, Artificial Sequence
  mmSKRIPTE0000946_Col3a1_1
  gRNA
cuguccaccagugcuuacgu

SEQ ID NO: 130168 - RNA, 20 nt, Artificial Sequence
  mmSKRIPTE0000947_Col3a1_2
  gRNA
guuaguguaagcaaccugca

SEQ ID NO: 130169 - RNA, 20 nt, Artificial Sequence
  mmSKRIPTE0000948_Col3a1_3
  gRNA
acaucauaugagucgaauug

SEQ ID NO: 130170 - RNA, 20 nt, Artificial Sequence
  mmSKRIPTE0000949_Col3a1_4
  gRNA
augcuuaccuugauacccug

SEQ ID NO: 130171 - RNA, 20 nt, Artificial Sequence
  mmSKRIPTE0000950_Col3a1_5
  gRNA
uaccacucuugaguucgggg

SEQ ID NO: 130172 - RNA, 20 nt, Artificial Sequence
  mmSKRIPTE0000951_Col3a1_6
  gRNA
uugagguaguuaacauaggg

SEQ ID NO: 130173 - RNA, 20 nt, Artificial Sequence
  mmSKRIPTE0000952_Col3a1_7
  gRNA
uuggcacagcaguccaacgu

SEQ ID NO: 130174 - RNA, 20 nt, Artificial Sequence
  mmSKRIPTE0000953_Col3a1_8
  gRNA
guaucguaaauaaucucaug

SEQ ID NO: 130175 - RNA, 20 nt, Artificial Sequence
  mmSKRIPTE0000954_Col3a1_9
  gRNA
ucuaaccccagcaaauccug

SEQ ID NO: 130176 - RNA, 20 nt, Artificial Sequence
  mmSKRIPTE0000955_Ptprc_1
  gRNA
uagagggacuccaaacgcag

SEQ ID NO: 130177 - RNA, 20 nt, Artificial Sequence
  mmSKRIPTE0000956_Ptprc_2
  gRNA
uaauuuauggcggaucacug

SEQ ID NO: 130178 - RNA, 20 nt, Artificial Sequence
  mmSKRIPTE0000957_Ptprc_3
  gRNA
cucaaaaguucggagagugu

SEQ ID NO: 130179 - RNA, 20 nt, Artificial Sequence
  mmSKRIPTE0000958_Ptprc_4
  gRNA
uugauuauagcagaccgggu

SEQ ID NO: 130180 - RNA, 20 nt, Artificial Sequence
  mmSKRIPTE0000959_Ptprc_5
  gRNA
gaguuccuggaugcuaugug

SEQ ID NO: 130181 - RNA, 20 nt, Artificial Sequence
  mmSKRIPTE0000960_Ptprc_6
  gRNA
gcaagcaggagauuucgcua

SEQ ID NO: 130182 - RNA, 20 nt, Artificial Sequence
  mmSKRIPTE0000961_Ptprc_7
  gRNA
guagcagaaaucuuauaucg

SEQ ID NO: 130183 - RNA, 20 nt, Artificial Sequence
  mmSKRIPTE0000962_Ptprc_8
  gRNA
agcacuauugguaggcuccg

SEQ ID NO: 130184 - RNA, 20 nt, Artificial Sequence
  mmSKRIPTE0000963_Ptprc_9
  gRNA
ugagaaagcaaccuccggug

SEQ ID NO: 130185 - RNA, 20 nt, Artificial Sequence
  mmSKRIPTE0000964_Ankrd54_1
  gRNA
cauaccuccucgaagcagug

SEQ ID NO: 130186 - RNA, 20 nt, Artificial Sequence
  mmSKRIPTE0000965_Ankrd54_2
  gRNA
ccguccguucgcugacagcg

SEQ ID NO: 130187 - RNA, 20 nt, Artificial Sequence
  mmSKRIPTE0000966_Ankrd54_3
  gRNA
ucugcuacaacagcacgugu

SEQ ID NO: 130188 - RNA, 20 nt, Artificial Sequence
  mmSKRIPTE0000967_Ankrd54_4
  gRNA
ggcaacacgccauugcaccu

SEQ ID NO: 130189 - RNA, 20 nt, Artificial Sequence
  mmSKRIPTE0000968_Ankrd54_5
  gRNA
ccugugaggaacucucauau

SEQ ID NO: 130190 - RNA, 20 nt, Artificial Sequence
  mmSKRIPTE0000969_Ankrd54_6
  gRNA
acauaccugggguauauucg

SEQ ID NO: 130191 - RNA, 20 nt, Artificial Sequence
  mmSKRIPTE0000970_Ankrd54_7
  gRNA
ggaagcgggucccauaacca

SEQ ID NO: 130192 - RNA, 20 nt, Artificial Sequence
  mmSKRIPTE0000971_Ankrd54_8
  gRNA
agugaucgcagugaucguag

SEQ ID NO: 130193 - RNA, 20 nt, Artificial Sequence
  mmSKRIPTE0000972_Ankrd54_9
  gRNA
cgauguaguuacaguaccag

SEQ ID NO: 130194 - RNA, 20 nt, Artificial Sequence
  mmSKRIPTE0000973_Ptprs_1
  gRNA
cuucuaaggaagccgccuag

SEQ ID NO: 130195 - RNA, 20 nt, Artificial Sequence
  mmSKRIPTE0000974_Ptprs_2
  gRNA
gaccaauacuggccuaaccg

SEQ ID NO: 130196 - RNA, 20 nt, Artificial Sequence
  mmSKRIPTE0000975_Ptprs_3
  gRNA
uguccuacuagguaguccag

SEQ ID NO: 130197 - RNA, 20 nt, Artificial Sequence
  mmSKRIPTE0000976_Ptprs_4
  gRNA
gacgccgagguagauccgag

SEQ ID NO: 130198 - RNA, 20 nt, Artificial Sequence
  mmSKRIPTE0000977_Ptprs_5
  gRNA
gaacugguacucguccugca

SEQ ID NO: 130199 - RNA, 20 nt, Artificial Sequence
  mmSKRIPTE0000978_Ptprs_6
  gRNA
accgccagaaacucacaacg

SEQ ID NO: 130200 - RNA, 20 nt, Artificial Sequence
  mmSKRIPTE0000979_Ptprs_7
  gRNA
ccguggcuuaggaucacccg

SEQ ID NO: 130201 - RNA, 20 nt, Artificial Sequence
  mmSKRIPTE0000980_Ptprs_8
  gRNA
ccaccucgagacuuccgaag

SEQ ID NO: 130202 - RNA, 20 nt, Artificial Sequence
  mmSKRIPTE0000981_Ptprs_9
  gRNA
ucguacacguucucaucccg

SEQ ID NO: 130203 - RNA, 20 nt, Artificial Sequence
  mmSKRIPTE0000982_Klf4_1
  gRNA
aguuauaaguaagaagcgcg

SEQ ID NO: 130204 - RNA, 20 nt, Artificial Sequence
  mmSKRIPTE0000983_Klf4_2
  gRNA
gccaugucagacucgccagg

SEQ ID NO: 130205 - RNA, 20 nt, Artificial Sequence
  mmSKRIPTE0000984_Klf4_3
  gRNA
guaguggcgcccuacagcgg

SEQ ID NO: 130206 - RNA, 20 nt, Artificial Sequence
  mmSKRIPTE0000985_Klf4_4
  gRNA
gaguugagagcuguacggau

SEQ ID NO: 130207 - RNA, 20 nt, Artificial Sequence
  mmSKRIPTE0000986_Klf4_5
  gRNA
cgcgacacucacguuagucg

SEQ ID NO: 130208 - RNA, 20 nt, Artificial Sequence
  mmSKRIPTE0000987_Klf4_6
  gRNA
aggcagauaaguagguccga

SEQ ID NO: 130209 - RNA, 20 nt, Artificial Sequence
  mmSKRIPTE0000988_Klf4_7
  gRNA
caguggccgcgacaacggug

SEQ ID NO: 130210 - RNA, 20 nt, Artificial Sequence
  mmSKRIPTE0000989_Klf4_8
  gRNA
uaccccuacacugagucccg

SEQ ID NO: 130211 - RNA, 20 nt, Artificial Sequence
  mmSKRIPTE0000990_Klf4_9
  gRNA
gagucggccuuaagugcgug

SEQ ID NO: 130212 - RNA, 20 nt, Artificial Sequence
  mmSKRIPTE0000991_Fam20c_1
  gRNA
acgagugcagccauaaggug

SEQ ID NO: 130213 - RNA, 20 nt, Artificial Sequence
  mmSKRIPTE0000992_Fam20c_2
  gRNA
gaugccuuacugcgggaccu

SEQ ID NO: 130214 - RNA, 20 nt, Artificial Sequence
  mmSKRIPTE0000993_Fam20c_3
  gRNA
acuauggugccguaggacug

SEQ ID NO: 130215 - RNA, 20 nt, Artificial Sequence
  mmSKRIPTE0000994_Fam20c_4
  gRNA
agaagaucaccagcgucggu

SEQ ID NO: 130216 - RNA, 20 nt, Artificial Sequence
  mmSKRIPTE0000995_Fam20c_5
  gRNA
auucgguggccacugucgua

SEQ ID NO: 130217 - RNA, 20 nt, Artificial Sequence
  mmSKRIPTE0000996_Fam20c_6
  gRNA
gggaggcccgaccagaucga

SEQ ID NO: 130218 - RNA, 20 nt, Artificial Sequence
  mmSKRIPTE0000997_Fam20c_7
  gRNA
guccugggcaggcgacaaag

SEQ ID NO: 130219 - RNA, 20 nt, Artificial Sequence
  mmSKRIPTE0000998_Fam20c_8
  gRNA
guagggugucacuaccggga

SEQ ID NO: 130220 - RNA, 20 nt, Artificial Sequence
  mmSKRIPTE0000999_Fam20c_9
  gRNA
uuccagugauuccgaauacg

SEQ ID NO: 130221 - RNA, 20 nt, Artificial Sequence
  mmSKRIPTE0001000_Efnb2_1
  gRNA
agguggcuaguguccgugug

SEQ ID NO: 130222 - RNA, 20 nt, Artificial Sequence
  mmSKRIPTE0001001_Efnb2_2
  gRNA
gguacgcuguaugguccggg

SEQ ID NO: 130223 - RNA, 20 nt, Artificial Sequence
  mmSKRIPTE0001002_Efnb2_3
  gRNA
auggcuuggagguccgcgug

SEQ ID NO: 130224 - RNA, 20 nt, Artificial Sequence
  mmSKRIPTE0001003_Efnb2_4
  gRNA
ccuaauuggaguugagcgug

SEQ ID NO: 130225 - RNA, 20 nt, Artificial Sequence
  mmSKRIPTE0001004_Efnb2_5
  gRNA
cgguucugcgagauucccgc

SEQ ID NO: 130226 - RNA, 20 nt, Artificial Sequence
  mmSKRIPTE0001005_Efnb2_6
  gRNA
uaaaagcuaucuuuacgaca

SEQ ID NO: 130227 - RNA, 20 nt, Artificial Sequence
  mmSKRIPTE0001006_Efnb2_7
  gRNA
agacccaccuguaaaccaug

SEQ ID NO: 130228 - RNA, 20 nt, Artificial Sequence
  mmSKRIPTE0001007_Efnb2_8
  gRNA
ucaugaccaucuaaacugug

SEQ ID NO: 130229 - RNA, 20 nt, Artificial Sequence
  mmSKRIPTE0001008_Efnb2_9
  gRNA
cauugcacccaguugcugag

SEQ ID NO: 130230 - RNA, 20 nt, Artificial Sequence
  mmSKRIPTE0001009_Mst1r_1
  gRNA
cuacucugcaggcauuacag

SEQ ID NO: 130231 - RNA, 20 nt, Artificial Sequence
  mmSKRIPTE0001010_Mst1r_2
  gRNA
guucaccaccaaguccgaug

SEQ ID NO: 130232 - RNA, 20 nt, Artificial Sequence
  mmSKRIPTE0001011_Mst1r_3
  gRNA
aagucucugagucguaagcg

SEQ ID NO: 130233 - RNA, 20 nt, Artificial Sequence
  mmSKRIPTE0001012_Mst1r_4
  gRNA
uggcagcauagcagguacaa

SEQ ID NO: 130234 - RNA, 20 nt, Artificial Sequence
  mmSKRIPTE0001013_Mst1r_5
  gRNA
cgugaugcuucgaugcuggg

SEQ ID NO: 130235 - RNA, 20 nt, Artificial Sequence
  mmSKRIPTE0001014_Mst1r_6
  gRNA
cucugggagcuacuaacacg

SEQ ID NO: 130236 - RNA, 20 nt, Artificial Sequence
  mmSKRIPTE0001015_Mst1r_7
  gRNA
ccacagcggaauauagacag

SEQ ID NO: 130237 - RNA, 20 nt, Artificial Sequence
  mmSKRIPTE0001016_Mst1r_8
  gRNA
ugaucuuuaacucccgaaga

SEQ ID NO: 130238 - RNA, 20 nt, Artificial Sequence
  mmSKRIPTE0001017_Mst1r_9
  gRNA
agaucggggcaagaccuggu

SEQ ID NO: 130239 - RNA, 20 nt, Artificial Sequence
  mmSKRIPTE0001018_Myd88_1
  gRNA
uugcuagaaucuagacuacg

SEQ ID NO: 130240 - RNA, 20 nt, Artificial Sequence
  mmSKRIPTE0001019_Myd88_2
  gRNA
uaaauucucacaccuucgag

SEQ ID NO: 130241 - RNA, 20 nt, Artificial Sequence
  mmSKRIPTE0001020_Myd88_3
  gRNA
ucuaugguagagaacgugaa

SEQ ID NO: 130242 - RNA, 20 nt, Artificial Sequence
  mmSKRIPTE0001021_Myd88_4
  gRNA
ccacaggcgagcguacugga

SEQ ID NO: 130243 - RNA, 20 nt, Artificial Sequence
  mmSKRIPTE0001022_Myd88_5
  gRNA
gugugguauuaggaccacgu

SEQ ID NO: 130244 - RNA, 20 nt, Artificial Sequence
  mmSKRIPTE0001023_Myd88_6
  gRNA
ucgcgcuuaacgugggagug

SEQ ID NO: 130245 - RNA, 20 nt, Artificial Sequence
  mmSKRIPTE0001024_Myd88_7
  gRNA
gcugaagucgcgcaucggug

SEQ ID NO: 130246 - RNA, 20 nt, Artificial Sequence
  mmSKRIPTE0001025_Myd88_8
  gRNA
agccaucuagaagcccuagg

SEQ ID NO: 130247 - RNA, 20 nt, Artificial Sequence
  mmSKRIPTE0001026_Myd88_9
  gRNA
cuuugugccaaggaucaacg

SEQ ID NO: 130248 - RNA, 20 nt, Artificial Sequence
  mmSKRIPTE0001027_Pbx1_1
  gRNA
aaagacaaccauuaucauag

SEQ ID NO: 130249 - RNA, 20 nt, Artificial Sequence
  mmSKRIPTE0001028_Pbx1_2
  gRNA
cuuucuagacgacaacacgu

SEQ ID NO: 130250 - RNA, 20 nt, Artificial Sequence
  mmSKRIPTE0001029_Pbx1_3
  gRNA
aaaucgcagucaucaaucag

SEQ ID NO: 130251 - RNA, 20 nt, Artificial Sequence
  mmSKRIPTE0001030_Pbx1_4
  gRNA
ucgaaggagguucaucacgu

SEQ ID NO: 130252 - RNA, 20 nt, Artificial Sequence
  mmSKRIPTE0001031_Pbx1_5
  gRNA
aaggguauccaccuagacag

SEQ ID NO: 130253 - RNA, 20 nt, Artificial Sequence
  mmSKRIPTE0001032_Pbx1_6
  gRNA
uuagaaugcaagcgcuacca

SEQ ID NO: 130254 - RNA, 20 nt, Artificial Sequence
  mmSKRIPTE0001033_Pbx1_7
  gRNA
cagauaagcccggaccuaug

SEQ ID NO: 130255 - RNA, 20 nt, Artificial Sequence
  mmSKRIPTE0001034_Pbx1_8
  gRNA
acauaguagaugacagacgu

SEQ ID NO: 130256 - RNA, 20 nt, Artificial Sequence
  mmSKRIPTE0001035_Pbx1_9
  gRNA
gcucuguaguucgaaugaag

SEQ ID NO: 130257 - RNA, 20 nt, Artificial Sequence
  mmSKRIPTE0001036_Ror2_1
  gRNA
acacuggucugacaguugcg

SEQ ID NO: 130258 - RNA, 20 nt, Artificial Sequence
  mmSKRIPTE0001037_Ror2_2
  gRNA
uaggucgcacagcccccucg

SEQ ID NO: 130259 - RNA, 20 nt, Artificial Sequence
  mmSKRIPTE0001038_Ror2_3
  gRNA
accauagcuccgaugccgug

SEQ ID NO: 130260 - RNA, 20 nt, Artificial Sequence
  mmSKRIPTE0001039_Ror2_4
  gRNA
agagaauacauacuacacgg

SEQ ID NO: 130261 - RNA, 20 nt, Artificial Sequence
  mmSKRIPTE0001040_Ror2_5
  gRNA
gucacacagagcacgucuac

SEQ ID NO: 130262 - RNA, 20 nt, Artificial Sequence
  mmSKRIPTE0001041_Ror2_6
  gRNA
ccuccgcccauaaagcaggg

SEQ ID NO: 130263 - RNA, 20 nt, Artificial Sequence
  mmSKRIPTE0001042_Ror2_7
  gRNA
gcagaauaaaaacguacgcg

SEQ ID NO: 130264 - RNA, 20 nt, Artificial Sequence
  mmSKRIPTE0001043_Ror2_8
  gRNA
caugcgcaucgggaucccgg

SEQ ID NO: 130265 - RNA, 20 nt, Artificial Sequence
  mmSKRIPTE0001044_Ror2_9
  gRNA
gaauaaagccaaaacgucga

SEQ ID NO: 130266 - RNA, 20 nt, Artificial Sequence
  mmSKRIPTE0001045_Ssbp3_1
  gRNA
acaccccaugcccgacaaug

SEQ ID NO: 130267 - RNA, 20 nt, Artificial Sequence
  mmSKRIPTE0001046_Ssbp3_2
  gRNA
ugcugacgacggcagacgug

SEQ ID NO: 130268 - RNA, 20 nt, Artificial Sequence
  mmSKRIPTE0001047_Ssbp3_3
  gRNA
aggaacauacuagaccugag

SEQ ID NO: 130269 - RNA, 20 nt, Artificial Sequence
  mmSKRIPTE0001048_Ssbp3_4
  gRNA
caggcuacuccuacaaggug

SEQ ID NO: 130270 - RNA, 20 nt, Artificial Sequence
  mmSKRIPTE0001049_Ssbp3_5
  gRNA
uggugguugagucaagugag

SEQ ID NO: 130271 - RNA, 20 nt, Artificial Sequence
  mmSKRIPTE0001050_Ssbp3_6
  gRNA
ucuccacagcuacagaagcg

SEQ ID NO: 130272 - RNA, 20 nt, Artificial Sequence
  mmSKRIPTE0001051_Ssbp3_7
  gRNA
cacugccaguuguguacgga

SEQ ID NO: 130273 - RNA, 20 nt, Artificial Sequence
  mmSKRIPTE0001052_Ssbp3_8
  gRNA
gcuauggcaauaccacagca

SEQ ID NO: 130274 - RNA, 20 nt, Artificial Sequence
  mmSKRIPTE0001053_Ssbp3_9
  gRNA
ccugguucaauggcgaacaa

SEQ ID NO: 130275 - RNA, 20 nt, Artificial Sequence
  mmSKRIPTE0001054_Inppl1_1
  gRNA
agaauccggucacaccacga

SEQ ID NO: 130276 - RNA, 20 nt, Artificial Sequence
  mmSKRIPTE0001055_Inppl1_2
  gRNA
uaacugggguaacguuacga

SEQ ID NO: 130277 - RNA, 20 nt, Artificial Sequence
  mmSKRIPTE0001056_Inppl1_3
  gRNA
cugccggcgagaaauaaggg

SEQ ID NO: 130278 - RNA, 20 nt, Artificial Sequence
  mmSKRIPTE0001057_Inppl1_4
  gRNA
guugaaaguucggagcggug

SEQ ID NO: 130279 - RNA, 20 nt, Artificial Sequence
  mmSKRIPTE0001058_Inppl1_5
  gRNA
gagccucaacuaccgaacgc

SEQ ID NO: 130280 - RNA, 20 nt, Artificial Sequence
  mmSKRIPTE0001059_Inppl1_6
  gRNA
gucaacccgagucgcccuag

SEQ ID NO: 130281 - RNA, 20 nt, Artificial Sequence
  mmSKRIPTE0001060_Inppl1_7
  gRNA
ggccaucuuaaguggccgcg

SEQ ID NO: 130282 - RNA, 20 nt, Artificial Sequence
  mmSKRIPTE0001061_Inppl1_8
  gRNA
cuagaggggaagagccgucg

SEQ ID NO: 130283 - RNA, 20 nt, Artificial Sequence
  mmSKRIPTE0001062_Inppl1_9
  gRNA
aggggccggccauaguccga

SEQ ID NO: 130284 - RNA, 20 nt, Artificial Sequence
  mmSKRIPTE0001063_Irf2_1
  gRNA
ccguacgagaauuacuacug

SEQ ID NO: 130285 - RNA, 20 nt, Artificial Sequence
  mmSKRIPTE0001064_Irf2_2
  gRNA
agagauacgcaucuaccgag

SEQ ID NO: 130286 - RNA, 20 nt, Artificial Sequence
  mmSKRIPTE0001065_Irf2_3
  gRNA
uggacuaggcaaaguaucug

SEQ ID NO: 130287 - RNA, 20 nt, Artificial Sequence
  mmSKRIPTE0001066_Irf2_4
  gRNA
guggaagcucugaaaccuag

SEQ ID NO: 130288 - RNA, 20 nt, Artificial Sequence
  mmSKRIPTE0001067_Irf2_5
  gRNA
guucuggaucaauucacgga

SEQ ID NO: 130289 - RNA, 20 nt, Artificial Sequence
  mmSKRIPTE0001068_Irf2_6
  gRNA
cuguugugaccguauuguca

SEQ ID NO: 130290 - RNA, 20 nt, Artificial Sequence
  mmSKRIPTE0001069_Irf2_7
  gRNA
guuaauaaucugcaacgggu

SEQ ID NO: 130291 - RNA, 20 nt, Artificial Sequence
  mmSKRIPTE0001070_Irf2_8
  gRNA
cccacuccccuuaccugcgu

SEQ ID NO: 130292 - RNA, 20 nt, Artificial Sequence
  mmSKRIPTE0001071_Irf2_9
  gRNA
ggauucaaccaauuagacag

SEQ ID NO: 130293 - RNA, 20 nt, Artificial Sequence
  mmSKRIPTE0001072_Hand2_1
  gRNA
ggguuaauauaugucgucag

SEQ ID NO: 130294 - RNA, 20 nt, Artificial Sequence
  mmSKRIPTE0001073_Hand2_2
  gRNA
guggaaacaucuucgacuag

SEQ ID NO: 130295 - RNA, 20 nt, Artificial Sequence
  mmSKRIPTE0001074_Hand2_3
  gRNA
cuuagcucgccucggccuag

SEQ ID NO: 130296 - RNA, 20 nt, Artificial Sequence
  mmSKRIPTE0001075_Hand2_4
  gRNA
cccaagauucuuguccggag

SEQ ID NO: 130297 - RNA, 20 nt, Artificial Sequence
  mmSKRIPTE0001076_Hand2_5
  gRNA
agggccauacuguagucggg

SEQ ID NO: 130298 - RNA, 20 nt, Artificial Sequence
  mmSKRIPTE0001077_Hand2_6
  gRNA
cggcgaauggacucucggag

SEQ ID NO: 130299 - RNA, 20 nt, Artificial Sequence
  mmSKRIPTE0001078_Hand2_7
  gRNA
augaagaggacacucccgug

SEQ ID NO: 130300 - RNA, 20 nt, Artificial Sequence
  mmSKRIPTE0001079_Hand2_8
  gRNA
uggucaguacuaagggaucg

SEQ ID NO: 130301 - RNA, 20 nt, Artificial Sequence
  mmSKRIPTE0001080_Hand2_9
  gRNA
cuagaggacacugagcgcua

SEQ ID NO: 130302 - RNA, 20 nt, Artificial Sequence
  mmSKRIPTE0001081_P4htm_1
  gRNA
cuugcacaguggccgcaccg

SEQ ID NO: 130303 - RNA, 20 nt, Artificial Sequence
  mmSKRIPTE0001082_P4htm_2
  gRNA
uggggauggauauagcccgc

SEQ ID NO: 130304 - RNA, 20 nt, Artificial Sequence
  mmSKRIPTE0001083_P4htm_3
  gRNA
cccgcacacagugaugcgug

SEQ ID NO: 130305 - RNA, 20 nt, Artificial Sequence
  mmSKRIPTE0001084_P4htm_4
  gRNA
guucgagguugacauacacg

SEQ ID NO: 130306 - RNA, 20 nt, Artificial Sequence
  mmSKRIPTE0001085_P4htm_5
  gRNA
augucuuggaugaugcugaa

SEQ ID NO: 130307 - RNA, 20 nt, Artificial Sequence
  mmSKRIPTE0001086_P4htm_6
  gRNA
cucgccugggaaauggacgg

SEQ ID NO: 130308 - RNA, 20 nt, Artificial Sequence
  mmSKRIPTE0001087_P4htm_7
  gRNA
acacucaagaaucuuguagg

SEQ ID NO: 130309 - RNA, 20 nt, Artificial Sequence
  mmSKRIPTE0001088_P4htm_8
  gRNA
gggguagcauuugacuacag

SEQ ID NO: 130310 - RNA, 20 nt, Artificial Sequence
  mmSKRIPTE0001089_P4htm_9
  gRNA
gugucggcucaucauccacc

SEQ ID NO: 130311 - RNA, 20 nt, Artificial Sequence
  mmSKRIPTE0001090_Nouch1_1
  gRNA
cugcccaccaggcuucgucg

SEQ ID NO: 130312 - RNA, 20 nt, Artificial Sequence
  mmSKRIPTE0001091_Nouch1_2
  gRNA
caguaucaaguauacgccug

SEQ ID NO: 130313 - RNA, 20 nt, Artificial Sequence
  mmSKRIPTE0001092_Nouch1_3
  gRNA
acagcguccacugcucacgu

SEQ ID NO: 130314 - RNA, 20 nt, Artificial Sequence
  mmSKRIPTE0001093_Nouch1_4
  gRNA
aggagccugagggcccacga

SEQ ID NO: 130315 - RNA, 20 nt, Artificial Sequence
  mmSKRIPTE0001094_Nouch1_5
  gRNA
ccgacugaguccucgccgag

SEQ ID NO: 130316 - RNA, 20 nt, Artificial Sequence
  mmSKRIPTE0001095_Nouch1_6
  gRNA
uugcaguaucccuccuaaag

SEQ ID NO: 130317 - RNA, 20 nt, Artificial Sequence
  mmSKRIPTE0001096_Nouch1_7
  gRNA
acuuucuguaaccaccagug

SEQ ID NO: 130318 - RNA, 20 nt, Artificial Sequence
  mmSKRIPTE0001097_Nouch1_8
  gRNA
acauacccguccacuccggu

SEQ ID NO: 130319 - RNA, 20 nt, Artificial Sequence
  mmSKRIPTE0001098_Nouch1_9
  gRNA
guauacaccuucauaaccug

SEQ ID NO: 130320 - RNA, 20 nt, Artificial Sequence
  mmSKRIPTE0001099_Cx3cl1_1
  gRNA
uuucgcauuucgucaugccg

SEQ ID NO: 130321 - RNA, 20 nt, Artificial Sequence
  mmSKRIPTE0001100_Cx3cl1_2
  gRNA
cagcuccuaguagucacucg

SEQ ID NO: 130322 - RNA, 20 nt, Artificial Sequence
  mmSKRIPTE0001101_Cx3cl1_3
  gRNA
gucaggggucaccaccagug

SEQ ID NO: 130323 - RNA, 20 nt, Artificial Sequence
  mmSKRIPTE0001102_Cx3cl1_4
  gRNA
ucagcgaggagauagccugu

SEQ ID NO: 130324 - RNA, 20 nt, Artificial Sequence
  mmSKRIPTE0001103_Cx3cl1_5
  gRNA
caaagccacugggauucgug

SEQ ID NO: 130325 - RNA, 20 nt, Artificial Sequence
  mmSKRIPTE0001104_Cx3cl1_6
  gRNA
guuuccuggauggcucaccg

SEQ ID NO: 130326 - RNA, 20 nt, Artificial Sequence
  mmSKRIPTE0001105_Cx3cl1_7
  gRNA
acuccugguuuagcugauag

SEQ ID NO: 130327 - RNA, 20 nt, Artificial Sequence
  mmSKRIPTE0001106_Cx3cl1_8
  gRNA
gcuacguagcagaagccacu

SEQ ID NO: 130328 - RNA, 20 nt, Artificial Sequence
  mmSKRIPTE0001107_Cx3cl1_9
  gRNA
gccauugguuuagacaacgc

SEQ ID NO: 130329 - RNA, 20 nt, Artificial Sequence
  mmSKRIPTE0001108_Tnfsf9_1
  gRNA
guucagugcaggcggccacg

SEQ ID NO: 130330 - RNA, 20 nt, Artificial Sequence
  mmSKRIPTE0001109_Tnfsf9_2
  gRNA
accugggggagaacucccga

SEQ ID NO: 130331 - RNA, 20 nt, Artificial Sequence
  mmSKRIPTE0001110_Tnfsf9_3
  gRNA
ccgugcuuuauaggcuaccg

SEQ ID NO: 130332 - RNA, 20 nt, Artificial Sequence
  mmSKRIPTE0001111_Tnfsf9_4
  gRNA
uggggcgcacaguaucugag

SEQ ID NO: 130333 - RNA, 20 nt, Artificial Sequence
  mmSKRIPTE0001112_Tnfsf9_5
  gRNA
agggucuagaguguuaagag

SEQ ID NO: 130334 - RNA, 20 nt, Artificial Sequence
  mmSKRIPTE0001113_Tnfsf9_6
  gRNA
gaagcaucgcugcaccgaca

SEQ ID NO: 130335 - RNA, 20 nt, Artificial Sequence
  mmSKRIPTE0001114_Tnfsf9_7
  gRNA
ugaggagcgccgcauccgag

SEQ ID NO: 130336 - RNA, 20 nt, Artificial Sequence
  mmSKRIPTE0001115_Tnfsf9_8
  gRNA
agacgugcacugaccgaccg

SEQ ID NO: 130337 - RNA, 20 nt, Artificial Sequence
  mmSKRIPTE0001116_Tnfsf9_9
  gRNA
aaguuccgggagucgagggg

SEQ ID NO: 130338 - RNA, 20 nt, Artificial Sequence
  mmSKRIPTE0001117_Camk4_1
  gRNA
ccccggugguuaacaagggu

SEQ ID NO: 130339 - RNA, 20 nt, Artificial Sequence
  mmSKRIPTE0001118_Camk4_2
  gRNA
uucaaggaggagauuaacgu

SEQ ID NO: 130340 - RNA, 20 nt, Artificial Sequence
  mmSKRIPTE0001119_Camk4_3
  gRNA
gaguugcgccaacaaugacc

SEQ ID NO: 130341 - RNA, 20 nt, Artificial Sequence
  mmSKRIPTE0001120_Camk4_4
  gRNA
ccuaggcuguauacucugcg

SEQ ID NO: 130342 - RNA, 20 nt, Artificial Sequence
  mmSKRIPTE0001121_Camk4_5
  gRNA
aagcguaccgcaguaccccg

SEQ ID NO: 130343 - RNA, 20 nt, Artificial Sequence
  mmSKRIPTE0001122_Camk4_6
  gRNA
guacuaaaugguguucccag

SEQ ID NO: 130344 - RNA, 20 nt, Artificial Sequence
  mmSKRIPTE0001123_Camk4_7
  gRNA
gacuuugagcaucuucgccg

SEQ ID NO: 130345 - RNA, 20 nt, Artificial Sequence
  mmSKRIPTE0001124_Camk4_8
  gRNA
uagggcaugacgaugacacg

SEQ ID NO: 130346 - RNA, 20 nt, Artificial Sequence
  mmSKRIPTE0001125_Camk4_9
  gRNA
gcuagccaagucguaggggu

SEQ ID NO: 130347 - RNA, 20 nt, Artificial Sequence
  mmSKRIPTE0001126_Foxl1_1
  gRNA
aaguacgugccaaacacacg

SEQ ID NO: 130348 - RNA, 20 nt, Artificial Sequence
  mmSKRIPTE0001127_Foxl1_2
  gRNA
aacgccgccaaagccuacga

SEQ ID NO: 130349 - RNA, 20 nt, Artificial Sequence
  mmSKRIPTE0001128_Foxl1_3
  gRNA
guacacguacaacagcggcg

SEQ ID NO: 130350 - RNA, 20 nt, Artificial Sequence
  mmSKRIPTE0001129_Foxl1_4
  gRNA
aaggcucagcgggcuccgug

SEQ ID NO: 130351 - RNA, 20 nt, Artificial Sequence
  mmSKRIPTE0001130_Foxl1_5
  gRNA
ucugcuggagacgaaccgug

SEQ ID NO: 130352 - RNA, 20 nt, Artificial Sequence
  mmSKRIPTE0001131_Foxl1_6
  gRNA
ggacugugagguccgcgucg

SEQ ID NO: 130353 - RNA, 20 nt, Artificial Sequence
  mmSKRIPTE0001132_Foxl1_7
  gRNA
aggagacucagguccgagug

SEQ ID NO: 130354 - RNA, 20 nt, Artificial Sequence
  mmSKRIPTE0001133_Foxl1_8
  gRNA
agaagggacaaagcgcgcag

SEQ ID NO: 130355 - RNA, 20 nt, Artificial Sequence
  mmSKRIPTE0001134_Foxl1_9
  gRNA
aaguccuuaggacuccccgg

SEQ ID NO: 130356 - RNA, 20 nt, Artificial Sequence
  mmSKRIPTE0001135_Peli1_1
  gRNA
cuuccaaauacuaauucgag

SEQ ID NO: 130357 - RNA, 20 nt, Artificial Sequence
  mmSKRIPTE0001136_Peli1_2
  gRNA
ugaaaagugugcguaccaug

SEQ ID NO: 130358 - RNA, 20 nt, Artificial Sequence
  mmSKRIPTE0001137_Peli1_3
  gRNA
ucuucugugaacccauuacg

SEQ ID NO: 130359 - RNA, 20 nt, Artificial Sequence
  mmSKRIPTE0001138_Peli1_4
  gRNA
auaaauccgagcuguaaagg

SEQ ID NO: 130360 - RNA, 20 nt, Artificial Sequence
  mmSKRIPTE0001139_Peli1_5
  gRNA
ccauggguauaucuaaacug

SEQ ID NO: 130361 - RNA, 20 nt, Artificial Sequence
  mmSKRIPTE0001140_Peli1_6
  gRNA
gcuuuguacugacugcgugu

SEQ ID NO: 130362 - RNA, 20 nt, Artificial Sequence
  mmSKRIPTE0001141_Peli1_7
  gRNA
aaagugaggacacaccgcag

SEQ ID NO: 130363 - RNA, 20 nt, Artificial Sequence
  mmSKRIPTE0001142_Peli1_8
  gRNA
aguguaacuucucacccucg

SEQ ID NO: 130364 - RNA, 20 nt, Artificial Sequence
  mmSKRIPTE0001143_Peli1_9
  gRNA
caucuagagcuguaaagggu

SEQ ID NO: 130365 - RNA, 20 nt, Artificial Sequence
  mmSKRIPTE0001144_Zfau_1
  gRNA
acguagcgacgucggucgcg

SEQ ID NO: 130366 - RNA, 20 nt, Artificial Sequence
  mmSKRIPTE0001145_Zfau_2
  gRNA
ucuuugugagcggauccgga

SEQ ID NO: 130367 - RNA, 20 nt, Artificial Sequence
  mmSKRIPTE0001146_Zfau_3
  gRNA
uauucuugguacccucuccg

SEQ ID NO: 130368 - RNA, 20 nt, Artificial Sequence
  mmSKRIPTE0001147_Zfau_4
  gRNA
gcugcgcucccauauccgag

SEQ ID NO: 130369 - RNA, 20 nt, Artificial Sequence
  mmSKRIPTE0001148_Zfau_5
  gRNA
gagagguuauggcgaaucug

SEQ ID NO: 130370 - RNA, 20 nt, Artificial Sequence
  mmSKRIPTE0001149_Zfau_6
  gRNA
guacaccaacgugggcagcg

SEQ ID NO: 130371 - RNA, 20 nt, Artificial Sequence
  mmSKRIPTE0001150_Zfau_7
  gRNA
acucuaugcuuauggaacga

SEQ ID NO: 130372 - RNA, 20 nt, Artificial Sequence
  mmSKRIPTE0001151_Zfau_8
  gRNA
acuuuccaggaggcacacug

SEQ ID NO: 130373 - RNA, 20 nt, Artificial Sequence
  mmSKRIPTE0001152_Zfau_9
  gRNA
gcacugugccuugcgugccg

SEQ ID NO: 130374 - RNA, 20 nt, Artificial Sequence
  mmSKRIPTE0001153_Dhtkd1_1
  gRNA
cugauguuccguaaaaugcg

SEQ ID NO: 130375 - RNA, 20 nt, Artificial Sequence
  mmSKRIPTE0001154_Dhtkd1_2
  gRNA
gaugucgguuauaccgccau

SEQ ID NO: 130376 - RNA, 20 nt, Artificial Sequence
  mmSKRIPTE0001155_Dhtkd1_3
  gRNA
cggucuuugaccagaacgug

SEQ ID NO: 130377 - RNA, 20 nt, Artificial Sequence
  mmSKRIPTE0001156_Dhtkd1_4
  gRNA
agaauggucgaccagccggg

SEQ ID NO: 130378 - RNA, 20 nt, Artificial Sequence
  mmSKRIPTE0001157_Dhtkd1_5
  gRNA
cgcagaaggaagcgucaccg

SEQ ID NO: 130379 - RNA, 20 nt, Artificial Sequence
  mmSKRIPTE0001158_Dhtkd1_6
  gRNA
ucuccaacucauaaccucga

SEQ ID NO: 130380 - RNA, 20 nt, Artificial Sequence
  mmSKRIPTE0001159_Dhtkd1_7
  gRNA
ggcgcgguuaccagacggag

SEQ ID NO: 130381 - RNA, 20 nt, Artificial Sequence
  mmSKRIPTE0001160_Dhtkd1_8
  gRNA
ccgaugccauauccaaucug

SEQ ID NO: 130382 - RNA, 20 nt, Artificial Sequence
  mmSKRIPTE0001161_Dhtkd1_9
  gRNA
gacugauuguugcuaaugug

SEQ ID NO: 130383 - RNA, 20 nt, Artificial Sequence
  mmSKRIPTE0001162_Kif16b_1
  gRNA
gauaccuugauuuagcugcg

SEQ ID NO: 130384 - RNA, 20 nt, Artificial Sequence
  mmSKRIPTE0001163_Kif16b_2
  gRNA
cugugucuuugagaacgccg

SEQ ID NO: 130385 - RNA, 20 nt, Artificial Sequence
  mmSKRIPTE0001164_Kif16b_3
  gRNA
guuccgcuuuaaccauccga

SEQ ID NO: 130386 - RNA, 20 nt, Artificial Sequence
  mmSKRIPTE0001165_Kif16b_4
  gRNA
uggaaaucuccccggccucg

SEQ ID NO: 130387 - RNA, 20 nt, Artificial Sequence
  mmSKRIPTE0001166_Kif16b_5
  gRNA
aacgugugagagaccuacuu

SEQ ID NO: 130388 - RNA, 20 nt, Artificial Sequence
  mmSKRIPTE0001167_Kif16b_6
  gRNA
augauguauuguacccgugu

SEQ ID NO: 130389 - RNA, 20 nt, Artificial Sequence
  mmSKRIPTE0001168_Kif16b_7
  gRNA
aacuuaaagguaagugacga

SEQ ID NO: 130390 - RNA, 20 nt, Artificial Sequence
  mmSKRIPTE0001169_Kif16b_8
  gRNA
aagaucgaugaagcugauug

SEQ ID NO: 130391 - RNA, 20 nt, Artificial Sequence
  mmSKRIPTE0001170_Kif16b_9
  gRNA
ucugaggggaaguguccgcg

SEQ ID NO: 130392 - RNA, 20 nt, Artificial Sequence
  mmSKRIPTE0001171_Ncf1_1
  gRNA
uugacguagaccagccagcg

SEQ ID NO: 130393 - RNA, 20 nt, Artificial Sequence
  mmSKRIPTE0001172_Ncf1_2
  gRNA
cauacgguucaccugguccg

SEQ ID NO: 130394 - RNA, 20 nt, Artificial Sequence
  mmSKRIPTE0001173_Ncf1_3
  gRNA
gcgacagaucagaggccgcg

SEQ ID NO: 130395 - RNA, 20 nt, Artificial Sequence
  mmSKRIPTE0001174_Ncf1_4
  gRNA
acacccgcuauugccucaga

SEQ ID NO: 130396 - RNA, 20 nt, Artificial Sequence
  mmSKRIPTE0001175_Ncf1_5
  gRNA
gauccggaucccaacuacgc

SEQ ID NO: 130397 - RNA, 20 nt, Artificial Sequence
  mmSKRIPTE0001176_Ncf1_6
  gRNA
uaccacaguacaacgggcgu

SEQ ID NO: 130398 - RNA, 20 nt, Artificial Sequence
  mmSKRIPTE0001177_Ncf1_7
  gRNA
ugaggggcauuagagccgag

SEQ ID NO: 130399 - RNA, 20 nt, Artificial Sequence
  mmSKRIPTE0001178_Ncf1_8
  gRNA
gcgagcaccuuacaacuggg

SEQ ID NO: 130400 - RNA, 20 nt, Artificial Sequence
  mmSKRIPTE0001179_Ncf1_9
  gRNA
gcgggcugugguuugacgcg

SEQ ID NO: 130401 - RNA, 20 nt, Artificial Sequence
  mmSKRIPTE0001180_Tnfsf13b_1
  gRNA
auggagcugcagagcuaccg

SEQ ID NO: 130402 - RNA, 20 nt, Artificial Sequence
  mmSKRIPTE0001181_Tnfsf13b_2
  gRNA
aaugcacagauuucacgcaa

SEQ ID NO: 130403 - RNA, 20 nt, Artificial Sequence
  mmSKRIPTE0001182_Tnfsf13b_3
  gRNA
gauuaggauucaguccagcg

SEQ ID NO: 130404 - RNA, 20 nt, Artificial Sequence
  mmSKRIPTE0001183_Tnfsf13b_4
  gRNA
uggccgcggcuggaguugug

SEQ ID NO: 130405 - RNA, 20 nt, Artificial Sequence
  mmSKRIPTE0001184_Tnfsf13b_5
  gRNA
uuauaaagcgaaauuccuga

SEQ ID NO: 130406 - RNA, 20 nt, Artificial Sequence
  mmSKRIPTE0001185_Tnfsf13b_6
  gRNA
acagcuguccaguaacggac

SEQ ID NO: 130407 - RNA, 20 nt, Artificial Sequence
  mmSKRIPTE0001186_Tnfsf13b_7
  gRNA
cagugaaaacgucggaccag

SEQ ID NO: 130408 - RNA, 20 nt, Artificial Sequence
  mmSKRIPTE0001187_Tnfsf13b_8
  gRNA
agaaacuggacuaaauuagg

SEQ ID NO: 130409 - RNA, 20 nt, Artificial Sequence
  mmSKRIPTE0001188_Tnfsf13b_9
  gRNA
ccuguggucacuuacuccaa

SEQ ID NO: 130410 - RNA, 20 nt, Artificial Sequence
  mmSKRIPTE0001189_Il17c_1
  gRNA
acgagcgcuccaucucacca

SEQ ID NO: 130411 - RNA, 20 nt, Artificial Sequence
  mmSKRIPTE0001190_Il17c_2
  gRNA
aggauugugaugcgccacag

SEQ ID NO: 130412 - RNA, 20 nt, Artificial Sequence
  mmSKRIPTE0001191_Il17c_3
  gRNA
cgacagcccugcucccgaga

SEQ ID NO: 130413 - RNA, 20 nt, Artificial Sequence
  mmSKRIPTE0001192_Il17c_4
  gRNA
cccgaagccauaggacccug

SEQ ID NO: 130414 - RNA, 20 nt, Artificial Sequence
  mmSKRIPTE0001193_Il17c_5
  gRNA
guggcagaaugcuugugucg

SEQ ID NO: 130415 - RNA, 20 nt, Artificial Sequence
  mmSKRIPTE0001194_Il17c_6
  gRNA
gcuaacucgaagugccaggu

SEQ ID NO: 130416 - RNA, 20 nt, Artificial Sequence
  mmSKRIPTE0001195_Il17c_7
  gRNA
agugaucuagggcuccgggg

SEQ ID NO: 130417 - RNA, 20 nt, Artificial Sequence
  mmSKRIPTE0001196_Il17c_8
  gRNA
gcacgcggaugaacucggug

SEQ ID NO: 130418 - RNA, 20 nt, Artificial Sequence
  mmSKRIPTE0001197_Il17c_9
  gRNA
accaagaucccccguccugg

SEQ ID NO: 130419 - RNA, 20 nt, Artificial Sequence
  mmSKRIPTE0001198_Bcl11a_1
  gRNA
gugagcaccguaauacagug

SEQ ID NO: 130420 - RNA, 20 nt, Artificial Sequence
  mmSKRIPTE0001199_Bcl11a_2
  gRNA
caacuuacaaauacccugcg

SEQ ID NO: 130421 - RNA, 20 nt, Artificial Sequence
  mmSKRIPTE0001200_Bcl11a_3
  gRNA
cuucccaugaggcuuaacga

SEQ ID NO: 130422 - RNA, 20 nt, Artificial Sequence
  mmSKRIPTE0001201_Bcl11a_4
  gRNA
aggcuacacaugcgauccag

SEQ ID NO: 130423 - RNA, 20 nt, Artificial Sequence
  mmSKRIPTE0001202_Bcl11a_5
  gRNA
ugaagggauaccaacccgcg

SEQ ID NO: 130424 - RNA, 20 nt, Artificial Sequence
  mmSKRIPTE0001203_Bcl11a_6
  gRNA
uguuuaucaacgucaucuag

SEQ ID NO: 130425 - RNA, 20 nt, Artificial Sequence
  mmSKRIPTE0001204_Bcl11a_7
  gRNA
ccucugcuuagaaaaaggug

SEQ ID NO: 130426 - RNA, 20 nt, Artificial Sequence
  mmSKRIPTE0001205_Bcl11a_8
  gRNA
cggagaacguguauucgcag

SEQ ID NO: 130427 - RNA, 20 nt, Artificial Sequence
  mmSKRIPTE0001206_Bcl11a_9
  gRNA
aggcugaggcuuacgagaug

SEQ ID NO: 130428 - RNA, 20 nt, Artificial Sequence
  mmSKRIPTE0001207_Dhx58_1
  gRNA
auacuacuggaaacaccucg

SEQ ID NO: 130429 - RNA, 20 nt, Artificial Sequence
  mmSKRIPTE0001208_Dhx58_2
  gRNA
agaacucguagauaacuacc

SEQ ID NO: 130430 - RNA, 20 nt, Artificial Sequence
  mmSKRIPTE0001209_Dhx58_3
  gRNA
auuuguacccggacccagaa

SEQ ID NO: 130431 - RNA, 20 nt, Artificial Sequence
  mmSKRIPTE0001210_Dhx58_4
  gRNA
guggaacagauggaagcacg

SEQ ID NO: 130432 - RNA, 20 nt, Artificial Sequence
  mmSKRIPTE0001211_Dhx58_5
  gRNA
uggaguuggaagaugaacgc

SEQ ID NO: 130433 - RNA, 20 nt, Artificial Sequence
  mmSKRIPTE0001212_Dhx58_6
  gRNA
ugaagaugauaccccgagug

SEQ ID NO: 130434 - RNA, 20 nt, Artificial Sequence
  mmSKRIPTE0001213_Dhx58_7
  gRNA
agccccauaucuaccaccag

SEQ ID NO: 130435 - RNA, 20 nt, Artificial Sequence
  mmSKRIPTE0001214_Dhx58_8
  gRNA
gagaguauuagucacucacc

SEQ ID NO: 130436 - RNA, 20 nt, Artificial Sequence
  mmSKRIPTE0001215_Dhx58_9
  gRNA
uuugauggugaggcauaaca

SEQ ID NO: 130437 - RNA, 20 nt, Artificial Sequence
  mmSKRIPTE0001216_Stk3_1
  gRNA
ccaacuuucacguaacuccg

SEQ ID NO: 130438 - RNA, 20 nt, Artificial Sequence
  mmSKRIPTE0001217_Stk3_2
  gRNA
aggucucuuaauaucgacac

SEQ ID NO: 130439 - RNA, 20 nt, Artificial Sequence
  mmSKRIPTE0001218_Stk3_3
  gRNA
augcugauauacauccgaug

SEQ ID NO: 130440 - RNA, 20 nt, Artificial Sequence
  mmSKRIPTE0001219_Stk3_4
  gRNA
ccgaacgcaagggaucacac

SEQ ID NO: 130441 - RNA, 20 nt, Artificial Sequence
  mmSKRIPTE0001220_Stk3_5
  gRNA
aaagugggcggaaccuagcg

SEQ ID NO: 130442 - RNA, 20 nt, Artificial Sequence
  mmSKRIPTE0001221_Stk3_6
  gRNA
cguccaagagguaacgacgg

SEQ ID NO: 130443 - RNA, 20 nt, Artificial Sequence
  mmSKRIPTE0001222_Stk3_7
  gRNA
cuuucaaaacgacaucagag

SEQ ID NO: 130444 - RNA, 20 nt, Artificial Sequence
  mmSKRIPTE0001223_Stk3_8
  gRNA
gaacacgggcaaaagacgaa

SEQ ID NO: 130445 - RNA, 20 nt, Artificial Sequence
  mmSKRIPTE0001224_Stk3_9
  gRNA
aaccgcguugaggagcggga

SEQ ID NO: 130446 - RNA, 20 nt, Artificial Sequence
  mmSKRIPTE0001225_Rarg_1
  gRNA
ucagcaauaugcgaacagcg

SEQ ID NO: 130447 - RNA, 20 nt, Artificial Sequence
  mmSKRIPTE0001226_Rarg_2
  gRNA
uacuggcccuuuaaacacga

SEQ ID NO: 130448 - RNA, 20 nt, Artificial Sequence
  mmSKRIPTE0001227_Rarg_3
  gRNA
agauuguggaguuugcgaag

SEQ ID NO: 130449 - RNA, 20 nt, Artificial Sequence
  mmSKRIPTE0001228_Rarg_4
  gRNA
acacuaugacauucucggau

SEQ ID NO: 130450 - RNA, 20 nt, Artificial Sequence
  mmSKRIPTE0001229_Rarg_5
  gRNA
acauacgucuacuagcugag

SEQ ID NO: 130451 - RNA, 20 nt, Artificial Sequence
  mmSKRIPTE0001230_Rarg_6
  gRNA
uccuguccuaucgugucgug

SEQ ID NO: 130452 - RNA, 20 nt, Artificial Sequence
  mmSKRIPTE0001231_Rarg_7
  gRNA
ugcagucguacaucgcgacc

SEQ ID NO: 130453 - RNA, 20 nt, Artificial Sequence
  mmSKRIPTE0001232_Rarg_8
  gRNA
ugggcaaguacaccacggug

SEQ ID NO: 130454 - RNA, 20 nt, Artificial Sequence
  mmSKRIPTE0001233_Rarg_9
  gRNA
uggggcccaaccccacaacg

SEQ ID NO: 130455 - RNA, 20 nt, Artificial Sequence
  mmSKRIPTE0001234_Abcf3_1
  gRNA
guacaacacucuacgccugu

SEQ ID NO: 130456 - RNA, 20 nt, Artificial Sequence
  mmSKRIPTE0001235_Abcf3_2
  gRNA
agaacgggacgcaagcgccg

SEQ ID NO: 130457 - RNA, 20 nt, Artificial Sequence
  mmSKRIPTE0001236_Abcf3_3
  gRNA
ucguaccuuaaccaacagcg

SEQ ID NO: 130458 - RNA, 20 nt, Artificial Sequence
  mmSKRIPTE0001237_Abcf3_4
  gRNA
acggcuagacgguuaccggg

SEQ ID NO: 130459 - RNA, 20 nt, Artificial Sequence
  mmSKRIPTE0001238_Abcf3_5
  gRNA
augucauccgucugucccug

SEQ ID NO: 130460 - RNA, 20 nt, Artificial Sequence
  mmSKRIPTE0001239_Abcf3_6
  gRNA
ucuugagucccgcaucugug

SEQ ID NO: 130461 - RNA, 20 nt, Artificial Sequence
  mmSKRIPTE0001240_Abcf3_7
  gRNA
cugcccaugaacgagcagag

SEQ ID NO: 130462 - RNA, 20 nt, Artificial Sequence
  mmSKRIPTE0001241_Abcf3_8
  gRNA
acugugccuaggacguggac

SEQ ID NO: 130463 - RNA, 20 nt, Artificial Sequence
  mmSKRIPTE0001242_Abcf3_9
  gRNA
acuauugcaagaaguguccg

SEQ ID NO: 130464 - RNA, 20 nt, Artificial Sequence
  mmSKRIPTE0001243_Plcg1_1
  gRNA
aggaccccgugaaucaugug

SEQ ID NO: 130465 - RNA, 20 nt, Artificial Sequence
  mmSKRIPTE0001244_Plcg1_2
  gRNA
ucguaaccgagaggaucggu

SEQ ID NO: 130466 - RNA, 20 nt, Artificial Sequence
  mmSKRIPTE0001245_Plcg1_3
  gRNA
uuucaguaccuugcccuccg

SEQ ID NO: 130467 - RNA, 20 nt, Artificial Sequence
  mmSKRIPTE0001246_Plcg1_4
  gRNA
ugaggcggaugccuaaccag

SEQ ID NO: 130468 - RNA, 20 nt, Artificial Sequence
  mmSKRIPTE0001247_Plcg1_5
  gRNA
uggcuaccgcagauccacau

SEQ ID NO: 130469 - RNA, 20 nt, Artificial Sequence
  mmSKRIPTE0001248_Plcg1_6
  gRNA
gcuacgcuaccccaucaacg

SEQ ID NO: 130470 - RNA, 20 nt, Artificial Sequence
  mmSKRIPTE0001249_Plcg1_7
  gRNA
ugagagcgcuaggaguaacu

SEQ ID NO: 130471 - RNA, 20 nt, Artificial Sequence
  mmSKRIPTE0001250_Plcg1_8
  gRNA
ccgccccagagugaccacca

SEQ ID NO: 130472 - RNA, 20 nt, Artificial Sequence
  mmSKRIPTE0001251_Plcg1_9
  gRNA
uaugccaucucuuuccggug

SEQ ID NO: 130473 - RNA, 20 nt, Artificial Sequence
  mmSKRIPTE0001252_Trpm4_1
  gRNA
acacaguggccggauccgug

SEQ ID NO: 130474 - RNA, 20 nt, Artificial Sequence
  mmSKRIPTE0001253_Trpm4_2
  gRNA
uggaccucuccgaugaugcg

SEQ ID NO: 130475 - RNA, 20 nt, Artificial Sequence
  mmSKRIPTE0001254_Trpm4_3
  gRNA
aggugcagccgauggcgcag

SEQ ID NO: 130476 - RNA, 20 nt, Artificial Sequence
  mmSKRIPTE0001255_Trpm4_4
  gRNA
cugaaccacagaagaugccg

SEQ ID NO: 130477 - RNA, 20 nt, Artificial Sequence
  mmSKRIPTE0001256_Trpm4_5
  gRNA
cccaggaggaaauggacggu

SEQ ID NO: 130478 - RNA, 20 nt, Artificial Sequence
  mmSKRIPTE0001257_Trpm4_6
  gRNA
acacacugcgaguaucaccg

SEQ ID NO: 130479 - RNA, 20 nt, Artificial Sequence
  mmSKRIPTE0001258_Trpm4_7
  gRNA
cgaagaucugcagauacggu

SEQ ID NO: 130480 - RNA, 20 nt, Artificial Sequence
  mmSKRIPTE0001259_Trpm4_8
  gRNA
aacggccguuccgugcucag

SEQ ID NO: 130481 - RNA, 20 nt, Artificial Sequence
  mmSKRIPTE0001260_Trpm4_9
  gRNA
uucaucagaagacggcuccg

SEQ ID NO: 130482 - RNA, 20 nt, Artificial Sequence
  mmSKRIPTE0001261_Il3_1
  gRNA
guacucaagauuaucgacau

SEQ ID NO: 130483 - RNA, 20 nt, Artificial Sequence
  mmSKRIPTE0001262_Il3_2
  gRNA
ggcuccgucucuccuaaccg

SEQ ID NO: 130484 - RNA, 20 nt, Artificial Sequence
  mmSKRIPTE0001263_Il3_3
  gRNA
gcagagucauucgcagaugu

SEQ ID NO: 130485 - RNA, 20 nt, Artificial Sequence
  mmSKRIPTE0001264_Il3_4
  gRNA
acagccugcuaaacacgugg

SEQ ID NO: 130486 - RNA, 20 nt, Artificial Sequence
  mmSKRIPTE0001265_Il3_5
  gRNA
agaucucgaaugaagacccc

SEQ ID NO: 130487 - RNA, 20 nt, Artificial Sequence
  mmSKRIPTE0001266_Il3_6
  gRNA
ggaggaccagaacgagacaa

SEQ ID NO: 130488 - RNA, 20 nt, Artificial Sequence
  mmSKRIPTE0001267_Il3_7
  gRNA
cugucuccagaucguuaagg

SEQ ID NO: 130489 - RNA, 20 nt, Artificial Sequence
  mmSKRIPTE0001268_Il3_8
  gRNA
caaacuauaagucuggucau

SEQ ID NO: 130490 - RNA, 20 nt, Artificial Sequence
  mmSKRIPTE0001269_Il3_9
  gRNA
ugcgggcugagguggucuag

SEQ ID NO: 130491 - RNA, 20 nt, Artificial Sequence
  mmSKRIPTE0001270_Six1_1
  gRNA
auuucgcgcuaguuggacaa

SEQ ID NO: 130492 - RNA, 20 nt, Artificial Sequence
  mmSKRIPTE0001271_Six1_2
  gRNA
gccgaaaauucccguugccg

SEQ ID NO: 130493 - RNA, 20 nt, Artificial Sequence
  mmSKRIPTE0001272_Six1_3
  gRNA
ucggcccgggagguucguag

SEQ ID NO: 130494 - RNA, 20 nt, Artificial Sequence
  mmSKRIPTE0001273_Six1_4
  gRNA
guggcugaaagcgcacuacg

SEQ ID NO: 130495 - RNA, 20 nt, Artificial Sequence
  mmSKRIPTE0001274_Six1_5
  gRNA
cucuaaacguguaccaacga

SEQ ID NO: 130496 - RNA, 20 nt, Artificial Sequence
  mmSKRIPTE0001275_Six1_6
  gRNA
guuggugacagauugcacaa

SEQ ID NO: 130497 - RNA, 20 nt, Artificial Sequence
  mmSKRIPTE0001276_Six1_7
  gRNA
aauaguuugagcuccuggcg

SEQ ID NO: 130498 - RNA, 20 nt, Artificial Sequence
  mmSKRIPTE0001277_Six1_8
  gRNA
agagaccagucgaaccucgg

SEQ ID NO: 130499 - RNA, 20 nt, Artificial Sequence
  mmSKRIPTE0001278_Six1_9
  gRNA
gcgaagggugaaacuucccg

SEQ ID NO: 130500 - RNA, 20 nt, Artificial Sequence
  mmSKRIPTE0001279_Clu_1
  gRNA
uuguaucccaaagcacgaag

SEQ ID NO: 130501 - RNA, 20 nt, Artificial Sequence
  mmSKRIPTE0001280_Clu_2
  gRNA
augaccgcauugguugcugu

SEQ ID NO: 130502 - RNA, 20 nt, Artificial Sequence
  mmSKRIPTE0001281_Clu_3
  gRNA
aagggacacguaucgcaagg

SEQ ID NO: 130503 - RNA, 20 nt, Artificial Sequence
  mmSKRIPTE0001282_Clu_4
  gRNA
guuccgcuaaugcuggacug

SEQ ID NO: 130504 - RNA, 20 nt, Artificial Sequence
  mmSKRIPTE0001283_Clu_5
  gRNA
gggcacguggccuaucccug

SEQ ID NO: 130505 - RNA, 20 nt, Artificial Sequence
  mmSKRIPTE0001284_Clu_6
  gRNA
ccucuguucugauagcgccg

SEQ ID NO: 130506 - RNA, 20 nt, Artificial Sequence
  mmSKRIPTE0001285_Clu_7
  gRNA
aggaccgccuuaggacacca

SEQ ID NO: 130507 - RNA, 20 nt, Artificial Sequence
  mmSKRIPTE0001286_Clu_8
  gRNA
gugggacaaaggucccaccu

SEQ ID NO: 130508 - RNA, 20 nt, Artificial Sequence
  mmSKRIPTE0001287_Clu_9
  gRNA
uaauuacgcgcgcagagcag

SEQ ID NO: 130509 - RNA, 20 nt, Artificial Sequence
  mmSKRIPTE0001288_Irak4_1
  gRNA
ccgaguccaucuacacagcg

SEQ ID NO: 130510 - RNA, 20 nt, Artificial Sequence
  mmSKRIPTE0001289_Irak4_2
  gRNA
ugacaucuacagcuucggcg

SEQ ID NO: 130511 - RNA, 20 nt, Artificial Sequence
  mmSKRIPTE0001290_Irak4_3
  gRNA
cauacaugguacuauacgug

SEQ ID NO: 130512 - RNA, 20 nt, Artificial Sequence
  mmSKRIPTE0001291_Irak4_4
  gRNA
guggcaugguccacagcaug

SEQ ID NO: 130513 - RNA, 20 nt, Artificial Sequence
  mmSKRIPTE0001292_Irak4_5
  gRNA
uuguaucugucgucgccgga

SEQ ID NO: 130514 - RNA, 20 nt, Artificial Sequence
  mmSKRIPTE0001293_Irak4_6
  gRNA
uaagaggcuaggcggcggaa

SEQ ID NO: 130515 - RNA, 20 nt, Artificial Sequence
  mmSKRIPTE0001294_Irak4_7
  gRNA
ggcggugaagaagcucggag

SEQ ID NO: 130516 - RNA, 20 nt, Artificial Sequence
  mmSKRIPTE0001295_Irak4_8
  gRNA
cguggguaacuccggcacac

SEQ ID NO: 130517 - RNA, 20 nt, Artificial Sequence
  mmSKRIPTE0001296_Irak4_9
  gRNA
ccuggagcacugauauugau

SEQ ID NO: 130518 - RNA, 20 nt, Artificial Sequence
  mmSKRIPTE0001297_Bag6_1
  gRNA
gcaagcacgagaccgaccag

SEQ ID NO: 130519 - RNA, 20 nt, Artificial Sequence
  mmSKRIPTE0001298_Bag6_2
  gRNA
uuuccuacagcgcuacugcg

SEQ ID NO: 130520 - RNA, 20 nt, Artificial Sequence
  mmSKRIPTE0001299_Bag6_3
  gRNA
cuuucagucguaguauagcg

SEQ ID NO: 130521 - RNA, 20 nt, Artificial Sequence
  mmSKRIPTE0001300_Bag6_4
  gRNA
ucuuauugcaagaccacgag

SEQ ID NO: 130522 - RNA, 20 nt, Artificial Sequence
  mmSKRIPTE0001301_Bag6_5
  gRNA
auaauagggacccauuccug

SEQ ID NO: 130523 - RNA, 20 nt, Artificial Sequence
  mmSKRIPTE0001302_Bag6_6
  gRNA
aaauccggaugacccguggg

SEQ ID NO: 130524 - RNA, 20 nt, Artificial Sequence
  mmSKRIPTE0001303_Bag6_7
  gRNA
gucguguugcuggaauaccg

SEQ ID NO: 130525 - RNA, 20 nt, Artificial Sequence
  mmSKRIPTE0001304_Bag6_8
  gRNA
ucaccaccgacccaagaccg

SEQ ID NO: 130526 - RNA, 20 nt, Artificial Sequence
  mmSKRIPTE0001305_Bag6_9
  gRNA
caaauccacugucugcgggg

SEQ ID NO: 130527 - RNA, 20 nt, Artificial Sequence
  mmSKRIPTE0001306_Traf2_1
  gRNA
acuuucaguuuccggcuccg

SEQ ID NO: 130528 - RNA, 20 nt, Artificial Sequence
  mmSKRIPTE0001307_Traf2_2
  gRNA
agagcggugauuagucagag

SEQ ID NO: 130529 - RNA, 20 nt, Artificial Sequence
  mmSKRIPTE0001308_Traf2_3
  gRNA
ggggaccuugaaagaauacg

SEQ ID NO: 130530 - RNA, 20 nt, Artificial Sequence
  mmSKRIPTE0001309_Traf2_4
  gRNA
cggccuauuugacaaaucga

SEQ ID NO: 130531 - RNA, 20 nt, Artificial Sequence
  mmSKRIPTE0001310_Traf2_5
  gRNA
aaugcuuuaccgucucccga

SEQ ID NO: 130532 - RNA, 20 nt, Artificial Sequence
  mmSKRIPTE0001311_Traf2_6
  gRNA
acucugaccgucaugugaug

SEQ ID NO: 130533 - RNA, 20 nt, Artificial Sequence
  mmSKRIPTE0001312_Traf2_7
  gRNA
acguugcuucaucgacagua

SEQ ID NO: 130534 - RNA, 20 nt, Artificial Sequence
  mmSKRIPTE0001313_Traf2_8
  gRNA
gugaugcaaucuaaguggug

SEQ ID NO: 130535 - RNA, 20 nt, Artificial Sequence
  mmSKRIPTE0001314_Traf2_9
  gRNA
agguuccaaguucacgugga

SEQ ID NO: 130536 - RNA, 20 nt, Artificial Sequence
  mmSKRIPTE0001315_Padi2_1
  gRNA
gcacguacaccgccuccacg

SEQ ID NO: 130537 - RNA, 20 nt, Artificial Sequence
  mmSKRIPTE0001316_Padi2_2
  gRNA
ccucccauauggcagccgcg

SEQ ID NO: 130538 - RNA, 20 nt, Artificial Sequence
  mmSKRIPTE0001317_Padi2_3
  gRNA
uuagcggcuauaugacccgg

SEQ ID NO: 130539 - RNA, 20 nt, Artificial Sequence
  mmSKRIPTE0001318_Padi2_4
  gRNA
caggaagucgcguaccaccu

SEQ ID NO: 130540 - RNA, 20 nt, Artificial Sequence
  mmSKRIPTE0001319_Padi2_5
  gRNA
caaacggguuaacgccaccg

SEQ ID NO: 130541 - RNA, 20 nt, Artificial Sequence
  mmSKRIPTE0001320_Padi2_6
  gRNA
accaucucuaugcauccacg

SEQ ID NO: 130542 - RNA, 20 nt, Artificial Sequence
  mmSKRIPTE0001321_Padi2_7
  gRNA
gcaggugcgguaauugacag

SEQ ID NO: 130543 - RNA, 20 nt, Artificial Sequence
  mmSKRIPTE0001322_Padi2_8
  gRNA
aggagcaucagcgcauacac

SEQ ID NO: 130544 - RNA, 20 nt, Artificial Sequence
  mmSKRIPTE0001323_Padi2_9
  gRNA
aggacuauuucauacccggc

SEQ ID NO: 130545 - RNA, 20 nt, Artificial Sequence
  mmSKRIPTE0001324_Tollip_1
  gRNA
cugaagagccgauugccucg

SEQ ID NO: 130546 - RNA, 20 nt, Artificial Sequence
  mmSKRIPTE0001325_Tollip_2
  gRNA
uccauggagaaggcgcgcug

SEQ ID NO: 130547 - RNA, 20 nt, Artificial Sequence
  mmSKRIPTE0001326_Tollip_3
  gRNA
ucucgucuaucggacaucug

SEQ ID NO: 130548 - RNA, 20 nt, Artificial Sequence
  mmSKRIPTE0001327_Tollip_4
  gRNA
agguccucuucauuacagcg

SEQ ID NO: 130549 - RNA, 20 nt, Artificial Sequence
  mmSKRIPTE0001328_Tollip_5
  gRNA
gagguuauggcaccuccuug

SEQ ID NO: 130550 - RNA, 20 nt, Artificial Sequence
  mmSKRIPTE0001329_Tollip_6
  gRNA
ggacggaagagcaacccgcg

SEQ ID NO: 130551 - RNA, 20 nt, Artificial Sequence
  mmSKRIPTE0001330_Tollip_7
  gRNA
ggugaguucacuguccggag

SEQ ID NO: 130552 - RNA, 20 nt, Artificial Sequence
  mmSKRIPTE0001331_Tollip_8
  gRNA
uagaacgaguccacaccugg

SEQ ID NO: 130553 - RNA, 20 nt, Artificial Sequence
  mmSKRIPTE0001332_Tollip_9
  gRNA
ccucacuggaagguguacau

SEQ ID NO: 130554 - RNA, 20 nt, Artificial Sequence
  mmSKRIPTE0001333_Bauf3_1
  gRNA
agacucggcgccgaacacgu

SEQ ID NO: 130555 - RNA, 20 nt, Artificial Sequence
  mmSKRIPTE0001334_Bauf3_2
  gRNA
caguaggaugacuuaugcag

SEQ ID NO: 130556 - RNA, 20 nt, Artificial Sequence
  mmSKRIPTE0001335_Bauf3_3
  gRNA
ccuguucaaccagagcggau

SEQ ID NO: 130557 - RNA, 20 nt, Artificial Sequence
  mmSKRIPTE0001336_Bauf3_4
  gRNA
gugguagacagcuggccacg

SEQ ID NO: 130558 - RNA, 20 nt, Artificial Sequence
  mmSKRIPTE0001337_Bauf3_5
  gRNA
ggacagcugucuccuaucgg

SEQ ID NO: 130559 - RNA, 20 nt, Artificial Sequence
  mmSKRIPTE0001338_Bauf3_6
  gRNA
cuauggcagaguuaagaccg

SEQ ID NO: 130560 - RNA, 20 nt, Artificial Sequence
  mmSKRIPTE0001339_Bauf3_7
  gRNA
ucuccugaggacguuugcag

SEQ ID NO: 130561 - RNA, 20 nt, Artificial Sequence
  mmSKRIPTE0001340_Bauf3_8
  gRNA
aaaaauacuaugagacaacg

SEQ ID NO: 130562 - RNA, 20 nt, Artificial Sequence
  mmSKRIPTE0001341_Bauf3_9
  gRNA
caagguuccgagccggacaa

SEQ ID NO: 130563 - RNA, 20 nt, Artificial Sequence
  mmSKRIPTE0001342_Pknox1_1
  gRNA
ugagccccaccucacgacga

SEQ ID NO: 130564 - RNA, 20 nt, Artificial Sequence
  mmSKRIPTE0001343_Pknox1_2
  gRNA
uucacugucaggucgccugg

SEQ ID NO: 130565 - RNA, 20 nt, Artificial Sequence
  mmSKRIPTE0001344_Pknox1_3
  gRNA
ugaccgagguuugaugacug

SEQ ID NO: 130566 - RNA, 20 nt, Artificial Sequence
  mmSKRIPTE0001345_Pknox1_4
  gRNA
uuagaaguaccaucucaacc

SEQ ID NO: 130567 - RNA, 20 nt, Artificial Sequence
  mmSKRIPTE0001346_Pknox1_5
  gRNA
acaggauugguaucacguga

SEQ ID NO: 130568 - RNA, 20 nt, Artificial Sequence
  mmSKRIPTE0001347_Pknox1_6
  gRNA
acuguuccuuaaucucguca

SEQ ID NO: 130569 - RNA, 20 nt, Artificial Sequence
  mmSKRIPTE0001348_Pknox1_7
  gRNA
gcaguugcaauugagucgug

SEQ ID NO: 130570 - RNA, 20 nt, Artificial Sequence
  mmSKRIPTE0001349_Pknox1_8
  gRNA
cgggaucaucauauccaaca

SEQ ID NO: 130571 - RNA, 20 nt, Artificial Sequence
  mmSKRIPTE0001350_Pknox1_9
  gRNA
gcaaggccaaguggucacgc

SEQ ID NO: 130572 - RNA, 20 nt, Artificial Sequence
  mmSKRIPTE0001351_Ecm1_1
  gRNA
cugcuaguucccaugcacga

SEQ ID NO: 130573 - RNA, 20 nt, Artificial Sequence
  mmSKRIPTE0001352_Ecm1_2
  gRNA
auuguaaugaguguucgagg

SEQ ID NO: 130574 - RNA, 20 nt, Artificial Sequence
  mmSKRIPTE0001353_Ecm1_3
  gRNA
gauauggaagcucgcagcag

SEQ ID NO: 130575 - RNA, 20 nt, Artificial Sequence
  mmSKRIPTE0001354_Ecm1_4
  gRNA
caacagcuagcuaguuacug

SEQ ID NO: 130576 - RNA, 20 nt, Artificial Sequence
  mmSKRIPTE0001355_Ecm1_5
  gRNA
gcacauggaaggccguaagu

SEQ ID NO: 130577 - RNA, 20 nt, Artificial Sequence
  mmSKRIPTE0001356_Ecm1_6
  gRNA
uaccaacuaccugaggaacg

SEQ ID NO: 130578 - RNA, 20 nt, Artificial Sequence
  mmSKRIPTE0001357_Ecm1_7
  gRNA
gcgaagcacucaucacgggc

SEQ ID NO: 130579 - RNA, 20 nt, Artificial Sequence
  mmSKRIPTE0001358_Ecm1_8
  gRNA
ggugcugcauaaccuacuag

SEQ ID NO: 130580 - RNA, 20 nt, Artificial Sequence
  mmSKRIPTE0001359_Ecm1_9
  gRNA
ucuuuccacgaauuccuccg

SEQ ID NO: 130581 - RNA, 20 nt, Artificial Sequence
  mmSKRIPTE0001360_Hoxa3_1
  gRNA
uggcuauaaaacgucacgug

SEQ ID NO: 130582 - RNA, 20 nt, Artificial Sequence
  mmSKRIPTE0001361_Hoxa3_2
  gRNA
gauuacgauccgugucaaag

SEQ ID NO: 130583 - RNA, 20 nt, Artificial Sequence
  mmSKRIPTE0001362_Hoxa3_3
  gRNA
gaagaguacuuguagcaacg

SEQ ID NO: 130584 - RNA, 20 nt, Artificial Sequence
  mmSKRIPTE0001363_Hoxa3_4
  gRNA
caauauuuagcagcacgacg

SEQ ID NO: 130585 - RNA, 20 nt, Artificial Sequence
  mmSKRIPTE0001364_Hoxa3_5
  gRNA
cauacuuuauggcucccgag

SEQ ID NO: 130586 - RNA, 20 nt, Artificial Sequence
  mmSKRIPTE0001365_Hoxa3_6
  gRNA
cggacauggaguugucgcca

SEQ ID NO: 130587 - RNA, 20 nt, Artificial Sequence
  mmSKRIPTE0001366_Hoxa3_7
  gRNA
gcgugugggcgaucucgaug

SEQ ID NO: 130588 - RNA, 20 nt, Artificial Sequence
  mmSKRIPTE0001367_Hoxa3_8
  gRNA
uagauugaauccucgaagga

SEQ ID NO: 130589 - RNA, 20 nt, Artificial Sequence
  mmSKRIPTE0001368_Hoxa3_9
  gRNA
gcggcagccacuugaaaccg

SEQ ID NO: 130590 - RNA, 20 nt, Artificial Sequence
  mmSKRIPTE0001369_Tnfrsf11a_1
  gRNA
acgagugcuucagacccgcg

SEQ ID NO: 130591 - RNA, 20 nt, Artificial Sequence
  mmSKRIPTE0001370_Tnfrsf11a_2
  gRNA
gcgaacaggaugacucaccg

SEQ ID NO: 130592 - RNA, 20 nt, Artificial Sequence
  mmSKRIPTE0001371_Tnfrsf11a_3
  gRNA
ggcauuaugagcaucucgga

SEQ ID NO: 130593 - RNA, 20 nt, Artificial Sequence
  mmSKRIPTE0001372_Tnfrsf11a_4
  gRNA
caggaugacaauucucggug

SEQ ID NO: 130594 - RNA, 20 nt, Artificial Sequence
  mmSKRIPTE0001373_Tnfrsf11a_5
  gRNA
gagaugaucagcguccagca

SEQ ID NO: 130595 - RNA, 20 nt, Artificial Sequence
  mmSKRIPTE0001374_Tnfrsf11a_6
  gRNA
agacgcaaggagaccucucg

SEQ ID NO: 130596 - RNA, 20 nt, Artificial Sequence
  mmSKRIPTE0001375_Tnfrsf11a_7
  gRNA
ccucacacugaucccgacug

SEQ ID NO: 130597 - RNA, 20 nt, Artificial Sequence
  mmSKRIPTE0001376_Tnfrsf11a_8
  gRNA
ccauggcggugucugaaaag

SEQ ID NO: 130598 - RNA, 20 nt, Artificial Sequence
  mmSKRIPTE0001377_Tnfrsf11a_9
  gRNA
gccagcagccugcaccagug

SEQ ID NO: 130599 - RNA, 20 nt, Artificial Sequence
  mmSKRIPTE0001378_Itk_1
  gRNA
ccccgaguaaauaaccuacg

SEQ ID NO: 130600 - RNA, 20 nt, Artificial Sequence
  mmSKRIPTE0001379_Itk_2
  gRNA
uugcagauacauccccgcug

SEQ ID NO: 130601 - RNA, 20 nt, Artificial Sequence
  mmSKRIPTE0001380_Itk_3
  gRNA
cauccauuucuaacgcccug

SEQ ID NO: 130602 - RNA, 20 nt, Artificial Sequence
  mmSKRIPTE0001381_Itk_4
  gRNA
guaagccuucucauaccccg

SEQ ID NO: 130603 - RNA, 20 nt, Artificial Sequence
  mmSKRIPTE0001382_Itk_5
  gRNA
gcaacauggagucuuacuug

SEQ ID NO: 130604 - RNA, 20 nt, Artificial Sequence
  mmSKRIPTE0001383_Itk_6
  gRNA
ggaaucggguggucuuucaa

SEQ ID NO: 130605 - RNA, 20 nt, Artificial Sequence
  mmSKRIPTE0001384_Itk_7
  gRNA
gugaaacacguguauaaccc

SEQ ID NO: 130606 - RNA, 20 nt, Artificial Sequence
  mmSKRIPTE0001385_Itk_8
  gRNA
uaccaauucuuucagaaacg

SEQ ID NO: 130607 - RNA, 20 nt, Artificial Sequence
  mmSKRIPTE0001386_Itk_9
  gRNA
gauguggccucaccacagcg

SEQ ID NO: 130608 - RNA, 20 nt, Artificial Sequence
  mmSKRIPTE0001387_Myo18a_1
  gRNA
gcuuguccuuagcacccgag

SEQ ID NO: 130609 - RNA, 20 nt, Artificial Sequence
  mmSKRIPTE0001388_Myo18a_2
  gRNA
gcucacuaugaacggccuag

SEQ ID NO: 130610 - RNA, 20 nt, Artificial Sequence
  mmSKRIPTE0001389_Myo18a_3
  gRNA
gcgaugcgcauguaccgcca

SEQ ID NO: 130611 - RNA, 20 nt, Artificial Sequence
  mmSKRIPTE0001390_Myo18a_4
  gRNA
caacagagugaacauccucg

SEQ ID NO: 130612 - RNA, 20 nt, Artificial Sequence
  mmSKRIPTE0001391_Myo18a_5
  gRNA
ucuaaggcaccuucugacga

SEQ ID NO: 130613 - RNA, 20 nt, Artificial Sequence
  mmSKRIPTE0001392_Myo18a_6
  gRNA
gccggguaagucgcccacag

SEQ ID NO: 130614 - RNA, 20 nt, Artificial Sequence
  mmSKRIPTE0001393_Myo18a_7
  gRNA
cacccuacuagcagugaucg

SEQ ID NO: 130615 - RNA, 20 nt, Artificial Sequence
  mmSKRIPTE0001394_Myo18a_8
  gRNA
ggcacaacgguaaugcacaa

SEQ ID NO: 130616 - RNA, 20 nt, Artificial Sequence
  mmSKRIPTE0001395_Myo18a_9
  gRNA
aguacaauccuguuauaccc

SEQ ID NO: 130617 - RNA, 20 nt, Artificial Sequence
  mmSKRIPTE0001396_Trim25_1
  gRNA
gcugcuucuuaaguaccgcg

SEQ ID NO: 130618 - RNA, 20 nt, Artificial Sequence
  mmSKRIPTE0001397_Trim25_2
  gRNA
ccgagcgacgcacgacccaa

SEQ ID NO: 130619 - RNA, 20 nt, Artificial Sequence
  mmSKRIPTE0001398_Trim25_3
  gRNA
gaaccugucaccacuccgug

SEQ ID NO: 130620 - RNA, 20 nt, Artificial Sequence
  mmSKRIPTE0001399_Trim25_4
  gRNA
aggcguccagucguccaccg

SEQ ID NO: 130621 - RNA, 20 nt, Artificial Sequence
  mmSKRIPTE0001400_Trim25_5
  gRNA
ggcuugacuuagggucguag

SEQ ID NO: 130622 - RNA, 20 nt, Artificial Sequence
  mmSKRIPTE0001401_Trim25_6
  gRNA
cagaaacugugguagaaucg

SEQ ID NO: 130623 - RNA, 20 nt, Artificial Sequence
  mmSKRIPTE0001402_Trim25_7
  gRNA
ucagacugcugauaacgcua

SEQ ID NO: 130624 - RNA, 20 nt, Artificial Sequence
  mmSKRIPTE0001403_Trim25_8
  gRNA
caugcacagccacaucaaug

SEQ ID NO: 130625 - RNA, 20 nt, Artificial Sequence
  mmSKRIPTE0001404_Trim25_9
  gRNA
cgggacaaaacaauucccga

SEQ ID NO: 130626 - RNA, 20 nt, Artificial Sequence
  mmSKRIPTE0001405_Fasn_1
  gRNA
uagauggcggucacacgggu

SEQ ID NO: 130627 - RNA, 20 nt, Artificial Sequence
  mmSKRIPTE0001406_Fasn_2
  gRNA
ccgcaccgguaagcaaguag

SEQ ID NO: 130628 - RNA, 20 nt, Artificial Sequence
  mmSKRIPTE0001407_Fasn_3
  gRNA
cgguuuaaauagcgccggcg

SEQ ID NO: 130629 - RNA, 20 nt, Artificial Sequence
  mmSKRIPTE0001408_Fasn_4
  gRNA
acucacucguggcucagcca

SEQ ID NO: 130630 - RNA, 20 nt, Artificial Sequence
  mmSKRIPTE0001409_Fasn_5
  gRNA
gguuggccaucauugcacgc

SEQ ID NO: 130631 - RNA, 20 nt, Artificial Sequence
  mmSKRIPTE0001410_Fasn_6
  gRNA
uaauggagaaacgaccagcg

SEQ ID NO: 130632 - RNA, 20 nt, Artificial Sequence
  mmSKRIPTE0001411_Fasn_7
  gRNA
cggugguggaacccucaaug

SEQ ID NO: 130633 - RNA, 20 nt, Artificial Sequence
  mmSKRIPTE0001412_Fasn_8
  gRNA
gcccaggccaaugagcgucg

SEQ ID NO: 130634 - RNA, 20 nt, Artificial Sequence
  mmSKRIPTE0001413_Fasn_9
  gRNA
uacaaggagcugcggcugcg

SEQ ID NO: 130635 - RNA, 20 nt, Artificial Sequence
  mmSKRIPTE0001414_Dicer1_1
  gRNA
cucaagucggaaccgcggug

SEQ ID NO: 130636 - RNA, 20 nt, Artificial Sequence
  mmSKRIPTE0001415_Dicer1_2
  gRNA
aguguaccuagacacgccac

SEQ ID NO: 130637 - RNA, 20 nt, Artificial Sequence
  mmSKRIPTE0001416_Dicer1_3
  gRNA
caguuagucccaaaauucga

SEQ ID NO: 130638 - RNA, 20 nt, Artificial Sequence
  mmSKRIPTE0001417_Dicer1_4
  gRNA
ucaauagcuuaggagauccg

SEQ ID NO: 130639 - RNA, 20 nt, Artificial Sequence
  mmSKRIPTE0001418_Dicer1_5
  gRNA
aaucugcccaaacucgcagu

SEQ ID NO: 130640 - RNA, 20 nt, Artificial Sequence
  mmSKRIPTE0001419_Dicer1_6
  gRNA
ugcuggggaguaagacugcg

SEQ ID NO: 130641 - RNA, 20 nt, Artificial Sequence
  mmSKRIPTE0001420_Dicer1_7
  gRNA
caggcaucguggacaccgcg

SEQ ID NO: 130642 - RNA, 20 nt, Artificial Sequence
  mmSKRIPTE0001421_Dicer1_8
  gRNA
ucucuaaaguaaaaucguag

SEQ ID NO: 130643 - RNA, 20 nt, Artificial Sequence
  mmSKRIPTE0001422_Dicer1_9
  gRNA
acggcuuucaugcggccgcg

SEQ ID NO: 130644 - RNA, 20 nt, Artificial Sequence
  mmSKRIPTE0001423_Lgals8_1
  gRNA
cacuuccguuggauaaggag

SEQ ID NO: 130645 - RNA, 20 nt, Artificial Sequence
  mmSKRIPTE0001424_Lgals8_2
  gRNA
aacccggggcuucacaccgu

SEQ ID NO: 130646 - RNA, 20 nt, Artificial Sequence
  mmSKRIPTE0001425_Lgals8_3
  gRNA
caucggguucagauucagcu

SEQ ID NO: 130647 - RNA, 20 nt, Artificial Sequence
  mmSKRIPTE0001426_Lgals8_4
  gRNA
cacgaacagcugaaccucga

SEQ ID NO: 130648 - RNA, 20 nt, Artificial Sequence
  mmSKRIPTE0001427_Lgals8_5
  gRNA
ggggcuuaugaagagcaacg

SEQ ID NO: 130649 - RNA, 20 nt, Artificial Sequence
  mmSKRIPTE0001428_Lgals8_6
  gRNA
caguaauggugccaacauag

SEQ ID NO: 130650 - RNA, 20 nt, Artificial Sequence
  mmSKRIPTE0001429_Lgals8_7
  gRNA
aagugaacaccaaugcccga

SEQ ID NO: 130651 - RNA, 20 nt, Artificial Sequence
  mmSKRIPTE0001430_Lgals8_8
  gRNA
cuaacagugacacgaugcug

SEQ ID NO: 130652 - RNA, 20 nt, Artificial Sequence
  mmSKRIPTE0001431_Lgals8_9
  gRNA
auaagccagcucaugcugug

SEQ ID NO: 130653 - RNA, 20 nt, Artificial Sequence
  mmSKRIPTE0001432_Syk_1
  gRNA
uguaacgaugcaccugccga

SEQ ID NO: 130654 - RNA, 20 nt, Artificial Sequence
  mmSKRIPTE0001433_Syk_2
  gRNA
gcgcaugaucggaaucugcg

SEQ ID NO: 130655 - RNA, 20 nt, Artificial Sequence
  mmSKRIPTE0001434_Syk_3
  gRNA
ugaugguccacacuaaacag

SEQ ID NO: 130656 - RNA, 20 nt, Artificial Sequence
  mmSKRIPTE0001435_Syk_4
  gRNA
cauucgagcaggguacacac

SEQ ID NO: 130657 - RNA, 20 nt, Artificial Sequence
  mmSKRIPTE0001436_Syk_5
  gRNA
gucuugggcuguacucccgg

SEQ ID NO: 130658 - RNA, 20 nt, Artificial Sequence
  mmSKRIPTE0001437_Syk_6
  gRNA
ucaaggagauaccuauccgc

SEQ ID NO: 130659 - RNA, 20 nt, Artificial Sequence
  mmSKRIPTE0001438_Syk_7
  gRNA
acuuggaaaugguggcaucg

SEQ ID NO: 130660 - RNA, 20 nt, Artificial Sequence
  mmSKRIPTE0001439_Syk_8
  gRNA
aaugguguucagucccacga

SEQ ID NO: 130661 - RNA, 20 nt, Artificial Sequence
  mmSKRIPTE0001440_Syk_9
  gRNA
ucauuaccaagaguggacgg

SEQ ID NO: 130662 - RNA, 20 nt, Artificial Sequence
  mmSKRIPTE0001441_Mef2c_1
  gRNA
ugacccauaacccgccacug

SEQ ID NO: 130663 - RNA, 20 nt, Artificial Sequence
  mmSKRIPTE0001442_Mef2c_2
  gRNA
aaggucuggugaguccaaug

SEQ ID NO: 130664 - RNA, 20 nt, Artificial Sequence
  mmSKRIPTE0001443_Mef2c_3
  gRNA
uaaagcaagccaccaucgag

SEQ ID NO: 130665 - RNA, 20 nt, Artificial Sequence
  mmSKRIPTE0001444_Mef2c_4
  gRNA
guguuguggguaucucgaag

SEQ ID NO: 130666 - RNA, 20 nt, Artificial Sequence
  mmSKRIPTE0001445_Mef2c_5
  gRNA
acugccagugcgcuccaccu

SEQ ID NO: 130667 - RNA, 20 nt, Artificial Sequence
  mmSKRIPTE0001446_Mef2c_6
  gRNA
acuauggggguugaauugug

SEQ ID NO: 130668 - RNA, 20 nt, Artificial Sequence
  mmSKRIPTE0001447_Mef2c_7
  gRNA
aaggaagcuuucgcuagacg

SEQ ID NO: 130669 - RNA, 20 nt, Artificial Sequence
  mmSKRIPTE0001448_Mef2c_8
  gRNA
gcuuccacuuaaaggucucg

SEQ ID NO: 130670 - RNA, 20 nt, Artificial Sequence
  mmSKRIPTE0001449_Mef2c_9
  gRNA
cgaguacauuacuaacucug

SEQ ID NO: 130671 - RNA, 20 nt, Artificial Sequence
  mmSKRIPTE0001450_Iuga2_1
  gRNA
cgaacuucacuuaacccggu

SEQ ID NO: 130672 - RNA, 20 nt, Artificial Sequence
  mmSKRIPTE0001451_Iuga2_2
  gRNA
uacaacuacaacauccacga

SEQ ID NO: 130673 - RNA, 20 nt, Artificial Sequence
  mmSKRIPTE0001452_Iuga2_3
  gRNA
uugauaaguacgauccgcag

SEQ ID NO: 130674 - RNA, 20 nt, Artificial Sequence
  mmSKRIPTE0001453_Iuga2_4
  gRNA
ucagagcuaucgaauucgca

SEQ ID NO: 130675 - RNA, 20 nt, Artificial Sequence
  mmSKRIPTE0001454_Iuga2_5
  gRNA
guacuagaaugucugucccg

SEQ ID NO: 130676 - RNA, 20 nt, Artificial Sequence
  mmSKRIPTE0001455_Iuga2_6
  gRNA
aacaugacgcuugaugcgga

SEQ ID NO: 130677 - RNA, 20 nt, Artificial Sequence
  mmSKRIPTE0001456_Iuga2_7
  gRNA
aauaagcguagucucugcga

SEQ ID NO: 130678 - RNA, 20 nt, Artificial Sequence
  mmSKRIPTE0001457_Iuga2_8
  gRNA
gaugcgaucugguauccaca

SEQ ID NO: 130679 - RNA, 20 nt, Artificial Sequence
  mmSKRIPTE0001458_Iuga2_9
  gRNA
guacuaugccguguucaggu

SEQ ID NO: 130680 - RNA, 20 nt, Artificial Sequence
  mmSKRIPTE0001459_Nfkb2_1
  gRNA
acaugguggacagaucaacg

SEQ ID NO: 130681 - RNA, 20 nt, Artificial Sequence
  mmSKRIPTE0001460_Nfkb2_2
  gRNA
cugcuauggaaccuucagcg

SEQ ID NO: 130682 - RNA, 20 nt, Artificial Sequence
  mmSKRIPTE0001461_Nfkb2_3
  gRNA
acccggaaugaugaucugcg

SEQ ID NO: 130683 - RNA, 20 nt, Artificial Sequence
  mmSKRIPTE0001462_Nfkb2_4
  gRNA
ccuucucugucuauaacgca

SEQ ID NO: 130684 - RNA, 20 nt, Artificial Sequence
  mmSKRIPTE0001463_Nfkb2_5
  gRNA
cuacgaaggagacugccgcu

SEQ ID NO: 130685 - RNA, 20 nt, Artificial Sequence
  mmSKRIPTE0001464_Nfkb2_6
  gRNA
aaggugagcucagaugacac

SEQ ID NO: 130686 - RNA, 20 nt, Artificial Sequence
  mmSKRIPTE0001465_Nfkb2_7
  gRNA
auuucgggauccaugcagcg

SEQ ID NO: 130687 - RNA, 20 nt, Artificial Sequence
  mmSKRIPTE0001466_Nfkb2_8
  gRNA
uggauccuuaggcuccacga

SEQ ID NO: 130688 - RNA, 20 nt, Artificial Sequence
  mmSKRIPTE0001467_Nfkb2_9
  gRNA
cuaaggauaucaccucugga

SEQ ID NO: 130689 - RNA, 20 nt, Artificial Sequence
  mmSKRIPTE0001468_Ahcy_1
  gRNA
uuguuuagguggcggcuucg

SEQ ID NO: 130690 - RNA, 20 nt, Artificial Sequence
  mmSKRIPTE0001469_Ahcy_2
  gRNA
gaugacuaaacggaguauug

SEQ ID NO: 130691 - RNA, 20 nt, Artificial Sequence
  mmSKRIPTE0001470_Ahcy_3
  gRNA
gucccaagccauacccugcg

SEQ ID NO: 130692 - RNA, 20 nt, Artificial Sequence
  mmSKRIPTE0001471_Ahcy_4
  gRNA
gcucgaggcguugagcggag

SEQ ID NO: 130693 - RNA, 20 nt, Artificial Sequence
  mmSKRIPTE0001472_Ahcy_5
  gRNA
cccaaggguucaguccuccg

SEQ ID NO: 130694 - RNA, 20 nt, Artificial Sequence
  mmSKRIPTE0001473_Ahcy_6
  gRNA
gcgcaccugacagaagcugu

SEQ ID NO: 130695 - RNA, 20 nt, Artificial Sequence
  mmSKRIPTE0001474_Ahcy_7
  gRNA
cagcgauucuaggggucccg

SEQ ID NO: 130696 - RNA, 20 nt, Artificial Sequence
  mmSKRIPTE0001475_Ahcy_8
  gRNA
ggccaguccgauguccgcug

SEQ ID NO: 130697 - RNA, 20 nt, Artificial Sequence
  mmSKRIPTE0001476_Ahcy_9
  gRNA
ggaaugugagggcuaaacgu

SEQ ID NO: 130698 - RNA, 20 nt, Artificial Sequence
  mmSKRIPTE0001477_Acp6_1
  gRNA
gauauaaguagaacgaccag

SEQ ID NO: 130699 - RNA, 20 nt, Artificial Sequence
  mmSKRIPTE0001478_Acp6_2
  gRNA
cuuaauuggagcagguccgu

SEQ ID NO: 130700 - RNA, 20 nt, Artificial Sequence
  mmSKRIPTE0001479_Acp6_3
  gRNA
cagaacaagcgacucuagcg

SEQ ID NO: 130701 - RNA, 20 nt, Artificial Sequence
  mmSKRIPTE0001480_Acp6_4
  gRNA
aacccaaaucugaugaaucg

SEQ ID NO: 130702 - RNA, 20 nt, Artificial Sequence
  mmSKRIPTE0001481_Acp6_5
  gRNA
cucaucccaaaccaccggug

SEQ ID NO: 130703 - RNA, 20 nt, Artificial Sequence
  mmSKRIPTE0001482_Acp6_6
  gRNA
ccauggguaaauucaacccg

SEQ ID NO: 130704 - RNA, 20 nt, Artificial Sequence
  mmSKRIPTE0001483_Acp6_7
  gRNA
uggaauccaccaguacaggc

SEQ ID NO: 130705 - RNA, 20 nt, Artificial Sequence
  mmSKRIPTE0001484_Acp6_8
  gRNA
cguagggcagugucggccug

SEQ ID NO: 130706 - RNA, 20 nt, Artificial Sequence
  mmSKRIPTE0001485_Acp6_9
  gRNA
gaaauggggaaucuacguag

SEQ ID NO: 130707 - RNA, 20 nt, Artificial Sequence
  mmSKRIPTE0001486_Fgfr3_1
  gRNA
ugaaauugguggcucgacag

SEQ ID NO: 130708 - RNA, 20 nt, Artificial Sequence
  mmSKRIPTE0001487_Fgfr3_2
  gRNA
ucgaugcucacacacaacgc

SEQ ID NO: 130709 - RNA, 20 nt, Artificial Sequence
  mmSKRIPTE0001488_Fgfr3_3
  gRNA
cugggacucuaggagacacg

SEQ ID NO: 130710 - RNA, 20 nt, Artificial Sequence
  mmSKRIPTE0001489_Fgfr3_4
  gRNA
aaggaguaguccaugccugg

SEQ ID NO: 130711 - RNA, 20 nt, Artificial Sequence
  mmSKRIPTE0001490_Fgfr3_5
  gRNA
agacagcacccuaagaggac

SEQ ID NO: 130712 - RNA, 20 nt, Artificial Sequence
  mmSKRIPTE0001491_Fgfr3_6
  gRNA
gaacaucauuaaccugcugg

SEQ ID NO: 130713 - RNA, 20 nt, Artificial Sequence
  mmSKRIPTE0001492_Fgfr3_7
  gRNA
ucugggagaucuuuacgcug

SEQ ID NO: 130714 - RNA, 20 nt, Artificial Sequence
  mmSKRIPTE0001493_Fgfr3_8
  gRNA
caagcucaaacgcagaagcg

SEQ ID NO: 130715 - RNA, 20 nt, Artificial Sequence
  mmSKRIPTE0001494_Fgfr3_9
  gRNA
uacgucacuguacucaaggu

SEQ ID NO: 130716 - RNA, 20 nt, Artificial Sequence
  mmSKRIPTE0001495_Crlf2_1
  gRNA
uuccgggugcauccuccccg

SEQ ID NO: 130717 - RNA, 20 nt, Artificial Sequence
  mmSKRIPTE0001496_Crlf2_2
  gRNA
cgaacaugacgucaucacag

SEQ ID NO: 130718 - RNA, 20 nt, Artificial Sequence
  mmSKRIPTE0001497_Crlf2_3
  gRNA
caccugugagucgaguggcg

SEQ ID NO: 130719 - RNA, 20 nt, Artificial Sequence
  mmSKRIPTE0001498_Crlf2_4
  gRNA
gcgccggacaggaaauaucg

SEQ ID NO: 130720 - RNA, 20 nt, Artificial Sequence
  mmSKRIPTE0001499_Crlf2_5
  gRNA
cuggcccuccuaagggcgau

SEQ ID NO: 130721 - RNA, 20 nt, Artificial Sequence
  mmSKRIPTE0001500_Crlf2_6
  gRNA
aauguaccucaagaauucgc

SEQ ID NO: 130722 - RNA, 20 nt, Artificial Sequence
  mmSKRIPTE0001501_Crlf2_7
  gRNA
gggcugccugucaaucgccg

SEQ ID NO: 130723 - RNA, 20 nt, Artificial Sequence
  mmSKRIPTE0001502_Crlf2_8
  gRNA
ucgcaggugaggggucuccg

SEQ ID NO: 130724 - RNA, 20 nt, Artificial Sequence
  mmSKRIPTE0001503_Crlf2_9
  gRNA
uggaggcgcagccuagcgag

SEQ ID NO: 130725 - RNA, 20 nt, Artificial Sequence
  mmSKRIPTE0001504_Ptpn11_1
  gRNA
gugcagaguaaguagcgaua

SEQ ID NO: 130726 - RNA, 20 nt, Artificial Sequence
  mmSKRIPTE0001505_Ptpn11_2
  gRNA
agcccccuguaguauacaca

SEQ ID NO: 130727 - RNA, 20 nt, Artificial Sequence
  mmSKRIPTE0001506_Ptpn11_3
  gRNA
cuccaugugacgguaccccg

SEQ ID NO: 130728 - RNA, 20 nt, Artificial Sequence
  mmSKRIPTE0001507_Ptpn11_4
  gRNA
aaggagcugaaauacgacgu

SEQ ID NO: 130729 - RNA, 20 nt, Artificial Sequence
  mmSKRIPTE0001508_Ptpn11_5
  gRNA
gaguagccuuacgagcaggg

SEQ ID NO: 130730 - RNA, 20 nt, Artificial Sequence
  mmSKRIPTE0001509_Ptpn11_6
  gRNA
ggaguauuaguaagaucccg

SEQ ID NO: 130731 - RNA, 20 nt, Artificial Sequence
  mmSKRIPTE0001510_Ptpn11_7
  gRNA
aaaaccaacguaguuuacga

SEQ ID NO: 130732 - RNA, 20 nt, Artificial Sequence
  mmSKRIPTE0001511_Ptpn11_8
  gRNA
guagcagccaaugugcgcug

SEQ ID NO: 130733 - RNA, 20 nt, Artificial Sequence
  mmSKRIPTE0001512_Ptpn11_9
  gRNA
uggauggcucauacguacca

SEQ ID NO: 130734 - RNA, 20 nt, Artificial Sequence
  mmSKRIPTE0001513_Pvr_1
  gRNA
uuccaacguagccuagacuc

SEQ ID NO: 130735 - RNA, 20 nt, Artificial Sequence
  mmSKRIPTE0001514_Pvr_2
  gRNA
cacuccuuagaccggcugug

SEQ ID NO: 130736 - RNA, 20 nt, Artificial Sequence
  mmSKRIPTE0001515_Pvr_3
  gRNA
uauacacuauacgaagaugc

SEQ ID NO: 130737 - RNA, 20 nt, Artificial Sequence
  mmSKRIPTE0001516_Pvr_4
  gRNA
cauacgcagauccacgcaca

SEQ ID NO: 130738 - RNA, 20 nt, Artificial Sequence
  mmSKRIPTE0001517_Pvr_5
  gRNA
caccggccaccggaguacag

SEQ ID NO: 130739 - RNA, 20 nt, Artificial Sequence
  mmSKRIPTE0001518_Pvr_6
  gRNA
gagacgccauaaaucugcug

SEQ ID NO: 130740 - RNA, 20 nt, Artificial Sequence
  mmSKRIPTE0001519_Pvr_7
  gRNA
cggacccagauccgauacca

SEQ ID NO: 130741 - RNA, 20 nt, Artificial Sequence
  mmSKRIPTE0001520_Pvr_8
  gRNA
cagagauggggauucccgag

SEQ ID NO: 130742 - RNA, 20 nt, Artificial Sequence
  mmSKRIPTE0001521_Pvr_9
  gRNA
uuagucagggggacacaacg

SEQ ID NO: 130743 - RNA, 20 nt, Artificial Sequence
  mmSKRIPTE0001522_Nlrp9c_1
  gRNA
agauaguguuguaugccggc

SEQ ID NO: 130744 - RNA, 20 nt, Artificial Sequence
  mmSKRIPTE0001523_Nlrp9c_2
  gRNA
gaaauguucaacaugucgag

SEQ ID NO: 130745 - RNA, 20 nt, Artificial Sequence
  mmSKRIPTE0001524_Nlrp9c_3
  gRNA
gugggggcauuauucgagag

SEQ ID NO: 130746 - RNA, 20 nt, Artificial Sequence
  mmSKRIPTE0001525_Nlrp9c_4
  gRNA
caagaaauaagugacacucg

SEQ ID NO: 130747 - RNA, 20 nt, Artificial Sequence
  mmSKRIPTE0001526_Nlrp9c_5
  gRNA
aaucuguuaacgugugacag

SEQ ID NO: 130748 - RNA, 20 nt, Artificial Sequence
  mmSKRIPTE0001527_Nlrp9c_6
  gRNA
cauccaguaauacacaccug

SEQ ID NO: 130749 - RNA, 20 nt, Artificial Sequence
  mmSKRIPTE0001528_Nlrp9c_7
  gRNA
aaaaugaucucagacucuag

SEQ ID NO: 130750 - RNA, 20 nt, Artificial Sequence
  mmSKRIPTE0001529_Nlrp9c_8
  gRNA
gaugauuagagacuguucca

SEQ ID NO: 130751 - RNA, 20 nt, Artificial Sequence
  mmSKRIPTE0001530_Nlrp9c_9
  gRNA
ucagucagaggacuauuccu

SEQ ID NO: 130752 - RNA, 20 nt, Artificial Sequence
  mmSKRIPTE0001531_Inpp5d_1
  gRNA
aucgaugccuuagcaaucug

SEQ ID NO: 130753 - RNA, 20 nt, Artificial Sequence
  mmSKRIPTE0001532_Inpp5d_2
  gRNA
cuaacggagcugcucauccg

SEQ ID NO: 130754 - RNA, 20 nt, Artificial Sequence
  mmSKRIPTE0001533_Inpp5d_3
  gRNA
uggggaucucaacuaccgcg

SEQ ID NO: 130755 - RNA, 20 nt, Artificial Sequence
  mmSKRIPTE0001534_Inpp5d_4
  gRNA
ccgauguccucauuauaggg

SEQ ID NO: 130756 - RNA, 20 nt, Artificial Sequence
  mmSKRIPTE0001535_Inpp5d_5
  gRNA
gcugaggcuaagguacggug

SEQ ID NO: 130757 - RNA, 20 nt, Artificial Sequence
  mmSKRIPTE0001536_Inpp5d_6
  gRNA
auggacagucucauggugug

SEQ ID NO: 130758 - RNA, 20 nt, Artificial Sequence
  mmSKRIPTE0001537_Inpp5d_7
  gRNA
gacgcaccgccuccucacgu

SEQ ID NO: 130759 - RNA, 20 nt, Artificial Sequence
  mmSKRIPTE0001538_Inpp5d_8
  gRNA
aggacucggucgcaccagga

SEQ ID NO: 130760 - RNA, 20 nt, Artificial Sequence
  mmSKRIPTE0001539_Inpp5d_9
  gRNA
gucgccuuccucgaccacgg

SEQ ID NO: 130761 - RNA, 20 nt, Artificial Sequence
  mmSKRIPTE0001540_Prdm1_1
  gRNA
ucuuaacaaugcucaugcug

SEQ ID NO: 130762 - RNA, 20 nt, Artificial Sequence
  mmSKRIPTE0001541_Prdm1_2
  gRNA
ccauuggaacuaaugccgua

SEQ ID NO: 130763 - RNA, 20 nt, Artificial Sequence
  mmSKRIPTE0001542_Prdm1_3
  gRNA
acgaagcuuacggcuaacug

SEQ ID NO: 130764 - RNA, 20 nt, Artificial Sequence
  mmSKRIPTE0001543_Prdm1_4
  gRNA
aagccgaggcauccuuacca

SEQ ID NO: 130765 - RNA, 20 nt, Artificial Sequence
  mmSKRIPTE0001544_Prdm1_5
  gRNA
ggauaggauaaaccacccga

SEQ ID NO: 130766 - RNA, 20 nt, Artificial Sequence
  mmSKRIPTE0001545_Prdm1_6
  gRNA
guguagacuucaccgaugag

SEQ ID NO: 130767 - RNA, 20 nt, Artificial Sequence
  mmSKRIPTE0001546_Prdm1_7
  gRNA
gacgagaguaguccccccag

SEQ ID NO: 130768 - RNA, 20 nt, Artificial Sequence
  mmSKRIPTE0001547_Prdm1_8
  gRNA
ugccuaccgauggagcccgg

SEQ ID NO: 130769 - RNA, 20 nt, Artificial Sequence
  mmSKRIPTE0001548_Prdm1_9
  gRNA
auucgggucagauccuccaa

SEQ ID NO: 130770 - RNA, 20 nt, Artificial Sequence
  mmSKRIPTE0001549_Thra_1
  gRNA
uaggcuagcuagcuacgggu

SEQ ID NO: 130771 - RNA, 20 nt, Artificial Sequence
  mmSKRIPTE0001550_Thra_2
  gRNA
gugcggcgaaagaagcccua

SEQ ID NO: 130772 - RNA, 20 nt, Artificial Sequence
  mmSKRIPTE0001551_Thra_3
  gRNA
cgauugauuaugcaaagccg

SEQ ID NO: 130773 - RNA, 20 nt, Artificial Sequence
  mmSKRIPTE0001552_Thra_4
  gRNA
gacuguaagaggcacccgug

SEQ ID NO: 130774 - RNA, 20 nt, Artificial Sequence
  mmSKRIPTE0001553_Thra_5
  gRNA
ggcacaccguaaacaaaccg

SEQ ID NO: 130775 - RNA, 20 nt, Artificial Sequence
  mmSKRIPTE0001554_Thra_6
  gRNA
gaucccugggauacccccaa

SEQ ID NO: 130776 - RNA, 20 nt, Artificial Sequence
  mmSKRIPTE0001555_Thra_7
  gRNA
ccgggcgccggaaaagacug

SEQ ID NO: 130777 - RNA, 20 nt, Artificial Sequence
  mmSKRIPTE0001556_Thra_8
  gRNA
cgagcugagcaacgacgcgg

SEQ ID NO: 130778 - RNA, 20 nt, Artificial Sequence
  mmSKRIPTE0001557_Thra_9
  gRNA
auaaggagccccucccuccg

SEQ ID NO: 130779 - RNA, 20 nt, Artificial Sequence
  mmSKRIPTE0001558_Prkar1a_1
  gRNA
ccuacguuagaaagguagcg

SEQ ID NO: 130780 - RNA, 20 nt, Artificial Sequence
  mmSKRIPTE0001559_Prkar1a_2
  gRNA
gccgagccgcuaucgcagag

SEQ ID NO: 130781 - RNA, 20 nt, Artificial Sequence
  mmSKRIPTE0001560_Prkar1a_3
  gRNA
cuucagcacugauagcaccu

SEQ ID NO: 130782 - RNA, 20 nt, Artificial Sequence
  mmSKRIPTE0001561_Prkar1a_4
  gRNA
uauucccgaaggaaugccau

SEQ ID NO: 130783 - RNA, 20 nt, Artificial Sequence
  mmSKRIPTE0001562_Prkar1a_5
  gRNA
uggcaguauggcaaccagug

SEQ ID NO: 130784 - RNA, 20 nt, Artificial Sequence
  mmSKRIPTE0001563_Prkar1a_6
  gRNA
ccggcauccguacugacucg

SEQ ID NO: 130785 - RNA, 20 nt, Artificial Sequence
  mmSKRIPTE0001564_Prkar1a_7
  gRNA
aguaguuccuguagacagug

SEQ ID NO: 130786 - RNA, 20 nt, Artificial Sequence
  mmSKRIPTE0001565_Prkar1a_8
  gRNA
ucgugcagcugugcacuacg

SEQ ID NO: 130787 - RNA, 20 nt, Artificial Sequence
  mmSKRIPTE0001566_Prkar1a_9
  gRNA
cgguucuagcuagaugacga

SEQ ID NO: 130788 - RNA, 20 nt, Artificial Sequence
  mmSKRIPTE0001567_Rab10_1
  gRNA
acgagcgagcucuacgucga

SEQ ID NO: 130789 - RNA, 20 nt, Artificial Sequence
  mmSKRIPTE0001568_Rab10_2
  gRNA
ccuuccgaacggccucgucg

SEQ ID NO: 130790 - RNA, 20 nt, Artificial Sequence
  mmSKRIPTE0001569_Rab10_3
  gRNA
cuugacgaacacgccccgcg

SEQ ID NO: 130791 - RNA, 20 nt, Artificial Sequence
  mmSKRIPTE0001570_Rab10_4
  gRNA
gagcaaucucaaccacgugu

SEQ ID NO: 130792 - RNA, 20 nt, Artificial Sequence
  mmSKRIPTE0001571_Rab10_5
  gRNA
ucuuucacgauaguuaacug

SEQ ID NO: 130793 - RNA, 20 nt, Artificial Sequence
  mmSKRIPTE0001572_Rab10_6
  gRNA
gcugagcucaaacuuuagga

SEQ ID NO: 130794 - RNA, 20 nt, Artificial Sequence
  mmSKRIPTE0001573_Rab10_7
  gRNA
gguguauguguaaguccgca

SEQ ID NO: 130795 - RNA, 20 nt, Artificial Sequence
  mmSKRIPTE0001574_Rab10_8
  gRNA
gaggagaugcuugcuccucg

SEQ ID NO: 130796 - RNA, 20 nt, Artificial Sequence
  mmSKRIPTE0001575_Rab10_9
  gRNA
gacaagagaguuguaccgaa

SEQ ID NO: 130797 - RNA, 20 nt, Artificial Sequence
  mmSKRIPTE0001576_Fos_1
  gRNA
ugacgacagagcgcccgcag

SEQ ID NO: 130798 - RNA, 20 nt, Artificial Sequence
  mmSKRIPTE0001577_Fos_2
  gRNA
acagauacacuccaagcggu

SEQ ID NO: 130799 - RNA, 20 nt, Artificial Sequence
  mmSKRIPTE0001578_Fos_3
  gRNA
uucgagcgagugaugccgaa

SEQ ID NO: 130800 - RNA, 20 nt, Artificial Sequence
  mmSKRIPTE0001579_Fos_4
  gRNA
gaaagauguaugccaagacg

SEQ ID NO: 130801 - RNA, 20 nt, Artificial Sequence
  mmSKRIPTE0001580_Fos_5
  gRNA
guuugggaggcggcaaaccg

SEQ ID NO: 130802 - RNA, 20 nt, Artificial Sequence
  mmSKRIPTE0001581_Fos_6
  gRNA
aggucgacgggaaccuucga

SEQ ID NO: 130803 - RNA, 20 nt, Artificial Sequence
  mmSKRIPTE0001582_Fos_7
  gRNA
uuacugaucaugcauugucg

SEQ ID NO: 130804 - RNA, 20 nt, Artificial Sequence
  mmSKRIPTE0001583_Fos_8
  gRNA
acuagauacaauccagcacc

SEQ ID NO: 130805 - RNA, 20 nt, Artificial Sequence
  mmSKRIPTE0001584_Fos_9
  gRNA
acaaugaacauugacgcuga

SEQ ID NO: 130806 - RNA, 20 nt, Artificial Sequence
  mmSKRIPTE0001585_Ripk1_1
  gRNA
cagcaaccaucucacccucg

SEQ ID NO: 130807 - RNA, 20 nt, Artificial Sequence
  mmSKRIPTE0001586_Ripk1_2
  gRNA
uucccggaaaucgaaaagcg

SEQ ID NO: 130808 - RNA, 20 nt, Artificial Sequence
  mmSKRIPTE0001587_Ripk1_3
  gRNA
cuaguagugcuucauucucg

SEQ ID NO: 130809 - RNA, 20 nt, Artificial Sequence
  mmSKRIPTE0001588_Ripk1_4
  gRNA
guccacgcgcagaaaucgcg

SEQ ID NO: 130810 - RNA, 20 nt, Artificial Sequence
  mmSKRIPTE0001589_Ripk1_5
  gRNA
agacagcggaggcuucggga

SEQ ID NO: 130811 - RNA, 20 nt, Artificial Sequence
  mmSKRIPTE0001590_Ripk1_6
  gRNA
uggaccgaccauucauucag

SEQ ID NO: 130812 - RNA, 20 nt, Artificial Sequence
  mmSKRIPTE0001591_Ripk1_7
  gRNA
ugacuaagacuucuccaccc

SEQ ID NO: 130813 - RNA, 20 nt, Artificial Sequence
  mmSKRIPTE0001592_Ripk1_8
  gRNA
auugaaaggaaggauaaucg

SEQ ID NO: 130814 - RNA, 20 nt, Artificial Sequence
  mmSKRIPTE0001593_Ripk1_9
  gRNA
uggcuauccuauaggcccug

SEQ ID NO: 130815 - RNA, 20 nt, Artificial Sequence
  mmSKRIPTE0001594_Ptk2_1
  gRNA
cuguugcuacuauauaucag

SEQ ID NO: 130816 - RNA, 20 nt, Artificial Sequence
  mmSKRIPTE0001595_Ptk2_2
  gRNA
gcguugaagaguaagcugug

SEQ ID NO: 130817 - RNA, 20 nt, Artificial Sequence
  mmSKRIPTE0001596_Ptk2_3
  gRNA
uacauaucggaaucacaccg

SEQ ID NO: 130818 - RNA, 20 nt, Artificial Sequence
  mmSKRIPTE0001597_Ptk2_4
  gRNA
uguaacgauucugaguugau

SEQ ID NO: 130819 - RNA, 20 nt, Artificial Sequence
  mmSKRIPTE0001598_Ptk2_5
  gRNA
gauugauggauacugccggc

SEQ ID NO: 130820 - RNA, 20 nt, Artificial Sequence
  mmSKRIPTE0001599_Ptk2_6
  gRNA
caagcagccuacuuacucga

SEQ ID NO: 130821 - RNA, 20 nt, Artificial Sequence
  mmSKRIPTE0001600_Ptk2_7
  gRNA
auacucguuccauugcacca

SEQ ID NO: 130822 - RNA, 20 nt, Artificial Sequence
  mmSKRIPTE0001601_Ptk2_8
  gRNA
ccugaugugaggcucucucg

SEQ ID NO: 130823 - RNA, 20 nt, Artificial Sequence
  mmSKRIPTE0001602_Ptk2_9
  gRNA
aaagcugccgaauccuggaa

SEQ ID NO: 130824 - RNA, 20 nt, Artificial Sequence
  mmSKRIPTE0001603_Malt1_1
  gRNA
ggcaucgagauggacgugca

SEQ ID NO: 130825 - RNA, 20 nt, Artificial Sequence
  mmSKRIPTE0001604_Malt1_2
  gRNA
acgacacggacggauaugcu

SEQ ID NO: 130826 - RNA, 20 nt, Artificial Sequence
  mmSKRIPTE0001605_Malt1_3
  gRNA
guccuaugccucacuaccag

SEQ ID NO: 130827 - RNA, 20 nt, Artificial Sequence
  mmSKRIPTE0001606_Malt1_4
  gRNA
ucucacgcgacuccguacca

SEQ ID NO: 130828 - RNA, 20 nt, Artificial Sequence
  mmSKRIPTE0001607_Malt1_5
  gRNA
gccaagcuagacaugcaccg

SEQ ID NO: 130829 - RNA, 20 nt, Artificial Sequence
  mmSKRIPTE0001608_Malt1_6
  gRNA
cccaacuagaacucagcucg

SEQ ID NO: 130830 - RNA, 20 nt, Artificial Sequence
  mmSKRIPTE0001609_Malt1_7
  gRNA
auaugagauguguaacgcug

SEQ ID NO: 130831 - RNA, 20 nt, Artificial Sequence
  mmSKRIPTE0001610_Malt1_8
  gRNA
gacuugcucaucauuacuag

SEQ ID NO: 130832 - RNA, 20 nt, Artificial Sequence
  mmSKRIPTE0001611_Malt1_9
  gRNA
uuagagacagaaucguccau

SEQ ID NO: 130833 - RNA, 20 nt, Artificial Sequence
  mmSKRIPTE0001612_Rela_1
  gRNA
aagguguacaggaauccgcg

SEQ ID NO: 130834 - RNA, 20 nt, Artificial Sequence
  mmSKRIPTE0001613_Rela_2
  gRNA
cgacuacaagcuccgcagcg

SEQ ID NO: 130835 - RNA, 20 nt, Artificial Sequence
  mmSKRIPTE0001614_Rela_3
  gRNA
aggugugacagccgccgcug

SEQ ID NO: 130836 - RNA, 20 nt, Artificial Sequence
  mmSKRIPTE0001615_Rela_4
  gRNA
caaagacauugaucuucgug

SEQ ID NO: 130837 - RNA, 20 nt, Artificial Sequence
  mmSKRIPTE0001616_Rela_5
  gRNA
ggugucgggcagcaccacgu

SEQ ID NO: 130838 - RNA, 20 nt, Artificial Sequence
  mmSKRIPTE0001617_Rela_6
  gRNA
aaaacagagugaguaaucgc

SEQ ID NO: 130839 - RNA, 20 nt, Artificial Sequence
  mmSKRIPTE0001618_Rela_7
  gRNA
uaucaaaaaucggaugugag

SEQ ID NO: 130840 - RNA, 20 nt, Artificial Sequence
  mmSKRIPTE0001619_Rela_8
  gRNA
gagguguucccuagcuacug

SEQ ID NO: 130841 - RNA, 20 nt, Artificial Sequence
  mmSKRIPTE0001620_Rela_9
  gRNA
gcccagaccgcaguauccau

SEQ ID NO: 130842 - RNA, 20 nt, Artificial Sequence
  mmSKRIPTE0001621_Spi1_1
  gRNA
acauaggcucuuacucaacg

SEQ ID NO: 130843 - RNA, 20 nt, Artificial Sequence
  mmSKRIPTE0001622_Spi1_2
  gRNA
cccacugauagggagccgga

SEQ ID NO: 130844 - RNA, 20 nt, Artificial Sequence
  mmSKRIPTE0001623_Spi1_3
  gRNA
gucucugcgggcgaucagug

SEQ ID NO: 130845 - RNA, 20 nt, Artificial Sequence
  mmSKRIPTE0001624_Spi1_4
  gRNA
aaauaagagaucgugcacac

SEQ ID NO: 130846 - RNA, 20 nt, Artificial Sequence
  mmSKRIPTE0001625_Spi1_5
  gRNA
aaguccauaagggauagccc

SEQ ID NO: 130847 - RNA, 20 nt, Artificial Sequence
  mmSKRIPTE0001626_Spi1_6
  gRNA
uaaguaaccaagucauccga

SEQ ID NO: 130848 - RNA, 20 nt, Artificial Sequence
  mmSKRIPTE0001627_Spi1_7
  gRNA
augggcaaccaaguggugug

SEQ ID NO: 130849 - RNA, 20 nt, Artificial Sequence
  mmSKRIPTE0001628_Spi1_8
  gRNA
gcagggucgaggacuaagaa

SEQ ID NO: 130850 - RNA, 20 nt, Artificial Sequence
  mmSKRIPTE0001629_Spi1_9
  gRNA
aggacagcgugcuaacaaug

SEQ ID NO: 130851 - RNA, 20 nt, Artificial Sequence
  mmSKRIPTE0001630_Asxl1_1
  gRNA
agacuauacauaccugacgc

SEQ ID NO: 130852 - RNA, 20 nt, Artificial Sequence
  mmSKRIPTE0001631_Asxl1_2
  gRNA
uggccgucucucgauugcag

SEQ ID NO: 130853 - RNA, 20 nt, Artificial Sequence
  mmSKRIPTE0001632_Asxl1_3
  gRNA
ggcggcuccgcauaaccacg

SEQ ID NO: 130854 - RNA, 20 nt, Artificial Sequence
  mmSKRIPTE0001633_Asxl1_4
  gRNA
aagagcgaacuaguggcggg

SEQ ID NO: 130855 - RNA, 20 nt, Artificial Sequence
  mmSKRIPTE0001634_Asxl1_5
  gRNA
gcagcugugaugacucuagu

SEQ ID NO: 130856 - RNA, 20 nt, Artificial Sequence
  mmSKRIPTE0001635_Asxl1_6
  gRNA
guguuaacaagaauggaccc

SEQ ID NO: 130857 - RNA, 20 nt, Artificial Sequence
  mmSKRIPTE0001636_Asxl1_7
  gRNA
gaagguaaacggggcccacg

SEQ ID NO: 130858 - RNA, 20 nt, Artificial Sequence
  mmSKRIPTE0001637_Asxl1_8
  gRNA
aggugccaagaaucgaucca

SEQ ID NO: 130859 - RNA, 20 nt, Artificial Sequence
  mmSKRIPTE0001638_Asxl1_9
  gRNA
agacauuagugauaccugac

SEQ ID NO: 130860 - RNA, 20 nt, Artificial Sequence
  mmSKRIPTE0001639_Ptk6_1
  gRNA
aaccugcugcagcuacugcg

SEQ ID NO: 130861 - RNA, 20 nt, Artificial Sequence
  mmSKRIPTE0001640_Ptk6_2
  gRNA
ugguugcaucucccgcucag

SEQ ID NO: 130862 - RNA, 20 nt, Artificial Sequence
  mmSKRIPTE0001641_Ptk6_3
  gRNA
uguggagucugaaccgugag

SEQ ID NO: 130863 - RNA, 20 nt, Artificial Sequence
  mmSKRIPTE0001642_Ptk6_4
  gRNA
agaaguccaggauaaucacg

SEQ ID NO: 130864 - RNA, 20 nt, Artificial Sequence
  mmSKRIPTE0001643_Ptk6_5
  gRNA
gugccuacuagaaggacuag

SEQ ID NO: 130865 - RNA, 20 nt, Artificial Sequence
  mmSKRIPTE0001644_Ptk6_6
  gRNA
ccagauccuguaaugucgca

SEQ ID NO: 130866 - RNA, 20 nt, Artificial Sequence
  mmSKRIPTE0001645_Ptk6_7
  gRNA
caccugaggcacuuucccga

SEQ ID NO: 130867 - RNA, 20 nt, Artificial Sequence
  mmSKRIPTE0001646_Ptk6_8
  gRNA
uugagauacccaaucaccug

SEQ ID NO: 130868 - RNA, 20 nt, Artificial Sequence
  mmSKRIPTE0001647_Ptk6_9
  gRNA
uacccuaccaguaggacccu

SEQ ID NO: 130869 - RNA, 20 nt, Artificial Sequence
  mmSKRIPTE0001648_Foxp1_1
  gRNA
acucggaagaagauccuccg

SEQ ID NO: 130870 - RNA, 20 nt, Artificial Sequence
  mmSKRIPTE0001649_Foxp1_2
  gRNA
cugcuccccuucuaacggcg

SEQ ID NO: 130871 - RNA, 20 nt, Artificial Sequence
  mmSKRIPTE0001650_Foxp1_3
  gRNA
accccuauauguaugaugca

SEQ ID NO: 130872 - RNA, 20 nt, Artificial Sequence
  mmSKRIPTE0001651_Foxp1_4
  gRNA
ugcuaucaaaagguguacgu

SEQ ID NO: 130873 - RNA, 20 nt, Artificial Sequence
  mmSKRIPTE0001652_Foxp1_5
  gRNA
acccccgagaccgaagauug

SEQ ID NO: 130874 - RNA, 20 nt, Artificial Sequence
  mmSKRIPTE0001653_Foxp1_6
  gRNA
caaguugaucaacagcuccg

SEQ ID NO: 130875 - RNA, 20 nt, Artificial Sequence
  mmSKRIPTE0001654_Foxp1_7
  gRNA
agauagucccccgagaucug

SEQ ID NO: 130876 - RNA, 20 nt, Artificial Sequence
  mmSKRIPTE0001655_Foxp1_8
  gRNA
acacggugggaccuauccgc

SEQ ID NO: 130877 - RNA, 20 nt, Artificial Sequence
  mmSKRIPTE0001656_Foxp1_9
  gRNA
uacucacacagcuugcauag

SEQ ID NO: 130878 - RNA, 20 nt, Artificial Sequence
  mmSKRIPTE0001657_Saub1_1
  gRNA
cgaguaucgacacuacggau

SEQ ID NO: 130879 - RNA, 20 nt, Artificial Sequence
  mmSKRIPTE0001658_Saub1_2
  gRNA
auggaacaaaaggugucacg

SEQ ID NO: 130880 - RNA, 20 nt, Artificial Sequence
  mmSKRIPTE0001659_Saub1_3
  gRNA
uacccagugauuccgcggca

SEQ ID NO: 130881 - RNA, 20 nt, Artificial Sequence
  mmSKRIPTE0001660_Saub1_4
  gRNA
caagcgcggcgacaacacaa

SEQ ID NO: 130882 - RNA, 20 nt, Artificial Sequence
  mmSKRIPTE0001661_Saub1_5
  gRNA
agguguuucaucgaucccca

SEQ ID NO: 130883 - RNA, 20 nt, Artificial Sequence
  mmSKRIPTE0001662_Saub1_6
  gRNA
uuuaggauuagcagauacga

SEQ ID NO: 130884 - RNA, 20 nt, Artificial Sequence
  mmSKRIPTE0001663_Saub1_7
  gRNA
ucauggucuucgucuagaca

SEQ ID NO: 130885 - RNA, 20 nt, Artificial Sequence
  mmSKRIPTE0001664_Saub1_8
  gRNA
auauggugcuuguaggcggg

SEQ ID NO: 130886 - RNA, 20 nt, Artificial Sequence
  mmSKRIPTE0001665_Saub1_9
  gRNA
ggggugcuggaaugucaucg

SEQ ID NO: 130887 - RNA, 20 nt, Artificial Sequence
  mmSKRIPTE0001666_Mixl1_1
  gRNA
cagcccuuauccucaaggcg

SEQ ID NO: 130888 - RNA, 20 nt, Artificial Sequence
  mmSKRIPTE0001667_Mixl1_2
  gRNA
agaucaaucacaugguaacg

SEQ ID NO: 130889 - RNA, 20 nt, Artificial Sequence
  mmSKRIPTE0001668_Mixl1_3
  gRNA
uucuccuuggcuacaacccg

SEQ ID NO: 130890 - RNA, 20 nt, Artificial Sequence
  mmSKRIPTE0001669_Mixl1_4
  gRNA
gcgguuuggaaagcacugcg

SEQ ID NO: 130891 - RNA, 20 nt, Artificial Sequence
  mmSKRIPTE0001670_Mixl1_5
  gRNA
cgccugcaguuauagcggcc

SEQ ID NO: 130892 - RNA, 20 nt, Artificial Sequence
  mmSKRIPTE0001671_Mixl1_6
  gRNA
uaaucgcuuccgcugacccg

SEQ ID NO: 130893 - RNA, 20 nt, Artificial Sequence
  mmSKRIPTE0001672_Mixl1_7
  gRNA
agccgcgucucgucuccucg

SEQ ID NO: 130894 - RNA, 20 nt, Artificial Sequence
  mmSKRIPTE0001673_Mixl1_8
  gRNA
ucaugcugggauccggaacg

SEQ ID NO: 130895 - RNA, 20 nt, Artificial Sequence
  mmSKRIPTE0001674_Mixl1_9
  gRNA
gaaaguagcguuguuacuga

SEQ ID NO: 130896 - RNA, 20 nt, Artificial Sequence
  mmSKRIPTE0001675_Ptpn22_1
  gRNA
gacuucuacgaugaaugccg

SEQ ID NO: 130897 - RNA, 20 nt, Artificial Sequence
  mmSKRIPTE0001676_Ptpn22_2
  gRNA
cuguggcugaaccuucuaca

SEQ ID NO: 130898 - RNA, 20 nt, Artificial Sequence
  mmSKRIPTE0001677_Ptpn22_3
  gRNA
gaugcacucucaaagcgccg

SEQ ID NO: 130899 - RNA, 20 nt, Artificial Sequence
  mmSKRIPTE0001678_Ptpn22_4
  gRNA
aguauggacacauccgccau

SEQ ID NO: 130900 - RNA, 20 nt, Artificial Sequence
  mmSKRIPTE0001679_Ptpn22_5
  gRNA
gaaaccgcuuguggaucgug

SEQ ID NO: 130901 - RNA, 20 nt, Artificial Sequence
  mmSKRIPTE0001680_Ptpn22_6
  gRNA
aaaacgauuuccgaaaccug

SEQ ID NO: 130902 - RNA, 20 nt, Artificial Sequence
  mmSKRIPTE0001681_Ptpn22_7
  gRNA
ugucucuugguuuaacggug

SEQ ID NO: 130903 - RNA, 20 nt, Artificial Sequence
  mmSKRIPTE0001682_Ptpn22_8
  gRNA
gaaagaugucgaguagucac

SEQ ID NO: 130904 - RNA, 20 nt, Artificial Sequence
  mmSKRIPTE0001683_Ptpn22_9
  gRNA
gcguugcccauaaugcacuu

SEQ ID NO: 130905 - RNA, 20 nt, Artificial Sequence
  mmSKRIPTE0001684_Yes1_1
  gRNA
acucagguaagcucgcggcg

SEQ ID NO: 130906 - RNA, 20 nt, Artificial Sequence
  mmSKRIPTE0001685_Yes1_2
  gRNA
cgggaccaguaggcggacag

SEQ ID NO: 130907 - RNA, 20 nt, Artificial Sequence
  mmSKRIPTE0001686_Yes1_3
  gRNA
guauuggaacaaguagagcg

SEQ ID NO: 130908 - RNA, 20 nt, Artificial Sequence
  mmSKRIPTE0001687_Yes1_4
  gRNA
gcggccccuucucguccuag

SEQ ID NO: 130909 - RNA, 20 nt, Artificial Sequence
  mmSKRIPTE0001688_Yes1_5
  gRNA
agauacaauugaguccaaug

SEQ ID NO: 130910 - RNA, 20 nt, Artificial Sequence
  mmSKRIPTE0001689_Yes1_6
  gRNA
gccaucagcgaucuuaggag

SEQ ID NO: 130911 - RNA, 20 nt, Artificial Sequence
  mmSKRIPTE0001690_Yes1_7
  gRNA
ucuagucgcaaugauucucg

SEQ ID NO: 130912 - RNA, 20 nt, Artificial Sequence
  mmSKRIPTE0001691_Yes1_8
  gRNA
agagaaccgaacucacgggg

SEQ ID NO: 130913 - RNA, 20 nt, Artificial Sequence
  mmSKRIPTE0001692_Yes1_9
  gRNA
cugaauccugggaaucagcg

SEQ ID NO: 130914 - RNA, 20 nt, Artificial Sequence
  mmSKRIPTE0001693_Rest_1
  gRNA
auggccgaauugaugcccgu

SEQ ID NO: 130915 - RNA, 20 nt, Artificial Sequence
  mmSKRIPTE0001694_Rest_2
  gRNA
gauaugcuacgguuucccaa

SEQ ID NO: 130916 - RNA, 20 nt, Artificial Sequence
  mmSKRIPTE0001695_Rest_3
  gRNA
ugacgacucaggacugcacg

SEQ ID NO: 130917 - RNA, 20 nt, Artificial Sequence
  mmSKRIPTE0001696_Rest_4
  gRNA
aagccgcguagucacacacg

SEQ ID NO: 130918 - RNA, 20 nt, Artificial Sequence
  mmSKRIPTE0001697_Rest_5
  gRNA
uuauggccacccaggugaug

SEQ ID NO: 130919 - RNA, 20 nt, Artificial Sequence
  mmSKRIPTE0001698_Rest_6
  gRNA
caucgccaaagggaaacucg

SEQ ID NO: 130920 - RNA, 20 nt, Artificial Sequence
  mmSKRIPTE0001699_Rest_7
  gRNA
uggcaaggcuuacaccggaa

SEQ ID NO: 130921 - RNA, 20 nt, Artificial Sequence
  mmSKRIPTE0001700_Rest_8
  gRNA
gauauguaacuagcucgugc

SEQ ID NO: 130922 - RNA, 20 nt, Artificial Sequence
  mmSKRIPTE0001701_Rest_9
  gRNA
auuaccuggucggugaagag

SEQ ID NO: 130923 - RNA, 20 nt, Artificial Sequence
  mmSKRIPTE0001702_Gpnmb_1
  gRNA
cgaagacguuagccccguag

SEQ ID NO: 130924 - RNA, 20 nt, Artificial Sequence
  mmSKRIPTE0001703_Gpnmb_2
  gRNA
agagagcacaaccaauuacg

SEQ ID NO: 130925 - RNA, 20 nt, Artificial Sequence
  mmSKRIPTE0001704_Gpnmb_3
  gRNA
cagcggguugacaaacggaa

SEQ ID NO: 130926 - RNA, 20 nt, Artificial Sequence
  mmSKRIPTE0001705_Gpnmb_4
  gRNA
gcaggugagguaccuuaccg

SEQ ID NO: 130927 - RNA, 20 nt, Artificial Sequence
  mmSKRIPTE0001706_Gpnmb_5
  gRNA
ugucuuucgaagauacggcc

SEQ ID NO: 130928 - RNA, 20 nt, Artificial Sequence
  mmSKRIPTE0001707_Gpnmb_6
  gRNA
uguaugugauaacaggugcg

SEQ ID NO: 130929 - RNA, 20 nt, Artificial Sequence
  mmSKRIPTE0001708_Gpnmb_7
  gRNA
accuugccuuaccccgaaug

SEQ ID NO: 130930 - RNA, 20 nt, Artificial Sequence
  mmSKRIPTE0001709_Gpnmb_8
  gRNA
auaucguggcuuagggagug

SEQ ID NO: 130931 - RNA, 20 nt, Artificial Sequence
  mmSKRIPTE0001710_Gpnmb_9
  gRNA
cuaacuaaguuucgugugag

SEQ ID NO: 130932 - RNA, 20 nt, Artificial Sequence
  mmSKRIPTE0001711_Ihh_1
  gRNA
cggaugcuaacacucccgcg

SEQ ID NO: 130933 - RNA, 20 nt, Artificial Sequence
  mmSKRIPTE0001712_Ihh_2
  gRNA
cucagagucgaggcgccgag

SEQ ID NO: 130934 - RNA, 20 nt, Artificial Sequence
  mmSKRIPTE0001713_Ihh_3
  gRNA
agguggugauauccaccgcg

SEQ ID NO: 130935 - RNA, 20 nt, Artificial Sequence
  mmSKRIPTE0001714_Ihh_4
  gRNA
gugaaacugcgggugaccga

SEQ ID NO: 130936 - RNA, 20 nt, Artificial Sequence
  mmSKRIPTE0001715_Ihh_5
  gRNA
cguugccaaaacaaacgggc

SEQ ID NO: 130937 - RNA, 20 nt, Artificial Sequence
  mmSKRIPTE0001716_Ihh_6
  gRNA
ccgagggaagaggauuuccg

SEQ ID NO: 130938 - RNA, 20 nt, Artificial Sequence
  mmSKRIPTE0001717_Ihh_7
  gRNA
gccgggacacuaccggacau

SEQ ID NO: 130939 - RNA, 20 nt, Artificial Sequence
  mmSKRIPTE0001718_Ihh_8
  gRNA
aggccugaccugcauuugcg

SEQ ID NO: 130940 - RNA, 20 nt, Artificial Sequence
  mmSKRIPTE0001719_Ihh_9
  gRNA
gaagauucgacagcacucau

SEQ ID NO: 130941 - RNA, 20 nt, Artificial Sequence
  mmSKRIPTE0001720_Ccr7_1
  gRNA
ccggcauguacggaacgcgu

SEQ ID NO: 130942 - RNA, 20 nt, Artificial Sequence
  mmSKRIPTE0001721_Ccr7_2
  gRNA
cuacaaggcacuacuaccag

SEQ ID NO: 130943 - RNA, 20 nt, Artificial Sequence
  mmSKRIPTE0001722_Ccr7_3
  gRNA
ccuggacgauggcuacguag

SEQ ID NO: 130944 - RNA, 20 nt, Artificial Sequence
  mmSKRIPTE0001723_Ccr7_4
  gRNA
gauccuaugacagccgaaug

SEQ ID NO: 130945 - RNA, 20 nt, Artificial Sequence
  mmSKRIPTE0001724_Ccr7_5
  gRNA
ccgccccgguaaaaauugcu

SEQ ID NO: 130946 - RNA, 20 nt, Artificial Sequence
  mmSKRIPTE0001725_Ccr7_6
  gRNA
ccacaaccuucuccccguag

SEQ ID NO: 130947 - RNA, 20 nt, Artificial Sequence
  mmSKRIPTE0001726_Ccr7_7
  gRNA
gcuugcugaugagaagcacg

SEQ ID NO: 130948 - RNA, 20 nt, Artificial Sequence
  mmSKRIPTE0001727_Ccr7_8
  gRNA
acucacucgccauuuaacca

SEQ ID NO: 130949 - RNA, 20 nt, Artificial Sequence
  mmSKRIPTE0001728_Ccr7_9
  gRNA
cuggguuugcaucuccggag

SEQ ID NO: 130950 - RNA, 20 nt, Artificial Sequence
  mmSKRIPTE0001729_Sec14l1_1
  gRNA
cgcaggucacagucacguag

SEQ ID NO: 130951 - RNA, 20 nt, Artificial Sequence
  mmSKRIPTE0001730_Sec14l1_2
  gRNA
gacaacacacuugcuugacg

SEQ ID NO: 130952 - RNA, 20 nt, Artificial Sequence
  mmSKRIPTE0001731_Sec14l1_3
  gRNA
ucaccgugcagaacggacgg

SEQ ID NO: 130953 - RNA, 20 nt, Artificial Sequence
  mmSKRIPTE0001732_Sec14l1_4
  gRNA
ucgguguaaaagauaauccg

SEQ ID NO: 130954 - RNA, 20 nt, Artificial Sequence
  mmSKRIPTE0001733_Sec14l1_5
  gRNA
guaagcucgcgucgucgugg

SEQ ID NO: 130955 - RNA, 20 nt, Artificial Sequence
  mmSKRIPTE0001734_Sec14l1_6
  gRNA
auguuuauacacccgcacug

SEQ ID NO: 130956 - RNA, 20 nt, Artificial Sequence
  mmSKRIPTE0001735_Sec14l1_7
  gRNA
cugcuauugaauuacaacca

SEQ ID NO: 130957 - RNA, 20 nt, Artificial Sequence
  mmSKRIPTE0001736_Sec14l1_8
  gRNA
uauucaagcagguacaguag

SEQ ID NO: 130958 - RNA, 20 nt, Artificial Sequence
  mmSKRIPTE0001737_Sec14l1_9
  gRNA
gcacucccagcugcucacgg

SEQ ID NO: 130959 - RNA, 20 nt, Artificial Sequence
  mmSKRIPTE0001738_Pdgfb_1
  gRNA
gucucgaugccugauucgga

SEQ ID NO: 130960 - RNA, 20 nt, Artificial Sequence
  mmSKRIPTE0001739_Pdgfb_2
  gRNA
gaugugcuacggaucaguag

SEQ ID NO: 130961 - RNA, 20 nt, Artificial Sequence
  mmSKRIPTE0001740_Pdgfb_3
  gRNA
acuucuagucacaggccgag

SEQ ID NO: 130962 - RNA, 20 nt, Artificial Sequence
  mmSKRIPTE0001741_Pdgfb_4
  gRNA
gaguuggaaagcucaucucg

SEQ ID NO: 130963 - RNA, 20 nt, Artificial Sequence
  mmSKRIPTE0001742_Pdgfb_5
  gRNA
aggagacccucggagccuag

SEQ ID NO: 130964 - RNA, 20 nt, Artificial Sequence
  mmSKRIPTE0001743_Pdgfb_6
  gRNA
gucgaugcauccugccaaug

SEQ ID NO: 130965 - RNA, 20 nt, Artificial Sequence
  mmSKRIPTE0001744_Pdgfb_7
  gRNA
gccugaucgccugaucgcgg

SEQ ID NO: 130966 - RNA, 20 nt, Artificial Sequence
  mmSKRIPTE0001745_Pdgfb_8
  gRNA
uaaaggccggaacagcugaa

SEQ ID NO: 130967 - RNA, 20 nt, Artificial Sequence
  mmSKRIPTE0001746_Pdgfb_9
  gRNA
cucauugagcccaaacagug

SEQ ID NO: 130968 - RNA, 20 nt, Artificial Sequence
  mmSKRIPTE0001747_Wnt1_1
  gRNA
gggcggcacuaaaagcacca

SEQ ID NO: 130969 - RNA, 20 nt, Artificial Sequence
  mmSKRIPTE0001748_Wnt1_2
  gRNA
uauuuacauaaccgaacgcg

SEQ ID NO: 130970 - RNA, 20 nt, Artificial Sequence
  mmSKRIPTE0001749_Wnt1_3
  gRNA
uguguccagucccaccgucg

SEQ ID NO: 130971 - RNA, 20 nt, Artificial Sequence
  mmSKRIPTE0001750_Wnt1_4
  gRNA
uuagcaggcuaucaacacgu

SEQ ID NO: 130972 - RNA, 20 nt, Artificial Sequence
  mmSKRIPTE0001751_Wnt1_5
  gRNA
ucucauuuagggucauccaa

SEQ ID NO: 130973 - RNA, 20 nt, Artificial Sequence
  mmSKRIPTE0001752_Wnt1_6
  gRNA
acuagcucacuuaccaccau

SEQ ID NO: 130974 - RNA, 20 nt, Artificial Sequence
  mmSKRIPTE0001753_Wnt1_7
  gRNA
agcugacaggcuaaccgucg

SEQ ID NO: 130975 - RNA, 20 nt, Artificial Sequence
  mmSKRIPTE0001754_Wnt1_8
  gRNA
cagcucacagccguccagcg

SEQ ID NO: 130976 - RNA, 20 nt, Artificial Sequence
  mmSKRIPTE0001755_Wnt1_9
  gRNA
acagcuguucaauggcuccg

SEQ ID NO: 130977 - RNA, 20 nt, Artificial Sequence
  mmSKRIPTE0001756_Myo1f_1
  gRNA
uaagaaccgagaucgaucgc

SEQ ID NO: 130978 - RNA, 20 nt, Artificial Sequence
  mmSKRIPTE0001757_Myo1f_2
  gRNA
uuguaucccaaguagcgcag

SEQ ID NO: 130979 - RNA, 20 nt, Artificial Sequence
  mmSKRIPTE0001758_Myo1f_3
  gRNA
gagucagggauaugcuaacg

SEQ ID NO: 130980 - RNA, 20 nt, Artificial Sequence
  mmSKRIPTE0001759_Myo1f_4
  gRNA
caucaaccguaacuucguug

SEQ ID NO: 130981 - RNA, 20 nt, Artificial Sequence
  mmSKRIPTE0001760_Myo1f_5
  gRNA
ugaccucaucgaaaacaagc

SEQ ID NO: 130982 - RNA, 20 nt, Artificial Sequence
  mmSKRIPTE0001761_Myo1f_6
  gRNA
acggucuacgcucuccacgc

SEQ ID NO: 130983 - RNA, 20 nt, Artificial Sequence
  mmSKRIPTE0001762_Myo1f_7
  gRNA
cauagguuugaaucgaaaug

SEQ ID NO: 130984 - RNA, 20 nt, Artificial Sequence
  mmSKRIPTE0001763_Myo1f_8
  gRNA
cguucaucuccacgccaccg

SEQ ID NO: 130985 - RNA, 20 nt, Artificial Sequence
  mmSKRIPTE0001764_Myo1f_9
  gRNA
gcaaccacuaugguugcacc

SEQ ID NO: 130986 - RNA, 20 nt, Artificial Sequence
  mmSKRIPTE0001765_Runx2_1
  gRNA
cgcugcagauggacuccccg

SEQ ID NO: 130987 - RNA, 20 nt, Artificial Sequence
  mmSKRIPTE0001766_Runx2_2
  gRNA
cuuaucaggaccuggcgcug

SEQ ID NO: 130988 - RNA, 20 nt, Artificial Sequence
  mmSKRIPTE0001767_Runx2_3
  gRNA
cggccucaaucggggcacug

SEQ ID NO: 130989 - RNA, 20 nt, Artificial Sequence
  mmSKRIPTE0001768_Runx2_4
  gRNA
agaaauccaaacgcauuccg

SEQ ID NO: 130990 - RNA, 20 nt, Artificial Sequence
  mmSKRIPTE0001769_Runx2_5
  gRNA
caugggcaccgagaccacgg

SEQ ID NO: 130991 - RNA, 20 nt, Artificial Sequence
  mmSKRIPTE0001770_Runx2_6
  gRNA
guucccacgccgguucagag

SEQ ID NO: 130992 - RNA, 20 nt, Artificial Sequence
  mmSKRIPTE0001771_Runx2_7
  gRNA
aggugccaaucgaggagcgu

SEQ ID NO: 130993 - RNA, 20 nt, Artificial Sequence
  mmSKRIPTE0001772_Runx2_8
  gRNA
ugguuuaaagaauuucugcg

SEQ ID NO: 130994 - RNA, 20 nt, Artificial Sequence
  mmSKRIPTE0001773_Runx2_9
  gRNA
caguucccaaugguacccgg

SEQ ID NO: 130995 - RNA, 20 nt, Artificial Sequence
  mmSKRIPTE0001774_Fer_1
  gRNA
ugaauuacgaagaagacgcg

SEQ ID NO: 130996 - RNA, 20 nt, Artificial Sequence
  mmSKRIPTE0001775_Fer_2
  gRNA
gaaucggaggggugccaacg

SEQ ID NO: 130997 - RNA, 20 nt, Artificial Sequence
  mmSKRIPTE0001776_Fer_3
  gRNA
augugaauauaguauaccgc

SEQ ID NO: 130998 - RNA, 20 nt, Artificial Sequence
  mmSKRIPTE0001777_Fer_4
  gRNA
gcuguuuauagcaccaaccg

SEQ ID NO: 130999 - RNA, 20 nt, Artificial Sequence
  mmSKRIPTE0001778_Fer_5
  gRNA
aaauaccuccuggaguacca

SEQ ID NO: 131000 - RNA, 20 nt, Artificial Sequence
  mmSKRIPTE0001779_Fer_6
  gRNA
acaguucugaaagugacgug

SEQ ID NO: 131001 - RNA, 20 nt, Artificial Sequence
  mmSKRIPTE0001780_Fer_7
  gRNA
ugugagcauaaacauauacc

SEQ ID NO: 131002 - RNA, 20 nt, Artificial Sequence
  mmSKRIPTE0001781_Fer_8
  gRNA
ggaaccacucguagagucag

SEQ ID NO: 131003 - RNA, 20 nt, Artificial Sequence
  mmSKRIPTE0001782_Fer_9
  gRNA
uguugccauuaaaacgugca

SEQ ID NO: 131004 - RNA, 20 nt, Artificial Sequence
  mmSKRIPTE0001783_Kif5b_1
  gRNA
gggugauccucgaaucgucg

SEQ ID NO: 131005 - RNA, 20 nt, Artificial Sequence
  mmSKRIPTE0001784_Kif5b_2
  gRNA
acggugaugaucgcggugag

SEQ ID NO: 131006 - RNA, 20 nt, Artificial Sequence
  mmSKRIPTE0001785_Kif5b_3
  gRNA
aucugggaagacccacacga

SEQ ID NO: 131007 - RNA, 20 nt, Artificial Sequence
  mmSKRIPTE0001786_Kif5b_4
  gRNA
gcggguucagacgaccaggg

SEQ ID NO: 131008 - RNA, 20 nt, Artificial Sequence
  mmSKRIPTE0001787_Kif5b_5
  gRNA
acucgagaugcauacaucgc

SEQ ID NO: 131009 - RNA, 20 nt, Artificial Sequence
  mmSKRIPTE0001788_Kif5b_6
  gRNA
cauccguuaccuaucacuau

SEQ ID NO: 131010 - RNA, 20 nt, Artificial Sequence
  mmSKRIPTE0001789_Kif5b_7
  gRNA
guaugaugucauaccacaug

SEQ ID NO: 131011 - RNA, 20 nt, Artificial Sequence
  mmSKRIPTE0001790_Kif5b_8
  gRNA
acgggcaucacagacucacg

SEQ ID NO: 131012 - RNA, 20 nt, Artificial Sequence
  mmSKRIPTE0001791_Kif5b_9
  gRNA
uggcgacguacuuaucgccg

SEQ ID NO: 131013 - RNA, 20 nt, Artificial Sequence
  mmSKRIPTE0001792_Fubp1_1
  gRNA
uccgccccuuuacggcacga

SEQ ID NO: 131014 - RNA, 20 nt, Artificial Sequence
  mmSKRIPTE0001793_Fubp1_2
  gRNA
guaagcguggaccgaccgcg

SEQ ID NO: 131015 - RNA, 20 nt, Artificial Sequence
  mmSKRIPTE0001794_Fubp1_3
  gRNA
gaagacgccaucuccucggg

SEQ ID NO: 131016 - RNA, 20 nt, Artificial Sequence
  mmSKRIPTE0001795_Fubp1_4
  gRNA
gcgucagcgcugaaacaucg

SEQ ID NO: 131017 - RNA, 20 nt, Artificial Sequence
  mmSKRIPTE0001796_Fubp1_5
  gRNA
agacgacggcggaggcacug

SEQ ID NO: 131018 - RNA, 20 nt, Artificial Sequence
  mmSKRIPTE0001797_Fubp1_6
  gRNA
uucuaacaagcauuuagacg

SEQ ID NO: 131019 - RNA, 20 nt, Artificial Sequence
  mmSKRIPTE0001798_Fubp1_7
  gRNA
cacacgcugccguuuccucg

SEQ ID NO: 131020 - RNA, 20 nt, Artificial Sequence
  mmSKRIPTE0001799_Fubp1_8
  gRNA
guggcccuaaaggauuuacu

SEQ ID NO: 131021 - RNA, 20 nt, Artificial Sequence
  mmSKRIPTE0001800_Fubp1_9
  gRNA
auauggcauuucauggucgg

SEQ ID NO: 131022 - RNA, 20 nt, Artificial Sequence
  mmSKRIPTE0001801_Cd36_1
  gRNA
caauacuccuuacgacagug

SEQ ID NO: 131023 - RNA, 20 nt, Artificial Sequence
  mmSKRIPTE0001802_Cd36_2
  gRNA
acugcuaguuaagcucacaa

SEQ ID NO: 131024 - RNA, 20 nt, Artificial Sequence
  mmSKRIPTE0001803_Cd36_3
  gRNA
aaaacacugugauuguaccu

SEQ ID NO: 131025 - RNA, 20 nt, Artificial Sequence
  mmSKRIPTE0001804_Cd36_4
  gRNA
gaacaucuccuuaaugcgau

SEQ ID NO: 131026 - RNA, 20 nt, Artificial Sequence
  mmSKRIPTE0001805_Cd36_5
  gRNA
ucuauacaaugcgauuccua

SEQ ID NO: 131027 - RNA, 20 nt, Artificial Sequence
  mmSKRIPTE0001806_Cd36_6
  gRNA
ugguugucuggauucuggag

SEQ ID NO: 131028 - RNA, 20 nt, Artificial Sequence
  mmSKRIPTE0001807_Cd36_7
  gRNA
cuauuaacccaugaccguag

SEQ ID NO: 131029 - RNA, 20 nt, Artificial Sequence
  mmSKRIPTE0001808_Cd36_8
  gRNA
aaacgaucauggauuaagug

SEQ ID NO: 131030 - RNA, 20 nt, Artificial Sequence
  mmSKRIPTE0001809_Cd36_9
  gRNA
ucucacacacauaaguagug

SEQ ID NO: 131031 - RNA, 20 nt, Artificial Sequence
  mmSKRIPTE0001810_Chd2_1
  gRNA
auauucaaacuuguaaccga

SEQ ID NO: 131032 - RNA, 20 nt, Artificial Sequence
  mmSKRIPTE0001811_Chd2_2
  gRNA
aaagcgugucuaagcaugag

SEQ ID NO: 131033 - RNA, 20 nt, Artificial Sequence
  mmSKRIPTE0001812_Chd2_3
  gRNA
aaucacgagcauccgugaug

SEQ ID NO: 131034 - RNA, 20 nt, Artificial Sequence
  mmSKRIPTE0001813_Chd2_4
  gRNA
uaagaaaccauuucgaccag

SEQ ID NO: 131035 - RNA, 20 nt, Artificial Sequence
  mmSKRIPTE0001814_Chd2_5
  gRNA
cgucaacuugaugcugugcg

SEQ ID NO: 131036 - RNA, 20 nt, Artificial Sequence
  mmSKRIPTE0001815_Chd2_6
  gRNA
gucaaccuacuggaugacac

SEQ ID NO: 131037 - RNA, 20 nt, Artificial Sequence
  mmSKRIPTE0001816_Chd2_7
  gRNA
gagggcguauaacuacccga

SEQ ID NO: 131038 - RNA, 20 nt, Artificial Sequence
  mmSKRIPTE0001817_Chd2_8
  gRNA
cuacagggguucgaacacag

SEQ ID NO: 131039 - RNA, 20 nt, Artificial Sequence
  mmSKRIPTE0001818_Chd2_9
  gRNA
uggucacgaaugugguggag

SEQ ID NO: 131040 - RNA, 20 nt, Artificial Sequence
  mmSKRIPTE0001819_Blm_1
  gRNA
ugaagaaggucgguccgcag

SEQ ID NO: 131041 - RNA, 20 nt, Artificial Sequence
  mmSKRIPTE0001820_Blm_2
  gRNA
guacggcugacugcaaguug

SEQ ID NO: 131042 - RNA, 20 nt, Artificial Sequence
  mmSKRIPTE0001821_Blm_3
  gRNA
guaaaacucaaauuugcacg

SEQ ID NO: 131043 - RNA, 20 nt, Artificial Sequence
  mmSKRIPTE0001822_Blm_4
  gRNA
gacuugguaucgccaucaga

SEQ ID NO: 131044 - RNA, 20 nt, Artificial Sequence
  mmSKRIPTE0001823_Blm_5
  gRNA
aaucaggacauauacaacga

SEQ ID NO: 131045 - RNA, 20 nt, Artificial Sequence
  mmSKRIPTE0001824_Blm_6
  gRNA
gcaauauggacaauuagggu

SEQ ID NO: 131046 - RNA, 20 nt, Artificial Sequence
  mmSKRIPTE0001825_Blm_7
  gRNA
acaucuuuaucacuuaacgc

SEQ ID NO: 131047 - RNA, 20 nt, Artificial Sequence
  mmSKRIPTE0001826_Blm_8
  gRNA
cguuugccgaaagggcgcgc

SEQ ID NO: 131048 - RNA, 20 nt, Artificial Sequence
  mmSKRIPTE0001827_Blm_9
  gRNA
ccgccgacuaacagagcccg

SEQ ID NO: 131049 - RNA, 20 nt, Artificial Sequence
  mmSKRIPTE0001828_Fanca_1
  gRNA
uacuccggacauacgugcug

SEQ ID NO: 131050 - RNA, 20 nt, Artificial Sequence
  mmSKRIPTE0001829_Fanca_2
  gRNA
gcacauaaacgguagucuga

SEQ ID NO: 131051 - RNA, 20 nt, Artificial Sequence
  mmSKRIPTE0001830_Fanca_3
  gRNA
acacagggugacacgcugcg

SEQ ID NO: 131052 - RNA, 20 nt, Artificial Sequence
  mmSKRIPTE0001831_Fanca_4
  gRNA
cuucuaccuacaaaccgaag

SEQ ID NO: 131053 - RNA, 20 nt, Artificial Sequence
  mmSKRIPTE0001832_Fanca_5
  gRNA
acagacaggucguauuuaag

SEQ ID NO: 131054 - RNA, 20 nt, Artificial Sequence
  mmSKRIPTE0001833_Fanca_6
  gRNA
ucugcucacacagagaucgu

SEQ ID NO: 131055 - RNA, 20 nt, Artificial Sequence
  mmSKRIPTE0001834_Fanca_7
  gRNA
ggcgaauaaacgaguaacag

SEQ ID NO: 131056 - RNA, 20 nt, Artificial Sequence
  mmSKRIPTE0001835_Fanca_8
  gRNA
cacgcugacuggcacuacac

SEQ ID NO: 131057 - RNA, 20 nt, Artificial Sequence
  mmSKRIPTE0001836_Fanca_9
  gRNA
caacagcaguuaucucgacg

SEQ ID NO: 131058 - RNA, 20 nt, Artificial Sequence
  mmSKRIPTE0001837_Ctnnb1_1
  gRNA
ggagcgauuuauaagcggcg

SEQ ID NO: 131059 - RNA, 20 nt, Artificial Sequence
  mmSKRIPTE0001838_Ctnnb1_2
  gRNA
uguccuauuccgaaugucug

SEQ ID NO: 131060 - RNA, 20 nt, Artificial Sequence
  mmSKRIPTE0001839_Ctnnb1_3
  gRNA
cacaaccggauuguaauccg

SEQ ID NO: 131061 - RNA, 20 nt, Artificial Sequence
  mmSKRIPTE0001840_Ctnnb1_4
  gRNA
cuuccgcugaguauaacgga

SEQ ID NO: 131062 - RNA, 20 nt, Artificial Sequence
  mmSKRIPTE0001841_Ctnnb1_5
  gRNA
ugucugugcgugcuccacga

SEQ ID NO: 131063 - RNA, 20 nt, Artificial Sequence
  mmSKRIPTE0001842_Ctnnb1_6
  gRNA
caaccuuucucaccaccgcg

SEQ ID NO: 131064 - RNA, 20 nt, Artificial Sequence
  mmSKRIPTE0001843_Ctnnb1_7
  gRNA
aguagccauuguccacgcag

SEQ ID NO: 131065 - RNA, 20 nt, Artificial Sequence
  mmSKRIPTE0001844_Ctnnb1_8
  gRNA
cucguguccugugaagcccg

SEQ ID NO: 131066 - RNA, 20 nt, Artificial Sequence
  mmSKRIPTE0001845_Ctnnb1_9
  gRNA
augagcagcgucaaacugcg

SEQ ID NO: 131067 - RNA, 20 nt, Artificial Sequence
  mmSKRIPTE0001846_Arid5a_1
  gRNA
aacccuacguuccgauugug

SEQ ID NO: 131068 - RNA, 20 nt, Artificial Sequence
  mmSKRIPTE0001847_Arid5a_2
  gRNA
cagguuucagcaccucggug

SEQ ID NO: 131069 - RNA, 20 nt, Artificial Sequence
  mmSKRIPTE0001848_Arid5a_3
  gRNA
acuccgcccccuuagacccg

SEQ ID NO: 131070 - RNA, 20 nt, Artificial Sequence
  mmSKRIPTE0001849_Arid5a_4
  gRNA
aauucccagcagugcccgcg

SEQ ID NO: 131071 - RNA, 20 nt, Artificial Sequence
  mmSKRIPTE0001850_Arid5a_5
  gRNA
uuccacaguaucauccgcac

SEQ ID NO: 131072 - RNA, 20 nt, Artificial Sequence
  mmSKRIPTE0001851_Arid5a_6
  gRNA
ggggguguuuaguggaccga

SEQ ID NO: 131073 - RNA, 20 nt, Artificial Sequence
  mmSKRIPTE0001852_Arid5a_7
  gRNA
cacguguguugcuuagcgug

SEQ ID NO: 131074 - RNA, 20 nt, Artificial Sequence
  mmSKRIPTE0001853_Arid5a_8
  gRNA
gcucacaaguaggacgacgu

SEQ ID NO: 131075 - RNA, 20 nt, Artificial Sequence
  mmSKRIPTE0001854_Arid5a_9
  gRNA
agggccacagaucgguggug

SEQ ID NO: 131076 - RNA, 20 nt, Artificial Sequence
  mmSKRIPTE0001855_Slc39a10_1
  gRNA
gagcuucacagacaucaucg

SEQ ID NO: 131077 - RNA, 20 nt, Artificial Sequence
  mmSKRIPTE0001856_Slc39a10_2
  gRNA
ggguuugguaccgagcggag

SEQ ID NO: 131078 - RNA, 20 nt, Artificial Sequence
  mmSKRIPTE0001857_Slc39a10_3
  gRNA
agauauuggaagacgccaag

SEQ ID NO: 131079 - RNA, 20 nt, Artificial Sequence
  mmSKRIPTE0001858_Slc39a10_4
  gRNA
acgucgcucagagaauccag

SEQ ID NO: 131080 - RNA, 20 nt, Artificial Sequence
  mmSKRIPTE0001859_Slc39a10_5
  gRNA
aaccagguauauuaggagca

SEQ ID NO: 131081 - RNA, 20 nt, Artificial Sequence
  mmSKRIPTE0001860_Slc39a10_6
  gRNA
aaagccauaggugcauccaa

SEQ ID NO: 131082 - RNA, 20 nt, Artificial Sequence
  mmSKRIPTE0001861_Slc39a10_7
  gRNA
acacacgcgucccaacccag

SEQ ID NO: 131083 - RNA, 20 nt, Artificial Sequence
  mmSKRIPTE0001862_Slc39a10_8
  gRNA
agugacguucaaacacugca

SEQ ID NO: 131084 - RNA, 20 nt, Artificial Sequence
  mmSKRIPTE0001863_Slc39a10_9
  gRNA
aaaucuuuauggaugucaca

SEQ ID NO: 131085 - RNA, 20 nt, Artificial Sequence
  mmSKRIPTE0001864_Xrcc5_1
  gRNA
uuagacgaguuaccccauga

SEQ ID NO: 131086 - RNA, 20 nt, Artificial Sequence
  mmSKRIPTE0001865_Xrcc5_2
  gRNA
ucggaugagagagaucacgu

SEQ ID NO: 131087 - RNA, 20 nt, Artificial Sequence
  mmSKRIPTE0001866_Xrcc5_3
  gRNA
gcaaaaggaaggcauccgca

SEQ ID NO: 131088 - RNA, 20 nt, Artificial Sequence
  mmSKRIPTE0001867_Xrcc5_4
  gRNA
uaauuccauucccgucgcug

SEQ ID NO: 131089 - RNA, 20 nt, Artificial Sequence
  mmSKRIPTE0001868_Xrcc5_5
  gRNA
gaaugauaucacuuccguag

SEQ ID NO: 131090 - RNA, 20 nt, Artificial Sequence
  mmSKRIPTE0001869_Xrcc5_6
  gRNA
ugucaucgucaucucucggg

SEQ ID NO: 131091 - RNA, 20 nt, Artificial Sequence
  mmSKRIPTE0001870_Xrcc5_7
  gRNA
ggacucuuggagccacggcg

SEQ ID NO: 131092 - RNA, 20 nt, Artificial Sequence
  mmSKRIPTE0001871_Xrcc5_8
  gRNA
gcgucuuuaagaagauugag

SEQ ID NO: 131093 - RNA, 20 nt, Artificial Sequence
  mmSKRIPTE0001872_Xrcc5_9
  gRNA
cgacacucuagguuuccgcc

SEQ ID NO: 131094 - RNA, 20 nt, Artificial Sequence
  mmSKRIPTE0001873_Mauk_1
  gRNA
acacggccucaucgauggug

SEQ ID NO: 131095 - RNA, 20 nt, Artificial Sequence
  mmSKRIPTE0001874_Mauk_2
  gRNA
gggacagugaucauuacccg

SEQ ID NO: 131096 - RNA, 20 nt, Artificial Sequence
  mmSKRIPTE0001875_Mauk_3
  gRNA
cacagagacaaaaaucgcag

SEQ ID NO: 131097 - RNA, 20 nt, Artificial Sequence
  mmSKRIPTE0001876_Mauk_4
  gRNA
gaggauagaagaccggacaa

SEQ ID NO: 131098 - RNA, 20 nt, Artificial Sequence
  mmSKRIPTE0001877_Mauk_5
  gRNA
gaaaccuccuuuagcgacug

SEQ ID NO: 131099 - RNA, 20 nt, Artificial Sequence
  mmSKRIPTE0001878_Mauk_6
  gRNA
accugaggcucucaaaaacg

SEQ ID NO: 131100 - RNA, 20 nt, Artificial Sequence
  mmSKRIPTE0001879_Mauk_7
  gRNA
caugaagugaguauacaccu

SEQ ID NO: 131101 - RNA, 20 nt, Artificial Sequence
  mmSKRIPTE0001880_Mauk_8
  gRNA
acccugucacacuuauccag

SEQ ID NO: 131102 - RNA, 20 nt, Artificial Sequence
  mmSKRIPTE0001881_Mauk_9
  gRNA
acagcgguucuccagcaagu

SEQ ID NO: 131103 - RNA, 20 nt, Artificial Sequence
  mmSKRIPTE0001882_Polr3b_1
  gRNA
uucgcuaagcuucuaaacgu

SEQ ID NO: 131104 - RNA, 20 nt, Artificial Sequence
  mmSKRIPTE0001883_Polr3b_2
  gRNA
aauguucacauccgcccgug

SEQ ID NO: 131105 - RNA, 20 nt, Artificial Sequence
  mmSKRIPTE0001884_Polr3b_3
  gRNA
aggaguccguuuauccgaca

SEQ ID NO: 131106 - RNA, 20 nt, Artificial Sequence
  mmSKRIPTE0001885_Polr3b_4
  gRNA
guacaacgaguaaggcugug

SEQ ID NO: 131107 - RNA, 20 nt, Artificial Sequence
  mmSKRIPTE0001886_Polr3b_5
  gRNA
ccccguaaacaagcgccacg

SEQ ID NO: 131108 - RNA, 20 nt, Artificial Sequence
  mmSKRIPTE0001887_Polr3b_6
  gRNA
gagaaacugcagcgaacgag

SEQ ID NO: 131109 - RNA, 20 nt, Artificial Sequence
  mmSKRIPTE0001888_Polr3b_7
  gRNA
gcugugcuggacaacgacga

SEQ ID NO: 131110 - RNA, 20 nt, Artificial Sequence
  mmSKRIPTE0001889_Polr3b_8
  gRNA
uaccagguaugagagccccg

SEQ ID NO: 131111 - RNA, 20 nt, Artificial Sequence
  mmSKRIPTE0001890_Polr3b_9
  gRNA
agcaggcugaagacucaccg

SEQ ID NO: 131112 - RNA, 20 nt, Artificial Sequence
  mmSKRIPTE0001891_Trpv1_1
  gRNA
cucccccggaggauacagag

SEQ ID NO: 131113 - RNA, 20 nt, Artificial Sequence
  mmSKRIPTE0001892_Trpv1_2
  gRNA
aggccgauaguaagcagccg

SEQ ID NO: 131114 - RNA, 20 nt, Artificial Sequence
  mmSKRIPTE0001893_Trpv1_3
  gRNA
uaugcguaucaguacaagaa

SEQ ID NO: 131115 - RNA, 20 nt, Artificial Sequence
  mmSKRIPTE0001894_Trpv1_4
  gRNA
aaucacucacaccucgccca

SEQ ID NO: 131116 - RNA, 20 nt, Artificial Sequence
  mmSKRIPTE0001895_Trpv1_5
  gRNA
agccguagugacacugaucg

SEQ ID NO: 131117 - RNA, 20 nt, Artificial Sequence
  mmSKRIPTE0001896_Trpv1_6
  gRNA
gcuccacgagaagcaugucg

SEQ ID NO: 131118 - RNA, 20 nt, Artificial Sequence
  mmSKRIPTE0001897_Trpv1_7
  gRNA
ccuggauagccacacccgug

SEQ ID NO: 131119 - RNA, 20 nt, Artificial Sequence
  mmSKRIPTE0001898_Trpv1_8
  gRNA
gacacggaaauaguccccaa

SEQ ID NO: 131120 - RNA, 20 nt, Artificial Sequence
  mmSKRIPTE0001899_Trpv1_9
  gRNA
gcagauccccgacacuugug

SEQ ID NO: 131121 - RNA, 20 nt, Artificial Sequence
  mmSKRIPTE0001900_Abr_1
  gRNA
ucuguagugugcaauacacg

SEQ ID NO: 131122 - RNA, 20 nt, Artificial Sequence
  mmSKRIPTE0001901_Abr_2
  gRNA
agucuuucaagucuaugucg

SEQ ID NO: 131123 - RNA, 20 nt, Artificial Sequence
  mmSKRIPTE0001902_Abr_3
  gRNA
guugugacugcaguccggcg

SEQ ID NO: 131124 - RNA, 20 nt, Artificial Sequence
  mmSKRIPTE0001903_Abr_4
  gRNA
aaggcgacuucccugccgag

SEQ ID NO: 131125 - RNA, 20 nt, Artificial Sequence
  mmSKRIPTE0001904_Abr_5
  gRNA
accaagauugagauaugcug

SEQ ID NO: 131126 - RNA, 20 nt, Artificial Sequence
  mmSKRIPTE0001905_Abr_6
  gRNA
cguccggcaaugcauagaag

SEQ ID NO: 131127 - RNA, 20 nt, Artificial Sequence
  mmSKRIPTE0001906_Abr_7
  gRNA
acuugcuugagcaacgacug

SEQ ID NO: 131128 - RNA, 20 nt, Artificial Sequence
  mmSKRIPTE0001907_Abr_8
  gRNA
gaaaugguggacagucugcg

SEQ ID NO: 131129 - RNA, 20 nt, Artificial Sequence
  mmSKRIPTE0001908_Abr_9
  gRNA
acagucgcucggaagccaag

SEQ ID NO: 131130 - RNA, 20 nt, Artificial Sequence
  mmSKRIPTE0001909_Tbx21_1
  gRNA
uguggggcuaguaguuacgu

SEQ ID NO: 131131 - RNA, 20 nt, Artificial Sequence
  mmSKRIPTE0001910_Tbx21_2
  gRNA
uucgcgcuguauuagccacg

SEQ ID NO: 131132 - RNA, 20 nt, Artificial Sequence
  mmSKRIPTE0001911_Tbx21_3
  gRNA
gacauauaagcgguucccug

SEQ ID NO: 131133 - RNA, 20 nt, Artificial Sequence
  mmSKRIPTE0001912_Tbx21_4
  gRNA
uaggcgaaggagacacuaag

SEQ ID NO: 131134 - RNA, 20 nt, Artificial Sequence
  mmSKRIPTE0001913_Tbx21_5
  gRNA
aaugggaacauucgccugug

SEQ ID NO: 131135 - RNA, 20 nt, Artificial Sequence
  mmSKRIPTE0001914_Tbx21_6
  gRNA
gaggaaagucguuguuccgg

SEQ ID NO: 131136 - RNA, 20 nt, Artificial Sequence
  mmSKRIPTE0001915_Tbx21_7
  gRNA
uccaugggcagaguucgcau

SEQ ID NO: 131137 - RNA, 20 nt, Artificial Sequence
  mmSKRIPTE0001916_Tbx21_8
  gRNA
aggucgggguagaaacggcu

SEQ ID NO: 131138 - RNA, 20 nt, Artificial Sequence
  mmSKRIPTE0001917_Tbx21_9
  gRNA
gacugccuaccagaacgcag

SEQ ID NO: 131139 - RNA, 20 nt, Artificial Sequence
  mmSKRIPTE0001918_Sla_1
  gRNA
agccccccaauauuccggag

SEQ ID NO: 131140 - RNA, 20 nt, Artificial Sequence
  mmSKRIPTE0001919_Sla_2
  gRNA
augcaucagcagaacuucgu

SEQ ID NO: 131141 - RNA, 20 nt, Artificial Sequence
  mmSKRIPTE0001920_Sla_3
  gRNA
uggcacccuuugaauauaug

SEQ ID NO: 131142 - RNA, 20 nt, Artificial Sequence
  mmSKRIPTE0001921_Sla_4
  gRNA
uuucccauaccaacaaccag

SEQ ID NO: 131143 - RNA, 20 nt, Artificial Sequence
  mmSKRIPTE0001922_Sla_5
  gRNA
gcaacauuggugaaccccug

SEQ ID NO: 131144 - RNA, 20 nt, Artificial Sequence
  mmSKRIPTE0001923_Sla_6
  gRNA
gccaugucuagcauucugau

SEQ ID NO: 131145 - RNA, 20 nt, Artificial Sequence
  mmSKRIPTE0001924_Sla_7
  gRNA
uauaucucaugucuaccggg

SEQ ID NO: 131146 - RNA, 20 nt, Artificial Sequence
  mmSKRIPTE0001925_Sla_8
  gRNA
agguagaagaccccucccau

SEQ ID NO: 131147 - RNA, 20 nt, Artificial Sequence
  mmSKRIPTE0001926_Sla_9
  gRNA
ucuugcuccauaaagguggu

SEQ ID NO: 131148 - RNA, 20 nt, Artificial Sequence
  mmSKRIPTE0001927_Unc93b1_1
  gRNA
gcacguucuugaccacuccg

SEQ ID NO: 131149 - RNA, 20 nt, Artificial Sequence
  mmSKRIPTE0001928_Unc93b1_2
  gRNA
cugggaacgcuacuacacgc

SEQ ID NO: 131150 - RNA, 20 nt, Artificial Sequence
  mmSKRIPTE0001929_Unc93b1_3
  gRNA
gcuacggcgugugcuccaug

SEQ ID NO: 131151 - RNA, 20 nt, Artificial Sequence
  mmSKRIPTE0001930_Unc93b1_4
  gRNA
gggaggguucaguuacgccg

SEQ ID NO: 131152 - RNA, 20 nt, Artificial Sequence
  mmSKRIPTE0001931_Unc93b1_5
  gRNA
uguggacugacaccccgagu

SEQ ID NO: 131153 - RNA, 20 nt, Artificial Sequence
  mmSKRIPTE0001932_Unc93b1_6
  gRNA
uagggugcgugggaaccucg

SEQ ID NO: 131154 - RNA, 20 nt, Artificial Sequence
  mmSKRIPTE0001933_Unc93b1_7
  gRNA
gacagcccagaguaguaaug

SEQ ID NO: 131155 - RNA, 20 nt, Artificial Sequence
  mmSKRIPTE0001934_Unc93b1_8
  gRNA
ccuccagguagcgguagccg

SEQ ID NO: 131156 - RNA, 20 nt, Artificial Sequence
  mmSKRIPTE0001935_Unc93b1_9
  gRNA
ucggacuccagacccuaucc

SEQ ID NO: 131157 - RNA, 20 nt, Artificial Sequence
  mmSKRIPTE0001936_Mrc1_1
  gRNA
agggacguuucgguggacug

SEQ ID NO: 131158 - RNA, 20 nt, Artificial Sequence
  mmSKRIPTE0001937_Mrc1_2
  gRNA
ucacagucguauguacaaca

SEQ ID NO: 131159 - RNA, 20 nt, Artificial Sequence
  mmSKRIPTE0001938_Mrc1_3
  gRNA
agggugcgguacacuaacug

SEQ ID NO: 131160 - RNA, 20 nt, Artificial Sequence
  mmSKRIPTE0001939_Mrc1_4
  gRNA
aacagucugaguguacgcag

SEQ ID NO: 131161 - RNA, 20 nt, Artificial Sequence
  mmSKRIPTE0001940_Mrc1_5
  gRNA
ucauggcgggaccaauagag

SEQ ID NO: 131162 - RNA, 20 nt, Artificial Sequence
  mmSKRIPTE0001941_Mrc1_6
  gRNA
gauuuaaguagaucguacgu

SEQ ID NO: 131163 - RNA, 20 nt, Artificial Sequence
  mmSKRIPTE0001942_Mrc1_7
  gRNA
gucuuucauaggaucucacg

SEQ ID NO: 131164 - RNA, 20 nt, Artificial Sequence
  mmSKRIPTE0001943_Mrc1_8
  gRNA
gauugguggcaauucacgag

SEQ ID NO: 131165 - RNA, 20 nt, Artificial Sequence
  mmSKRIPTE0001944_Mrc1_9
  gRNA
aaggaugacgacguaaggug

SEQ ID NO: 131166 - RNA, 20 nt, Artificial Sequence
  mmSKRIPTE0001945_Nr1h3_1
  gRNA
gcgucacgguacuugacccg

SEQ ID NO: 131167 - RNA, 20 nt, Artificial Sequence
  mmSKRIPTE0001946_Nr1h3_2
  gRNA
ugcuucuggagacgucacgg

SEQ ID NO: 131168 - RNA, 20 nt, Artificial Sequence
  mmSKRIPTE0001947_Nr1h3_3
  gRNA
guaaagugcugugagucgag

SEQ ID NO: 131169 - RNA, 20 nt, Artificial Sequence
  mmSKRIPTE0001948_Nr1h3_4
  gRNA
cagaguaggauuaucaguag

SEQ ID NO: 131170 - RNA, 20 nt, Artificial Sequence
  mmSKRIPTE0001949_Nr1h3_5
  gRNA
gucagugagccuucgccaug

SEQ ID NO: 131171 - RNA, 20 nt, Artificial Sequence
  mmSKRIPTE0001950_Nr1h3_6
  gRNA
uggaacuagaccggucugcg

SEQ ID NO: 131172 - RNA, 20 nt, Artificial Sequence
  mmSKRIPTE0001951_Nr1h3_7
  gRNA
cggucuauaggucaccaaca

SEQ ID NO: 131173 - RNA, 20 nt, Artificial Sequence
  mmSKRIPTE0001952_Nr1h3_8
  gRNA
gccccauggacaccuacaug

SEQ ID NO: 131174 - RNA, 20 nt, Artificial Sequence
  mmSKRIPTE0001953_Nr1h3_9
  gRNA
gauucggcgagucugcucag

SEQ ID NO: 131175 - RNA, 20 nt, Artificial Sequence
  mmSKRIPTE0001954_Jag1_1
  gRNA
ucccguccagaacgccacga

SEQ ID NO: 131176 - RNA, 20 nt, Artificial Sequence
  mmSKRIPTE0001955_Jag1_2
  gRNA
gaucagcugcaugaaacgcg

SEQ ID NO: 131177 - RNA, 20 nt, Artificial Sequence
  mmSKRIPTE0001956_Jag1_3
  gRNA
ugccacccagagaaugacga

SEQ ID NO: 131178 - RNA, 20 nt, Artificial Sequence
  mmSKRIPTE0001957_Jag1_4
  gRNA
uagaguuugagggcaccgcg

SEQ ID NO: 131179 - RNA, 20 nt, Artificial Sequence
  mmSKRIPTE0001958_Jag1_5
  gRNA
aagaucgcccugaaacugag

SEQ ID NO: 131180 - RNA, 20 nt, Artificial Sequence
  mmSKRIPTE0001959_Jag1_6
  gRNA
aagaaguccgucaugauaag

SEQ ID NO: 131181 - RNA, 20 nt, Artificial Sequence
  mmSKRIPTE0001960_Jag1_7
  gRNA
aucuauguauccacgaaccc

SEQ ID NO: 131182 - RNA, 20 nt, Artificial Sequence
  mmSKRIPTE0001961_Jag1_8
  gRNA
agcaaggugguaaaacaacg

SEQ ID NO: 131183 - RNA, 20 nt, Artificial Sequence
  mmSKRIPTE0001962_Jag1_9
  gRNA
cacaagaagagucuucaccu

SEQ ID NO: 131184 - RNA, 20 nt, Artificial Sequence
  mmSKRIPTE0001963_Add1_1
  gRNA
ccguggaaguacuaaccuag

SEQ ID NO: 131185 - RNA, 20 nt, Artificial Sequence
  mmSKRIPTE0001964_Add1_2
  gRNA
ccacacaacugacggcacca

SEQ ID NO: 131186 - RNA, 20 nt, Artificial Sequence
  mmSKRIPTE0001965_Add1_3
  gRNA
acuggaagaauaccgacgag

SEQ ID NO: 131187 - RNA, 20 nt, Artificial Sequence
  mmSKRIPTE0001966_Add1_4
  gRNA
gucgccauaagagugugaug

SEQ ID NO: 131188 - RNA, 20 nt, Artificial Sequence
  mmSKRIPTE0001967_Add1_5
  gRNA
agcauuuacgcaguacccgg

SEQ ID NO: 131189 - RNA, 20 nt, Artificial Sequence
  mmSKRIPTE0001968_Add1_6
  gRNA
guacgacggcugacauggcg

SEQ ID NO: 131190 - RNA, 20 nt, Artificial Sequence
  mmSKRIPTE0001969_Add1_7
  gRNA
acucuugccuaucuccccgg

SEQ ID NO: 131191 - RNA, 20 nt, Artificial Sequence
  mmSKRIPTE0001970_Add1_8
  gRNA
aaaauaccucuccuugugag

SEQ ID NO: 131192 - RNA, 20 nt, Artificial Sequence
  mmSKRIPTE0001971_Add1_9
  gRNA
acucuaauguuugcgcugcg

SEQ ID NO: 131193 - RNA, 20 nt, Artificial Sequence
  mmSKRIPTE0001972_Tec_1
  gRNA
ucgaugcuaagcaucuacug

SEQ ID NO: 131194 - RNA, 20 nt, Artificial Sequence
  mmSKRIPTE0001973_Tec_2
  gRNA
ucauaguccuaaagccgccg

SEQ ID NO: 131195 - RNA, 20 nt, Artificial Sequence
  mmSKRIPTE0001974_Tec_3
  gRNA
auccaguugaggcaauccug

SEQ ID NO: 131196 - RNA, 20 nt, Artificial Sequence
  mmSKRIPTE0001975_Tec_4
  gRNA
uguauggaagucccccugcg

SEQ ID NO: 131197 - RNA, 20 nt, Artificial Sequence
  mmSKRIPTE0001976_Tec_5
  gRNA
acccucauaguagcucaaca

SEQ ID NO: 131198 - RNA, 20 nt, Artificial Sequence
  mmSKRIPTE0001977_Tec_6
  gRNA
aacagcgcgugacaaugcug

SEQ ID NO: 131199 - RNA, 20 nt, Artificial Sequence
  mmSKRIPTE0001978_Tec_7
  gRNA
uaagaaggaacuguacggag

SEQ ID NO: 131200 - RNA, 20 nt, Artificial Sequence
  mmSKRIPTE0001979_Tec_8
  gRNA
aggauuacuacguauccagg

SEQ ID NO: 131201 - RNA, 20 nt, Artificial Sequence
  mmSKRIPTE0001980_Tec_9
  gRNA
uguggguaagaaacgccuug

SEQ ID NO: 131202 - RNA, 20 nt, Artificial Sequence
  mmSKRIPTE0001981_Tgfbr3_1
  gRNA
aggcacuacagcuauucacg

SEQ ID NO: 131203 - RNA, 20 nt, Artificial Sequence
  mmSKRIPTE0001982_Tgfbr3_2
  gRNA
aucccacauugguaacuaug

SEQ ID NO: 131204 - RNA, 20 nt, Artificial Sequence
  mmSKRIPTE0001983_Tgfbr3_3
  gRNA
ccucucaggaggacguguag

SEQ ID NO: 131205 - RNA, 20 nt, Artificial Sequence
  mmSKRIPTE0001984_Tgfbr3_4
  gRNA
aucuuuacaagacacgccau

SEQ ID NO: 131206 - RNA, 20 nt, Artificial Sequence
  mmSKRIPTE0001985_Tgfbr3_5
  gRNA
ucagugacucuuaacccggu

SEQ ID NO: 131207 - RNA, 20 nt, Artificial Sequence
  mmSKRIPTE0001986_Tgfbr3_6
  gRNA
ccgaugaucccuuacgucag

SEQ ID NO: 131208 - RNA, 20 nt, Artificial Sequence
  mmSKRIPTE0001987_Tgfbr3_7
  gRNA
uugagaaggugcauuaccug

SEQ ID NO: 131209 - RNA, 20 nt, Artificial Sequence
  mmSKRIPTE0001988_Tgfbr3_8
  gRNA
uaguugcauaaagacuuacg

SEQ ID NO: 131210 - RNA, 20 nt, Artificial Sequence
  mmSKRIPTE0001989_Tgfbr3_9
  gRNA
cagcagcaaugcauagugug

SEQ ID NO: 131211 - RNA, 20 nt, Artificial Sequence
  mmSKRIPTE0001990_Card11_1
  gRNA
cgcgaggaauuaucuccgug

SEQ ID NO: 131212 - RNA, 20 nt, Artificial Sequence
  mmSKRIPTE0001991_Card11_2
  gRNA
gcggaacagcggaugcacga

SEQ ID NO: 131213 - RNA, 20 nt, Artificial Sequence
  mmSKRIPTE0001992_Card11_3
  gRNA
ucuacagaccugucacugcg

SEQ ID NO: 131214 - RNA, 20 nt, Artificial Sequence
  mmSKRIPTE0001993_Card11_4
  gRNA
guaaggaagaugcgccacac

SEQ ID NO: 131215 - RNA, 20 nt, Artificial Sequence
  mmSKRIPTE0001994_Card11_5
  gRNA
acggucugccacguccaggg

SEQ ID NO: 131216 - RNA, 20 nt, Artificial Sequence
  mmSKRIPTE0001995_Card11_6
  gRNA
cagcagcuuccgguauccug

SEQ ID NO: 131217 - RNA, 20 nt, Artificial Sequence
  mmSKRIPTE0001996_Card11_7
  gRNA
uauaauauuuaugcccgccg

SEQ ID NO: 131218 - RNA, 20 nt, Artificial Sequence
  mmSKRIPTE0001997_Card11_8
  gRNA
cacccugauaagcaacucgu

SEQ ID NO: 131219 - RNA, 20 nt, Artificial Sequence
  mmSKRIPTE0001998_Card11_9
  gRNA
acucagacgcgguaucucca

SEQ ID NO: 131220 - RNA, 20 nt, Artificial Sequence
  mmSKRIPTE0001999_Eif2ak1_1
  gRNA
ucauacaaaguacacccggu

SEQ ID NO: 131221 - RNA, 20 nt, Artificial Sequence
  mmSKRIPTE0002000_Eif2ak1_2
  gRNA
auauccagcuccuaaccggg

SEQ ID NO: 131222 - RNA, 20 nt, Artificial Sequence
  mmSKRIPTE0002001_Eif2ak1_3
  gRNA
gggcauuaacuugagcuccg

SEQ ID NO: 131223 - RNA, 20 nt, Artificial Sequence
  mmSKRIPTE0002002_Eif2ak1_4
  gRNA
uaauuguagucgguacucug

SEQ ID NO: 131224 - RNA, 20 nt, Artificial Sequence
  mmSKRIPTE0002003_Eif2ak1_5
  gRNA
aagccggaugcaccucacug

SEQ ID NO: 131225 - RNA, 20 nt, Artificial Sequence
  mmSKRIPTE0002004_Eif2ak1_6
  gRNA
cauguucuauccacgcagug

SEQ ID NO: 131226 - RNA, 20 nt, Artificial Sequence
  mmSKRIPTE0002005_Eif2ak1_7
  gRNA
aaaaagucagacaugccgca

SEQ ID NO: 131227 - RNA, 20 nt, Artificial Sequence
  mmSKRIPTE0002006_Eif2ak1_8
  gRNA
cuauacauaucugacugcag

SEQ ID NO: 131228 - RNA, 20 nt, Artificial Sequence
  mmSKRIPTE0002007_Eif2ak1_9
  gRNA
uuguggcuugcgguacucgg

SEQ ID NO: 131229 - RNA, 20 nt, Artificial Sequence
  mmSKRIPTE0002008_Styk1_1
  gRNA
gggucccacaacuaccacug

SEQ ID NO: 131230 - RNA, 20 nt, Artificial Sequence
  mmSKRIPTE0002009_Styk1_2
  gRNA
ugacucauuaaucgccucug

SEQ ID NO: 131231 - RNA, 20 nt, Artificial Sequence
  mmSKRIPTE0002010_Styk1_3
  gRNA
uuaaccagacacuaacccug

SEQ ID NO: 131232 - RNA, 20 nt, Artificial Sequence
  mmSKRIPTE0002011_Styk1_4
  gRNA
acaggauggacaauuacacu

SEQ ID NO: 131233 - RNA, 20 nt, Artificial Sequence
  mmSKRIPTE0002012_Styk1_5
  gRNA
ucaugcaacaaugaccacca

SEQ ID NO: 131234 - RNA, 20 nt, Artificial Sequence
  mmSKRIPTE0002013_Styk1_6
  gRNA
agauauuguaggaugcuggu

SEQ ID NO: 131235 - RNA, 20 nt, Artificial Sequence
  mmSKRIPTE0002014_Styk1_7
  gRNA
auccucugugcgccuaacag

SEQ ID NO: 131236 - RNA, 20 nt, Artificial Sequence
  mmSKRIPTE0002015_Styk1_8
  gRNA
ccucugaggcacauuuaaag

SEQ ID NO: 131237 - RNA, 20 nt, Artificial Sequence
  mmSKRIPTE0002016_Styk1_9
  gRNA
agaguuugagccuuaccucg

SEQ ID NO: 131238 - RNA, 20 nt, Artificial Sequence
  mmSKRIPTE0002017_Kcnj8_1
  gRNA
ggugcgauccauagugcacg

SEQ ID NO: 131239 - RNA, 20 nt, Artificial Sequence
  mmSKRIPTE0002018_Kcnj8_2
  gRNA
acggaccuccuacauugccg

SEQ ID NO: 131240 - RNA, 20 nt, Artificial Sequence
  mmSKRIPTE0002019_Kcnj8_3
  gRNA
ggcuacgcuugucaaucacg

SEQ ID NO: 131241 - RNA, 20 nt, Artificial Sequence
  mmSKRIPTE0002020_Kcnj8_4
  gRNA
cuggaaaguaauuugcgacg

SEQ ID NO: 131242 - RNA, 20 nt, Artificial Sequence
  mmSKRIPTE0002021_Kcnj8_5
  gRNA
uuguacagauaccugagacg

SEQ ID NO: 131243 - RNA, 20 nt, Artificial Sequence
  mmSKRIPTE0002022_Kcnj8_6
  gRNA
aaguugcaucgcgccucccg

SEQ ID NO: 131244 - RNA, 20 nt, Artificial Sequence
  mmSKRIPTE0002023_Kcnj8_7
  gRNA
aucacacaccguguuaaccc

SEQ ID NO: 131245 - RNA, 20 nt, Artificial Sequence
  mmSKRIPTE0002024_Kcnj8_8
  gRNA
acuuuccccggcucgcucgg

SEQ ID NO: 131246 - RNA, 20 nt, Artificial Sequence
  mmSKRIPTE0002025_Kcnj8_9
  gRNA
gaccaccuggaugcgcaccg

SEQ ID NO: 131247 - RNA, 20 nt, Artificial Sequence
  mmSKRIPTE0002026_Gas6_1
  gRNA
ccagaccggagcgaucacag

SEQ ID NO: 131248 - RNA, 20 nt, Artificial Sequence
  mmSKRIPTE0002027_Gas6_2
  gRNA
ggucaaccuacacccacucg

SEQ ID NO: 131249 - RNA, 20 nt, Artificial Sequence
  mmSKRIPTE0002028_Gas6_3
  gRNA
agagaguuaaauaguccgug

SEQ ID NO: 131250 - RNA, 20 nt, Artificial Sequence
  mmSKRIPTE0002029_Gas6_4
  gRNA
uccuuaaacacagauaacgu

SEQ ID NO: 131251 - RNA, 20 nt, Artificial Sequence
  mmSKRIPTE0002030_Gas6_5
  gRNA
cggucauccuggcuaagcga

SEQ ID NO: 131252 - RNA, 20 nt, Artificial Sequence
  mmSKRIPTE0002031_Gas6_6
  gRNA
ccucgaagacuugguaggcg

SEQ ID NO: 131253 - RNA, 20 nt, Artificial Sequence
  mmSKRIPTE0002032_Gas6_7
  gRNA
agaggucccuaggugcacaa

SEQ ID NO: 131254 - RNA, 20 nt, Artificial Sequence
  mmSKRIPTE0002033_Gas6_8
  gRNA
cccgucacugcguucuaccg

SEQ ID NO: 131255 - RNA, 20 nt, Artificial Sequence
  mmSKRIPTE0002034_Gas6_9
  gRNA
guaaguccauucccgacacg

SEQ ID NO: 131256 - RNA, 20 nt, Artificial Sequence
  mmSKRIPTE0002035_Pik3cb_1
  gRNA
uauguccgggaauacgcugu

SEQ ID NO: 131257 - RNA, 20 nt, Artificial Sequence
  mmSKRIPTE0002036_Pik3cb_2
  gRNA
acagcucccagccccgaaug

SEQ ID NO: 131258 - RNA, 20 nt, Artificial Sequence
  mmSKRIPTE0002037_Pik3cb_3
  gRNA
acugccagucacaacucgug

SEQ ID NO: 131259 - RNA, 20 nt, Artificial Sequence
  mmSKRIPTE0002038_Pik3cb_4
  gRNA
cuguugcuaagcagccauag

SEQ ID NO: 131260 - RNA, 20 nt, Artificial Sequence
  mmSKRIPTE0002039_Pik3cb_5
  gRNA
caacucgaguugcuuaacga

SEQ ID NO: 131261 - RNA, 20 nt, Artificial Sequence
  mmSKRIPTE0002040_Pik3cb_6
  gRNA
uagcaugcaagugucuccga

SEQ ID NO: 131262 - RNA, 20 nt, Artificial Sequence
  mmSKRIPTE0002041_Pik3cb_7
  gRNA
auccuggaagcauacugucg

SEQ ID NO: 131263 - RNA, 20 nt, Artificial Sequence
  mmSKRIPTE0002042_Pik3cb_8
  gRNA
gaguccuuggaucaggcgaa

SEQ ID NO: 131264 - RNA, 20 nt, Artificial Sequence
  mmSKRIPTE0002043_Pik3cb_9
  gRNA
acuuaccuuucccggcacau

SEQ ID NO: 131265 - RNA, 20 nt, Artificial Sequence
  mmSKRIPTE0002044_Map3k5_1
  gRNA
cuauaccauacggaagacga

SEQ ID NO: 131266 - RNA, 20 nt, Artificial Sequence
  mmSKRIPTE0002045_Map3k5_2
  gRNA
uguuugguugucgugacgga

SEQ ID NO: 131267 - RNA, 20 nt, Artificial Sequence
  mmSKRIPTE0002046_Map3k5_3
  gRNA
aauuggcagcugaauuggcg

SEQ ID NO: 131268 - RNA, 20 nt, Artificial Sequence
  mmSKRIPTE0002047_Map3k5_4
  gRNA
aaugugcuggaaacuagucg

SEQ ID NO: 131269 - RNA, 20 nt, Artificial Sequence
  mmSKRIPTE0002048_Map3k5_5
  gRNA
ucguauucguagucauacug

SEQ ID NO: 131270 - RNA, 20 nt, Artificial Sequence
  mmSKRIPTE0002049_Map3k5_6
  gRNA
gaaacuaauagguaacguga

SEQ ID NO: 131271 - RNA, 20 nt, Artificial Sequence
  mmSKRIPTE0002050_Map3k5_7
  gRNA
auuaucugacugagcccacg

SEQ ID NO: 131272 - RNA, 20 nt, Artificial Sequence
  mmSKRIPTE0002051_Map3k5_8
  gRNA
gcgcuugauaggggucaaug

SEQ ID NO: 131273 - RNA, 20 nt, Artificial Sequence
  mmSKRIPTE0002052_Map3k5_9
  gRNA
gcaacguuagaauuguugag

SEQ ID NO: 131274 - RNA, 20 nt, Artificial Sequence
  mmSKRIPTE0002053_Sqstm1_1
  gRNA
uuucguccguaccuagaccg

SEQ ID NO: 131275 - RNA, 20 nt, Artificial Sequence
  mmSKRIPTE0002054_Sqstm1_2
  gRNA
uugcuccccguaacgcccgg

SEQ ID NO: 131276 - RNA, 20 nt, Artificial Sequence
  mmSKRIPTE0002055_Sqstm1_3
  gRNA
gagagggacucaaucagccg

SEQ ID NO: 131277 - RNA, 20 nt, Artificial Sequence
  mmSKRIPTE0002056_Sqstm1_4
  gRNA
gucccuauaaggcuaagcag

SEQ ID NO: 131278 - RNA, 20 nt, Artificial Sequence
  mmSKRIPTE0002057_Sqstm1_5
  gRNA
auagaggcuccgcccccacg

SEQ ID NO: 131279 - RNA, 20 nt, Artificial Sequence
  mmSKRIPTE0002058_Sqstm1_6
  gRNA
ugaugguugcaacgggccug

SEQ ID NO: 131280 - RNA, 20 nt, Artificial Sequence
  mmSKRIPTE0002059_Sqstm1_7
  gRNA
ugggacccuugaaagguacg

SEQ ID NO: 131281 - RNA, 20 nt, Artificial Sequence
  mmSKRIPTE0002060_Sqstm1_8
  gRNA
gaccaagaauuacgacaucg

SEQ ID NO: 131282 - RNA, 20 nt, Artificial Sequence
  mmSKRIPTE0002061_Sqstm1_9
  gRNA
uugcaucacguagagcagca

SEQ ID NO: 131283 - RNA, 20 nt, Artificial Sequence
  mmSKRIPTE0002062_Adam17_1
  gRNA
uggggcagaauauaacguag

SEQ ID NO: 131284 - RNA, 20 nt, Artificial Sequence
  mmSKRIPTE0002063_Adam17_2
  gRNA
uuacacuguacaguaacccu

SEQ ID NO: 131285 - RNA, 20 nt, Artificial Sequence
  mmSKRIPTE0002064_Adam17_3
  gRNA
aggccaucucgaaguucaug

SEQ ID NO: 131286 - RNA, 20 nt, Artificial Sequence
  mmSKRIPTE0002065_Adam17_4
  gRNA
uccaucaccaggcuauccca

SEQ ID NO: 131287 - RNA, 20 nt, Artificial Sequence
  mmSKRIPTE0002066_Adam17_5
  gRNA
gaauggcccugaaagcaacg

SEQ ID NO: 131288 - RNA, 20 nt, Artificial Sequence
  mmSKRIPTE0002067_Adam17_6
  gRNA
auaucauagggcaugcaccu

SEQ ID NO: 131289 - RNA, 20 nt, Artificial Sequence
  mmSKRIPTE0002068_Adam17_7
  gRNA
ccgaacucuuuaccaagucg

SEQ ID NO: 131290 - RNA, 20 nt, Artificial Sequence
  mmSKRIPTE0002069_Adam17_8
  gRNA
agcagguacucaucagccgu

SEQ ID NO: 131291 - RNA, 20 nt, Artificial Sequence
  mmSKRIPTE0002070_Adam17_9
  gRNA
gugauuggagggacgcgccg

SEQ ID NO: 131292 - RNA, 20 nt, Artificial Sequence
  mmSKRIPTE0002071_Bcl11b_1
  gRNA
aguucaccaucauagccccg

SEQ ID NO: 131293 - RNA, 20 nt, Artificial Sequence
  mmSKRIPTE0002072_Bcl11b_2
  gRNA
ugacucggucgaaggcacug

SEQ ID NO: 131294 - RNA, 20 nt, Artificial Sequence
  mmSKRIPTE0002073_Bcl11b_3
  gRNA
ucugagaggguucggccccg

SEQ ID NO: 131295 - RNA, 20 nt, Artificial Sequence
  mmSKRIPTE0002074_Bcl11b_4
  gRNA
cugagagcccgucgucugag

SEQ ID NO: 131296 - RNA, 20 nt, Artificial Sequence
  mmSKRIPTE0002075_Bcl11b_5
  gRNA
uugggacagaugccuuucgu

SEQ ID NO: 131297 - RNA, 20 nt, Artificial Sequence
  mmSKRIPTE0002076_Bcl11b_6
  gRNA
ucaaaaucgagcaggcugag

SEQ ID NO: 131298 - RNA, 20 nt, Artificial Sequence
  mmSKRIPTE0002077_Bcl11b_7
  gRNA
agaacgcccagggcacgcag

SEQ ID NO: 131299 - RNA, 20 nt, Artificial Sequence
  mmSKRIPTE0002078_Bcl11b_8
  gRNA
aaccugugucgguucccagg

SEQ ID NO: 131300 - RNA, 20 nt, Artificial Sequence
  mmSKRIPTE0002079_Bcl11b_9
  gRNA
gcacgccaccuccguucucg

SEQ ID NO: 131301 - RNA, 20 nt, Artificial Sequence
  mmSKRIPTE0002080_Ddx41_1
  gRNA
gauuagccuaucuuaccgag

SEQ ID NO: 131302 - RNA, 20 nt, Artificial Sequence
  mmSKRIPTE0002081_Ddx41_2
  gRNA
augcucaggacauaacgcgg

SEQ ID NO: 131303 - RNA, 20 nt, Artificial Sequence
  mmSKRIPTE0002082_Ddx41_3
  gRNA
cugcugcagcgaagacgcaa

SEQ ID NO: 131304 - RNA, 20 nt, Artificial Sequence
  mmSKRIPTE0002083_Ddx41_4
  gRNA
cugcuguggucgccuagcaa

SEQ ID NO: 131305 - RNA, 20 nt, Artificial Sequence
  mmSKRIPTE0002084_Ddx41_5
  gRNA
guacguacugauggucucgg

SEQ ID NO: 131306 - RNA, 20 nt, Artificial Sequence
  mmSKRIPTE0002085_Ddx41_6
  gRNA
caacacgguagaguauggug

SEQ ID NO: 131307 - RNA, 20 nt, Artificial Sequence
  mmSKRIPTE0002086_Ddx41_7
  gRNA
gacaugucgccguugcacca

SEQ ID NO: 131308 - RNA, 20 nt, Artificial Sequence
  mmSKRIPTE0002087_Ddx41_8
  gRNA
cgccggcagcuacuggugag

SEQ ID NO: 131309 - RNA, 20 nt, Artificial Sequence
  mmSKRIPTE0002088_Ddx41_9
  gRNA
gcgcagaagauccaagucgu

SEQ ID NO: 131310 - RNA, 20 nt, Artificial Sequence
  mmSKRIPTE0002089_Rb1_1
  gRNA
uacguucagaauccacggga

SEQ ID NO: 131311 - RNA, 20 nt, Artificial Sequence
  mmSKRIPTE0002090_Rb1_2
  gRNA
aauaaugggaacgucccccg

SEQ ID NO: 131312 - RNA, 20 nt, Artificial Sequence
  mmSKRIPTE0002091_Rb1_3
  gRNA
aucuuaccaaaguugcccag

SEQ ID NO: 131313 - RNA, 20 nt, Artificial Sequence
  mmSKRIPTE0002092_Rb1_4
  gRNA
ucggaccagaccaguccgcg

SEQ ID NO: 131314 - RNA, 20 nt, Artificial Sequence
  mmSKRIPTE0002093_Rb1_5
  gRNA
agcauucuagugcuaucaga

SEQ ID NO: 131315 - RNA, 20 nt, Artificial Sequence
  mmSKRIPTE0002094_Rb1_6
  gRNA
uugggagaaaguuucauccg

SEQ ID NO: 131316 - RNA, 20 nt, Artificial Sequence
  mmSKRIPTE0002095_Rb1_7
  gRNA
aaguacccgaggacgacggg

SEQ ID NO: 131317 - RNA, 20 nt, Artificial Sequence
  mmSKRIPTE0002096_Rb1_8
  gRNA
uacagcuggcaaccuccgaa

SEQ ID NO: 131318 - RNA, 20 nt, Artificial Sequence
  mmSKRIPTE0002097_Rb1_9
  gRNA
auuucuacauugauuccgga

SEQ ID NO: 131319 - RNA, 20 nt, Artificial Sequence
  mmSKRIPTE0002098_Plcl2_1
  gRNA
cugaugauggaccuaaacgu

SEQ ID NO: 131320 - RNA, 20 nt, Artificial Sequence
  mmSKRIPTE0002099_Plcl2_2
  gRNA
cggaauuccugccgacugcg

SEQ ID NO: 131321 - RNA, 20 nt, Artificial Sequence
  mmSKRIPTE0002100_Plcl2_3
  gRNA
cagcacgacaaagcgcacca

SEQ ID NO: 131322 - RNA, 20 nt, Artificial Sequence
  mmSKRIPTE0002101_Plcl2_4
  gRNA
ugcaggcggaauuaccucug

SEQ ID NO: 131323 - RNA, 20 nt, Artificial Sequence
  mmSKRIPTE0002102_Plcl2_5
  gRNA
ggguguagcacauaucaaug

SEQ ID NO: 131324 - RNA, 20 nt, Artificial Sequence
  mmSKRIPTE0002103_Plcl2_6
  gRNA
accaggcacugaaaacuccg

SEQ ID NO: 131325 - RNA, 20 nt, Artificial Sequence
  mmSKRIPTE0002104_Plcl2_7
  gRNA
auggcuucuaggcuccggcg

SEQ ID NO: 131326 - RNA, 20 nt, Artificial Sequence
  mmSKRIPTE0002105_Plcl2_8
  gRNA
gaaaaucuauguacaaggug

SEQ ID NO: 131327 - RNA, 20 nt, Artificial Sequence
  mmSKRIPTE0002106_Plcl2_9
  gRNA
acaggcaguucccucacucg

SEQ ID NO: 131328 - RNA, 20 nt, Artificial Sequence
  mmSKRIPTE0002107_Gbf1_1
  gRNA
ugguaaguuaccuaugcaag

SEQ ID NO: 131329 - RNA, 20 nt, Artificial Sequence
  mmSKRIPTE0002108_Gbf1_2
  gRNA
gacuccguaguaccaccuag

SEQ ID NO: 131330 - RNA, 20 nt, Artificial Sequence
  mmSKRIPTE0002109_Gbf1_3
  gRNA
acacgaccgccauaacucug

SEQ ID NO: 131331 - RNA, 20 nt, Artificial Sequence
  mmSKRIPTE0002110_Gbf1_4
  gRNA
auggacuacgucaauccucg

SEQ ID NO: 131332 - RNA, 20 nt, Artificial Sequence
  mmSKRIPTE0002111_Gbf1_5
  gRNA
aaccccccuaagguuaccca

SEQ ID NO: 131333 - RNA, 20 nt, Artificial Sequence
  mmSKRIPTE0002112_Gbf1_6
  gRNA
uggagcgugcugcuucaccg

SEQ ID NO: 131334 - RNA, 20 nt, Artificial Sequence
  mmSKRIPTE0002113_Gbf1_7
  gRNA
gcaugagugacucguccaag

SEQ ID NO: 131335 - RNA, 20 nt, Artificial Sequence
  mmSKRIPTE0002114_Gbf1_8
  gRNA
agcaguaauggaaccacgag

SEQ ID NO: 131336 - RNA, 20 nt, Artificial Sequence
  mmSKRIPTE0002115_Gbf1_9
  gRNA
gacaccguaugguagcuggc

SEQ ID NO: 131337 - RNA, 20 nt, Artificial Sequence
  mmSKRIPTE0002116_Ppp6c_1
  gRNA
ucaaaggaaauacggcgucg

SEQ ID NO: 131338 - RNA, 20 nt, Artificial Sequence
  mmSKRIPTE0002117_Ppp6c_2
  gRNA
ucaacgccaguaacagugug

SEQ ID NO: 131339 - RNA, 20 nt, Artificial Sequence
  mmSKRIPTE0002118_Ppp6c_3
  gRNA
acgagaagcuggucacagug

SEQ ID NO: 131340 - RNA, 20 nt, Artificial Sequence
  mmSKRIPTE0002119_Ppp6c_4
  gRNA
acccguagcucucugccgcg

SEQ ID NO: 131341 - RNA, 20 nt, Artificial Sequence
  mmSKRIPTE0002120_Ppp6c_5
  gRNA
ccuaacuacugcuaucgcug

SEQ ID NO: 131342 - RNA, 20 nt, Artificial Sequence
  mmSKRIPTE0002121_Ppp6c_6
  gRNA
acagauccccugauaccaug

SEQ ID NO: 131343 - RNA, 20 nt, Artificial Sequence
  mmSKRIPTE0002122_Ppp6c_7
  gRNA
guuuacagccggguugacaa

SEQ ID NO: 131344 - RNA, 20 nt, Artificial Sequence
  mmSKRIPTE0002123_Ppp6c_8
  gRNA
aucaaauuaucauccaacaa

SEQ ID NO: 131345 - RNA, 20 nt, Artificial Sequence
  mmSKRIPTE0002124_Ppp6c_9
  gRNA
ggaucggacgugacguaagg

SEQ ID NO: 131346 - RNA, 20 nt, Artificial Sequence
  mmSKRIPTE0002125_Ptprj_1
  gRNA
acaaccuggcucaacacgug

SEQ ID NO: 131347 - RNA, 20 nt, Artificial Sequence
  mmSKRIPTE0002126_Ptprj_2
  gRNA
gugacugaugcaaggucgug

SEQ ID NO: 131348 - RNA, 20 nt, Artificial Sequence
  mmSKRIPTE0002127_Ptprj_3
  gRNA
ccucccguuguaguagccga

SEQ ID NO: 131349 - RNA, 20 nt, Artificial Sequence
  mmSKRIPTE0002128_Ptprj_4
  gRNA
aggacccagauauuaccggu

SEQ ID NO: 131350 - RNA, 20 nt, Artificial Sequence
  mmSKRIPTE0002129_Ptprj_5
  gRNA
cucuucaaucagcauccggu

SEQ ID NO: 131351 - RNA, 20 nt, Artificial Sequence
  mmSKRIPTE0002130_Ptprj_6
  gRNA
cagauccaaguuaauccgag

SEQ ID NO: 131352 - RNA, 20 nt, Artificial Sequence
  mmSKRIPTE0002131_Ptprj_7
  gRNA
ugcugucauccucaccaccg

SEQ ID NO: 131353 - RNA, 20 nt, Artificial Sequence
  mmSKRIPTE0002132_Ptprj_8
  gRNA
cuugucuccauaaagcccga

SEQ ID NO: 131354 - RNA, 20 nt, Artificial Sequence
  mmSKRIPTE0002133_Ptprj_9
  gRNA
uaacuaauauuugaugcacg

SEQ ID NO: 131355 - RNA, 20 nt, Artificial Sequence
  mmSKRIPTE0002134_F2_1
  gRNA
gagcguggccgacuauacca

SEQ ID NO: 131356 - RNA, 20 nt, Artificial Sequence
  mmSKRIPTE0002135_F2_2
  gRNA
aaauacguuugguaucgcug

SEQ ID NO: 131357 - RNA, 20 nt, Artificial Sequence
  mmSKRIPTE0002136_F2_3
  gRNA
ccugucaccgaguugucacg

SEQ ID NO: 131358 - RNA, 20 nt, Artificial Sequence
  mmSKRIPTE0002137_F2_4
  gRNA
ucacacgggagugauccacc

SEQ ID NO: 131359 - RNA, 20 nt, Artificial Sequence
  mmSKRIPTE0002138_F2_5
  gRNA
ugugccuagacucuuaaccu

SEQ ID NO: 131360 - RNA, 20 nt, Artificial Sequence
  mmSKRIPTE0002139_F2_6
  gRNA
agauagucuaagcgcccaag

SEQ ID NO: 131361 - RNA, 20 nt, Artificial Sequence
  mmSKRIPTE0002140_F2_7
  gRNA
cagugaggcucgcgacauga

SEQ ID NO: 131362 - RNA, 20 nt, Artificial Sequence
  mmSKRIPTE0002141_F2_8
  gRNA
ucuucucgaacaaaggccgc

SEQ ID NO: 131363 - RNA, 20 nt, Artificial Sequence
  mmSKRIPTE0002142_F2_9
  gRNA
aaaggugucccgguuaugga

SEQ ID NO: 131364 - RNA, 20 nt, Artificial Sequence
  mmSKRIPTE0002143_Mertk_1
  gRNA
aauuggugugacgaucaaug

SEQ ID NO: 131365 - RNA, 20 nt, Artificial Sequence
  mmSKRIPTE0002144_Mertk_2
  gRNA
guggggccagaaccaucgcg

SEQ ID NO: 131366 - RNA, 20 nt, Artificial Sequence
  mmSKRIPTE0002145_Mertk_3
  gRNA
cgauugcuauaccccaacag

SEQ ID NO: 131367 - RNA, 20 nt, Artificial Sequence
  mmSKRIPTE0002146_Mertk_4
  gRNA
aguuacgcucugacuaaacg

SEQ ID NO: 131368 - RNA, 20 nt, Artificial Sequence
  mmSKRIPTE0002147_Mertk_5
  gRNA
cagcgcaaauggaaauagcg

SEQ ID NO: 131369 - RNA, 20 nt, Artificial Sequence
  mmSKRIPTE0002148_Mertk_6
  gRNA
uguccugagcuagagacccg

SEQ ID NO: 131370 - RNA, 20 nt, Artificial Sequence
  mmSKRIPTE0002149_Mertk_7
  gRNA
aacgugacuaagacgacaug

SEQ ID NO: 131371 - RNA, 20 nt, Artificial Sequence
  mmSKRIPTE0002150_Mertk_8
  gRNA
gugugauuaaacgcaacagg

SEQ ID NO: 131372 - RNA, 20 nt, Artificial Sequence
  mmSKRIPTE0002151_Mertk_9
  gRNA
uaguguacuauggugagacc

SEQ ID NO: 131373 - RNA, 20 nt, Artificial Sequence
  mmSKRIPTE0002152_Gbp3_1
  gRNA
gucaugaccucuccucaaug

SEQ ID NO: 131374 - RNA, 20 nt, Artificial Sequence
  mmSKRIPTE0002153_Gbp3_2
  gRNA
ggcacugguagaccuaaccg

SEQ ID NO: 131375 - RNA, 20 nt, Artificial Sequence
  mmSKRIPTE0002154_Gbp3_3
  gRNA
acugcagucuaaauccaaga

SEQ ID NO: 131376 - RNA, 20 nt, Artificial Sequence
  mmSKRIPTE0002155_Gbp3_4
  gRNA
acagugcaauccgaaaccaa

SEQ ID NO: 131377 - RNA, 20 nt, Artificial Sequence
  mmSKRIPTE0002156_Gbp3_5
  gRNA
cggcuaaugggaguacucag

SEQ ID NO: 131378 - RNA, 20 nt, Artificial Sequence
  mmSKRIPTE0002157_Gbp3_6
  gRNA
cauauaacgacuaagcacug

SEQ ID NO: 131379 - RNA, 20 nt, Artificial Sequence
  mmSKRIPTE0002158_Gbp3_7
  gRNA
ucuuguuaaaacgcacaagu

SEQ ID NO: 131380 - RNA, 20 nt, Artificial Sequence
  mmSKRIPTE0002159_Gbp3_8
  gRNA
uuguugguuuauaucguaca

SEQ ID NO: 131381 - RNA, 20 nt, Artificial Sequence
  mmSKRIPTE0002160_Gbp3_9
  gRNA
gugugacagccacagcucga

SEQ ID NO: 131382 - RNA, 20 nt, Artificial Sequence
  mmSKRIPTE0002161_Glmn_1
  gRNA
agagcguacagucgggcccg

SEQ ID NO: 131383 - RNA, 20 nt, Artificial Sequence
  mmSKRIPTE0002162_Glmn_2
  gRNA
uucaacugcagaagguacga

SEQ ID NO: 131384 - RNA, 20 nt, Artificial Sequence
  mmSKRIPTE0002163_Glmn_3
  gRNA
agaccaucauuaagucuaug

SEQ ID NO: 131385 - RNA, 20 nt, Artificial Sequence
  mmSKRIPTE0002164_Glmn_4
  gRNA
cuaaauacaaguaaucacuc

SEQ ID NO: 131386 - RNA, 20 nt, Artificial Sequence
  mmSKRIPTE0002165_Glmn_5
  gRNA
aacaacaaggcauacuccgu

SEQ ID NO: 131387 - RNA, 20 nt, Artificial Sequence
  mmSKRIPTE0002166_Glmn_6
  gRNA
ucauccagucaaguacaacu

SEQ ID NO: 131388 - RNA, 20 nt, Artificial Sequence
  mmSKRIPTE0002167_Glmn_7
  gRNA
ucuugaggaacauuucaccg

SEQ ID NO: 131389 - RNA, 20 nt, Artificial Sequence
  mmSKRIPTE0002168_Glmn_8
  gRNA
ccaacuuacuuguucaugcg

SEQ ID NO: 131390 - RNA, 20 nt, Artificial Sequence
  mmSKRIPTE0002169_Glmn_9
  gRNA
acaacaucugaacaugguga

SEQ ID NO: 131391 - RNA, 20 nt, Artificial Sequence
  mmSKRIPTE0002170_Irak2_1
  gRNA
gcagagguaggacguucgcg

SEQ ID NO: 131392 - RNA, 20 nt, Artificial Sequence
  mmSKRIPTE0002171_Irak2_2
  gRNA
gcuccccccagauaucaacg

SEQ ID NO: 131393 - RNA, 20 nt, Artificial Sequence
  mmSKRIPTE0002172_Irak2_3
  gRNA
ugucaggucugugaucacgu

SEQ ID NO: 131394 - RNA, 20 nt, Artificial Sequence
  mmSKRIPTE0002173_Irak2_4
  gRNA
gcuuagcaguugcauacaca

SEQ ID NO: 131395 - RNA, 20 nt, Artificial Sequence
  mmSKRIPTE0002174_Irak2_5
  gRNA
cugcaccggaagcuuaccug

SEQ ID NO: 131396 - RNA, 20 nt, Artificial Sequence
  mmSKRIPTE0002175_Irak2_6
  gRNA
cacucacuugguaaauaccc

SEQ ID NO: 131397 - RNA, 20 nt, Artificial Sequence
  mmSKRIPTE0002176_Irak2_7
  gRNA
cucaagguaguacaucacac

SEQ ID NO: 131398 - RNA, 20 nt, Artificial Sequence
  mmSKRIPTE0002177_Irak2_8
  gRNA
caaggggcauccaucucgca

SEQ ID NO: 131399 - RNA, 20 nt, Artificial Sequence
  mmSKRIPTE0002178_Irak2_9
  gRNA
aaccugacacuaagaugcgg

SEQ ID NO: 131400 - RNA, 20 nt, Artificial Sequence
  mmSKRIPTE0002179_Ptpn6_1
  gRNA
caccaucugauagccuacca

SEQ ID NO: 131401 - RNA, 20 nt, Artificial Sequence
  mmSKRIPTE0002180_Ptpn6_2
  gRNA
cuucuaugaccuguacggag

SEQ ID NO: 131402 - RNA, 20 nt, Artificial Sequence
  mmSKRIPTE0002181_Ptpn6_3
  gRNA
augugucccauacuggcccg

SEQ ID NO: 131403 - RNA, 20 nt, Artificial Sequence
  mmSKRIPTE0002182_Ptpn6_4
  gRNA
gauaugagugacccugagcg

SEQ ID NO: 131404 - RNA, 20 nt, Artificial Sequence
  mmSKRIPTE0002183_Ptpn6_5
  gRNA
guauucaggucuaugucuag

SEQ ID NO: 131405 - RNA, 20 nt, Artificial Sequence
  mmSKRIPTE0002184_Ptpn6_6
  gRNA
uaccacggccacauaucugg

SEQ ID NO: 131406 - RNA, 20 nt, Artificial Sequence
  mmSKRIPTE0002185_Ptpn6_7
  gRNA
caucaaugccaacuacguga

SEQ ID NO: 131407 - RNA, 20 nt, Artificial Sequence
  mmSKRIPTE0002186_Ptpn6_8
  gRNA
ucacuuggaggaaguacgcg

SEQ ID NO: 131408 - RNA, 20 nt, Artificial Sequence
  mmSKRIPTE0002187_Ptpn6_9
  gRNA
gauaaguggacauccagacc

SEQ ID NO: 131409 - RNA, 20 nt, Artificial Sequence
  mmSKRIPTE0002188_Irf7_1
  gRNA
ucaccggugaggaucuagag

SEQ ID NO: 131410 - RNA, 20 nt, Artificial Sequence
  mmSKRIPTE0002189_Irf7_2
  gRNA
cccagguagaugguguagug

SEQ ID NO: 131411 - RNA, 20 nt, Artificial Sequence
  mmSKRIPTE0002190_Irf7_3
  gRNA
uaguacuucgggcagaggcg

SEQ ID NO: 131412 - RNA, 20 nt, Artificial Sequence
  mmSKRIPTE0002191_Irf7_4
  gRNA
cauuagcccuaaccccagcg

SEQ ID NO: 131413 - RNA, 20 nt, Artificial Sequence
  mmSKRIPTE0002192_Irf7_5
  gRNA
auggaccagauguaccugug

SEQ ID NO: 131414 - RNA, 20 nt, Artificial Sequence
  mmSKRIPTE0002193_Irf7_6
  gRNA
uaccugguaccggagccgcc

SEQ ID NO: 131415 - RNA, 20 nt, Artificial Sequence
  mmSKRIPTE0002194_Irf7_7
  gRNA
aaaccauagaggcacccaag

SEQ ID NO: 131416 - RNA, 20 nt, Artificial Sequence
  mmSKRIPTE0002195_Irf7_8
  gRNA
uacaaguguugguaacaggu

SEQ ID NO: 131417 - RNA, 20 nt, Artificial Sequence
  mmSKRIPTE0002196_Irf7_9
  gRNA
gcugagcgaagagagcgaag

SEQ ID NO: 131418 - RNA, 20 nt, Artificial Sequence
  mmSKRIPTE0002197_Cbfa2t3_1
  gRNA
cagccguggaaacggccaug

SEQ ID NO: 131419 - RNA, 20 nt, Artificial Sequence
  mmSKRIPTE0002198_Cbfa2t3_2
  gRNA
aguucgugcccacggcaggg

SEQ ID NO: 131420 - RNA, 20 nt, Artificial Sequence
  mmSKRIPTE0002199_Cbfa2t3_3
  gRNA
ugcccgaguugugagcguag

SEQ ID NO: 131421 - RNA, 20 nt, Artificial Sequence
  mmSKRIPTE0002200_Cbfa2t3_4
  gRNA
gggcuuagucauccgcaugg

SEQ ID NO: 131422 - RNA, 20 nt, Artificial Sequence
  mmSKRIPTE0002201_Cbfa2t3_5
  gRNA
uuuaacauaacgugacccug

SEQ ID NO: 131423 - RNA, 20 nt, Artificial Sequence
  mmSKRIPTE0002202_Cbfa2t3_6
  gRNA
accguagcucucucgcaacc

SEQ ID NO: 131424 - RNA, 20 nt, Artificial Sequence
  mmSKRIPTE0002203_Cbfa2t3_7
  gRNA
cauaccuuucagcuaacgag

SEQ ID NO: 131425 - RNA, 20 nt, Artificial Sequence
  mmSKRIPTE0002204_Cbfa2t3_8
  gRNA
gcggcagcugcguaguacgc

SEQ ID NO: 131426 - RNA, 20 nt, Artificial Sequence
  mmSKRIPTE0002205_Cbfa2t3_9
  gRNA
gggugcaggaccgcuuacug

SEQ ID NO: 131427 - RNA, 20 nt, Artificial Sequence
  mmSKRIPTE0002206_Anxa2_1
  gRNA
augagguuauggcucacccg

SEQ ID NO: 131428 - RNA, 20 nt, Artificial Sequence
  mmSKRIPTE0002207_Anxa2_2
  gRNA
ugaacgucuccuaaagcgug

SEQ ID NO: 131429 - RNA, 20 nt, Artificial Sequence
  mmSKRIPTE0002208_Anxa2_3
  gRNA
ucacccugucaggacugcga

SEQ ID NO: 131430 - RNA, 20 nt, Artificial Sequence
  mmSKRIPTE0002209_Anxa2_4
  gRNA
agguggcgaaggcugcaccg

SEQ ID NO: 131431 - RNA, 20 nt, Artificial Sequence
  mmSKRIPTE0002210_Anxa2_5
  gRNA
aacacacgucaucccgugaa

SEQ ID NO: 131432 - RNA, 20 nt, Artificial Sequence
  mmSKRIPTE0002211_Anxa2_6
  gRNA
aggucaaugcuacuguagcg

SEQ ID NO: 131433 - RNA, 20 nt, Artificial Sequence
  mmSKRIPTE0002212_Anxa2_7
  gRNA
cugcgguaccuucaaccacg

SEQ ID NO: 131434 - RNA, 20 nt, Artificial Sequence
  mmSKRIPTE0002213_Anxa2_8
  gRNA
cuucuuuaucagauucaucg

SEQ ID NO: 131435 - RNA, 20 nt, Artificial Sequence
  mmSKRIPTE0002214_Anxa2_9
  gRNA
cguucagcaccgcaaccccg

SEQ ID NO: 131436 - RNA, 20 nt, Artificial Sequence
  mmSKRIPTE0002215_Ager_1
  gRNA
cgaguccgagucuaccguaa

SEQ ID NO: 131437 - RNA, 20 nt, Artificial Sequence
  mmSKRIPTE0002216_Ager_2
  gRNA
ccacuggaauugucgaugag

SEQ ID NO: 131438 - RNA, 20 nt, Artificial Sequence
  mmSKRIPTE0002217_Ager_3
  gRNA
cccauccaacuccgagucag

SEQ ID NO: 131439 - RNA, 20 nt, Artificial Sequence
  mmSKRIPTE0002218_Ager_4
  gRNA
aguaguagcccugcucgucg

SEQ ID NO: 131440 - RNA, 20 nt, Artificial Sequence
  mmSKRIPTE0002219_Ager_5
  gRNA
ccacaaugaugcuaucaccc

SEQ ID NO: 131441 - RNA, 20 nt, Artificial Sequence
  mmSKRIPTE0002220_Ager_6
  gRNA
aaccucaggaguuacccuug

SEQ ID NO: 131442 - RNA, 20 nt, Artificial Sequence
  mmSKRIPTE0002221_Ager_7
  gRNA
gucgggcaacuaacaggcga

SEQ ID NO: 131443 - RNA, 20 nt, Artificial Sequence
  mmSKRIPTE0002222_Ager_8
  gRNA
gggaaacuucugauucccga

SEQ ID NO: 131444 - RNA, 20 nt, Artificial Sequence
  mmSKRIPTE0002223_Ager_9
  gRNA
ugagggcaccuauagcugcg

SEQ ID NO: 131445 - RNA, 20 nt, Artificial Sequence
  mmSKRIPTE0002224_Ms4a1_1
  gRNA
gaaggguagacuacacuacg

SEQ ID NO: 131446 - RNA, 20 nt, Artificial Sequence
  mmSKRIPTE0002225_Ms4a1_2
  gRNA
gcugcuaauuuccugucacg

SEQ ID NO: 131447 - RNA, 20 nt, Artificial Sequence
  mmSKRIPTE0002226_Ms4a1_3
  gRNA
uaaggcaaggucuacuaccg

SEQ ID NO: 131448 - RNA, 20 nt, Artificial Sequence
  mmSKRIPTE0002227_Ms4a1_4
  gRNA
cccacguugaaaccaugcaa

SEQ ID NO: 131449 - RNA, 20 nt, Artificial Sequence
  mmSKRIPTE0002228_Ms4a1_5
  gRNA
ccuacugaugucauccauug

SEQ ID NO: 131450 - RNA, 20 nt, Artificial Sequence
  mmSKRIPTE0002229_Ms4a1_6
  gRNA
aguguaugguacccucucug

SEQ ID NO: 131451 - RNA, 20 nt, Artificial Sequence
  mmSKRIPTE0002230_Ms4a1_7
  gRNA
ucuagauccaggaauucugu

SEQ ID NO: 131452 - RNA, 20 nt, Artificial Sequence
  mmSKRIPTE0002231_Ms4a1_8
  gRNA
uagacagcauuagaccaccc

SEQ ID NO: 131453 - RNA, 20 nt, Artificial Sequence
  mmSKRIPTE0002232_Ms4a1_9
  gRNA
ggugauuggagcgauucuca

SEQ ID NO: 131454 - RNA, 20 nt, Artificial Sequence
  mmSKRIPTE0002233_Braf_1
  gRNA
gagacgacgaggagucgccg

SEQ ID NO: 131455 - RNA, 20 nt, Artificial Sequence
  mmSKRIPTE0002234_Braf_2
  gRNA
guagaaacgugugagcgcga

SEQ ID NO: 131456 - RNA, 20 nt, Artificial Sequence
  mmSKRIPTE0002235_Braf_3
  gRNA
ugggugcgugacgucauccg

SEQ ID NO: 131457 - RNA, 20 nt, Artificial Sequence
  mmSKRIPTE0002236_Braf_4
  gRNA
ugucauuagagaccgugaca

SEQ ID NO: 131458 - RNA, 20 nt, Artificial Sequence
  mmSKRIPTE0002237_Braf_5
  gRNA
aacuggcaauuguuacacag

SEQ ID NO: 131459 - RNA, 20 nt, Artificial Sequence
  mmSKRIPTE0002238_Braf_6
  gRNA
ccagugagcaaggcaacccg

SEQ ID NO: 131460 - RNA, 20 nt, Artificial Sequence
  mmSKRIPTE0002239_Braf_7
  gRNA
ucaccagcguuguaguacag

SEQ ID NO: 131461 - RNA, 20 nt, Artificial Sequence
  mmSKRIPTE0002240_Braf_8
  gRNA
gagguuaggagggcauaaug

SEQ ID NO: 131462 - RNA, 20 nt, Artificial Sequence
  mmSKRIPTE0002241_Braf_9
  gRNA
aauuacuuagcagcaccgau

SEQ ID NO: 131463 - RNA, 20 nt, Artificial Sequence
  mmSKRIPTE0002242_Bcl6b_1
  gRNA
aauuaucccucguauacgca

SEQ ID NO: 131464 - RNA, 20 nt, Artificial Sequence
  mmSKRIPTE0002243_Bcl6b_2
  gRNA
aacucagcuauggucccccg

SEQ ID NO: 131465 - RNA, 20 nt, Artificial Sequence
  mmSKRIPTE0002244_Bcl6b_3
  gRNA
gcaucugcgucagaaacacg

SEQ ID NO: 131466 - RNA, 20 nt, Artificial Sequence
  mmSKRIPTE0002245_Bcl6b_4
  gRNA
cagauugcuaagcacgucgg

SEQ ID NO: 131467 - RNA, 20 nt, Artificial Sequence
  mmSKRIPTE0002246_Bcl6b_5
  gRNA
accgcacggugcacacaggu

SEQ ID NO: 131468 - RNA, 20 nt, Artificial Sequence
  mmSKRIPTE0002247_Bcl6b_6
  gRNA
agaucgcccuacgggagcgg

SEQ ID NO: 131469 - RNA, 20 nt, Artificial Sequence
  mmSKRIPTE0002248_Bcl6b_7
  gRNA
caaccaacgccaucagauag

SEQ ID NO: 131470 - RNA, 20 nt, Artificial Sequence
  mmSKRIPTE0002249_Bcl6b_8
  gRNA
uaucgcuugcagguucgagg

SEQ ID NO: 131471 - RNA, 20 nt, Artificial Sequence
  mmSKRIPTE0002250_Bcl6b_9
  gRNA
cuuagcccugagaauaucga

SEQ ID NO: 131472 - RNA, 20 nt, Artificial Sequence
  mmSKRIPTE0002251_Erap1_1
  gRNA
cauauuugacuuauccaacg

SEQ ID NO: 131473 - RNA, 20 nt, Artificial Sequence
  mmSKRIPTE0002252_Erap1_2
  gRNA
gauaauugcgcacacaugcg

SEQ ID NO: 131474 - RNA, 20 nt, Artificial Sequence
  mmSKRIPTE0002253_Erap1_3
  gRNA
caguggaucaaauuuaacgu

SEQ ID NO: 131475 - RNA, 20 nt, Artificial Sequence
  mmSKRIPTE0002254_Erap1_4
  gRNA
guguucuuagaugcguaaug

SEQ ID NO: 131476 - RNA, 20 nt, Artificial Sequence
  mmSKRIPTE0002255_Erap1_5
  gRNA
cuuucacuuucggucccggg

SEQ ID NO: 131477 - RNA, 20 nt, Artificial Sequence
  mmSKRIPTE0002256_Erap1_6
  gRNA
aggccaauggauaacccacu

SEQ ID NO: 131478 - RNA, 20 nt, Artificial Sequence
  mmSKRIPTE0002257_Erap1_7
  gRNA
aaguaguuaucagagugcgg

SEQ ID NO: 131479 - RNA, 20 nt, Artificial Sequence
  mmSKRIPTE0002258_Erap1_8
  gRNA
ccauugaagaaaacauacga

SEQ ID NO: 131480 - RNA, 20 nt, Artificial Sequence
  mmSKRIPTE0002259_Erap1_9
  gRNA
cuauuacauugugcauuacg

SEQ ID NO: 131481 - RNA, 20 nt, Artificial Sequence
  mmSKRIPTE0002260_Rabgef1_1
  gRNA
agccugaaguccgaacgcag

SEQ ID NO: 131482 - RNA, 20 nt, Artificial Sequence
  mmSKRIPTE0002261_Rabgef1_2
  gRNA
uagaacggaaugauagcaug

SEQ ID NO: 131483 - RNA, 20 nt, Artificial Sequence
  mmSKRIPTE0002262_Rabgef1_3
  gRNA
auuccaggauuuaagcaucg

SEQ ID NO: 131484 - RNA, 20 nt, Artificial Sequence
  mmSKRIPTE0002263_Rabgef1_4
  gRNA
gcugaaagaaugcagacccg

SEQ ID NO: 131485 - RNA, 20 nt, Artificial Sequence
  mmSKRIPTE0002264_Rabgef1_5
  gRNA
aggcacuggaauacacaaag

SEQ ID NO: 131486 - RNA, 20 nt, Artificial Sequence
  mmSKRIPTE0002265_Rabgef1_6
  gRNA
augguggugaaagcgaucac

SEQ ID NO: 131487 - RNA, 20 nt, Artificial Sequence
  mmSKRIPTE0002266_Rabgef1_7
  gRNA
cauauuccggaccugaacag

SEQ ID NO: 131488 - RNA, 20 nt, Artificial Sequence
  mmSKRIPTE0002267_Rabgef1_8
  gRNA
gcaaugccuuauaaaagggu

SEQ ID NO: 131489 - RNA, 20 nt, Artificial Sequence
  mmSKRIPTE0002268_Rabgef1_9
  gRNA
agcuguguuagaagacgaug

SEQ ID NO: 131490 - RNA, 20 nt, Artificial Sequence
  mmSKRIPTE0002269_Nlrp12_1
  gRNA
accuccgaaucagacuuccg

SEQ ID NO: 131491 - RNA, 20 nt, Artificial Sequence
  mmSKRIPTE0002270_Nlrp12_2
  gRNA
auucgccuaaucgugcauug

SEQ ID NO: 131492 - RNA, 20 nt, Artificial Sequence
  mmSKRIPTE0002271_Nlrp12_3
  gRNA
uaagugguggagcuaccacg

SEQ ID NO: 131493 - RNA, 20 nt, Artificial Sequence
  mmSKRIPTE0002272_Nlrp12_4
  gRNA
cucacgaccugacacuagug

SEQ ID NO: 131494 - RNA, 20 nt, Artificial Sequence
  mmSKRIPTE0002273_Nlrp12_5
  gRNA
ucgagggauauaccacgcuc

SEQ ID NO: 131495 - RNA, 20 nt, Artificial Sequence
  mmSKRIPTE0002274_Nlrp12_6
  gRNA
ccuacaaagacuauguccga

SEQ ID NO: 131496 - RNA, 20 nt, Artificial Sequence
  mmSKRIPTE0002275_Nlrp12_7
  gRNA
ugguauuacaaggggcagcg

SEQ ID NO: 131497 - RNA, 20 nt, Artificial Sequence
  mmSKRIPTE0002276_Nlrp12_8
  gRNA
cccguccuaaauuaucugcg

SEQ ID NO: 131498 - RNA, 20 nt, Artificial Sequence
  mmSKRIPTE0002277_Nlrp12_9
  gRNA
acaugggggacaaaguaacg

SEQ ID NO: 131499 - RNA, 20 nt, Artificial Sequence
  mmSKRIPTE0002278_Igf1r_1
  gRNA
augaugccuugcaauagucg

SEQ ID NO: 131500 - RNA, 20 nt, Artificial Sequence
  mmSKRIPTE0002279_Igf1r_2
  gRNA
ugucaggugccuacaacgag

SEQ ID NO: 131501 - RNA, 20 nt, Artificial Sequence
  mmSKRIPTE0002280_Igf1r_3
  gRNA
uuggcuguaaguuggcggcg

SEQ ID NO: 131502 - RNA, 20 nt, Artificial Sequence
  mmSKRIPTE0002281_Igf1r_4
  gRNA
aagaaucgaguuucucaacg

SEQ ID NO: 131503 - RNA, 20 nt, Artificial Sequence
  mmSKRIPTE0002282_Igf1r_5
  gRNA
aggauuacggacacgcagug

SEQ ID NO: 131504 - RNA, 20 nt, Artificial Sequence
  mmSKRIPTE0002283_Igf1r_6
  gRNA
agaaccgaaucaucauaacg

SEQ ID NO: 131505 - RNA, 20 nt, Artificial Sequence
  mmSKRIPTE0002284_Igf1r_7
  gRNA
gagacggacuacuaccggaa

SEQ ID NO: 131506 - RNA, 20 nt, Artificial Sequence
  mmSKRIPTE0002285_Igf1r_8
  gRNA
guugcgauauguacccuccg

SEQ ID NO: 131507 - RNA, 20 nt, Artificial Sequence
  mmSKRIPTE0002286_Igf1r_9
  gRNA
ugucgaucuccugagcaccg

SEQ ID NO: 131508 - RNA, 20 nt, Artificial Sequence
  mmSKRIPTE0002287_Zfp809_1
  gRNA
ccaucauggugagcucggcg

SEQ ID NO: 131509 - RNA, 20 nt, Artificial Sequence
  mmSKRIPTE0002288_Zfp809_2
  gRNA
cuuagauaauggucaagcug

SEQ ID NO: 131510 - RNA, 20 nt, Artificial Sequence
  mmSKRIPTE0002289_Zfp809_3
  gRNA
agucaccaaucgaugacgga

SEQ ID NO: 131511 - RNA, 20 nt, Artificial Sequence
  mmSKRIPTE0002290_Zfp809_4
  gRNA
gaucauacggaaagucuuag

SEQ ID NO: 131512 - RNA, 20 nt, Artificial Sequence
  mmSKRIPTE0002291_Zfp809_5
  gRNA
gagucuucuuaugucgagug

SEQ ID NO: 131513 - RNA, 20 nt, Artificial Sequence
  mmSKRIPTE0002292_Zfp809_6
  gRNA
acuuagguuuggcaaugcag

SEQ ID NO: 131514 - RNA, 20 nt, Artificial Sequence
  mmSKRIPTE0002293_Zfp809_7
  gRNA
gugaguaagagacuucgguc

SEQ ID NO: 131515 - RNA, 20 nt, Artificial Sequence
  mmSKRIPTE0002294_Zfp809_8
  gRNA
ccagcucgaguccccacgca

SEQ ID NO: 131516 - RNA, 20 nt, Artificial Sequence
  mmSKRIPTE0002295_Zfp809_9
  gRNA
uaaguaaaacauguaaugcg

SEQ ID NO: 131517 - RNA, 20 nt, Artificial Sequence
  mmSKRIPTE0002296_Iuga1_1
  gRNA
ugcguacaacacccggacag

SEQ ID NO: 131518 - RNA, 20 nt, Artificial Sequence
  mmSKRIPTE0002297_Iuga1_2
  gRNA
auuacucuuccaccgcucca

SEQ ID NO: 131519 - RNA, 20 nt, Artificial Sequence
  mmSKRIPTE0002298_Iuga1_3
  gRNA
cagcagcaaccggaaacgag

SEQ ID NO: 131520 - RNA, 20 nt, Artificial Sequence
  mmSKRIPTE0002299_Iuga1_4
  gRNA
auucggauucucgaacggug

SEQ ID NO: 131521 - RNA, 20 nt, Artificial Sequence
  mmSKRIPTE0002300_Iuga1_5
  gRNA
ugguugucgcgugcacuuug

SEQ ID NO: 131522 - RNA, 20 nt, Artificial Sequence
  mmSKRIPTE0002301_Iuga1_6
  gRNA
cacaacagacuugcgccggg

SEQ ID NO: 131523 - RNA, 20 nt, Artificial Sequence
  mmSKRIPTE0002302_Iuga1_7
  gRNA
cuaugacuggaacggaacug

SEQ ID NO: 131524 - RNA, 20 nt, Artificial Sequence
  mmSKRIPTE0002303_Iuga1_8
  gRNA
aaguuucucacacugcuacg

SEQ ID NO: 131525 - RNA, 20 nt, Artificial Sequence
  mmSKRIPTE0002304_Iuga1_9
  gRNA
accaaaugguuccgcuagcg

SEQ ID NO: 131526 - RNA, 20 nt, Artificial Sequence
  mmSKRIPTE0002305_Gnrh1_1
  gRNA
cggaggcacaucacguucgu

SEQ ID NO: 131527 - RNA, 20 nt, Artificial Sequence
  mmSKRIPTE0002306_Gnrh1_2
  gRNA
ucacagcgucauccuuuacg

SEQ ID NO: 131528 - RNA, 20 nt, Artificial Sequence
  mmSKRIPTE0002307_Gnrh1_3
  gRNA
ucagggucaauguuauacuc

SEQ ID NO: 131529 - RNA, 20 nt, Artificial Sequence
  mmSKRIPTE0002308_Gnrh1_4
  gRNA
agaucccugaggggugaacg

SEQ ID NO: 131530 - RNA, 20 nt, Artificial Sequence
  mmSKRIPTE0002309_Gnrh1_5
  gRNA
acaguacauucgaagugcug

SEQ ID NO: 131531 - RNA, 20 nt, Artificial Sequence
  mmSKRIPTE0002310_Gnrh1_6
  gRNA
ucuuuguccaaagugcaagg

SEQ ID NO: 131532 - RNA, 20 nt, Artificial Sequence
  mmSKRIPTE0002311_Gnrh1_7
  gRNA
ugagugcucuuuaagcacag

SEQ ID NO: 131533 - RNA, 20 nt, Artificial Sequence
  mmSKRIPTE0002312_Gnrh1_8
  gRNA
gucuugagcuucauagacau

SEQ ID NO: 131534 - RNA, 20 nt, Artificial Sequence
  mmSKRIPTE0002313_Gnrh1_9
  gRNA
cuaaaauccagaucuaagga

SEQ ID NO: 131535 - RNA, 20 nt, Artificial Sequence
  mmSKRIPTE0002314_Pibf1_1
  gRNA
aaaacgcauuaccgaacucg

SEQ ID NO: 131536 - RNA, 20 nt, Artificial Sequence
  mmSKRIPTE0002315_Pibf1_2
  gRNA
cccaaucaccgcgaccgucg

SEQ ID NO: 131537 - RNA, 20 nt, Artificial Sequence
  mmSKRIPTE0002316_Pibf1_3
  gRNA
acucucgcgagaaaacacga

SEQ ID NO: 131538 - RNA, 20 nt, Artificial Sequence
  mmSKRIPTE0002317_Pibf1_4
  gRNA
caggugggacgaguaccucg

SEQ ID NO: 131539 - RNA, 20 nt, Artificial Sequence
  mmSKRIPTE0002318_Pibf1_5
  gRNA
gguccuugguaacucacgca

SEQ ID NO: 131540 - RNA, 20 nt, Artificial Sequence
  mmSKRIPTE0002319_Pibf1_6
  gRNA
accccucaacagguaucucg

SEQ ID NO: 131541 - RNA, 20 nt, Artificial Sequence
  mmSKRIPTE0002320_Pibf1_7
  gRNA
gcucagcaaauaacugucgg

SEQ ID NO: 131542 - RNA, 20 nt, Artificial Sequence
  mmSKRIPTE0002321_Pibf1_8
  gRNA
cgccgugccccagaagaagu

SEQ ID NO: 131543 - RNA, 20 nt, Artificial Sequence
  mmSKRIPTE0002322_Pibf1_9
  gRNA
aauguauaacaguaacgcac

SEQ ID NO: 131544 - RNA, 20 nt, Artificial Sequence
  mmSKRIPTE0002323_Drosha_1
  gRNA
uuaagacaacaaccgcagug

SEQ ID NO: 131545 - RNA, 20 nt, Artificial Sequence
  mmSKRIPTE0002324_Drosha_2
  gRNA
augcuaaaggaggagccgcg

SEQ ID NO: 131546 - RNA, 20 nt, Artificial Sequence
  mmSKRIPTE0002325_Drosha_3
  gRNA
acagucugacaacaacccga

SEQ ID NO: 131547 - RNA, 20 nt, Artificial Sequence
  mmSKRIPTE0002326_Drosha_4
  gRNA
gaccuguagacaaugucgau

SEQ ID NO: 131548 - RNA, 20 nt, Artificial Sequence
  mmSKRIPTE0002327_Drosha_5
  gRNA
gcaucuuagugucaaucacg

SEQ ID NO: 131549 - RNA, 20 nt, Artificial Sequence
  mmSKRIPTE0002328_Drosha_6
  gRNA
uaccgcucagacuaugaucg

SEQ ID NO: 131550 - RNA, 20 nt, Artificial Sequence
  mmSKRIPTE0002329_Drosha_7
  gRNA
aaagugcgugaaaaucaccg

SEQ ID NO: 131551 - RNA, 20 nt, Artificial Sequence
  mmSKRIPTE0002330_Drosha_8
  gRNA
ugaccaucauaguccccgag

SEQ ID NO: 131552 - RNA, 20 nt, Artificial Sequence
  mmSKRIPTE0002331_Drosha_9
  gRNA
uauacgugggcuaacacggg

SEQ ID NO: 131553 - RNA, 20 nt, Artificial Sequence
  mmSKRIPTE0002332_Lrrk2_1
  gRNA
ucgugaacaagauguacgga

SEQ ID NO: 131554 - RNA, 20 nt, Artificial Sequence
  mmSKRIPTE0002333_Lrrk2_2
  gRNA
gcaucuagguuggugauacg

SEQ ID NO: 131555 - RNA, 20 nt, Artificial Sequence
  mmSKRIPTE0002334_Lrrk2_3
  gRNA
cggaacggauccgcacugag

SEQ ID NO: 131556 - RNA, 20 nt, Artificial Sequence
  mmSKRIPTE0002335_Lrrk2_4
  gRNA
guacucacauguaaccgcca

SEQ ID NO: 131557 - RNA, 20 nt, Artificial Sequence
  mmSKRIPTE0002336_Lrrk2_5
  gRNA
uguccggugcuacaaucuug

SEQ ID NO: 131558 - RNA, 20 nt, Artificial Sequence
  mmSKRIPTE0002337_Lrrk2_6
  gRNA
agcgaugaucuggauagcga

SEQ ID NO: 131559 - RNA, 20 nt, Artificial Sequence
  mmSKRIPTE0002338_Lrrk2_7
  gRNA
ucgcacgucuaugccgacug

SEQ ID NO: 131560 - RNA, 20 nt, Artificial Sequence
  mmSKRIPTE0002339_Lrrk2_8
  gRNA
agucacgugacguauccacg

SEQ ID NO: 131561 - RNA, 20 nt, Artificial Sequence
  mmSKRIPTE0002340_Lrrk2_9
  gRNA
cuugauauaucacacgaaca

SEQ ID NO: 131562 - RNA, 20 nt, Artificial Sequence
  mmSKRIPTE0002341_Ciiua_1
  gRNA
gcucaacgccagucugacga

SEQ ID NO: 131563 - RNA, 20 nt, Artificial Sequence
  mmSKRIPTE0002342_Ciiua_2
  gRNA
aucgucucgugcagacccag

SEQ ID NO: 131564 - RNA, 20 nt, Artificial Sequence
  mmSKRIPTE0002343_Ciiua_3
  gRNA
auaugucaucggauuauggu

SEQ ID NO: 131565 - RNA, 20 nt, Artificial Sequence
  mmSKRIPTE0002344_Ciiua_4
  gRNA
ccauuggagcaguaguacac

SEQ ID NO: 131566 - RNA, 20 nt, Artificial Sequence
  mmSKRIPTE0002345_Ciiua_5
  gRNA
aguucuuacuccugcacccg

SEQ ID NO: 131567 - RNA, 20 nt, Artificial Sequence
  mmSKRIPTE0002346_Ciiua_6
  gRNA
agcucgacuaaggcuccggg

SEQ ID NO: 131568 - RNA, 20 nt, Artificial Sequence
  mmSKRIPTE0002347_Ciiua_7
  gRNA
cuuccguggguucacccggg

SEQ ID NO: 131569 - RNA, 20 nt, Artificial Sequence
  mmSKRIPTE0002348_Ciiua_8
  gRNA
caauugccaaugucggcagu

SEQ ID NO: 131570 - RNA, 20 nt, Artificial Sequence
  mmSKRIPTE0002349_Ciiua_9
  gRNA
gguguuccugaaccccaaag

SEQ ID NO: 131571 - RNA, 20 nt, Artificial Sequence
  mmSKRIPTE0002350_Lrp5_1
  gRNA
cguguacuggaccgacgaug

SEQ ID NO: 131572 - RNA, 20 nt, Artificial Sequence
  mmSKRIPTE0002351_Lrp5_2
  gRNA
uuucugaggacuccaaacgu

SEQ ID NO: 131573 - RNA, 20 nt, Artificial Sequence
  mmSKRIPTE0002352_Lrp5_3
  gRNA
aagucaucuaacaauccuug

SEQ ID NO: 131574 - RNA, 20 nt, Artificial Sequence
  mmSKRIPTE0002353_Lrp5_4
  gRNA
uccaguacauguaccuagug

SEQ ID NO: 131575 - RNA, 20 nt, Artificial Sequence
  mmSKRIPTE0002354_Lrp5_5
  gRNA
aggaccguuugacgaaggau

SEQ ID NO: 131576 - RNA, 20 nt, Artificial Sequence
  mmSKRIPTE0002355_Lrp5_6
  gRNA
ugaggugcgggcuauccgca

SEQ ID NO: 131577 - RNA, 20 nt, Artificial Sequence
  mmSKRIPTE0002356_Lrp5_7
  gRNA
accuaaccaagugccacaag

SEQ ID NO: 131578 - RNA, 20 nt, Artificial Sequence
  mmSKRIPTE0002357_Lrp5_8
  gRNA
caagacgugcaagacaggug

SEQ ID NO: 131579 - RNA, 20 nt, Artificial Sequence
  mmSKRIPTE0002358_Lrp5_9
  gRNA
ggaguagaaaggcucccucg

SEQ ID NO: 131580 - RNA, 20 nt, Artificial Sequence
  mmSKRIPTE0002359_Dock8_1
  gRNA
ucucaggaaacggauucccg

SEQ ID NO: 131581 - RNA, 20 nt, Artificial Sequence
  mmSKRIPTE0002360_Dock8_2
  gRNA
auaugcuggccuauucuccg

SEQ ID NO: 131582 - RNA, 20 nt, Artificial Sequence
  mmSKRIPTE0002361_Dock8_3
  gRNA
agguaaugcgccccgcccgu

SEQ ID NO: 131583 - RNA, 20 nt, Artificial Sequence
  mmSKRIPTE0002362_Dock8_4
  gRNA
uuucuacggaucccgauuug

SEQ ID NO: 131584 - RNA, 20 nt, Artificial Sequence
  mmSKRIPTE0002363_Dock8_5
  gRNA
ccaagaauggcacccccgag

SEQ ID NO: 131585 - RNA, 20 nt, Artificial Sequence
  mmSKRIPTE0002364_Dock8_6
  gRNA
gaucaacagguaagacggcg

SEQ ID NO: 131586 - RNA, 20 nt, Artificial Sequence
  mmSKRIPTE0002365_Dock8_7
  gRNA
aagcagauggcuaacccgga

SEQ ID NO: 131587 - RNA, 20 nt, Artificial Sequence
  mmSKRIPTE0002366_Dock8_8
  gRNA
ggucaccacaggcguagaca

SEQ ID NO: 131588 - RNA, 20 nt, Artificial Sequence
  mmSKRIPTE0002367_Dock8_9
  gRNA
ugacucgaugggucaaucga

SEQ ID NO: 131589 - RNA, 20 nt, Artificial Sequence
  mmSKRIPTE0002368_Lef1_1
  gRNA
gcgcacguaauaacgaugcg

SEQ ID NO: 131590 - RNA, 20 nt, Artificial Sequence
  mmSKRIPTE0002369_Lef1_2
  gRNA
uacaccgcgugugcauucug

SEQ ID NO: 131591 - RNA, 20 nt, Artificial Sequence
  mmSKRIPTE0002370_Lef1_3
  gRNA
ugguggcccuuuaacggaca

SEQ ID NO: 131592 - RNA, 20 nt, Artificial Sequence
  mmSKRIPTE0002371_Lef1_4
  gRNA
gaauggugguuuacgccaca

SEQ ID NO: 131593 - RNA, 20 nt, Artificial Sequence
  mmSKRIPTE0002372_Lef1_5
  gRNA
gcaaacuaugcauuggccug

SEQ ID NO: 131594 - RNA, 20 nt, Artificial Sequence
  mmSKRIPTE0002373_Lef1_6
  gRNA
uugaaaagcauacccccacg

SEQ ID NO: 131595 - RNA, 20 nt, Artificial Sequence
  mmSKRIPTE0002374_Lef1_7
  gRNA
gcggaucauuguaaccaucg

SEQ ID NO: 131596 - RNA, 20 nt, Artificial Sequence
  mmSKRIPTE0002375_Lef1_8
  gRNA
uacaggagucgacuucaggu

SEQ ID NO: 131597 - RNA, 20 nt, Artificial Sequence
  mmSKRIPTE0002376_Lef1_9
  gRNA
guacccaagcccaugcgaca

SEQ ID NO: 131598 - RNA, 20 nt, Artificial Sequence
  mmSKRIPTE0002377_Nkx3-2_1
  gRNA
gaauaauaaauagcgucccg

SEQ ID NO: 131599 - RNA, 20 nt, Artificial Sequence
  mmSKRIPTE0002378_Nkx3-2_2
  gRNA
agaaccugucagacucgcag

SEQ ID NO: 131600 - RNA, 20 nt, Artificial Sequence
  mmSKRIPTE0002379_Nkx3-2_3
  gRNA
aggccggcgagaauugucaa

SEQ ID NO: 131601 - RNA, 20 nt, Artificial Sequence
  mmSKRIPTE0002380_Nkx3-2_4
  gRNA
gucgcuacaagaccaaacgc

SEQ ID NO: 131602 - RNA, 20 nt, Artificial Sequence
  mmSKRIPTE0002381_Nkx3-2_5
  gRNA
aggcgacugcagacgcggag

SEQ ID NO: 131603 - RNA, 20 nt, Artificial Sequence
  mmSKRIPTE0002382_Nkx3-2_6
  gRNA
cccgaaccagaacagccgug

SEQ ID NO: 131604 - RNA, 20 nt, Artificial Sequence
  mmSKRIPTE0002383_Nkx3-2_7
  gRNA
ucagcgcuaccuguccgggc

SEQ ID NO: 131605 - RNA, 20 nt, Artificial Sequence
  mmSKRIPTE0002384_Nkx3-2_8
  gRNA
gccgauuaucucuucgcccg

SEQ ID NO: 131606 - RNA, 20 nt, Artificial Sequence
  mmSKRIPTE0002385_Nkx3-2_9
  gRNA
gcgcuucuuucgcgguuuag

SEQ ID NO: 131607 - RNA, 20 nt, Artificial Sequence
  mmSKRIPTE0002386_Oas3_1
  gRNA
cuccuggaguccauguaccg

SEQ ID NO: 131608 - RNA, 20 nt, Artificial Sequence
  mmSKRIPTE0002387_Oas3_2
  gRNA
uaggggugaagaugccggaa

SEQ ID NO: 131609 - RNA, 20 nt, Artificial Sequence
  mmSKRIPTE0002388_Oas3_3
  gRNA
augaggucuguguagacccg

SEQ ID NO: 131610 - RNA, 20 nt, Artificial Sequence
  mmSKRIPTE0002389_Oas3_4
  gRNA
gagaggggucccaucccgca

SEQ ID NO: 131611 - RNA, 20 nt, Artificial Sequence
  mmSKRIPTE0002390_Oas3_5
  gRNA
uggauccagcugauccaacg

SEQ ID NO: 131612 - RNA, 20 nt, Artificial Sequence
  mmSKRIPTE0002391_Oas3_6
  gRNA
gacagaugccaauagcuacg

SEQ ID NO: 131613 - RNA, 20 nt, Artificial Sequence
  mmSKRIPTE0002392_Oas3_7
  gRNA
ccaaccagagacccgucaag

SEQ ID NO: 131614 - RNA, 20 nt, Artificial Sequence
  mmSKRIPTE0002393_Oas3_8
  gRNA
accuggccugcuauacacca

SEQ ID NO: 131615 - RNA, 20 nt, Artificial Sequence
  mmSKRIPTE0002394_Oas3_9
  gRNA
gugauuacagaugugccucg

SEQ ID NO: 131616 - RNA, 20 nt, Artificial Sequence
  mmSKRIPTE0002395_Hcar2_1
  gRNA
ucgaauuuagagaaacggcg

SEQ ID NO: 131617 - RNA, 20 nt, Artificial Sequence
  mmSKRIPTE0002396_Hcar2_2
  gRNA
ccgagaugaaaacaucgcca

SEQ ID NO: 131618 - RNA, 20 nt, Artificial Sequence
  mmSKRIPTE0002397_Hcar2_3
  gRNA
auuuggccguucguugaaca

SEQ ID NO: 131619 - RNA, 20 nt, Artificial Sequence
  mmSKRIPTE0002398_Hcar2_4
  gRNA
cugacaugacauaaagccga

SEQ ID NO: 131620 - RNA, 20 nt, Artificial Sequence
  mmSKRIPTE0002399_Hcar2_5
  gRNA
guucugcucaaagucacgga

SEQ ID NO: 131621 - RNA, 20 nt, Artificial Sequence
  mmSKRIPTE0002400_Hcar2_6
  gRNA
gaacaagaucuccaaccgga

SEQ ID NO: 131622 - RNA, 20 nt, Artificial Sequence
  mmSKRIPTE0002401_Hcar2_7
  gRNA
aaagaaagccagguccaccg

SEQ ID NO: 131623 - RNA, 20 nt, Artificial Sequence
  mmSKRIPTE0002402_Hcar2_8
  gRNA
acucgccuugagccuucgcu

SEQ ID NO: 131624 - RNA, 20 nt, Artificial Sequence
  mmSKRIPTE0002403_Hcar2_9
  gRNA
gacaggcuagguaggacccu

SEQ ID NO: 131625 - RNA, 20 nt, Artificial Sequence
  mmSKRIPTE0002404_Zfp36_1
  gRNA
gaucgccgguaucuggaccg

SEQ ID NO: 131626 - RNA, 20 nt, Artificial Sequence
  mmSKRIPTE0002405_Zfp36_2
  gRNA
aagcgggcguugucgcuacg

SEQ ID NO: 131627 - RNA, 20 nt, Artificial Sequence
  mmSKRIPTE0002406_Zfp36_3
  gRNA
gacuucugcgaaccgacagu

SEQ ID NO: 131628 - RNA, 20 nt, Artificial Sequence
  mmSKRIPTE0002407_Zfp36_4
  gRNA
gcuagucugagaagguacgg

SEQ ID NO: 131629 - RNA, 20 nt, Artificial Sequence
  mmSKRIPTE0002408_Zfp36_5
  gRNA
cgugaagugcuuuacaacag

SEQ ID NO: 131630 - RNA, 20 nt, Artificial Sequence
  mmSKRIPTE0002409_Zfp36_6
  gRNA
caugaccugucauccgacca

SEQ ID NO: 131631 - RNA, 20 nt, Artificial Sequence
  mmSKRIPTE0002410_Zfp36_7
  gRNA
ggccuaaguuuggugcgucg

SEQ ID NO: 131632 - RNA, 20 nt, Artificial Sequence
  mmSKRIPTE0002411_Zfp36_8
  gRNA
cuagcugauccauacugggu

SEQ ID NO: 131633 - RNA, 20 nt, Artificial Sequence
  mmSKRIPTE0002412_Zfp36_9
  gRNA
gacucgaagagacccuaacc

SEQ ID NO: 131634 - RNA, 20 nt, Artificial Sequence
  mmSKRIPTE0002413_Lrrk1_1
  gRNA
gaguucgagacacuagagcg

SEQ ID NO: 131635 - RNA, 20 nt, Artificial Sequence
  mmSKRIPTE0002414_Lrrk1_2
  gRNA
ccgaugagugacacgaugca

SEQ ID NO: 131636 - RNA, 20 nt, Artificial Sequence
  mmSKRIPTE0002415_Lrrk1_3
  gRNA
uaggacgacagacgagcaug

SEQ ID NO: 131637 - RNA, 20 nt, Artificial Sequence
  mmSKRIPTE0002416_Lrrk1_4
  gRNA
cgguaggcacagguuaacgg

SEQ ID NO: 131638 - RNA, 20 nt, Artificial Sequence
  mmSKRIPTE0002417_Lrrk1_5
  gRNA
ucugccgugcaucuucgucg

SEQ ID NO: 131639 - RNA, 20 nt, Artificial Sequence
  mmSKRIPTE0002418_Lrrk1_6
  gRNA
uaaugccccagcagguaacg

SEQ ID NO: 131640 - RNA, 20 nt, Artificial Sequence
  mmSKRIPTE0002419_Lrrk1_7
  gRNA
cauccucuaagggcgaggcu

SEQ ID NO: 131641 - RNA, 20 nt, Artificial Sequence
  mmSKRIPTE0002420_Lrrk1_8
  gRNA
cauacgaaugccuccagggu

SEQ ID NO: 131642 - RNA, 20 nt, Artificial Sequence
  mmSKRIPTE0002421_Lrrk1_9
  gRNA
acaugcccaagugcaaaucg

SEQ ID NO: 131643 - RNA, 20 nt, Artificial Sequence
  mmSKRIPTE0002422_Cdkn1c_1
  gRNA
gcugcacccuccaaucgccg

SEQ ID NO: 131644 - RNA, 20 nt, Artificial Sequence
  mmSKRIPTE0002423_Cdkn1c_2
  gRNA
ucaucucagacguuugcgcg

SEQ ID NO: 131645 - RNA, 20 nt, Artificial Sequence
  mmSKRIPTE0002424_Cdkn1c_3
  gRNA
cguggucuacaggcccgaag

SEQ ID NO: 131646 - RNA, 20 nt, Artificial Sequence
  mmSKRIPTE0002425_Cdkn1c_4
  gRNA
uaaacaaagcugacccgccg

SEQ ID NO: 131647 - RNA, 20 nt, Artificial Sequence
  mmSKRIPTE0002426_Cdkn1c_5
  gRNA
ccguggcauuaaagggcccg

SEQ ID NO: 131648 - RNA, 20 nt, Artificial Sequence
  mmSKRIPTE0002427_Cdkn1c_6
  gRNA
ucaauaacccagcaguugcg

SEQ ID NO: 131649 - RNA, 20 nt, Artificial Sequence
  mmSKRIPTE0002428_Cdkn1c_7
  gRNA
ccguccaucaccaaucagcc

SEQ ID NO: 131650 - RNA, 20 nt, Artificial Sequence
  mmSKRIPTE0002429_Cdkn1c_8
  gRNA
guacacgucggacaugccca

SEQ ID NO: 131651 - RNA, 20 nt, Artificial Sequence
  mmSKRIPTE0002430_Cdkn1c_9
  gRNA
gcgcguauaaaggggcgcag

SEQ ID NO: 131652 - RNA, 20 nt, Artificial Sequence
  mmSKRIPTE0002431_Casp3_1
  gRNA
ucucacucgcguuaacagga

SEQ ID NO: 131653 - RNA, 20 nt, Artificial Sequence
  mmSKRIPTE0002432_Casp3_2
  gRNA
aagcgcaguguccugcggcg

SEQ ID NO: 131654 - RNA, 20 nt, Artificial Sequence
  mmSKRIPTE0002433_Casp3_3
  gRNA
aaggccggcguuuaaaagga

SEQ ID NO: 131655 - RNA, 20 nt, Artificial Sequence
  mmSKRIPTE0002434_Casp3_4
  gRNA
ccuaggaggcaaaaauacga

SEQ ID NO: 131656 - RNA, 20 nt, Artificial Sequence
  mmSKRIPTE0002435_Casp3_5
  gRNA
cgacuggcgugugcgagaug

SEQ ID NO: 131657 - RNA, 20 nt, Artificial Sequence
  mmSKRIPTE0002436_Casp3_6
  gRNA
ccgcccaccgaagcuuccga

SEQ ID NO: 131658 - RNA, 20 nt, Artificial Sequence
  mmSKRIPTE0002437_Casp3_7
  gRNA
aaugucaucucgcucuggua

SEQ ID NO: 131659 - RNA, 20 nt, Artificial Sequence
  mmSKRIPTE0002438_Casp3_8
  gRNA
ccaaaagagcgccagcuccg

SEQ ID NO: 131660 - RNA, 20 nt, Artificial Sequence
  mmSKRIPTE0002439_Casp3_9
  gRNA
gaugucuugugugcuaacag

SEQ ID NO: 131661 - RNA, 20 nt, Artificial Sequence
  mmSKRIPTE0002440_Map2k1_1
  gRNA
gaugacgcggaaauacguca

SEQ ID NO: 131662 - RNA, 20 nt, Artificial Sequence
  mmSKRIPTE0002441_Map2k1_2
  gRNA
cgcuucgccgacagccaaug

SEQ ID NO: 131663 - RNA, 20 nt, Artificial Sequence
  mmSKRIPTE0002442_Map2k1_3
  gRNA
cguaggccucgccguccuug

SEQ ID NO: 131664 - RNA, 20 nt, Artificial Sequence
  mmSKRIPTE0002443_Map2k1_4
  gRNA
aguguggaugaugcagcacg

SEQ ID NO: 131665 - RNA, 20 nt, Artificial Sequence
  mmSKRIPTE0002444_Map2k1_5
  gRNA
gauggugugccuauaauggg

SEQ ID NO: 131666 - RNA, 20 nt, Artificial Sequence
  mmSKRIPTE0002445_Map2k1_6
  gRNA
gggcacgagauccuacaugu

SEQ ID NO: 131667 - RNA, 20 nt, Artificial Sequence
  mmSKRIPTE0002446_Map2k1_7
  gRNA
cacaaagccaauccacuuag

SEQ ID NO: 131668 - RNA, 20 nt, Artificial Sequence
  mmSKRIPTE0002447_Map2k1_8
  gRNA
acauucuagugaacucacgu

SEQ ID NO: 131669 - RNA, 20 nt, Artificial Sequence
  mmSKRIPTE0002448_Map2k1_9
  gRNA
uagaggccuaggagacccgg

SEQ ID NO: 131670 - RNA, 20 nt, Artificial Sequence
  mmSKRIPTE0002449_Cadm1_1
  gRNA
auaucgaucaucaaguuacg

SEQ ID NO: 131671 - RNA, 20 nt, Artificial Sequence
  mmSKRIPTE0002450_Cadm1_2
  gRNA
auggccaucaucagccgaag

SEQ ID NO: 131672 - RNA, 20 nt, Artificial Sequence
  mmSKRIPTE0002451_Cadm1_3
  gRNA
ggaucagugccgcggccgaa

SEQ ID NO: 131673 - RNA, 20 nt, Artificial Sequence
  mmSKRIPTE0002452_Cadm1_4
  gRNA
gugcauucaucucggcacag

SEQ ID NO: 131674 - RNA, 20 nt, Artificial Sequence
  mmSKRIPTE0002453_Cadm1_5
  gRNA
uaacgguacuuaccgcugug

SEQ ID NO: 131675 - RNA, 20 nt, Artificial Sequence
  mmSKRIPTE0002454_Cadm1_6
  gRNA
auuagcaaaaacauccgagg

SEQ ID NO: 131676 - RNA, 20 nt, Artificial Sequence
  mmSKRIPTE0002455_Cadm1_7
  gRNA
gagcguggcaaggaaagucg

SEQ ID NO: 131677 - RNA, 20 nt, Artificial Sequence
  mmSKRIPTE0002456_Cadm1_8
  gRNA
aacucaaauaggguucggca

SEQ ID NO: 131678 - RNA, 20 nt, Artificial Sequence
  mmSKRIPTE0002457_Cadm1_9
  gRNA
augagaacgugaagauacug

SEQ ID NO: 131679 - RNA, 20 nt, Artificial Sequence
  mmSKRIPTE0002458_Bcr_1
  gRNA
ucuuucagaccccgucgcaa

SEQ ID NO: 131680 - RNA, 20 nt, Artificial Sequence
  mmSKRIPTE0002459_Bcr_2
  gRNA
cccucucagugauaguaggu

SEQ ID NO: 131681 - RNA, 20 nt, Artificial Sequence
  mmSKRIPTE0002460_Bcr_3
  gRNA
aacggugcuccuguacugcg

SEQ ID NO: 131682 - RNA, 20 nt, Artificial Sequence
  mmSKRIPTE0002461_Bcr_4
  gRNA
uuguauucagugccgcacag

SEQ ID NO: 131683 - RNA, 20 nt, Artificial Sequence
  mmSKRIPTE0002462_Bcr_5
  gRNA
cugacuaugagcgagccgag

SEQ ID NO: 131684 - RNA, 20 nt, Artificial Sequence
  mmSKRIPTE0002463_Bcr_6
  gRNA
agaaugcaggaccuccucgg

SEQ ID NO: 131685 - RNA, 20 nt, Artificial Sequence
  mmSKRIPTE0002464_Bcr_7
  gRNA
ggacugcugcgaauucugcg

SEQ ID NO: 131686 - RNA, 20 nt, Artificial Sequence
  mmSKRIPTE0002465_Bcr_8
  gRNA
gucucuuagauggggcaacg

SEQ ID NO: 131687 - RNA, 20 nt, Artificial Sequence
  mmSKRIPTE0002466_Bcr_9
  gRNA
ugggcggucauaacggacug

SEQ ID NO: 131688 - RNA, 20 nt, Artificial Sequence
  mmSKRIPTE0002467_Ptprq_1
  gRNA
ugaaggacgagagauuaacg

SEQ ID NO: 131689 - RNA, 20 nt, Artificial Sequence
  mmSKRIPTE0002468_Ptprq_2
  gRNA
caaacagaagacaccgugcg

SEQ ID NO: 131690 - RNA, 20 nt, Artificial Sequence
  mmSKRIPTE0002469_Ptprq_3
  gRNA
gggaaacguaguagaagacg

SEQ ID NO: 131691 - RNA, 20 nt, Artificial Sequence
  mmSKRIPTE0002470_Ptprq_4
  gRNA
augccaucaguauuggcccg

SEQ ID NO: 131692 - RNA, 20 nt, Artificial Sequence
  mmSKRIPTE0002471_Ptprq_5
  gRNA
ugggaucauuauugccuacg

SEQ ID NO: 131693 - RNA, 20 nt, Artificial Sequence
  mmSKRIPTE0002472_Ptprq_6
  gRNA
gcaggcgaaugacuguacgu

SEQ ID NO: 131694 - RNA, 20 nt, Artificial Sequence
  mmSKRIPTE0002473_Ptprq_7
  gRNA
uccuccugaaaauguucgcg

SEQ ID NO: 131695 - RNA, 20 nt, Artificial Sequence
  mmSKRIPTE0002474_Ptprq_8
  gRNA
caagagaaguaauagccacg

SEQ ID NO: 131696 - RNA, 20 nt, Artificial Sequence
  mmSKRIPTE0002475_Ptprq_9
  gRNA
gugacacaggaaacuaccgg

SEQ ID NO: 131697 - RNA, 20 nt, Artificial Sequence
  mmSKRIPTE0002476_Erbb2_1
  gRNA
gaacaacacagagaucggca

SEQ ID NO: 131698 - RNA, 20 nt, Artificial Sequence
  mmSKRIPTE0002477_Erbb2_2
  gRNA
caggauugaagcaucgagcg

SEQ ID NO: 131699 - RNA, 20 nt, Artificial Sequence
  mmSKRIPTE0002478_Erbb2_3
  gRNA
gggacccuagaaacgcucca

SEQ ID NO: 131700 - RNA, 20 nt, Artificial Sequence
  mmSKRIPTE0002479_Erbb2_4
  gRNA
uaucauuuaauccacaggcg

SEQ ID NO: 131701 - RNA, 20 nt, Artificial Sequence
  mmSKRIPTE0002480_Erbb2_5
  gRNA
agggagucgcaacuucaugu

SEQ ID NO: 131702 - RNA, 20 nt, Artificial Sequence
  mmSKRIPTE0002481_Erbb2_6
  gRNA
agaccugcuauggaucggug

SEQ ID NO: 131703 - RNA, 20 nt, Artificial Sequence
  mmSKRIPTE0002482_Erbb2_7
  gRNA
gcaggaccaucccuauuccg

SEQ ID NO: 131704 - RNA, 20 nt, Artificial Sequence
  mmSKRIPTE0002483_Erbb2_8
  gRNA
uguguggaccuggacgaacg

SEQ ID NO: 131705 - RNA, 20 nt, Artificial Sequence
  mmSKRIPTE0002484_Erbb2_9
  gRNA
gggcaucguagccuugaucg

SEQ ID NO: 131706 - RNA, 20 nt, Artificial Sequence
  mmSKRIPTE0002485_Csf3_1
  gRNA
gcucauuaaacguuaacggu

SEQ ID NO: 131707 - RNA, 20 nt, Artificial Sequence
  mmSKRIPTE0002486_Csf3_2
  gRNA
agcuugcggauaauaaagug

SEQ ID NO: 131708 - RNA, 20 nt, Artificial Sequence
  mmSKRIPTE0002487_Csf3_3
  gRNA
ugcacuauggucaggacgag

SEQ ID NO: 131709 - RNA, 20 nt, Artificial Sequence
  mmSKRIPTE0002488_Csf3_4
  gRNA
aaauacccgauagagccugc

SEQ ID NO: 131710 - RNA, 20 nt, Artificial Sequence
  mmSKRIPTE0002489_Csf3_5
  gRNA
aaagccaucaaggccccggg

SEQ ID NO: 131711 - RNA, 20 nt, Artificial Sequence
  mmSKRIPTE0002490_Csf3_6
  gRNA
cuacaagcugugucaccccg

SEQ ID NO: 131712 - RNA, 20 nt, Artificial Sequence
  mmSKRIPTE0002491_Csf3_7
  gRNA
gacuuaagcaggaagcuucg

SEQ ID NO: 131713 - RNA, 20 nt, Artificial Sequence
  mmSKRIPTE0002492_Csf3_8
  gRNA
uaguagagaauggcacccag

SEQ ID NO: 131714 - RNA, 20 nt, Artificial Sequence
  mmSKRIPTE0002493_Csf3_9
  gRNA
gagggggggacaagacguca

SEQ ID NO: 131715 - RNA, 20 nt, Artificial Sequence
  mmSKRIPTE0002494_Map3k14_1
  gRNA
acaccccagaugcagcaccg

SEQ ID NO: 131716 - RNA, 20 nt, Artificial Sequence
  mmSKRIPTE0002495_Map3k14_2
  gRNA
gcugucaaaaagguaugccg

SEQ ID NO: 131717 - RNA, 20 nt, Artificial Sequence
  mmSKRIPTE0002496_Map3k14_3
  gRNA
gcaaagcccgaaaaaaacgu

SEQ ID NO: 131718 - RNA, 20 nt, Artificial Sequence
  mmSKRIPTE0002497_Map3k14_4
  gRNA
agagaucaccccgacccacg

SEQ ID NO: 131719 - RNA, 20 nt, Artificial Sequence
  mmSKRIPTE0002498_Map3k14_5
  gRNA
caacagucaugggguauccg

SEQ ID NO: 131720 - RNA, 20 nt, Artificial Sequence
  mmSKRIPTE0002499_Map3k14_6
  gRNA
augacacaccagccucgggu

SEQ ID NO: 131721 - RNA, 20 nt, Artificial Sequence
  mmSKRIPTE0002500_Map3k14_7
  gRNA
cagggcuaagagguccgacg

SEQ ID NO: 131722 - RNA, 20 nt, Artificial Sequence
  mmSKRIPTE0002501_Map3k14_8
  gRNA
gacaccaggggacuauacau

SEQ ID NO: 131723 - RNA, 20 nt, Artificial Sequence
  mmSKRIPTE0002502_Map3k14_9
  gRNA
cuaccgguacuaugauugug

SEQ ID NO: 131724 - RNA, 20 nt, Artificial Sequence
  mmSKRIPTE0002503_Gch1_1
  gRNA
cggccaaugaaaauaucucg

SEQ ID NO: 131725 - RNA, 20 nt, Artificial Sequence
  mmSKRIPTE0002504_Gch1_2
  gRNA
auaaaaagagaggcgcggcg

SEQ ID NO: 131726 - RNA, 20 nt, Artificial Sequence
  mmSKRIPTE0002505_Gch1_3
  gRNA
uuggugcaccugacuccccg

SEQ ID NO: 131727 - RNA, 20 nt, Artificial Sequence
  mmSKRIPTE0002506_Gch1_4
  gRNA
cagugggcauagucuaacgu

SEQ ID NO: 131728 - RNA, 20 nt, Artificial Sequence
  mmSKRIPTE0002507_Gch1_5
  gRNA
aggagccugaaagcacggcg

SEQ ID NO: 131729 - RNA, 20 nt, Artificial Sequence
  mmSKRIPTE0002508_Gch1_6
  gRNA
cucacaacugccgagagcau

SEQ ID NO: 131730 - RNA, 20 nt, Artificial Sequence
  mmSKRIPTE0002509_Gch1_7
  gRNA
cuguggccguuggugcacag

SEQ ID NO: 131731 - RNA, 20 nt, Artificial Sequence
  mmSKRIPTE0002510_Gch1_8
  gRNA
guguagcuguccgagaagug

SEQ ID NO: 131732 - RNA, 20 nt, Artificial Sequence
  mmSKRIPTE0002511_Gch1_9
  gRNA
uagggugcuaacaagcgcug

SEQ ID NO: 131733 - RNA, 20 nt, Artificial Sequence
  mmSKRIPTE0002512_Tagap_1
  gRNA
aagcgcggaacccuaccugu

SEQ ID NO: 131734 - RNA, 20 nt, Artificial Sequence
  mmSKRIPTE0002513_Tagap_2
  gRNA
ggucucguagggucucggaa

SEQ ID NO: 131735 - RNA, 20 nt, Artificial Sequence
  mmSKRIPTE0002514_Tagap_3
  gRNA
aagcugauaagcagucucga

SEQ ID NO: 131736 - RNA, 20 nt, Artificial Sequence
  mmSKRIPTE0002515_Tagap_4
  gRNA
aucccagguuccgauagaca

SEQ ID NO: 131737 - RNA, 20 nt, Artificial Sequence
  mmSKRIPTE0002516_Tagap_5
  gRNA
ccagugcccagggacacacg

SEQ ID NO: 131738 - RNA, 20 nt, Artificial Sequence
  mmSKRIPTE0002517_Tagap_6
  gRNA
gagggggguccacuaccucg

SEQ ID NO: 131739 - RNA, 20 nt, Artificial Sequence
  mmSKRIPTE0002518_Tagap_7
  gRNA
uuaaagguccuucaacggaa

SEQ ID NO: 131740 - RNA, 20 nt, Artificial Sequence
  mmSKRIPTE0002519_Tagap_8
  gRNA
uccccacagaugaucgacaa

SEQ ID NO: 131741 - RNA, 20 nt, Artificial Sequence
  mmSKRIPTE0002520_Tagap_9
  gRNA
cuuacuaugcugguuacggg

SEQ ID NO: 131742 - RNA, 20 nt, Artificial Sequence
  mmSKRIPTE0002521_Epas1_1
  gRNA
agaaaucccgugaugccgcg

SEQ ID NO: 131743 - RNA, 20 nt, Artificial Sequence
  mmSKRIPTE0002522_Epas1_2
  gRNA
uuugcauaaacgccauuuag

SEQ ID NO: 131744 - RNA, 20 nt, Artificial Sequence
  mmSKRIPTE0002523_Epas1_3
  gRNA
cagcuucgaacaccaccgcg

SEQ ID NO: 131745 - RNA, 20 nt, Artificial Sequence
  mmSKRIPTE0002524_Epas1_4
  gRNA
cggacuccggagcuguacac

SEQ ID NO: 131746 - RNA, 20 nt, Artificial Sequence
  mmSKRIPTE0002525_Epas1_5
  gRNA
ggggcuuugaguaagcgagu

SEQ ID NO: 131747 - RNA, 20 nt, Artificial Sequence
  mmSKRIPTE0002526_Epas1_6
  gRNA
uggggauagacacuaacggg

SEQ ID NO: 131748 - RNA, 20 nt, Artificial Sequence
  mmSKRIPTE0002527_Epas1_7
  gRNA
acugauugguuaccaccccg

SEQ ID NO: 131749 - RNA, 20 nt, Artificial Sequence
  mmSKRIPTE0002528_Epas1_8
  gRNA
aguucacugaaguccgucug

SEQ ID NO: 131750 - RNA, 20 nt, Artificial Sequence
  mmSKRIPTE0002529_Epas1_9
  gRNA
augccugaugucacacuacg

SEQ ID NO: 131751 - RNA, 20 nt, Artificial Sequence
  mmSKRIPTE0002530_Chd7_1
  gRNA
uaauauuccuuggcgcugug

SEQ ID NO: 131752 - RNA, 20 nt, Artificial Sequence
  mmSKRIPTE0002531_Chd7_2
  gRNA
cccugcuaaaucauuccggu

SEQ ID NO: 131753 - RNA, 20 nt, Artificial Sequence
  mmSKRIPTE0002532_Chd7_3
  gRNA
gaugaaaguucauugucgag

SEQ ID NO: 131754 - RNA, 20 nt, Artificial Sequence
  mmSKRIPTE0002533_Chd7_4
  gRNA
gguacgacaccuccgcacag

SEQ ID NO: 131755 - RNA, 20 nt, Artificial Sequence
  mmSKRIPTE0002534_Chd7_5
  gRNA
uuauugacacuccucgagug

SEQ ID NO: 131756 - RNA, 20 nt, Artificial Sequence
  mmSKRIPTE0002535_Chd7_6
  gRNA
aauuguuccuccuuucagcg

SEQ ID NO: 131757 - RNA, 20 nt, Artificial Sequence
  mmSKRIPTE0002536_Chd7_7
  gRNA
gugggauucccgucaaacag

SEQ ID NO: 131758 - RNA, 20 nt, Artificial Sequence
  mmSKRIPTE0002537_Chd7_8
  gRNA
cugguaccugaacggcccgg

SEQ ID NO: 131759 - RNA, 20 nt, Artificial Sequence
  mmSKRIPTE0002538_Chd7_9
  gRNA
guggacugaacucaccguga

SEQ ID NO: 131760 - RNA, 20 nt, Artificial Sequence
  mmSKRIPTE0002539_Trim32_1
  gRNA
gauacgauaguugccccggu

SEQ ID NO: 131761 - RNA, 20 nt, Artificial Sequence
  mmSKRIPTE0002540_Trim32_2
  gRNA
uggcagaaauucccgucaag

SEQ ID NO: 131762 - RNA, 20 nt, Artificial Sequence
  mmSKRIPTE0002541_Trim32_3
  gRNA
gagcuucgaccaacaaugug

SEQ ID NO: 131763 - RNA, 20 nt, Artificial Sequence
  mmSKRIPTE0002542_Trim32_4
  gRNA
uacggcaccaucaacaacga

SEQ ID NO: 131764 - RNA, 20 nt, Artificial Sequence
  mmSKRIPTE0002543_Trim32_5
  gRNA
uggcagcgguggacucgcgu

SEQ ID NO: 131765 - RNA, 20 nt, Artificial Sequence
  mmSKRIPTE0002544_Trim32_6
  gRNA
uuuguggugacugacgugga

SEQ ID NO: 131766 - RNA, 20 nt, Artificial Sequence
  mmSKRIPTE0002545_Trim32_7
  gRNA
gcaucgcccucacacccaag

SEQ ID NO: 131767 - RNA, 20 nt, Artificial Sequence
  mmSKRIPTE0002546_Trim32_8
  gRNA
auuuggggacuggaucggag

SEQ ID NO: 131768 - RNA, 20 nt, Artificial Sequence
  mmSKRIPTE0002547_Trim32_9
  gRNA
cugcacacuuccggucaagg

SEQ ID NO: 131769 - RNA, 20 nt, Artificial Sequence
  mmSKRIPTE0002548_Tnfrsf8_1
  gRNA
cauuagaagugauuucaccg

SEQ ID NO: 131770 - RNA, 20 nt, Artificial Sequence
  mmSKRIPTE0002549_Tnfrsf8_2
  gRNA
augugugcagcauccguucg

SEQ ID NO: 131771 - RNA, 20 nt, Artificial Sequence
  mmSKRIPTE0002550_Tnfrsf8_3
  gRNA
agauggucccagauucggga

SEQ ID NO: 131772 - RNA, 20 nt, Artificial Sequence
  mmSKRIPTE0002551_Tnfrsf8_4
  gRNA
ggccagagugacacuucgug

SEQ ID NO: 131773 - RNA, 20 nt, Artificial Sequence
  mmSKRIPTE0002552_Tnfrsf8_5
  gRNA
aagccagaaucucugucucg

SEQ ID NO: 131774 - RNA, 20 nt, Artificial Sequence
  mmSKRIPTE0002553_Tnfrsf8_6
  gRNA
gagcgcccuacucaccgcag

SEQ ID NO: 131775 - RNA, 20 nt, Artificial Sequence
  mmSKRIPTE0002554_Tnfrsf8_7
  gRNA
uuagggcugaacccgaagaa

SEQ ID NO: 131776 - RNA, 20 nt, Artificial Sequence
  mmSKRIPTE0002555_Tnfrsf8_8
  gRNA
agauccuggucuaaucaugu

SEQ ID NO: 131777 - RNA, 20 nt, Artificial Sequence
  mmSKRIPTE0002556_Tnfrsf8_9
  gRNA
gucaccuaguaagugucuug

SEQ ID NO: 131778 - RNA, 20 nt, Artificial Sequence
  mmSKRIPTE0002557_Serpine1_1
  gRNA
agucacugaucauaccuaag

SEQ ID NO: 131779 - RNA, 20 nt, Artificial Sequence
  mmSKRIPTE0002558_Serpine1_2
  gRNA
cugguuauccaauugcauug

SEQ ID NO: 131780 - RNA, 20 nt, Artificial Sequence
  mmSKRIPTE0002559_Serpine1_3
  gRNA
gguaaacgagagcggcacag

SEQ ID NO: 131781 - RNA, 20 nt, Artificial Sequence
  mmSKRIPTE0002560_Serpine1_4
  gRNA
ccaucugggaaacuccgcaa

SEQ ID NO: 131782 - RNA, 20 nt, Artificial Sequence
  mmSKRIPTE0002561_Serpine1_5
  gRNA
gcaccuuugaauacucaggu

SEQ ID NO: 131783 - RNA, 20 nt, Artificial Sequence
  mmSKRIPTE0002562_Serpine1_6
  gRNA
cccaucacgaggcuacccag

SEQ ID NO: 131784 - RNA, 20 nt, Artificial Sequence
  mmSKRIPTE0002563_Serpine1_7
  gRNA
auuauuuaaaggacucuaug

SEQ ID NO: 131785 - RNA, 20 nt, Artificial Sequence
  mmSKRIPTE0002564_Serpine1_8
  gRNA
ggcucaagaaaacgucuacg

SEQ ID NO: 131786 - RNA, 20 nt, Artificial Sequence
  mmSKRIPTE0002565_Serpine1_9
  gRNA
cgucauacucgagcccaucg

SEQ ID NO: 131787 - RNA, 20 nt, Artificial Sequence
  mmSKRIPTE0002566_Abcc9_1
  gRNA
ucgauaauggaucaaguccg

SEQ ID NO: 131788 - RNA, 20 nt, Artificial Sequence
  mmSKRIPTE0002567_Abcc9_2
  gRNA
uuuagacacuguaaccaacg

SEQ ID NO: 131789 - RNA, 20 nt, Artificial Sequence
  mmSKRIPTE0002568_Abcc9_3
  gRNA
caccauacaggauaaccaug

SEQ ID NO: 131790 - RNA, 20 nt, Artificial Sequence
  mmSKRIPTE0002569_Abcc9_4
  gRNA
uccaugcguuuacccuccag

SEQ ID NO: 131791 - RNA, 20 nt, Artificial Sequence
  mmSKRIPTE0002570_Abcc9_5
  gRNA
aauguuaugauaauagacga

SEQ ID NO: 131792 - RNA, 20 nt, Artificial Sequence
  mmSKRIPTE0002571_Abcc9_6
  gRNA
cugcugcgugaauuguaaag

SEQ ID NO: 131793 - RNA, 20 nt, Artificial Sequence
  mmSKRIPTE0002572_Abcc9_7
  gRNA
cauguuugugagauagcgga

SEQ ID NO: 131794 - RNA, 20 nt, Artificial Sequence
  mmSKRIPTE0002573_Abcc9_8
  gRNA
gaaaccgaaugguucuuucg

SEQ ID NO: 131795 - RNA, 20 nt, Artificial Sequence
  mmSKRIPTE0002574_Abcc9_9
  gRNA
cuauggcgccaacagaggau

SEQ ID NO: 131796 - RNA, 20 nt, Artificial Sequence
  mmSKRIPTE0002575_Myo9b_1
  gRNA
gaugccguaggucuaguggc

SEQ ID NO: 131797 - RNA, 20 nt, Artificial Sequence
  mmSKRIPTE0002576_Myo9b_2
  gRNA
cccuauccacgcuaucaccg

SEQ ID NO: 131798 - RNA, 20 nt, Artificial Sequence
  mmSKRIPTE0002577_Myo9b_3
  gRNA
acuguacucacauaugcgcg

SEQ ID NO: 131799 - RNA, 20 nt, Artificial Sequence
  mmSKRIPTE0002578_Myo9b_4
  gRNA
cccuggccugcugauacuaa

SEQ ID NO: 131800 - RNA, 20 nt, Artificial Sequence
  mmSKRIPTE0002579_Myo9b_5
  gRNA
ugauaggagaacuguaggcg

SEQ ID NO: 131801 - RNA, 20 nt, Artificial Sequence
  mmSKRIPTE0002580_Myo9b_6
  gRNA
ggaguugcaagaccuuuggu

SEQ ID NO: 131802 - RNA, 20 nt, Artificial Sequence
  mmSKRIPTE0002581_Myo9b_7
  gRNA
caccagagaugacgauacac

SEQ ID NO: 131803 - RNA, 20 nt, Artificial Sequence
  mmSKRIPTE0002582_Myo9b_8
  gRNA
cuacaugcggccugacaucg

SEQ ID NO: 131804 - RNA, 20 nt, Artificial Sequence
  mmSKRIPTE0002583_Myo9b_9
  gRNA
gaucccgccuacucucuaug

SEQ ID NO: 131805 - RNA, 20 nt, Artificial Sequence
  mmSKRIPTE0002584_Fli1_1
  gRNA
ccuguuacauaucccccgga

SEQ ID NO: 131806 - RNA, 20 nt, Artificial Sequence
  mmSKRIPTE0002585_Fli1_2
  gRNA
agaaaccuuacuccucggua

SEQ ID NO: 131807 - RNA, 20 nt, Artificial Sequence
  mmSKRIPTE0002586_Fli1_3
  gRNA
ggaucaggauagguuccacg

SEQ ID NO: 131808 - RNA, 20 nt, Artificial Sequence
  mmSKRIPTE0002587_Fli1_4
  gRNA
cccuucagauuagcccggcg

SEQ ID NO: 131809 - RNA, 20 nt, Artificial Sequence
  mmSKRIPTE0002588_Fli1_5
  gRNA
auuacucgucuacguugacu

SEQ ID NO: 131810 - RNA, 20 nt, Artificial Sequence
  mmSKRIPTE0002589_Fli1_6
  gRNA
uagagcagggucguccaagg

SEQ ID NO: 131811 - RNA, 20 nt, Artificial Sequence
  mmSKRIPTE0002590_Fli1_7
  gRNA
aauccacaugugcauucacg

SEQ ID NO: 131812 - RNA, 20 nt, Artificial Sequence
  mmSKRIPTE0002591_Fli1_8
  gRNA
acuucacuuugcgaucgggg

SEQ ID NO: 131813 - RNA, 20 nt, Artificial Sequence
  mmSKRIPTE0002592_Fli1_9
  gRNA
acuacacaaauccagacggu

SEQ ID NO: 131814 - RNA, 20 nt, Artificial Sequence
  mmSKRIPTE0002593_Smad3_1
  gRNA
gcggcucuacuacaucggag

SEQ ID NO: 131815 - RNA, 20 nt, Artificial Sequence
  mmSKRIPTE0002594_Smad3_2
  gRNA
guacagccuugaugacgaug

SEQ ID NO: 131816 - RNA, 20 nt, Artificial Sequence
  mmSKRIPTE0002595_Smad3_3
  gRNA
augaaccacagcauggacgc

SEQ ID NO: 131817 - RNA, 20 nt, Artificial Sequence
  mmSKRIPTE0002596_Smad3_4
  gRNA
gccaagaaaaacaucguuag

SEQ ID NO: 131818 - RNA, 20 nt, Artificial Sequence
  mmSKRIPTE0002597_Smad3_5
  gRNA
acuuuguguuccugccgcag

SEQ ID NO: 131819 - RNA, 20 nt, Artificial Sequence
  mmSKRIPTE0002598_Smad3_6
  gRNA
ugggcgagacgcgacaugug

SEQ ID NO: 131820 - RNA, 20 nt, Artificial Sequence
  mmSKRIPTE0002599_Smad3_7
  gRNA
acgacauggcuggcaccgaa

SEQ ID NO: 131821 - RNA, 20 nt, Artificial Sequence
  mmSKRIPTE0002600_Smad3_8
  gRNA
ccaacacagccuauacauca

SEQ ID NO: 131822 - RNA, 20 nt, Artificial Sequence
  mmSKRIPTE0002601_Smad3_9
  gRNA
cauacuacggucccacccag

SEQ ID NO: 131823 - RNA, 20 nt, Artificial Sequence
  mmSKRIPTE0002602_Onecuu1_1
  gRNA
uugcauguagaguucgacgu

SEQ ID NO: 131824 - RNA, 20 nt, Artificial Sequence
  mmSKRIPTE0002603_Onecuu1_2
  gRNA
ccacuaugcucaucccggcg

SEQ ID NO: 131825 - RNA, 20 nt, Artificial Sequence
  mmSKRIPTE0002604_Onecuu1_3
  gRNA
agcgggcugcaacaucgaug

SEQ ID NO: 131826 - RNA, 20 nt, Artificial Sequence
  mmSKRIPTE0002605_Onecuu1_4
  gRNA
auaaauacccgaccgcaagg

SEQ ID NO: 131827 - RNA, 20 nt, Artificial Sequence
  mmSKRIPTE0002606_Onecuu1_5
  gRNA
gcugugcguucaucgugaug

SEQ ID NO: 131828 - RNA, 20 nt, Artificial Sequence
  mmSKRIPTE0002607_Onecuu1_6
  gRNA
ugccaugcucggucgccacg

SEQ ID NO: 131829 - RNA, 20 nt, Artificial Sequence
  mmSKRIPTE0002608_Onecuu1_7
  gRNA
agggaacuugucggacacgg

SEQ ID NO: 131830 - RNA, 20 nt, Artificial Sequence
  mmSKRIPTE0002609_Onecuu1_8
  gRNA
acgccaugcccauggaacgc

SEQ ID NO: 131831 - RNA, 20 nt, Artificial Sequence
  mmSKRIPTE0002610_Onecuu1_9
  gRNA
accacggacuaguaccucgg

SEQ ID NO: 131832 - RNA, 20 nt, Artificial Sequence
  mmSKRIPTE0002611_Nos2_1
  gRNA
cgacccguccacaguaugug

SEQ ID NO: 131833 - RNA, 20 nt, Artificial Sequence
  mmSKRIPTE0002612_Nos2_2
  gRNA
acccacucuucgcuuacuag

SEQ ID NO: 131834 - RNA, 20 nt, Artificial Sequence
  mmSKRIPTE0002613_Nos2_3
  gRNA
gcagaguucaccgaucagag

SEQ ID NO: 131835 - RNA, 20 nt, Artificial Sequence
  mmSKRIPTE0002614_Nos2_4
  gRNA
caucugguuacaaggugucg

SEQ ID NO: 131836 - RNA, 20 nt, Artificial Sequence
  mmSKRIPTE0002615_Nos2_5
  gRNA
guggucaccuaccgcacccg

SEQ ID NO: 131837 - RNA, 20 nt, Artificial Sequence
  mmSKRIPTE0002616_Nos2_6
  gRNA
cauuugcggagaugugcgca

SEQ ID NO: 131838 - RNA, 20 nt, Artificial Sequence
  mmSKRIPTE0002617_Nos2_7
  gRNA
cuaaaccuuuaugggccgag

SEQ ID NO: 131839 - RNA, 20 nt, Artificial Sequence
  mmSKRIPTE0002618_Nos2_8
  gRNA
uaacuaucaagaccaacaag

SEQ ID NO: 131840 - RNA, 20 nt, Artificial Sequence
  mmSKRIPTE0002619_Nos2_9
  gRNA
gaacccguaaagcuucccuc

SEQ ID NO: 131841 - RNA, 20 nt, Artificial Sequence
  mmSKRIPTE0002620_Rab3b_1
  gRNA
uaggcgccuccaagacgacg

SEQ ID NO: 131842 - RNA, 20 nt, Artificial Sequence
  mmSKRIPTE0002621_Rab3b_2
  gRNA
gauacuaacugcagguuacg

SEQ ID NO: 131843 - RNA, 20 nt, Artificial Sequence
  mmSKRIPTE0002622_Rab3b_3
  gRNA
ugaucccaagaacucgacug

SEQ ID NO: 131844 - RNA, 20 nt, Artificial Sequence
  mmSKRIPTE0002623_Rab3b_4
  gRNA
ggcgagccaccauacucggu

SEQ ID NO: 131845 - RNA, 20 nt, Artificial Sequence
  mmSKRIPTE0002624_Rab3b_5
  gRNA
uaguuauguugauugcauug

SEQ ID NO: 131846 - RNA, 20 nt, Artificial Sequence
  mmSKRIPTE0002625_Rab3b_6
  gRNA
ccaucugcagagaaccgcag

SEQ ID NO: 131847 - RNA, 20 nt, Artificial Sequence
  mmSKRIPTE0002626_Rab3b_7
  gRNA
agaacugcucuuguuagaca

SEQ ID NO: 131848 - RNA, 20 nt, Artificial Sequence
  mmSKRIPTE0002627_Rab3b_8
  gRNA
uagaacuaguugucaauaca

SEQ ID NO: 131849 - RNA, 20 nt, Artificial Sequence
  mmSKRIPTE0002628_Rab3b_9
  gRNA
ucagauuaagaccuacuccu

SEQ ID NO: 131850 - RNA, 20 nt, Artificial Sequence
  mmSKRIPTE0002629_Nme2_1
  gRNA
uccgacuccaaaaggcgacg

SEQ ID NO: 131851 - RNA, 20 nt, Artificial Sequence
  mmSKRIPTE0002630_Nme2_2
  gRNA
cauuggcgaacggaucggaa

SEQ ID NO: 131852 - RNA, 20 nt, Artificial Sequence
  mmSKRIPTE0002631_Nme2_3
  gRNA
agugugauacugacuguucg

SEQ ID NO: 131853 - RNA, 20 nt, Artificial Sequence
  mmSKRIPTE0002632_Nme2_4
  gRNA
cgaagggcguuguuacccga

SEQ ID NO: 131854 - RNA, 20 nt, Artificial Sequence
  mmSKRIPTE0002633_Nme2_5
  gRNA
agaacgaccaccagccggcg

SEQ ID NO: 131855 - RNA, 20 nt, Artificial Sequence
  mmSKRIPTE0002634_Nme2_6
  gRNA
caugaaaccgacacuuauug

SEQ ID NO: 131856 - RNA, 20 nt, Artificial Sequence
  mmSKRIPTE0002635_Nme2_7
  gRNA
gaggucaaaaggauucucgu

SEQ ID NO: 131857 - RNA, 20 nt, Artificial Sequence
  mmSKRIPTE0002636_Nme2_8
  gRNA
uuuauugaacuaccaaaccu

SEQ ID NO: 131858 - RNA, 20 nt, Artificial Sequence
  mmSKRIPTE0002637_Nme2_9
  gRNA
uagccuuaccgaaagccggu

SEQ ID NO: 131859 - RNA, 20 nt, Artificial Sequence
  mmSKRIPTE0002638_Suau5a_1
  gRNA
agagauacuacaacugacgu

SEQ ID NO: 131860 - RNA, 20 nt, Artificial Sequence
  mmSKRIPTE0002639_Suau5a_2
  gRNA
aguggucggucuuguaagcg

SEQ ID NO: 131861 - RNA, 20 nt, Artificial Sequence
  mmSKRIPTE0002640_Suau5a_3
  gRNA
ugucaguucuugcgccaggg

SEQ ID NO: 131862 - RNA, 20 nt, Artificial Sequence
  mmSKRIPTE0002641_Suau5a_4
  gRNA
acacuccccauaaucaggag

SEQ ID NO: 131863 - RNA, 20 nt, Artificial Sequence
  mmSKRIPTE0002642_Suau5a_5
  gRNA
agccugaggacgcucuaugg

SEQ ID NO: 131864 - RNA, 20 nt, Artificial Sequence
  mmSKRIPTE0002643_Suau5a_6
  gRNA
aucaagcgcgccgacaggcg

SEQ ID NO: 131865 - RNA, 20 nt, Artificial Sequence
  mmSKRIPTE0002644_Suau5a_7
  gRNA
gcacgguggcaguagcauug

SEQ ID NO: 131866 - RNA, 20 nt, Artificial Sequence
  mmSKRIPTE0002645_Suau5a_8
  gRNA
ggaccccacaaagcacccgu

SEQ ID NO: 131867 - RNA, 20 nt, Artificial Sequence
  mmSKRIPTE0002646_Suau5a_9
  gRNA
aggcaguguaugucacgcug

SEQ ID NO: 131868 - RNA, 20 nt, Artificial Sequence
  mmSKRIPTE0002647_Csk_1
  gRNA
ucggcaauacagguaucgug

SEQ ID NO: 131869 - RNA, 20 nt, Artificial Sequence
  mmSKRIPTE0002648_Csk_2
  gRNA
ucacacgggagcaggccgag

SEQ ID NO: 131870 - RNA, 20 nt, Artificial Sequence
  mmSKRIPTE0002649_Csk_3
  gRNA
cugcaaaaacgugggccgug

SEQ ID NO: 131871 - RNA, 20 nt, Artificial Sequence
  mmSKRIPTE0002650_Csk_4
  gRNA
cgagggacgacguccuucag

SEQ ID NO: 131872 - RNA, 20 nt, Artificial Sequence
  mmSKRIPTE0002651_Csk_5
  gRNA
ucaccucguagacugcgggc

SEQ ID NO: 131873 - RNA, 20 nt, Artificial Sequence
  mmSKRIPTE0002652_Csk_6
  gRNA
aguuggugcuuucccgcacg

SEQ ID NO: 131874 - RNA, 20 nt, Artificial Sequence
  mmSKRIPTE0002653_Csk_7
  gRNA
cacuacaccacagaugccga

SEQ ID NO: 131875 - RNA, 20 nt, Artificial Sequence
  mmSKRIPTE0002654_Csk_8
  gRNA
aggcugaggagaaccuaccu

SEQ ID NO: 131876 - RNA, 20 nt, Artificial Sequence
  mmSKRIPTE0002655_Csk_9
  gRNA
caguccagcucacgucauga

SEQ ID NO: 131877 - RNA, 20 nt, Artificial Sequence
  mmSKRIPTE0002656_Cd276_1
  gRNA
gugcaggauagguagcgcua

SEQ ID NO: 131878 - RNA, 20 nt, Artificial Sequence
  mmSKRIPTE0002657_Cd276_2
  gRNA
gggacaaacccauucguugg

SEQ ID NO: 131879 - RNA, 20 nt, Artificial Sequence
  mmSKRIPTE0002658_Cd276_3
  gRNA
gcgcguccgaguaaccgacg

SEQ ID NO: 131880 - RNA, 20 nt, Artificial Sequence
  mmSKRIPTE0002659_Cd276_4
  gRNA
caccaucgaaguaccagggg

SEQ ID NO: 131881 - RNA, 20 nt, Artificial Sequence
  mmSKRIPTE0002660_Cd276_5
  gRNA
ccaacaaggaccuacgucca

SEQ ID NO: 131882 - RNA, 20 nt, Artificial Sequence
  mmSKRIPTE0002661_Cd276_6
  gRNA
acgacucuggaggaacaccg

SEQ ID NO: 131883 - RNA, 20 nt, Artificial Sequence
  mmSKRIPTE0002662_Cd276_7
  gRNA
acgauacacgaaccauccug

SEQ ID NO: 131884 - RNA, 20 nt, Artificial Sequence
  mmSKRIPTE0002663_Cd276_8
  gRNA
ugcaaggcaaugcguccuug

SEQ ID NO: 131885 - RNA, 20 nt, Artificial Sequence
  mmSKRIPTE0002664_Cd276_9
  gRNA
uuguucuacggugugaacag

SEQ ID NO: 131886 - RNA, 20 nt, Artificial Sequence
  mmSKRIPTE0002665_Kdm5d_1
  gRNA
uugccgaauaugcucucgug

SEQ ID NO: 131887 - RNA, 20 nt, Artificial Sequence
  mmSKRIPTE0002666_Kdm5d_2
  gRNA
cuauauagccaagaggaucg

SEQ ID NO: 131888 - RNA, 20 nt, Artificial Sequence
  mmSKRIPTE0002667_Kdm5d_3
  gRNA
ggaauugccuacucacugcg

SEQ ID NO: 131889 - RNA, 20 nt, Artificial Sequence
  mmSKRIPTE0002668_Kdm5d_4
  gRNA
ucagucuggagcuaaucuug

SEQ ID NO: 131890 - RNA, 20 nt, Artificial Sequence
  mmSKRIPTE0002669_Kdm5d_5
  gRNA
cuucauguucgcucaaaacg

SEQ ID NO: 131891 - RNA, 20 nt, Artificial Sequence
  mmSKRIPTE0002670_Kdm5d_6
  gRNA
aagcaaauaccagugaacca

SEQ ID NO: 131892 - RNA, 20 nt, Artificial Sequence
  mmSKRIPTE0002671_Kdm5d_7
  gRNA
uucaguugcuacaguagacg

SEQ ID NO: 131893 - RNA, 20 nt, Artificial Sequence
  mmSKRIPTE0002672_Kdm5d_8
  gRNA
cugguaugcuacuccuugug

SEQ ID NO: 131894 - RNA, 20 nt, Artificial Sequence
  mmSKRIPTE0002673_Kdm5d_9
  gRNA
ccuucacuacaauaguugca

SEQ ID NO: 131895 - RNA, 20 nt, Artificial Sequence
  mmSKRIPTE0002674_Il4_1
  gRNA
ugccuggauucaucgguaag

SEQ ID NO: 131896 - RNA, 20 nt, Artificial Sequence
  mmSKRIPTE0002675_Il4_2
  gRNA
accauccggaucgagccggg

SEQ ID NO: 131897 - RNA, 20 nt, Artificial Sequence
  mmSKRIPTE0002676_Il4_3
  gRNA
ccaaagucuugacuuaccag

SEQ ID NO: 131898 - RNA, 20 nt, Artificial Sequence
  mmSKRIPTE0002677_Il4_4
  gRNA
agcaggaugaauccuaucca

SEQ ID NO: 131899 - RNA, 20 nt, Artificial Sequence
  mmSKRIPTE0002678_Il4_5
  gRNA
ugcagcaccgaagccacggu

SEQ ID NO: 131900 - RNA, 20 nt, Artificial Sequence
  mmSKRIPTE0002679_Il4_6
  gRNA
acucucauggaacguucuag

SEQ ID NO: 131901 - RNA, 20 nt, Artificial Sequence
  mmSKRIPTE0002680_Il4_7
  gRNA
uuauucccaugagcacaccu

SEQ ID NO: 131902 - RNA, 20 nt, Artificial Sequence
  mmSKRIPTE0002681_Il4_8
  gRNA
cucaugacagccaaaacgcg

SEQ ID NO: 131903 - RNA, 20 nt, Artificial Sequence
  mmSKRIPTE0002682_Il4_9
  gRNA
cagagagugagcucgucugu

SEQ ID NO: 131904 - RNA, 20 nt, Artificial Sequence
  mmSKRIPTE0002683_Suau5b_1
  gRNA
uagauguguuggcugcugcg

SEQ ID NO: 131905 - RNA, 20 nt, Artificial Sequence
  mmSKRIPTE0002684_Suau5b_2
  gRNA
cugcagcuucaucgcccucg

SEQ ID NO: 131906 - RNA, 20 nt, Artificial Sequence
  mmSKRIPTE0002685_Suau5b_3
  gRNA
caagaggucugaccgccgug

SEQ ID NO: 131907 - RNA, 20 nt, Artificial Sequence
  mmSKRIPTE0002686_Suau5b_4
  gRNA
uuuaagucuagacgucaccc

SEQ ID NO: 131908 - RNA, 20 nt, Artificial Sequence
  mmSKRIPTE0002687_Suau5b_5
  gRNA
guggcaaguagggggcaccg

SEQ ID NO: 131909 - RNA, 20 nt, Artificial Sequence
  mmSKRIPTE0002688_Suau5b_6
  gRNA
aagacacgauggacguggcg

SEQ ID NO: 131910 - RNA, 20 nt, Artificial Sequence
  mmSKRIPTE0002689_Suau5b_7
  gRNA
cauuuagccaacuuaugucg

SEQ ID NO: 131911 - RNA, 20 nt, Artificial Sequence
  mmSKRIPTE0002690_Suau5b_8
  gRNA
aaugccacaugugagaaucg

SEQ ID NO: 131912 - RNA, 20 nt, Artificial Sequence
  mmSKRIPTE0002691_Suau5b_9
  gRNA
auugcguacuagcugcggag

SEQ ID NO: 131913 - RNA, 20 nt, Artificial Sequence
  mmSKRIPTE0002692_Prkcd_1
  gRNA
cguuaggcuccacccuaugg

SEQ ID NO: 131914 - RNA, 20 nt, Artificial Sequence
  mmSKRIPTE0002693_Prkcd_2
  gRNA
ugugucacauuuaacaccgu

SEQ ID NO: 131915 - RNA, 20 nt, Artificial Sequence
  mmSKRIPTE0002694_Prkcd_3
  gRNA
caaacagucuaugcguagug

SEQ ID NO: 131916 - RNA, 20 nt, Artificial Sequence
  mmSKRIPTE0002695_Prkcd_4
  gRNA
gagcccucacauacguagcc

SEQ ID NO: 131917 - RNA, 20 nt, Artificial Sequence
  mmSKRIPTE0002696_Prkcd_5
  gRNA
uuuccaaccaugaaccgucg

SEQ ID NO: 131918 - RNA, 20 nt, Artificial Sequence
  mmSKRIPTE0002697_Prkcd_6
  gRNA
gauuccuuggugauccaacg

SEQ ID NO: 131919 - RNA, 20 nt, Artificial Sequence
  mmSKRIPTE0002698_Prkcd_7
  gRNA
aaguaggcuagugucaagcg

SEQ ID NO: 131920 - RNA, 20 nt, Artificial Sequence
  mmSKRIPTE0002699_Prkcd_8
  gRNA
auccggcagaaacuacccug

SEQ ID NO: 131921 - RNA, 20 nt, Artificial Sequence
  mmSKRIPTE0002700_Prkcd_9
  gRNA
cagggcuaaaauccagcgug

SEQ ID NO: 131922 - RNA, 20 nt, Artificial Sequence
  mmSKRIPTE0002701_Tarbp2_1
  gRNA
gacccuacauauaggcugag

SEQ ID NO: 131923 - RNA, 20 nt, Artificial Sequence
  mmSKRIPTE0002702_Tarbp2_2
  gRNA
gacugucuaaguuaaccuag

SEQ ID NO: 131924 - RNA, 20 nt, Artificial Sequence
  mmSKRIPTE0002703_Tarbp2_3
  gRNA
acaccugcagagcaccgacg

SEQ ID NO: 131925 - RNA, 20 nt, Artificial Sequence
  mmSKRIPTE0002704_Tarbp2_4
  gRNA
ugcacguucaaccagcacca

SEQ ID NO: 131926 - RNA, 20 nt, Artificial Sequence
  mmSKRIPTE0002705_Tarbp2_5
  gRNA
ugcucccccuaauacccacg

SEQ ID NO: 131927 - RNA, 20 nt, Artificial Sequence
  mmSKRIPTE0002706_Tarbp2_6
  gRNA
guccuucaggaauccaagcg

SEQ ID NO: 131928 - RNA, 20 nt, Artificial Sequence
  mmSKRIPTE0002707_Tarbp2_7
  gRNA
gaucgcaugauauuaagcca

SEQ ID NO: 131929 - RNA, 20 nt, Artificial Sequence
  mmSKRIPTE0002708_Tarbp2_8
  gRNA
aggcgagggauccugugccg

SEQ ID NO: 131930 - RNA, 20 nt, Artificial Sequence
  mmSKRIPTE0002709_Tarbp2_9
  gRNA
cugcuacuuuaucaccccag

SEQ ID NO: 131931 - RNA, 20 nt, Artificial Sequence
  mmSKRIPTE0002710_Muc4_1
  gRNA
uccucguugaacgaauggug

SEQ ID NO: 131932 - RNA, 20 nt, Artificial Sequence
  mmSKRIPTE0002711_Muc4_2
  gRNA
guacccuggagauucuagcg

SEQ ID NO: 131933 - RNA, 20 nt, Artificial Sequence
  mmSKRIPTE0002712_Muc4_3
  gRNA
cuguaacacaggagguacga

SEQ ID NO: 131934 - RNA, 20 nt, Artificial Sequence
  mmSKRIPTE0002713_Muc4_4
  gRNA
cucccaucacgguaagugag

SEQ ID NO: 131935 - RNA, 20 nt, Artificial Sequence
  mmSKRIPTE0002714_Muc4_5
  gRNA
gcccaucagcugccucgucg

SEQ ID NO: 131936 - RNA, 20 nt, Artificial Sequence
  mmSKRIPTE0002715_Muc4_6
  gRNA
ccauauacgagagacgacug

SEQ ID NO: 131937 - RNA, 20 nt, Artificial Sequence
  mmSKRIPTE0002716_Muc4_7
  gRNA
ggagaccuuaaccccgcccg

SEQ ID NO: 131938 - RNA, 20 nt, Artificial Sequence
  mmSKRIPTE0002717_Muc4_8
  gRNA
aggccuaaugaggauuagag

SEQ ID NO: 131939 - RNA, 20 nt, Artificial Sequence
  mmSKRIPTE0002718_Muc4_9
  gRNA
ucugucgccuuugcacccag

SEQ ID NO: 131940 - RNA, 20 nt, Artificial Sequence
  mmSKRIPTE0002719_Nkx2-5_1
  gRNA
ucugcccuggauguggcgcg

SEQ ID NO: 131941 - RNA, 20 nt, Artificial Sequence
  mmSKRIPTE0002720_Nkx2-5_2
  gRNA
gugagugcgcuaacgcacgc

SEQ ID NO: 131942 - RNA, 20 nt, Artificial Sequence
  mmSKRIPTE0002721_Nkx2-5_3
  gRNA
uaaaggugggagucguuccg

SEQ ID NO: 131943 - RNA, 20 nt, Artificial Sequence
  mmSKRIPTE0002722_Nkx2-5_4
  gRNA
gauagucucccacuccugca

SEQ ID NO: 131944 - RNA, 20 nt, Artificial Sequence
  mmSKRIPTE0002723_Nkx2-5_5
  gRNA
ggauuucugagcgagcgcag

SEQ ID NO: 131945 - RNA, 20 nt, Artificial Sequence
  mmSKRIPTE0002724_Nkx2-5_6
  gRNA
gagacgcccgaauugcccug

SEQ ID NO: 131946 - RNA, 20 nt, Artificial Sequence
  mmSKRIPTE0002725_Nkx2-5_7
  gRNA
gcagguuucacagcgccagg

SEQ ID NO: 131947 - RNA, 20 nt, Artificial Sequence
  mmSKRIPTE0002726_Nkx2-5_8
  gRNA
cacucggcgauuagcuuaag

SEQ ID NO: 131948 - RNA, 20 nt, Artificial Sequence
  mmSKRIPTE0002727_Nkx2-5_9
  gRNA
aaggucccaggccugcgcga

SEQ ID NO: 131949 - RNA, 20 nt, Artificial Sequence
  mmSKRIPTE0002728_Sos1_1
  gRNA
guaccgaggcuucaccaaag

SEQ ID NO: 131950 - RNA, 20 nt, Artificial Sequence
  mmSKRIPTE0002729_Sos1_2
  gRNA
acaaaguugccacuaugaug

SEQ ID NO: 131951 - RNA, 20 nt, Artificial Sequence
  mmSKRIPTE0002730_Sos1_3
  gRNA
gcauguaucucgccguacgu

SEQ ID NO: 131952 - RNA, 20 nt, Artificial Sequence
  mmSKRIPTE0002731_Sos1_4
  gRNA
guacgcagguaagaaacacg

SEQ ID NO: 131953 - RNA, 20 nt, Artificial Sequence
  mmSKRIPTE0002732_Sos1_5
  gRNA
aaguggggauguucaaagcg

SEQ ID NO: 131954 - RNA, 20 nt, Artificial Sequence
  mmSKRIPTE0002733_Sos1_6
  gRNA
cagcuguugacacucgcccg

SEQ ID NO: 131955 - RNA, 20 nt, Artificial Sequence
  mmSKRIPTE0002734_Sos1_7
  gRNA
guaauguauguccuggcucg

SEQ ID NO: 131956 - RNA, 20 nt, Artificial Sequence
  mmSKRIPTE0002735_Sos1_8
  gRNA
aguuucaugaugguucagac

SEQ ID NO: 131957 - RNA, 20 nt, Artificial Sequence
  mmSKRIPTE0002736_Sos1_9
  gRNA
cugauaaaguaagacgcaug

SEQ ID NO: 131958 - RNA, 20 nt, Artificial Sequence
  mmSKRIPTE0002737_Zeb1_1
  gRNA
gacggaugcugaguacaaug

SEQ ID NO: 131959 - RNA, 20 nt, Artificial Sequence
  mmSKRIPTE0002738_Zeb1_2
  gRNA
cuuaggcgagugugugcucg

SEQ ID NO: 131960 - RNA, 20 nt, Artificial Sequence
  mmSKRIPTE0002739_Zeb1_3
  gRNA
aacacggcaucuaacgucag

SEQ ID NO: 131961 - RNA, 20 nt, Artificial Sequence
  mmSKRIPTE0002740_Zeb1_4
  gRNA
caccugguuuacgacacucg

SEQ ID NO: 131962 - RNA, 20 nt, Artificial Sequence
  mmSKRIPTE0002741_Zeb1_5
  gRNA
uuaccugccucugcgccuag

SEQ ID NO: 131963 - RNA, 20 nt, Artificial Sequence
  mmSKRIPTE0002742_Zeb1_6
  gRNA
ugucauaugacguucaagcu

SEQ ID NO: 131964 - RNA, 20 nt, Artificial Sequence
  mmSKRIPTE0002743_Zeb1_7
  gRNA
ggacuguccagacaaugacc

SEQ ID NO: 131965 - RNA, 20 nt, Artificial Sequence
  mmSKRIPTE0002744_Zeb1_8
  gRNA
aguccguggugcuuucacug

SEQ ID NO: 131966 - RNA, 20 nt, Artificial Sequence
  mmSKRIPTE0002745_Zeb1_9
  gRNA
gugcucaaguuuaugguacg

SEQ ID NO: 131967 - RNA, 20 nt, Artificial Sequence
  mmSKRIPTE0002746_Smad7_1
  gRNA
ucaaggcaaucaccgccucg

SEQ ID NO: 131968 - RNA, 20 nt, Artificial Sequence
  mmSKRIPTE0002747_Smad7_2
  gRNA
caaaaauggcagacaaccgu

SEQ ID NO: 131969 - RNA, 20 nt, Artificial Sequence
  mmSKRIPTE0002748_Smad7_3
  gRNA
gggaggagaagacucgcgug

SEQ ID NO: 131970 - RNA, 20 nt, Artificial Sequence
  mmSKRIPTE0002749_Smad7_4
  gRNA
accauuaauaaucugcaucg

SEQ ID NO: 131971 - RNA, 20 nt, Artificial Sequence
  mmSKRIPTE0002750_Smad7_5
  gRNA
acagucacgugggacacgag

SEQ ID NO: 131972 - RNA, 20 nt, Artificial Sequence
  mmSKRIPTE0002751_Smad7_6
  gRNA
caacaauuccagaccaacgg

SEQ ID NO: 131973 - RNA, 20 nt, Artificial Sequence
  mmSKRIPTE0002752_Smad7_7
  gRNA
acagccgguagucggucgug

SEQ ID NO: 131974 - RNA, 20 nt, Artificial Sequence
  mmSKRIPTE0002753_Smad7_8
  gRNA
gauucgacccaagcccgcca

SEQ ID NO: 131975 - RNA, 20 nt, Artificial Sequence
  mmSKRIPTE0002754_Smad7_9
  gRNA
gcuguggcauccagcugacg

SEQ ID NO: 131976 - RNA, 20 nt, Artificial Sequence
  mmSKRIPTE0002755_Dbh_1
  gRNA
gcuuguucaagagcguaugg

SEQ ID NO: 131977 - RNA, 20 nt, Artificial Sequence
  mmSKRIPTE0002756_Dbh_2
  gRNA
gcuucccgguaugacugaug

SEQ ID NO: 131978 - RNA, 20 nt, Artificial Sequence
  mmSKRIPTE0002757_Dbh_3
  gRNA
aaaaaagugcuuaaccggug

SEQ ID NO: 131979 - RNA, 20 nt, Artificial Sequence
  mmSKRIPTE0002758_Dbh_4
  gRNA
cguacauggaagccgccuca

SEQ ID NO: 131980 - RNA, 20 nt, Artificial Sequence
  mmSKRIPTE0002759_Dbh_5
  gRNA
cauuugcuaagcggacagcg

SEQ ID NO: 131981 - RNA, 20 nt, Artificial Sequence
  mmSKRIPTE0002760_Dbh_6
  gRNA
aacuuccagucggagaaacg

SEQ ID NO: 131982 - RNA, 20 nt, Artificial Sequence
  mmSKRIPTE0002761_Dbh_7
  gRNA
ccccguuuaccaugaugaug

SEQ ID NO: 131983 - RNA, 20 nt, Artificial Sequence
  mmSKRIPTE0002762_Dbh_8
  gRNA
acccacggaagauacaaggu

SEQ ID NO: 131984 - RNA, 20 nt, Artificial Sequence
  mmSKRIPTE0002763_Dbh_9
  gRNA
ugagauggucgauccauucg

SEQ ID NO: 131985 - RNA, 20 nt, Artificial Sequence
  mmSKRIPTE0002764_Jak1_1
  gRNA
ugcugguggucaaugccuag

SEQ ID NO: 131986 - RNA, 20 nt, Artificial Sequence
  mmSKRIPTE0002765_Jak1_2
  gRNA
aagcagcauuuacuguugug

SEQ ID NO: 131987 - RNA, 20 nt, Artificial Sequence
  mmSKRIPTE0002766_Jak1_3
  gRNA
caucucgaaacgaagugcug

SEQ ID NO: 131988 - RNA, 20 nt, Artificial Sequence
  mmSKRIPTE0002767_Jak1_4
  gRNA
uguaacucgaguauuuguug

SEQ ID NO: 131989 - RNA, 20 nt, Artificial Sequence
  mmSKRIPTE0002768_Jak1_5
  gRNA
gaaccaaccagauuggaccg

SEQ ID NO: 131990 - RNA, 20 nt, Artificial Sequence
  mmSKRIPTE0002769_Jak1_6
  gRNA
cacagguuugacguaaacag

SEQ ID NO: 131991 - RNA, 20 nt, Artificial Sequence
  mmSKRIPTE0002770_Jak1_7
  gRNA
acucuccuuucauacuggag

SEQ ID NO: 131992 - RNA, 20 nt, Artificial Sequence
  mmSKRIPTE0002771_Jak1_8
  gRNA
ccaguggagugaaguaauug

SEQ ID NO: 131993 - RNA, 20 nt, Artificial Sequence
  mmSKRIPTE0002772_Jak1_9
  gRNA
gaaucgcacugcaacacgga

SEQ ID NO: 131994 - RNA, 20 nt, Artificial Sequence
  mmSKRIPTE0002773_Ptprz1_1
  gRNA
uaagugauaggaccucggcg

SEQ ID NO: 131995 - RNA, 20 nt, Artificial Sequence
  mmSKRIPTE0002774_Ptprz1_2
  gRNA
guugagucgucugcgaaugg

SEQ ID NO: 131996 - RNA, 20 nt, Artificial Sequence
  mmSKRIPTE0002775_Ptprz1_3
  gRNA
auggcgucauaaacgacccg

SEQ ID NO: 131997 - RNA, 20 nt, Artificial Sequence
  mmSKRIPTE0002776_Ptprz1_4
  gRNA
gaccaaaggagucucaguag

SEQ ID NO: 131998 - RNA, 20 nt, Artificial Sequence
  mmSKRIPTE0002777_Ptprz1_5
  gRNA
uucccaugugcacaucaacg

SEQ ID NO: 131999 - RNA, 20 nt, Artificial Sequence
  mmSKRIPTE0002778_Ptprz1_6
  gRNA
ucacucguucaccuagaccc

SEQ ID NO: 132000 - RNA, 20 nt, Artificial Sequence
  mmSKRIPTE0002779_Ptprz1_7
  gRNA
gucacaaccauaaugaucac

SEQ ID NO: 132001 - RNA, 20 nt, Artificial Sequence
  mmSKRIPTE0002780_Ptprz1_8
  gRNA
uugugaugugagauaugaug

SEQ ID NO: 132002 - RNA, 20 nt, Artificial Sequence
  mmSKRIPTE0002781_Ptprz1_9
  gRNA
ugggcauguccacuaucagu

SEQ ID NO: 132003 - RNA, 20 nt, Artificial Sequence
  mmSKRIPTE0002782_Prmt1_1
  gRNA
agguccguccuaaagcacaa

SEQ ID NO: 132004 - RNA, 20 nt, Artificial Sequence
  mmSKRIPTE0002783_Prmt1_2
  gRNA
accgacuaccggaugcgcug

SEQ ID NO: 132005 - RNA, 20 nt, Artificial Sequence
  mmSKRIPTE0002784_Prmt1_3
  gRNA
cuucgcguugguccgcaucg

SEQ ID NO: 132006 - RNA, 20 nt, Artificial Sequence
  mmSKRIPTE0002785_Prmt1_4
  gRNA
gcugggcucuuuaggcccgg

SEQ ID NO: 132007 - RNA, 20 nt, Artificial Sequence
  mmSKRIPTE0002786_Prmt1_5
  gRNA
gagccgaggacugucgcacg

SEQ ID NO: 132008 - RNA, 20 nt, Artificial Sequence
  mmSKRIPTE0002787_Prmt1_6
  gRNA
gggggccgagaucaucagug

SEQ ID NO: 132009 - RNA, 20 nt, Artificial Sequence
  mmSKRIPTE0002788_Prmt1_7
  gRNA
gguagcauagcggguacccg

SEQ ID NO: 132010 - RNA, 20 nt, Artificial Sequence
  mmSKRIPTE0002789_Prmt1_8
  gRNA
gaggacgguuagaccucuug

SEQ ID NO: 132011 - RNA, 20 nt, Artificial Sequence
  mmSKRIPTE0002790_Prmt1_9
  gRNA
accaaugagaacuuauggcg

SEQ ID NO: 132012 - RNA, 20 nt, Artificial Sequence
  mmSKRIPTE0002791_Ikbkb_1
  gRNA
auguggcacccucggcaaag

SEQ ID NO: 132013 - RNA, 20 nt, Artificial Sequence
  mmSKRIPTE0002792_Ikbkb_2
  gRNA
cguucacacauaccccguga

SEQ ID NO: 132014 - RNA, 20 nt, Artificial Sequence
  mmSKRIPTE0002793_Ikbkb_3
  gRNA
ucuuaacagguaaggccgug

SEQ ID NO: 132015 - RNA, 20 nt, Artificial Sequence
  mmSKRIPTE0002794_Ikbkb_4
  gRNA
auagacgcacggcgacacca

SEQ ID NO: 132016 - RNA, 20 nt, Artificial Sequence
  mmSKRIPTE0002795_Ikbkb_5
  gRNA
cugacgucacggguacuaga

SEQ ID NO: 132017 - RNA, 20 nt, Artificial Sequence
  mmSKRIPTE0002796_Ikbkb_6
  gRNA
gccucguaggaaucguucug

SEQ ID NO: 132018 - RNA, 20 nt, Artificial Sequence
  mmSKRIPTE0002797_Ikbkb_7
  gRNA
gcuucacgguaaccgccuga

SEQ ID NO: 132019 - RNA, 20 nt, Artificial Sequence
  mmSKRIPTE0002798_Ikbkb_8
  gRNA
ugggauuaacacuaacgacu

SEQ ID NO: 132020 - RNA, 20 nt, Artificial Sequence
  mmSKRIPTE0002799_Ikbkb_9
  gRNA
ugucuguauaccuaaccuag

SEQ ID NO: 132021 - RNA, 20 nt, Artificial Sequence
  mmSKRIPTE0002800_Junb_1
  gRNA
acgcagcggcgggauacggu

SEQ ID NO: 132022 - RNA, 20 nt, Artificial Sequence
  mmSKRIPTE0002801_Junb_2
  gRNA
cgcuugguacucagccugcg

SEQ ID NO: 132023 - RNA, 20 nt, Artificial Sequence
  mmSKRIPTE0002802_Junb_3
  gRNA
gacugggagcucauacccga

SEQ ID NO: 132024 - RNA, 20 nt, Artificial Sequence
  mmSKRIPTE0002803_Junb_4
  gRNA
ggguaaaaguacugucccgg

SEQ ID NO: 132025 - RNA, 20 nt, Artificial Sequence
  mmSKRIPTE0002804_Junb_5
  gRNA
agaaagcaggcgcaccacgg

SEQ ID NO: 132026 - RNA, 20 nt, Artificial Sequence
  mmSKRIPTE0002805_Junb_6
  gRNA
ggaaccgcagaccguaccgg

SEQ ID NO: 132027 - RNA, 20 nt, Artificial Sequence
  mmSKRIPTE0002806_Junb_7
  gRNA
caagcgcuccaguuccgugg

SEQ ID NO: 132028 - RNA, 20 nt, Artificial Sequence
  mmSKRIPTE0002807_Junb_8
  gRNA
gcugcgccacuugcucccgu

SEQ ID NO: 132029 - RNA, 20 nt, Artificial Sequence
  mmSKRIPTE0002808_Junb_9
  gRNA
gaccccgauagggauccgcc

SEQ ID NO: 132030 - RNA, 20 nt, Artificial Sequence
  mmSKRIPTE0002809_Mb21d1_1
  gRNA
gaagugugucaccgccauag

SEQ ID NO: 132031 - RNA, 20 nt, Artificial Sequence
  mmSKRIPTE0002810_Mb21d1_2
  gRNA
cgaggcgcggaaagucguaa

SEQ ID NO: 132032 - RNA, 20 nt, Artificial Sequence
  mmSKRIPTE0002811_Mb21d1_3
  gRNA
cagugguuuccgcgucugug

SEQ ID NO: 132033 - RNA, 20 nt, Artificial Sequence
  mmSKRIPTE0002812_Mb21d1_4
  gRNA
ggcgccgucguccuucuacg

SEQ ID NO: 132034 - RNA, 20 nt, Artificial Sequence
  mmSKRIPTE0002813_Mb21d1_5
  gRNA
cgagacggugaauaaaguug

SEQ ID NO: 132035 - RNA, 20 nt, Artificial Sequence
  mmSKRIPTE0002814_Mb21d1_6
  gRNA
gaaaaagacagaccgcccga

SEQ ID NO: 132036 - RNA, 20 nt, Artificial Sequence
  mmSKRIPTE0002815_Mb21d1_7
  gRNA
aggaccagaacaccuuguag

SEQ ID NO: 132037 - RNA, 20 nt, Artificial Sequence
  mmSKRIPTE0002816_Mb21d1_8
  gRNA
ucguagugccacacccugcg

SEQ ID NO: 132038 - RNA, 20 nt, Artificial Sequence
  mmSKRIPTE0002817_Mb21d1_9
  gRNA
ugaagugugccaccuaaugg

SEQ ID NO: 132039 - RNA, 20 nt, Artificial Sequence
  mmSKRIPTE0002818_Ikbkg_1
  gRNA
auuuggccuuguccaaccag

SEQ ID NO: 132040 - RNA, 20 nt, Artificial Sequence
  mmSKRIPTE0002819_Ikbkg_2
  gRNA
caguagcccacaucacucug

SEQ ID NO: 132041 - RNA, 20 nt, Artificial Sequence
  mmSKRIPTE0002820_Ikbkg_3
  gRNA
ggaucccgcacuuacgacac

SEQ ID NO: 132042 - RNA, 20 nt, Artificial Sequence
  mmSKRIPTE0002821_Ikbkg_4
  gRNA
acuugggggcauaucaucag

SEQ ID NO: 132043 - RNA, 20 nt, Artificial Sequence
  mmSKRIPTE0002822_Ikbkg_5
  gRNA
gagcuccgguucugucggag

SEQ ID NO: 132044 - RNA, 20 nt, Artificial Sequence
  mmSKRIPTE0002823_Ikbkg_6
  gRNA
gcucccccucagguacacug

SEQ ID NO: 132045 - RNA, 20 nt, Artificial Sequence
  mmSKRIPTE0002824_Ikbkg_7
  gRNA
cuuagaucgccagccugcgu

SEQ ID NO: 132046 - RNA, 20 nt, Artificial Sequence
  mmSKRIPTE0002825_Ikbkg_8
  gRNA
gucacaugcagaagauaaug

SEQ ID NO: 132047 - RNA, 20 nt, Artificial Sequence
  mmSKRIPTE0002826_Ikbkg_9
  gRNA
uguuaccucugguagacaug

SEQ ID NO: 132048 - RNA, 20 nt, Artificial Sequence
  mmSKRIPTE0002827_Eprs_1
  gRNA
uccuacggcuaaaucuccug

SEQ ID NO: 132049 - RNA, 20 nt, Artificial Sequence
  mmSKRIPTE0002828_Eprs_2
  gRNA
gagccuggacuacguccacg

SEQ ID NO: 132050 - RNA, 20 nt, Artificial Sequence
  mmSKRIPTE0002829_Eprs_3
  gRNA
gguagacaguaaaaugaccg

SEQ ID NO: 132051 - RNA, 20 nt, Artificial Sequence
  mmSKRIPTE0002830_Eprs_4
  gRNA
auaagaaacgccacguagag

SEQ ID NO: 132052 - RNA, 20 nt, Artificial Sequence
  mmSKRIPTE0002831_Eprs_5
  gRNA
gcucaaccaguggugcaaug

SEQ ID NO: 132053 - RNA, 20 nt, Artificial Sequence
  mmSKRIPTE0002832_Eprs_6
  gRNA
ucccagauggaguacgacca

SEQ ID NO: 132054 - RNA, 20 nt, Artificial Sequence
  mmSKRIPTE0002833_Eprs_7
  gRNA
ggaaagccguaggaacgcug

SEQ ID NO: 132055 - RNA, 20 nt, Artificial Sequence
  mmSKRIPTE0002834_Eprs_8
  gRNA
ugacagcucuucauaucacg

SEQ ID NO: 132056 - RNA, 20 nt, Artificial Sequence
  mmSKRIPTE0002835_Eprs_9
  gRNA
uaggcucaauaacgauggaa

SEQ ID NO: 132057 - RNA, 20 nt, Artificial Sequence
  mmSKRIPTE0002836_9230019H11Rik_1
  gRNA
gaugugcuacuucaaaugcg

SEQ ID NO: 132058 - RNA, 20 nt, Artificial Sequence
  mmSKRIPTE0002837_9230019H11Rik_2
  gRNA
gaguuugaauaauuuaugcg

SEQ ID NO: 132059 - RNA, 20 nt, Artificial Sequence
  mmSKRIPTE0002838_9230019H11Rik_3
  gRNA
gaucauagaaugauggugcu

SEQ ID NO: 132060 - RNA, 20 nt, Artificial Sequence
  mmSKRIPTE0002839_9230019H11Rik_4
  gRNA
uguagaaugagccaucccca

SEQ ID NO: 132061 - RNA, 20 nt, Artificial Sequence
  mmSKRIPTE0002840_9230019H11Rik_5
  gRNA
gauagacguuacuguucuag

SEQ ID NO: 132062 - RNA, 20 nt, Artificial Sequence
  mmSKRIPTE0002841_9230019H11Rik_6
  gRNA
cccagagauaaaguagccug

SEQ ID NO: 132063 - RNA, 20 nt, Artificial Sequence
  mmSKRIPTE0002842_9230019H11Rik_7
  gRNA
uguguggguccugaguugga

SEQ ID NO: 132064 - RNA, 20 nt, Artificial Sequence
  mmSKRIPTE0002843_9230019H11Rik_8
  gRNA
aaaauguggaggguaaaacc

SEQ ID NO: 132065 - RNA, 20 nt, Artificial Sequence
  mmSKRIPTE0002844_9230019H11Rik_9
  gRNA
uccagucuaucggacagagu

SEQ ID NO: 132066 - RNA, 20 nt, Artificial Sequence
  mmSKRIPTE0002845_Esr1_1
  gRNA
augaauaggaacccgcacaa

SEQ ID NO: 132067 - RNA, 20 nt, Artificial Sequence
  mmSKRIPTE0002846_Esr1_2
  gRNA
ggagccagucuguaacucgc

SEQ ID NO: 132068 - RNA, 20 nt, Artificial Sequence
  mmSKRIPTE0002847_Esr1_3
  gRNA
gcucgaaugaucgaguggcg

SEQ ID NO: 132069 - RNA, 20 nt, Artificial Sequence
  mmSKRIPTE0002848_Esr1_4
  gRNA
acacagcggccaccccgaug

SEQ ID NO: 132070 - RNA, 20 nt, Artificial Sequence
  mmSKRIPTE0002849_Esr1_5
  gRNA
ggcauacggaaagaccgccg

SEQ ID NO: 132071 - RNA, 20 nt, Artificial Sequence
  mmSKRIPTE0002850_Esr1_6
  gRNA
aauccuacaaguccggaaag

SEQ ID NO: 132072 - RNA, 20 nt, Artificial Sequence
  mmSKRIPTE0002851_Esr1_7
  gRNA
gggccaguacucgugccaag

SEQ ID NO: 132073 - RNA, 20 nt, Artificial Sequence
  mmSKRIPTE0002852_Esr1_8
  gRNA
aacuauuggcccuuuagugu

SEQ ID NO: 132074 - RNA, 20 nt, Artificial Sequence
  mmSKRIPTE0002853_Esr1_9
  gRNA
auauuggccaagucccagcu

SEQ ID NO: 132075 - RNA, 20 nt, Artificial Sequence
  mmSKRIPTE0002854_Igf1_1
  gRNA
cucagaagguacgaucgagu

SEQ ID NO: 132076 - RNA, 20 nt, Artificial Sequence
  mmSKRIPTE0002855_Igf1_2
  gRNA
uccuggaagaaaguacacgc

SEQ ID NO: 132077 - RNA, 20 nt, Artificial Sequence
  mmSKRIPTE0002856_Igf1_3
  gRNA
gcgauguguugacucgcacu

SEQ ID NO: 132078 - RNA, 20 nt, Artificial Sequence
  mmSKRIPTE0002857_Igf1_4
  gRNA
gggauacggcacuuacacau

SEQ ID NO: 132079 - RNA, 20 nt, Artificial Sequence
  mmSKRIPTE0002858_Igf1_5
  gRNA
gaugcucuucaguucgugug

SEQ ID NO: 132080 - RNA, 20 nt, Artificial Sequence
  mmSKRIPTE0002859_Igf1_6
  gRNA
aggagguaacggaggcaacu

SEQ ID NO: 132081 - RNA, 20 nt, Artificial Sequence
  mmSKRIPTE0002860_Igf1_7
  gRNA
uggaccagagacccuuugcg

SEQ ID NO: 132082 - RNA, 20 nt, Artificial Sequence
  mmSKRIPTE0002861_Igf1_8
  gRNA
cuaguuacauuuggacaccc

SEQ ID NO: 132083 - RNA, 20 nt, Artificial Sequence
  mmSKRIPTE0002862_Igf1_9
  gRNA
gaccugcuguguaaacgacc

SEQ ID NO: 132084 - RNA, 20 nt, Artificial Sequence
  mmSKRIPTE0002863_Meis1_1
  gRNA
aagacagauacuaaugagcg

SEQ ID NO: 132085 - RNA, 20 nt, Artificial Sequence
  mmSKRIPTE0002864_Meis1_2
  gRNA
cagcgaccaaauuauaccug

SEQ ID NO: 132086 - RNA, 20 nt, Artificial Sequence
  mmSKRIPTE0002865_Meis1_3
  gRNA
augcggguccccauacaucg

SEQ ID NO: 132087 - RNA, 20 nt, Artificial Sequence
  mmSKRIPTE0002866_Meis1_4
  gRNA
uaaccauagaacuugcacug

SEQ ID NO: 132088 - RNA, 20 nt, Artificial Sequence
  mmSKRIPTE0002867_Meis1_5
  gRNA
guucccccacaugucaagcg

SEQ ID NO: 132089 - RNA, 20 nt, Artificial Sequence
  mmSKRIPTE0002868_Meis1_6
  gRNA
ucccacuauaagucaaacug

SEQ ID NO: 132090 - RNA, 20 nt, Artificial Sequence
  mmSKRIPTE0002869_Meis1_7
  gRNA
caagcgggcagcaucgaucg

SEQ ID NO: 132091 - RNA, 20 nt, Artificial Sequence
  mmSKRIPTE0002870_Meis1_8
  gRNA
agccuggagaccuuauucga

SEQ ID NO: 132092 - RNA, 20 nt, Artificial Sequence
  mmSKRIPTE0002871_Meis1_9
  gRNA
cauaccaagcagauuacaug

SEQ ID NO: 132093 - RNA, 20 nt, Artificial Sequence
  mmSKRIPTE0002872_Arid4a_1
  gRNA
acugcaccgggaccccaucg

SEQ ID NO: 132094 - RNA, 20 nt, Artificial Sequence
  mmSKRIPTE0002873_Arid4a_2
  gRNA
agaagcgcuccuucacccgg

SEQ ID NO: 132095 - RNA, 20 nt, Artificial Sequence
  mmSKRIPTE0002874_Arid4a_3
  gRNA
ggugccuccuuaauaccccg

SEQ ID NO: 132096 - RNA, 20 nt, Artificial Sequence
  mmSKRIPTE0002875_Arid4a_4
  gRNA
uugauaccagcacuacuagg

SEQ ID NO: 132097 - RNA, 20 nt, Artificial Sequence
  mmSKRIPTE0002876_Arid4a_5
  gRNA
uggauuguggcaguaaaucg

SEQ ID NO: 132098 - RNA, 20 nt, Artificial Sequence
  mmSKRIPTE0002877_Arid4a_6
  gRNA
ccuccccugacaugucaccg

SEQ ID NO: 132099 - RNA, 20 nt, Artificial Sequence
  mmSKRIPTE0002878_Arid4a_7
  gRNA
aagucaagguaaaugcgcga

SEQ ID NO: 132100 - RNA, 20 nt, Artificial Sequence
  mmSKRIPTE0002879_Arid4a_8
  gRNA
auuaccagcgcuuccacuag

SEQ ID NO: 132101 - RNA, 20 nt, Artificial Sequence
  mmSKRIPTE0002880_Arid4a_9
  gRNA
aguagugcuguaucgcccug

SEQ ID NO: 132102 - RNA, 20 nt, Artificial Sequence
  mmSKRIPTE0002881_Gabpa_1
  gRNA
aaaugggagucgcagcgccg

SEQ ID NO: 132103 - RNA, 20 nt, Artificial Sequence
  mmSKRIPTE0002882_Gabpa_2
  gRNA
augugagagcagguucaucg

SEQ ID NO: 132104 - RNA, 20 nt, Artificial Sequence
  mmSKRIPTE0002883_Gabpa_3
  gRNA
ugaggaccauggagcccucg

SEQ ID NO: 132105 - RNA, 20 nt, Artificial Sequence
  mmSKRIPTE0002884_Gabpa_4
  gRNA
acaggaaugaauacucacgc

SEQ ID NO: 132106 - RNA, 20 nt, Artificial Sequence
  mmSKRIPTE0002885_Gabpa_5
  gRNA
ccuacuccucagcuguaacg

SEQ ID NO: 132107 - RNA, 20 nt, Artificial Sequence
  mmSKRIPTE0002886_Gabpa_6
  gRNA
aaagucagagauacaccgca

SEQ ID NO: 132108 - RNA, 20 nt, Artificial Sequence
  mmSKRIPTE0002887_Gabpa_7
  gRNA
cucuguguaaagcagcggag

SEQ ID NO: 132109 - RNA, 20 nt, Artificial Sequence
  mmSKRIPTE0002888_Gabpa_8
  gRNA
gcuguguuagacccaacuag

SEQ ID NO: 132110 - RNA, 20 nt, Artificial Sequence
  mmSKRIPTE0002889_Gabpa_9
  gRNA
aucgggacgcugacuccgaa

SEQ ID NO: 132111 - RNA, 20 nt, Artificial Sequence
  mmSKRIPTE0002890_Pim1_1
  gRNA
ccaucgcuaccacggcaggu

SEQ ID NO: 132112 - RNA, 20 nt, Artificial Sequence
  mmSKRIPTE0002891_Pim1_2
  gRNA
ugacuaaaguuccaucgaca

SEQ ID NO: 132113 - RNA, 20 nt, Artificial Sequence
  mmSKRIPTE0002892_Pim1_3
  gRNA
ggcgagucggaggacgacug

SEQ ID NO: 132114 - RNA, 20 nt, Artificial Sequence
  mmSKRIPTE0002893_Pim1_4
  gRNA
ccggcaaguugucggcgacg

SEQ ID NO: 132115 - RNA, 20 nt, Artificial Sequence
  mmSKRIPTE0002894_Pim1_5
  gRNA
caaacucaucgacuucgggu

SEQ ID NO: 132116 - RNA, 20 nt, Artificial Sequence
  mmSKRIPTE0002895_Pim1_6
  gRNA
ccaccuccagggugucggug

SEQ ID NO: 132117 - RNA, 20 nt, Artificial Sequence
  mmSKRIPTE0002896_Pim1_7
  gRNA
guucggugauaaagucgaag

SEQ ID NO: 132118 - RNA, 20 nt, Artificial Sequence
  mmSKRIPTE0002897_Pim1_8
  gRNA
uuauaccaaacacugcccgg

SEQ ID NO: 132119 - RNA, 20 nt, Artificial Sequence
  mmSKRIPTE0002898_Pim1_9
  gRNA
uucccggcauaguacagccg

SEQ ID NO: 132120 - RNA, 20 nt, Artificial Sequence
  mmSKRIPTE0002899_Rbp4_1
  gRNA
gccauaccgaugccuaugag

SEQ ID NO: 132121 - RNA, 20 nt, Artificial Sequence
  mmSKRIPTE0002900_Rbp4_2
  gRNA
aacuucgacaaggcucgugu

SEQ ID NO: 132122 - RNA, 20 nt, Artificial Sequence
  mmSKRIPTE0002901_Rbp4_3
  gRNA
augguacccgauaagcccaa

SEQ ID NO: 132123 - RNA, 20 nt, Artificial Sequence
  mmSKRIPTE0002902_Rbp4_4
  gRNA
agggacgaguccgucuucug

SEQ ID NO: 132124 - RNA, 20 nt, Artificial Sequence
  mmSKRIPTE0002903_Rbp4_5
  gRNA
gucgcgcuuucguaaccgcg

SEQ ID NO: 132125 - RNA, 20 nt, Artificial Sequence
  mmSKRIPTE0002904_Rbp4_6
  gRNA
ccggagcuauaaaggaccga

SEQ ID NO: 132126 - RNA, 20 nt, Artificial Sequence
  mmSKRIPTE0002905_Rbp4_7
  gRNA
acaggcgcaggguaaacgcg

SEQ ID NO: 132127 - RNA, 20 nt, Artificial Sequence
  mmSKRIPTE0002906_Rbp4_8
  gRNA
uugaagacuuauuuguggcg

SEQ ID NO: 132128 - RNA, 20 nt, Artificial Sequence
  mmSKRIPTE0002907_Rbp4_9
  gRNA
ccguugggaagggcuucgag

SEQ ID NO: 132129 - RNA, 20 nt, Artificial Sequence
  mmSKRIPTE0002908_Samhd1_1
  gRNA
ucagguucaacagugcaucg

SEQ ID NO: 132130 - RNA, 20 nt, Artificial Sequence
  mmSKRIPTE0002909_Samhd1_2
  gRNA
cuugggcugccaucgcagcg

SEQ ID NO: 132131 - RNA, 20 nt, Artificial Sequence
  mmSKRIPTE0002910_Samhd1_3
  gRNA
guaccauacgcucagcauug

SEQ ID NO: 132132 - RNA, 20 nt, Artificial Sequence
  mmSKRIPTE0002911_Samhd1_4
  gRNA
cuauaugaacagcauuugcg

SEQ ID NO: 132133 - RNA, 20 nt, Artificial Sequence
  mmSKRIPTE0002912_Samhd1_5
  gRNA
gcgaacacacgggcuacccg

SEQ ID NO: 132134 - RNA, 20 nt, Artificial Sequence
  mmSKRIPTE0002913_Samhd1_6
  gRNA
uaaaggccagcauuccggca

SEQ ID NO: 132135 - RNA, 20 nt, Artificial Sequence
  mmSKRIPTE0002914_Samhd1_7
  gRNA
ggcugcgaaguuaaguaccg

SEQ ID NO: 132136 - RNA, 20 nt, Artificial Sequence
  mmSKRIPTE0002915_Samhd1_8
  gRNA
ccuuggcauagaaaagcgca

SEQ ID NO: 132137 - RNA, 20 nt, Artificial Sequence
  mmSKRIPTE0002916_Samhd1_9
  gRNA
ccucaaagcagaccccuacg

SEQ ID NO: 132138 - RNA, 20 nt, Artificial Sequence
  mmSKRIPTE0002917_Stk4_1
  gRNA
gagagaauuaggacaauucg

SEQ ID NO: 132139 - RNA, 20 nt, Artificial Sequence
  mmSKRIPTE0002918_Stk4_2
  gRNA
ccaugggaggcucgucacug

SEQ ID NO: 132140 - RNA, 20 nt, Artificial Sequence
  mmSKRIPTE0002919_Stk4_3
  gRNA
cucugaugaguagauacccg

SEQ ID NO: 132141 - RNA, 20 nt, Artificial Sequence
  mmSKRIPTE0002920_Stk4_4
  gRNA
uucugccaagggcaguuacg

SEQ ID NO: 132142 - RNA, 20 nt, Artificial Sequence
  mmSKRIPTE0002921_Stk4_5
  gRNA
uuaugguacugugcagcaag

SEQ ID NO: 132143 - RNA, 20 nt, Artificial Sequence
  mmSKRIPTE0002922_Stk4_6
  gRNA
ucuguucaaaguaucgaagu

SEQ ID NO: 132144 - RNA, 20 nt, Artificial Sequence
  mmSKRIPTE0002923_Stk4_7
  gRNA
ugacuggcuggacgugagag

SEQ ID NO: 132145 - RNA, 20 nt, Artificial Sequence
  mmSKRIPTE0002924_Stk4_8
  gRNA
uuguaucgcgacaucugcug

SEQ ID NO: 132146 - RNA, 20 nt, Artificial Sequence
  mmSKRIPTE0002925_Stk4_9
  gRNA
gaggcguaugugcuguucgg

SEQ ID NO: 132147 - RNA, 20 nt, Artificial Sequence
  mmSKRIPTE0002926_Nfauc2_1
  gRNA
acgccuucuaccaaguacac

SEQ ID NO: 132148 - RNA, 20 nt, Artificial Sequence
  mmSKRIPTE0002927_Nfauc2_2
  gRNA
cucaucaacagugaucuacg

SEQ ID NO: 132149 - RNA, 20 nt, Artificial Sequence
  mmSKRIPTE0002928_Nfauc2_3
  gRNA
gagcccgacugauuggagag

SEQ ID NO: 132150 - RNA, 20 nt, Artificial Sequence
  mmSKRIPTE0002929_Nfauc2_4
  gRNA
cggguucguauagagucgcg

SEQ ID NO: 132151 - RNA, 20 nt, Artificial Sequence
  mmSKRIPTE0002930_Nfauc2_5
  gRNA
accucgaaccagccucgccg

SEQ ID NO: 132152 - RNA, 20 nt, Artificial Sequence
  mmSKRIPTE0002931_Nfauc2_6
  gRNA
aucugaacccuaucgaaggu

SEQ ID NO: 132153 - RNA, 20 nt, Artificial Sequence
  mmSKRIPTE0002932_Nfauc2_7
  gRNA
gcggaggcauucgugcgcag

SEQ ID NO: 132154 - RNA, 20 nt, Artificial Sequence
  mmSKRIPTE0002933_Nfauc2_8
  gRNA
gucaccguaucuguggcgca

SEQ ID NO: 132155 - RNA, 20 nt, Artificial Sequence
  mmSKRIPTE0002934_Nfauc2_9
  gRNA
ccaucgagugcuguaaguca

SEQ ID NO: 132156 - RNA, 20 nt, Artificial Sequence
  mmSKRIPTE0002935_Il12a_1
  gRNA
gaugacgaagacaaacuccu

SEQ ID NO: 132157 - RNA, 20 nt, Artificial Sequence
  mmSKRIPTE0002936_Il12a_2
  gRNA
guaucuggcaggaaccguag

SEQ ID NO: 132158 - RNA, 20 nt, Artificial Sequence
  mmSKRIPTE0002937_Il12a_3
  gRNA
aaucacgcuguaaguaccug

SEQ ID NO: 132159 - RNA, 20 nt, Artificial Sequence
  mmSKRIPTE0002938_Il12a_4
  gRNA
ucugcuaacacauugagggg

SEQ ID NO: 132160 - RNA, 20 nt, Artificial Sequence
  mmSKRIPTE0002939_Il12a_5
  gRNA
ucgggacuggcuaagacacc

SEQ ID NO: 132161 - RNA, 20 nt, Artificial Sequence
  mmSKRIPTE0002940_Il12a_6
  gRNA
uggaacuacacaagguaugg

SEQ ID NO: 132162 - RNA, 20 nt, Artificial Sequence
  mmSKRIPTE0002941_Il12a_7
  gRNA
uuauuguagaggcccccuca

SEQ ID NO: 132163 - RNA, 20 nt, Artificial Sequence
  mmSKRIPTE0002942_Il12a_8
  gRNA
auaauuuaagcccuuccccg

SEQ ID NO: 132164 - RNA, 20 nt, Artificial Sequence
  mmSKRIPTE0002943_Il12a_9
  gRNA
guuagaagucaugucaacag

SEQ ID NO: 132165 - RNA, 20 nt, Artificial Sequence
  mmSKRIPTE0002944_Efna4_1
  gRNA
acgccguguagcauguucga

SEQ ID NO: 132166 - RNA, 20 nt, Artificial Sequence
  mmSKRIPTE0002945_Efna4_2
  gRNA
auaaaucacccguucuagug

SEQ ID NO: 132167 - RNA, 20 nt, Artificial Sequence
  mmSKRIPTE0002946_Efna4_3
  gRNA
ugugcccacagguugcuccg

SEQ ID NO: 132168 - RNA, 20 nt, Artificial Sequence
  mmSKRIPTE0002947_Efna4_4
  gRNA
ccgacaguccgacaguccgg

SEQ ID NO: 132169 - RNA, 20 nt, Artificial Sequence
  mmSKRIPTE0002948_Efna4_5
  gRNA
gagaaagcgguacguccggg

SEQ ID NO: 132170 - RNA, 20 nt, Artificial Sequence
  mmSKRIPTE0002949_Efna4_6
  gRNA
gagccuugaccaccugagcg

SEQ ID NO: 132171 - RNA, 20 nt, Artificial Sequence
  mmSKRIPTE0002950_Efna4_7
  gRNA
gugaagacggacuugccaug

SEQ ID NO: 132172 - RNA, 20 nt, Artificial Sequence
  mmSKRIPTE0002951_Efna4_8
  gRNA
ggagagcgguaagugaacca

SEQ ID NO: 132173 - RNA, 20 nt, Artificial Sequence
  mmSKRIPTE0002952_Efna4_9
  gRNA
gauaugccacacacaugcgc

SEQ ID NO: 132174 - RNA, 20 nt, Artificial Sequence
  mmSKRIPTE0002953_Cdk6_1
  gRNA
ccaaccauguggcaacgacg

SEQ ID NO: 132175 - RNA, 20 nt, Artificial Sequence
  mmSKRIPTE0002954_Cdk6_2
  gRNA
uguuugaugugugagacgcg

SEQ ID NO: 132176 - RNA, 20 nt, Artificial Sequence
  mmSKRIPTE0002955_Cdk6_3
  gRNA
aauacacccuacugaaucug

SEQ ID NO: 132177 - RNA, 20 nt, Artificial Sequence
  mmSKRIPTE0002956_Cdk6_4
  gRNA
acggacacucgaaguaaggg

SEQ ID NO: 132178 - RNA, 20 nt, Artificial Sequence
  mmSKRIPTE0002957_Cdk6_5
  gRNA
cuaaggacgucaucccacgg

SEQ ID NO: 132179 - RNA, 20 nt, Artificial Sequence
  mmSKRIPTE0002958_Cdk6_6
  gRNA
caggacccccugauuuagug

SEQ ID NO: 132180 - RNA, 20 nt, Artificial Sequence
  mmSKRIPTE0002959_Cdk6_7
  gRNA
ucucgagggaaugucccgcg

SEQ ID NO: 132181 - RNA, 20 nt, Artificial Sequence
  mmSKRIPTE0002960_Cdk6_8
  gRNA
uggggauaaaguccaccccg

SEQ ID NO: 132182 - RNA, 20 nt, Artificial Sequence
  mmSKRIPTE0002961_Cdk6_9
  gRNA
uggcauagccccaccguacg

SEQ ID NO: 132183 - RNA, 20 nt, Artificial Sequence
  mmSKRIPTE0002962_Flt3_1
  gRNA
cgugugccacgaccgcaucg

SEQ ID NO: 132184 - RNA, 20 nt, Artificial Sequence
  mmSKRIPTE0002963_Flt3_2
  gRNA
uuacgguaaacaccacgggu

SEQ ID NO: 132185 - RNA, 20 nt, Artificial Sequence
  mmSKRIPTE0002964_Flt3_3
  gRNA
acccacgaauccgaugcacg

SEQ ID NO: 132186 - RNA, 20 nt, Artificial Sequence
  mmSKRIPTE0002965_Flt3_4
  gRNA
gagcuuaugcgagccuggug

SEQ ID NO: 132187 - RNA, 20 nt, Artificial Sequence
  mmSKRIPTE0002966_Flt3_5
  gRNA
cugaauccgcauuagugucg

SEQ ID NO: 132188 - RNA, 20 nt, Artificial Sequence
  mmSKRIPTE0002967_Flt3_6
  gRNA
uagcucucacacgaccacag

SEQ ID NO: 132189 - RNA, 20 nt, Artificial Sequence
  mmSKRIPTE0002968_Flt3_7
  gRNA
ggggcuaagucuauagcucg

SEQ ID NO: 132190 - RNA, 20 nt, Artificial Sequence
  mmSKRIPTE0002969_Flt3_8
  gRNA
acgcgagaccgauuagaacu

SEQ ID NO: 132191 - RNA, 20 nt, Artificial Sequence
  mmSKRIPTE0002970_Flt3_9
  gRNA
ggagacaguucuagaagucg

SEQ ID NO: 132192 - RNA, 20 nt, Artificial Sequence
  mmSKRIPTE0002971_Rras_1
  gRNA
cgguggcgacaugagcagcg

SEQ ID NO: 132193 - RNA, 20 nt, Artificial Sequence
  mmSKRIPTE0002972_Rras_2
  gRNA
auacagucgagcacaccuug

SEQ ID NO: 132194 - RNA, 20 nt, Artificial Sequence
  mmSKRIPTE0002973_Rras_3
  gRNA
aagaggaggcuucagaccgg

SEQ ID NO: 132195 - RNA, 20 nt, Artificial Sequence
  mmSKRIPTE0002974_Rras_4
  gRNA
agcuugugagucucgccggg

SEQ ID NO: 132196 - RNA, 20 nt, Artificial Sequence
  mmSKRIPTE0002975_Rras_5
  gRNA
agaaacgugugggucccccc

SEQ ID NO: 132197 - RNA, 20 nt, Artificial Sequence
  mmSKRIPTE0002976_Rras_6
  gRNA
ugguguuugccauuaacgac

SEQ ID NO: 132198 - RNA, 20 nt, Artificial Sequence
  mmSKRIPTE0002977_Rras_7
  gRNA
augcagggcugaugaccggg

SEQ ID NO: 132199 - RNA, 20 nt, Artificial Sequence
  mmSKRIPTE0002978_Rras_8
  gRNA
uugugacaauagagggacca

SEQ ID NO: 132200 - RNA, 20 nt, Artificial Sequence
  mmSKRIPTE0002979_Rras_9
  gRNA
acugcgucugaaugucgaug

SEQ ID NO: 132201 - RNA, 20 nt, Artificial Sequence
  mmSKRIPTE0002980_Nlrp6_1
  gRNA
cacgccaugccgcuacaggg

SEQ ID NO: 132202 - RNA, 20 nt, Artificial Sequence
  mmSKRIPTE0002981_Nlrp6_2
  gRNA
cugcuguugcuuaagucgcg

SEQ ID NO: 132203 - RNA, 20 nt, Artificial Sequence
  mmSKRIPTE0002982_Nlrp6_3
  gRNA
gcccaaaguuucauucgcgg

SEQ ID NO: 132204 - RNA, 20 nt, Artificial Sequence
  mmSKRIPTE0002983_Nlrp6_4
  gRNA
guauacaccaggauaacggc

SEQ ID NO: 132205 - RNA, 20 nt, Artificial Sequence
  mmSKRIPTE0002984_Nlrp6_5
  gRNA
uggaaggcaaacccgacaug

SEQ ID NO: 132206 - RNA, 20 nt, Artificial Sequence
  mmSKRIPTE0002985_Nlrp6_6
  gRNA
auggccgcagcaucccgugg

SEQ ID NO: 132207 - RNA, 20 nt, Artificial Sequence
  mmSKRIPTE0002986_Nlrp6_7
  gRNA
ugauaaccccaauggcggag

SEQ ID NO: 132208 - RNA, 20 nt, Artificial Sequence
  mmSKRIPTE0002987_Nlrp6_8
  gRNA
uagaagcugagcgaacuccg

SEQ ID NO: 132209 - RNA, 20 nt, Artificial Sequence
  mmSKRIPTE0002988_Nlrp6_9
  gRNA
ggucucggcaaacugcauca

SEQ ID NO: 132210 - RNA, 20 nt, Artificial Sequence
  mmSKRIPTE0002989_Pdgfd_1
  gRNA
agacugguagaccgacggug

SEQ ID NO: 132211 - RNA, 20 nt, Artificial Sequence
  mmSKRIPTE0002990_Pdgfd_2
  gRNA
cgucuggcucuucugcggaa

SEQ ID NO: 132212 - RNA, 20 nt, Artificial Sequence
  mmSKRIPTE0002991_Pdgfd_3
  gRNA
uacccugucagauuauaggg

SEQ ID NO: 132213 - RNA, 20 nt, Artificial Sequence
  mmSKRIPTE0002992_Pdgfd_4
  gRNA
ucgugggaagaagacugcau

SEQ ID NO: 132214 - RNA, 20 nt, Artificial Sequence
  mmSKRIPTE0002993_Pdgfd_5
  gRNA
uauuuacugaaguccccuag

SEQ ID NO: 132215 - RNA, 20 nt, Artificial Sequence
  mmSKRIPTE0002994_Pdgfd_6
  gRNA
ucaucugagaugucaugccg

SEQ ID NO: 132216 - RNA, 20 nt, Artificial Sequence
  mmSKRIPTE0002995_Pdgfd_7
  gRNA
auaauuaugccacugccaca

SEQ ID NO: 132217 - RNA, 20 nt, Artificial Sequence
  mmSKRIPTE0002996_Pdgfd_8
  gRNA
agcagcuaaaguucgcgcac

SEQ ID NO: 132218 - RNA, 20 nt, Artificial Sequence
  mmSKRIPTE0002997_Pdgfd_9
  gRNA
uaguccgaauugauggucaa

SEQ ID NO: 132219 - RNA, 20 nt, Artificial Sequence
  mmSKRIPTE0002998_Icosl_1
  gRNA
guaaugcuuuguacucggga

SEQ ID NO: 132220 - RNA, 20 nt, Artificial Sequence
  mmSKRIPTE0002999_Icosl_2
  gRNA
agagacugaagucggugcaa

SEQ ID NO: 132221 - RNA, 20 nt, Artificial Sequence
  mmSKRIPTE0003000_Icosl_3
  gRNA
ccgagggagaucucuccagu

SEQ ID NO: 132222 - RNA, 20 nt, Artificial Sequence
  mmSKRIPTE0003001_Icosl_4
  gRNA
ccagugugaugcucguccug

SEQ ID NO: 132223 - RNA, 20 nt, Artificial Sequence
  mmSKRIPTE0003002_Icosl_5
  gRNA
gcucccuuggacaucucgug

SEQ ID NO: 132224 - RNA, 20 nt, Artificial Sequence
  mmSKRIPTE0003003_Icosl_6
  gRNA
acggacucacuuuagcugca

SEQ ID NO: 132225 - RNA, 20 nt, Artificial Sequence
  mmSKRIPTE0003004_Icosl_7
  gRNA
auugcccgacgcuagcgcag

SEQ ID NO: 132226 - RNA, 20 nt, Artificial Sequence
  mmSKRIPTE0003005_Icosl_8
  gRNA
aggaggaaucagacguuaca

SEQ ID NO: 132227 - RNA, 20 nt, Artificial Sequence
  mmSKRIPTE0003006_Icosl_9
  gRNA
ucggacgcggagaguugcag

SEQ ID NO: 132228 - RNA, 20 nt, Artificial Sequence
  mmSKRIPTE0003007_Ube2n_1
  gRNA
gaggccucucuaaggcaucg

SEQ ID NO: 132229 - RNA, 20 nt, Artificial Sequence
  mmSKRIPTE0003008_Ube2n_2
  gRNA
ugaagggacagcauaggcgu

SEQ ID NO: 132230 - RNA, 20 nt, Artificial Sequence
  mmSKRIPTE0003009_Ube2n_3
  gRNA
cagggacuacauuucccgag

SEQ ID NO: 132231 - RNA, 20 nt, Artificial Sequence
  mmSKRIPTE0003010_Ube2n_4
  gRNA
gaccuaaugaacccggcaag

SEQ ID NO: 132232 - RNA, 20 nt, Artificial Sequence
  mmSKRIPTE0003011_Ube2n_5
  gRNA
caucaagguaaccgcccagg

SEQ ID NO: 132233 - RNA, 20 nt, Artificial Sequence
  mmSKRIPTE0003012_Ube2n_6
  gRNA
ccacucgagcgugaggagag

SEQ ID NO: 132234 - RNA, 20 nt, Artificial Sequence
  mmSKRIPTE0003013_Ube2n_7
  gRNA
guaaggcaucagcuaugacu

SEQ ID NO: 132235 - RNA, 20 nt, Artificial Sequence
  mmSKRIPTE0003014_Ube2n_8
  gRNA
uuagacugaugaucauugug

SEQ ID NO: 132236 - RNA, 20 nt, Artificial Sequence
  mmSKRIPTE0003015_Ube2n_9
  gRNA
gcuuguccggcguucagagg

SEQ ID NO: 132237 - RNA, 20 nt, Artificial Sequence
  mmSKRIPTE0003016_Sox4_1
  gRNA
ugugggcggaaucggcgcug

SEQ ID NO: 132238 - RNA, 20 nt, Artificial Sequence
  mmSKRIPTE0003017_Sox4_2
  gRNA
cgaggaguuucuccaaacgu

SEQ ID NO: 132239 - RNA, 20 nt, Artificial Sequence
  mmSKRIPTE0003018_Sox4_3
  gRNA
gucccgaucgagcgccgaug

SEQ ID NO: 132240 - RNA, 20 nt, Artificial Sequence
  mmSKRIPTE0003019_Sox4_4
  gRNA
uuggagcuucucauugcacg

SEQ ID NO: 132241 - RNA, 20 nt, Artificial Sequence
  mmSKRIPTE0003020_Sox4_5
  gRNA
ccgccaaccuagaguccccg

SEQ ID NO: 132242 - RNA, 20 nt, Artificial Sequence
  mmSKRIPTE0003021_Sox4_6
  gRNA
agaagcgcgaggcggaauug

SEQ ID NO: 132243 - RNA, 20 nt, Artificial Sequence
  mmSKRIPTE0003022_Sox4_7
  gRNA
aaauggacauggggaccucg

SEQ ID NO: 132244 - RNA, 20 nt, Artificial Sequence
  mmSKRIPTE0003023_Sox4_8
  gRNA
uugcaguucacgagagcucg

SEQ ID NO: 132245 - RNA, 20 nt, Artificial Sequence
  mmSKRIPTE0003024_Sox4_9
  gRNA
gcaaagcuucuaaagaccga

SEQ ID NO: 132246 - RNA, 20 nt, Artificial Sequence
  mmSKRIPTE0003025_Map3k8_1
  gRNA
gaacugcgaccuaggagacg

SEQ ID NO: 132247 - RNA, 20 nt, Artificial Sequence
  mmSKRIPTE0003026_Map3k8_2
  gRNA
cuaagcaacuccaucaccgu

SEQ ID NO: 132248 - RNA, 20 nt, Artificial Sequence
  mmSKRIPTE0003027_Map3k8_3
  gRNA
acaccuugcgcaagaccgcg

SEQ ID NO: 132249 - RNA, 20 nt, Artificial Sequence
  mmSKRIPTE0003028_Map3k8_4
  gRNA
gcccacuguuaaaugcagug

SEQ ID NO: 132250 - RNA, 20 nt, Artificial Sequence
  mmSKRIPTE0003029_Map3k8_5
  gRNA
aucugucagauaugggaccg

SEQ ID NO: 132251 - RNA, 20 nt, Artificial Sequence
  mmSKRIPTE0003030_Map3k8_6
  gRNA
cccaccggugaacacucgag

SEQ ID NO: 132252 - RNA, 20 nt, Artificial Sequence
  mmSKRIPTE0003031_Map3k8_7
  gRNA
cauccaucagccguauucca

SEQ ID NO: 132253 - RNA, 20 nt, Artificial Sequence
  mmSKRIPTE0003032_Map3k8_8
  gRNA
auguguauaacagagcaccg

SEQ ID NO: 132254 - RNA, 20 nt, Artificial Sequence
  mmSKRIPTE0003033_Map3k8_9
  gRNA
gcuacuucaauauuguucgu

SEQ ID NO: 132255 - RNA, 20 nt, Artificial Sequence
  mmSKRIPTE0003034_Rock1_1
  gRNA
cgauaccuucuugcccgcag

SEQ ID NO: 132256 - RNA, 20 nt, Artificial Sequence
  mmSKRIPTE0003035_Rock1_2
  gRNA
ucagggcuagcuaaacaacu

SEQ ID NO: 132257 - RNA, 20 nt, Artificial Sequence
  mmSKRIPTE0003036_Rock1_3
  gRNA
caagcaccaaucuaucgaag

SEQ ID NO: 132258 - RNA, 20 nt, Artificial Sequence
  mmSKRIPTE0003037_Rock1_4
  gRNA
cgaacggacccuuaaaacac

SEQ ID NO: 132259 - RNA, 20 nt, Artificial Sequence
  mmSKRIPTE0003038_Rock1_5
  gRNA
cugcggcuacaaacccaccg

SEQ ID NO: 132260 - RNA, 20 nt, Artificial Sequence
  mmSKRIPTE0003039_Rock1_6
  gRNA
ucgcugucacaccgagccug

SEQ ID NO: 132261 - RNA, 20 nt, Artificial Sequence
  mmSKRIPTE0003040_Rock1_7
  gRNA
acaucaacucuuguuaccag

SEQ ID NO: 132262 - RNA, 20 nt, Artificial Sequence
  mmSKRIPTE0003041_Rock1_8
  gRNA
uguaguaauccauacaacca

SEQ ID NO: 132263 - RNA, 20 nt, Artificial Sequence
  mmSKRIPTE0003042_Rock1_9
  gRNA
gcucguaggugaguaaagca

SEQ ID NO: 132264 - RNA, 20 nt, Artificial Sequence
  mmSKRIPTE0003043_Ticam2_1
  gRNA
uuugcagaaucuagacgaug

SEQ ID NO: 132265 - RNA, 20 nt, Artificial Sequence
  mmSKRIPTE0003044_Ticam2_2
  gRNA
ucgaaguucuaugagcggaa

SEQ ID NO: 132266 - RNA, 20 nt, Artificial Sequence
  mmSKRIPTE0003045_Ticam2_3
  gRNA
agugguacugcuugaccacg

SEQ ID NO: 132267 - RNA, 20 nt, Artificial Sequence
  mmSKRIPTE0003046_Ticam2_4
  gRNA
acaacuccgucauacccaug

SEQ ID NO: 132268 - RNA, 20 nt, Artificial Sequence
  mmSKRIPTE0003047_Ticam2_5
  gRNA
ucgaaaguagcccaauccua

SEQ ID NO: 132269 - RNA, 20 nt, Artificial Sequence
  mmSKRIPTE0003048_Ticam2_6
  gRNA
ugcagaagaugacaccgacg

SEQ ID NO: 132270 - RNA, 20 nt, Artificial Sequence
  mmSKRIPTE0003049_Ticam2_7
  gRNA
uucauguaaagucacaaucc

SEQ ID NO: 132271 - RNA, 20 nt, Artificial Sequence
  mmSKRIPTE0003050_Ticam2_8
  gRNA
cugcggaugaaugugccagu

SEQ ID NO: 132272 - RNA, 20 nt, Artificial Sequence
  mmSKRIPTE0003051_Ticam2_9
  gRNA
gagacgccuuagccuccagu

SEQ ID NO: 132273 - RNA, 20 nt, Artificial Sequence
  mmSKRIPTE0003052_Gal_1
  gRNA
agacugcgaugguaucagug

SEQ ID NO: 132274 - RNA, 20 nt, Artificial Sequence
  mmSKRIPTE0003053_Gal_2
  gRNA
acagugcauaggguaaugga

SEQ ID NO: 132275 - RNA, 20 nt, Artificial Sequence
  mmSKRIPTE0003054_Gal_3
  gRNA
guuagacagccuaggacccg

SEQ ID NO: 132276 - RNA, 20 nt, Artificial Sequence
  mmSKRIPTE0003055_Gal_4
  gRNA
cugccgcuauuuaugcccag

SEQ ID NO: 132277 - RNA, 20 nt, Artificial Sequence
  mmSKRIPTE0003056_Gal_5
  gRNA
cagcccugcaucacucacgu

SEQ ID NO: 132278 - RNA, 20 nt, Artificial Sequence
  mmSKRIPTE0003057_Gal_6
  gRNA
gagagcgguuccggucacag

SEQ ID NO: 132279 - RNA, 20 nt, Artificial Sequence
  mmSKRIPTE0003058_Gal_7
  gRNA
aggaugguucauugucccug

SEQ ID NO: 132280 - RNA, 20 nt, Artificial Sequence
  mmSKRIPTE0003059_Gal_8
  gRNA
gucaggcucuaguccuccug

SEQ ID NO: 132281 - RNA, 20 nt, Artificial Sequence
  mmSKRIPTE0003060_Gal_9
  gRNA
agaucauuuagcgacaagca

SEQ ID NO: 132282 - RNA, 20 nt, Artificial Sequence
  mmSKRIPTE0003061_Zc3h8_1
  gRNA
uuguguuuccgcagucagcg

SEQ ID NO: 132283 - RNA, 20 nt, Artificial Sequence
  mmSKRIPTE0003062_Zc3h8_2
  gRNA
gcacacgaucacgacgacac

SEQ ID NO: 132284 - RNA, 20 nt, Artificial Sequence
  mmSKRIPTE0003063_Zc3h8_3
  gRNA
acuacacuacagcgucguca

SEQ ID NO: 132285 - RNA, 20 nt, Artificial Sequence
  mmSKRIPTE0003064_Zc3h8_4
  gRNA
cucccguucgacacgcagag

SEQ ID NO: 132286 - RNA, 20 nt, Artificial Sequence
  mmSKRIPTE0003065_Zc3h8_5
  gRNA
ccaucauagcucucgacugg

SEQ ID NO: 132287 - RNA, 20 nt, Artificial Sequence
  mmSKRIPTE0003066_Zc3h8_6
  gRNA
gguaugcugagacggugcau

SEQ ID NO: 132288 - RNA, 20 nt, Artificial Sequence
  mmSKRIPTE0003067_Zc3h8_7
  gRNA
ccuugacucauccucacacg

SEQ ID NO: 132289 - RNA, 20 nt, Artificial Sequence
  mmSKRIPTE0003068_Zc3h8_8
  gRNA
guacugaacaaccagcgaag

SEQ ID NO: 132290 - RNA, 20 nt, Artificial Sequence
  mmSKRIPTE0003069_Zc3h8_9
  gRNA
uaugccuuauaauaacgcag

SEQ ID NO: 132291 - RNA, 20 nt, Artificial Sequence
  mmSKRIPTE0003070_Pik3ca_1
  gRNA
gcgcacuauuuaugacccag

SEQ ID NO: 132292 - RNA, 20 nt, Artificial Sequence
  mmSKRIPTE0003071_Pik3ca_2
  gRNA
acggugcguaaguaccaaca

SEQ ID NO: 132293 - RNA, 20 nt, Artificial Sequence
  mmSKRIPTE0003072_Pik3ca_3
  gRNA
acaaggacggucaucuacag

SEQ ID NO: 132294 - RNA, 20 nt, Artificial Sequence
  mmSKRIPTE0003073_Pik3ca_4
  gRNA
ccaguguucugucuaacacg

SEQ ID NO: 132295 - RNA, 20 nt, Artificial Sequence
  mmSKRIPTE0003074_Pik3ca_5
  gRNA
acgugccccaaccccgacau

SEQ ID NO: 132296 - RNA, 20 nt, Artificial Sequence
  mmSKRIPTE0003075_Pik3ca_6
  gRNA
caaccgggugagauaacuga

SEQ ID NO: 132297 - RNA, 20 nt, Artificial Sequence
  mmSKRIPTE0003076_Pik3ca_7
  gRNA
ccaucuucgggugaacugug

SEQ ID NO: 132298 - RNA, 20 nt, Artificial Sequence
  mmSKRIPTE0003077_Pik3ca_8
  gRNA
uaugugcuauggaaacggag

SEQ ID NO: 132299 - RNA, 20 nt, Artificial Sequence
  mmSKRIPTE0003078_Pik3ca_9
  gRNA
uacggauacguagcuuacga

SEQ ID NO: 132300 - RNA, 20 nt, Artificial Sequence
  mmSKRIPTE0003079_Pik3cd_1
  gRNA
acgaggcuugagacgguggu

SEQ ID NO: 132301 - RNA, 20 nt, Artificial Sequence
  mmSKRIPTE0003080_Pik3cd_2
  gRNA
caaccuuaagcaacagcucg

SEQ ID NO: 132302 - RNA, 20 nt, Artificial Sequence
  mmSKRIPTE0003081_Pik3cd_3
  gRNA
ccagagaguagggucgacag

SEQ ID NO: 132303 - RNA, 20 nt, Artificial Sequence
  mmSKRIPTE0003082_Pik3cd_4
  gRNA
gacucacgucagcuuccgaa

SEQ ID NO: 132304 - RNA, 20 nt, Artificial Sequence
  mmSKRIPTE0003083_Pik3cd_5
  gRNA
cuugaagaacuagccaacgg

SEQ ID NO: 132305 - RNA, 20 nt, Artificial Sequence
  mmSKRIPTE0003084_Pik3cd_6
  gRNA
gugccccauuuagcuccgug

SEQ ID NO: 132306 - RNA, 20 nt, Artificial Sequence
  mmSKRIPTE0003085_Pik3cd_7
  gRNA
caccaccuaggcgcaccgug

SEQ ID NO: 132307 - RNA, 20 nt, Artificial Sequence
  mmSKRIPTE0003086_Pik3cd_8
  gRNA
ugagguuggcccaagcgaug

SEQ ID NO: 132308 - RNA, 20 nt, Artificial Sequence
  mmSKRIPTE0003087_Pik3cd_9
  gRNA
accacccauuaucaccacca

SEQ ID NO: 132309 - RNA, 20 nt, Artificial Sequence
  mmSKRIPTE0003088_Jchain_1
  gRNA
agucaggguagcaagaaucg

SEQ ID NO: 132310 - RNA, 20 nt, Artificial Sequence
  mmSKRIPTE0003089_Jchain_2
  gRNA
uaggaucaucccuuccaccg

SEQ ID NO: 132311 - RNA, 20 nt, Artificial Sequence
  mmSKRIPTE0003090_Jchain_3
  gRNA
auaccuaagugggaccauag

SEQ ID NO: 132312 - RNA, 20 nt, Artificial Sequence
  mmSKRIPTE0003091_Jchain_4
  gRNA
aggcuguccuuguaacaggu

SEQ ID NO: 132313 - RNA, 20 nt, Artificial Sequence
  mmSKRIPTE0003092_Jchain_5
  gRNA
cuguaagaaaugcgauccug

SEQ ID NO: 132314 - RNA, 20 nt, Artificial Sequence
  mmSKRIPTE0003093_Jchain_6
  gRNA
aacagaucccuguaguaggg

SEQ ID NO: 132315 - RNA, 20 nt, Artificial Sequence
  mmSKRIPTE0003094_Jchain_7
  gRNA
auaccucuuuauguaaugca

SEQ ID NO: 132316 - RNA, 20 nt, Artificial Sequence
  mmSKRIPTE0003095_Jchain_8
  gRNA
gccuaaucaucugcacagca

SEQ ID NO: 132317 - RNA, 20 nt, Artificial Sequence
  mmSKRIPTE0003096_Jchain_9
  gRNA
auacaucuccugcuucugaa

SEQ ID NO: 132318 - RNA, 20 nt, Artificial Sequence
  mmSKRIPTE0003097_Ephb4_1
  gRNA
cagaggucccuacugaaccg

SEQ ID NO: 132319 - RNA, 20 nt, Artificial Sequence
  mmSKRIPTE0003098_Ephb4_2
  gRNA
gacugaaggugaguucggcg

SEQ ID NO: 132320 - RNA, 20 nt, Artificial Sequence
  mmSKRIPTE0003099_Ephb4_3
  gRNA
caucauggugaagcguaucg

SEQ ID NO: 132321 - RNA, 20 nt, Artificial Sequence
  mmSKRIPTE0003100_Ephb4_4
  gRNA
ucacucgccuacccaucuug

SEQ ID NO: 132322 - RNA, 20 nt, Artificial Sequence
  mmSKRIPTE0003101_Ephb4_5
  gRNA
ccuccaaggacucaccaccg

SEQ ID NO: 132323 - RNA, 20 nt, Artificial Sequence
  mmSKRIPTE0003102_Ephb4_6
  gRNA
aaugucaccacugaccguga

SEQ ID NO: 132324 - RNA, 20 nt, Artificial Sequence
  mmSKRIPTE0003103_Ephb4_7
  gRNA
agccggaccacaaacccuag

SEQ ID NO: 132325 - RNA, 20 nt, Artificial Sequence
  mmSKRIPTE0003104_Ephb4_8
  gRNA
gcgaguacccgggaaaggug

SEQ ID NO: 132326 - RNA, 20 nt, Artificial Sequence
  mmSKRIPTE0003105_Ephb4_9
  gRNA
uucagagucguacaaacgug

SEQ ID NO: 132327 - RNA, 20 nt, Artificial Sequence
  mmSKRIPTE0003106_Epo_1
  gRNA
gcaaguucgucgguccacca

SEQ ID NO: 132328 - RNA, 20 nt, Artificial Sequence
  mmSKRIPTE0003107_Epo_2
  gRNA
guuggcaugacacagugacg

SEQ ID NO: 132329 - RNA, 20 nt, Artificial Sequence
  mmSKRIPTE0003108_Epo_3
  gRNA
aaaccccuuagugcacgugg

SEQ ID NO: 132330 - RNA, 20 nt, Artificial Sequence
  mmSKRIPTE0003109_Epo_4
  gRNA
agaacuguuaaagaacccug

SEQ ID NO: 132331 - RNA, 20 nt, Artificial Sequence
  mmSKRIPTE0003110_Epo_5
  gRNA
acaaauccgagcugauucug

SEQ ID NO: 132332 - RNA, 20 nt, Artificial Sequence
  mmSKRIPTE0003111_Epo_6
  gRNA
aaggaugaagacuugcagcg

SEQ ID NO: 132333 - RNA, 20 nt, Artificial Sequence
  mmSKRIPTE0003112_Epo_7
  gRNA
uccacugugaguguucggag

SEQ ID NO: 132334 - RNA, 20 nt, Artificial Sequence
  mmSKRIPTE0003113_Epo_8
  gRNA
ucuacgccaacuuccuccgg

SEQ ID NO: 132335 - RNA, 20 nt, Artificial Sequence
  mmSKRIPTE0003114_Epo_9
  gRNA
ucaguccuguauaauagcca

SEQ ID NO: 132336 - RNA, 20 nt, Artificial Sequence
  mmSKRIPTE0003115_Arhgef5_1
  gRNA
ugaagugcacugcuaauacg

SEQ ID NO: 132337 - RNA, 20 nt, Artificial Sequence
  mmSKRIPTE0003116_Arhgef5_2
  gRNA
gcaaaauugaaggucuacga

SEQ ID NO: 132338 - RNA, 20 nt, Artificial Sequence
  mmSKRIPTE0003117_Arhgef5_3
  gRNA
uccguucuccuccauccgag

SEQ ID NO: 132339 - RNA, 20 nt, Artificial Sequence
  mmSKRIPTE0003118_Arhgef5_4
  gRNA
guaugccagagucaacuuag

SEQ ID NO: 132340 - RNA, 20 nt, Artificial Sequence
  mmSKRIPTE0003119_Arhgef5_5
  gRNA
ccgauugaaagcuauucuag

SEQ ID NO: 132341 - RNA, 20 nt, Artificial Sequence
  mmSKRIPTE0003120_Arhgef5_6
  gRNA
ccucaugguaguccgacaug

SEQ ID NO: 132342 - RNA, 20 nt, Artificial Sequence
  mmSKRIPTE0003121_Arhgef5_7
  gRNA
cucgaggcuuguaggcacgg

SEQ ID NO: 132343 - RNA, 20 nt, Artificial Sequence
  mmSKRIPTE0003122_Arhgef5_8
  gRNA
ugccuuucgacgaugccgug

SEQ ID NO: 132344 - RNA, 20 nt, Artificial Sequence
  mmSKRIPTE0003123_Arhgef5_9
  gRNA
auccccugagagaacauacg

SEQ ID NO: 132345 - RNA, 20 nt, Artificial Sequence
  mmSKRIPTE0003124_Kau6a_1
  gRNA
accaacguaagggcuacggc

SEQ ID NO: 132346 - RNA, 20 nt, Artificial Sequence
  mmSKRIPTE0003125_Kau6a_2
  gRNA
gugaaucugcagucuccgcg

SEQ ID NO: 132347 - RNA, 20 nt, Artificial Sequence
  mmSKRIPTE0003126_Kau6a_3
  gRNA
aaacucgugcagacgcacga

SEQ ID NO: 132348 - RNA, 20 nt, Artificial Sequence
  mmSKRIPTE0003127_Kau6a_4
  gRNA
cacuuaacggaccuuacaug

SEQ ID NO: 132349 - RNA, 20 nt, Artificial Sequence
  mmSKRIPTE0003128_Kau6a_5
  gRNA
ggcaauggaaguacccucug

SEQ ID NO: 132350 - RNA, 20 nt, Artificial Sequence
  mmSKRIPTE0003129_Kau6a_6
  gRNA
guacauacuacagaggcgag

SEQ ID NO: 132351 - RNA, 20 nt, Artificial Sequence
  mmSKRIPTE0003130_Kau6a_7
  gRNA
cuggugacuuguaagccgag

SEQ ID NO: 132352 - RNA, 20 nt, Artificial Sequence
  mmSKRIPTE0003131_Kau6a_8
  gRNA
ugagagugaaggccuuacgg

SEQ ID NO: 132353 - RNA, 20 nt, Artificial Sequence
  mmSKRIPTE0003132_Kau6a_9
  gRNA
aaaauuauggacaagcccga

SEQ ID NO: 132354 - RNA, 20 nt, Artificial Sequence
  mmSKRIPTE0003133_Drd2_1
  gRNA
uuuccacugagucuccgucg

SEQ ID NO: 132355 - RNA, 20 nt, Artificial Sequence
  mmSKRIPTE0003134_Drd2_2
  gRNA
guuguggagauuauuuaccc

SEQ ID NO: 132356 - RNA, 20 nt, Artificial Sequence
  mmSKRIPTE0003135_Drd2_3
  gRNA
agaacucagacucucgucag

SEQ ID NO: 132357 - RNA, 20 nt, Artificial Sequence
  mmSKRIPTE0003136_Drd2_4
  gRNA
gccaucagcaucgacaggug

SEQ ID NO: 132358 - RNA, 20 nt, Artificial Sequence
  mmSKRIPTE0003137_Drd2_5
  gRNA
cagguucaguggauccauug

SEQ ID NO: 132359 - RNA, 20 nt, Artificial Sequence
  mmSKRIPTE0003138_Drd2_6
  gRNA
uggcgaucaugacaguaacu

SEQ ID NO: 132360 - RNA, 20 nt, Artificial Sequence
  mmSKRIPTE0003139_Drd2_7
  gRNA
gguacgaugaugaucuggag

SEQ ID NO: 132361 - RNA, 20 nt, Artificial Sequence
  mmSKRIPTE0003140_Drd2_8
  gRNA
agacgcuucgaccggugcag

SEQ ID NO: 132362 - RNA, 20 nt, Artificial Sequence
  mmSKRIPTE0003141_Drd2_9
  gRNA
acaugggucacacaagacag

SEQ ID NO: 132363 - RNA, 20 nt, Artificial Sequence
  mmSKRIPTE0003142_Atm_1
  gRNA
uaauucagcaugacaucgug

SEQ ID NO: 132364 - RNA, 20 nt, Artificial Sequence
  mmSKRIPTE0003143_Atm_2
  gRNA
acgguuuauguucggcugag

SEQ ID NO: 132365 - RNA, 20 nt, Artificial Sequence
  mmSKRIPTE0003144_Atm_3
  gRNA
auccaagugauaaucgacug

SEQ ID NO: 132366 - RNA, 20 nt, Artificial Sequence
  mmSKRIPTE0003145_Atm_4
  gRNA
uugaugguaggaucgaacag

SEQ ID NO: 132367 - RNA, 20 nt, Artificial Sequence
  mmSKRIPTE0003146_Atm_5
  gRNA
agccuguaaaccuucuaggu

SEQ ID NO: 132368 - RNA, 20 nt, Artificial Sequence
  mmSKRIPTE0003147_Atm_6
  gRNA
cccaacuccaagacccggag

SEQ ID NO: 132369 - RNA, 20 nt, Artificial Sequence
  mmSKRIPTE0003148_Atm_7
  gRNA
agcaccaaacccauuaggag

SEQ ID NO: 132370 - RNA, 20 nt, Artificial Sequence
  mmSKRIPTE0003149_Atm_8
  gRNA
uauaguagcuguugucacgu

SEQ ID NO: 132371 - RNA, 20 nt, Artificial Sequence
  mmSKRIPTE0003150_Atm_9
  gRNA
ucuaggcacgauaauagcac

SEQ ID NO: 132372 - RNA, 20 nt, Artificial Sequence
  mmSKRIPTE0003151_Impdh2_1
  gRNA
uaaucuaguuuauauuggcg

SEQ ID NO: 132373 - RNA, 20 nt, Artificial Sequence
  mmSKRIPTE0003152_Impdh2_2
  gRNA
uggaauggccaucgcgaugg

SEQ ID NO: 132374 - RNA, 20 nt, Artificial Sequence
  mmSKRIPTE0003153_Impdh2_3
  gRNA
gcauaggggcuacuuacgaa

SEQ ID NO: 132375 - RNA, 20 nt, Artificial Sequence
  mmSKRIPTE0003154_Impdh2_4
  gRNA
ugcugggaauuagaggcgug

SEQ ID NO: 132376 - RNA, 20 nt, Artificial Sequence
  mmSKRIPTE0003155_Impdh2_5
  gRNA
uuucuuagcuagagcacgca

SEQ ID NO: 132377 - RNA, 20 nt, Artificial Sequence
  mmSKRIPTE0003156_Impdh2_6
  gRNA
uccuuccagaaauacgaaca

SEQ ID NO: 132378 - RNA, 20 nt, Artificial Sequence
  mmSKRIPTE0003157_Impdh2_7
  gRNA
acccacucuaggaacuggau

SEQ ID NO: 132379 - RNA, 20 nt, Artificial Sequence
  mmSKRIPTE0003158_Impdh2_8
  gRNA
gccagcuccgccucuauacg

SEQ ID NO: 132380 - RNA, 20 nt, Artificial Sequence
  mmSKRIPTE0003159_Impdh2_9
  gRNA
cgggucuagggcacccaucg

SEQ ID NO: 132381 - RNA, 20 nt, Artificial Sequence
  mmSKRIPTE0003160_Cmtm7_1
  gRNA
ucgcaccccggguuucggug

SEQ ID NO: 132382 - RNA, 20 nt, Artificial Sequence
  mmSKRIPTE0003161_Cmtm7_2
  gRNA
gcgcgaugucucauggaucg

SEQ ID NO: 132383 - RNA, 20 nt, Artificial Sequence
  mmSKRIPTE0003162_Cmtm7_3
  gRNA
agaucccagucagaguugcg

SEQ ID NO: 132384 - RNA, 20 nt, Artificial Sequence
  mmSKRIPTE0003163_Cmtm7_4
  gRNA
ccaacuuccgcgugucuaga

SEQ ID NO: 132385 - RNA, 20 nt, Artificial Sequence
  mmSKRIPTE0003164_Cmtm7_5
  gRNA
ugauccauaagggaagccga

SEQ ID NO: 132386 - RNA, 20 nt, Artificial Sequence
  mmSKRIPTE0003165_Cmtm7_6
  gRNA
aaccuggggacccguacacg

SEQ ID NO: 132387 - RNA, 20 nt, Artificial Sequence
  mmSKRIPTE0003166_Cmtm7_7
  gRNA
ucacaaucccaauuugcccg

SEQ ID NO: 132388 - RNA, 20 nt, Artificial Sequence
  mmSKRIPTE0003167_Cmtm7_8
  gRNA
gacuuggucaucuuucuacg

SEQ ID NO: 132389 - RNA, 20 nt, Artificial Sequence
  mmSKRIPTE0003168_Cmtm7_9
  gRNA
ccacggcgcccuguucaaag

SEQ ID NO: 132390 - RNA, 20 nt, Artificial Sequence
  mmSKRIPTE0003169_Foxp3_1
  gRNA
ucccacgcucggguacaccc

SEQ ID NO: 132391 - RNA, 20 nt, Artificial Sequence
  mmSKRIPTE0003170_Foxp3_2
  gRNA
acggcggccuguuugcagug

SEQ ID NO: 132392 - RNA, 20 nt, Artificial Sequence
  mmSKRIPTE0003171_Foxp3_3
  gRNA
ccacgggcacuaucacacau

SEQ ID NO: 132393 - RNA, 20 nt, Artificial Sequence
  mmSKRIPTE0003172_Foxp3_4
  gRNA
accacucugucgugaaugug

SEQ ID NO: 132394 - RNA, 20 nt, Artificial Sequence
  mmSKRIPTE0003173_Foxp3_5
  gRNA
uaugucucuucauacaugcg

SEQ ID NO: 132395 - RNA, 20 nt, Artificial Sequence
  mmSKRIPTE0003174_Foxp3_6
  gRNA
gcuuacccaucggauaaggg

SEQ ID NO: 132396 - RNA, 20 nt, Artificial Sequence
  mmSKRIPTE0003175_Foxp3_7
  gRNA
cgguuuccauagguacacgu

SEQ ID NO: 132397 - RNA, 20 nt, Artificial Sequence
  mmSKRIPTE0003176_Foxp3_8
  gRNA
aacugauacacuaagccaag

SEQ ID NO: 132398 - RNA, 20 nt, Artificial Sequence
  mmSKRIPTE0003177_Foxp3_9
  gRNA
ugugccugagaacgaccagg

SEQ ID NO: 132399 - RNA, 20 nt, Artificial Sequence
  mmSKRIPTE0003178_Tsc1_1
  gRNA
aauagcccaacuucaccgga

SEQ ID NO: 132400 - RNA, 20 nt, Artificial Sequence
  mmSKRIPTE0003179_Tsc1_2
  gRNA
accaacguguugacaagcau

SEQ ID NO: 132401 - RNA, 20 nt, Artificial Sequence
  mmSKRIPTE0003180_Tsc1_3
  gRNA
guaccgugaccuaugcuaag

SEQ ID NO: 132402 - RNA, 20 nt, Artificial Sequence
  mmSKRIPTE0003181_Tsc1_4
  gRNA
cacagacagucaaacgaccg

SEQ ID NO: 132403 - RNA, 20 nt, Artificial Sequence
  mmSKRIPTE0003182_Tsc1_5
  gRNA
uaggggucgauaccaacacu

SEQ ID NO: 132404 - RNA, 20 nt, Artificial Sequence
  mmSKRIPTE0003183_Tsc1_6
  gRNA
cugaaaugcaacuugucucg

SEQ ID NO: 132405 - RNA, 20 nt, Artificial Sequence
  mmSKRIPTE0003184_Tsc1_7
  gRNA
aaagguuggacgccucacag

SEQ ID NO: 132406 - RNA, 20 nt, Artificial Sequence
  mmSKRIPTE0003185_Tsc1_8
  gRNA
acgauaaggugaguacuggu

SEQ ID NO: 132407 - RNA, 20 nt, Artificial Sequence
  mmSKRIPTE0003186_Tsc1_9
  gRNA
acaaggcagcuggacccgag

SEQ ID NO: 132408 - RNA, 20 nt, Artificial Sequence
  mmSKRIPTE0003187_Rassf2_1
  gRNA
guucauguguacgugccacg

SEQ ID NO: 132409 - RNA, 20 nt, Artificial Sequence
  mmSKRIPTE0003188_Rassf2_2
  gRNA
uaagcgcucuaauacacgag

SEQ ID NO: 132410 - RNA, 20 nt, Artificial Sequence
  mmSKRIPTE0003189_Rassf2_3
  gRNA
ugcauccgcucucgccgcag

SEQ ID NO: 132411 - RNA, 20 nt, Artificial Sequence
  mmSKRIPTE0003190_Rassf2_4
  gRNA
aaugauucggcaaaggcucg

SEQ ID NO: 132412 - RNA, 20 nt, Artificial Sequence
  mmSKRIPTE0003191_Rassf2_5
  gRNA
ucaagcguggcagauccgug

SEQ ID NO: 132413 - RNA, 20 nt, Artificial Sequence
  mmSKRIPTE0003192_Rassf2_6
  gRNA
gggcguuguugcucggugug

SEQ ID NO: 132414 - RNA, 20 nt, Artificial Sequence
  mmSKRIPTE0003193_Rassf2_7
  gRNA
gauucauugcauccgcccug

SEQ ID NO: 132415 - RNA, 20 nt, Artificial Sequence
  mmSKRIPTE0003194_Rassf2_8
  gRNA
ucaagcgaucaggcucaggu

SEQ ID NO: 132416 - RNA, 20 nt, Artificial Sequence
  mmSKRIPTE0003195_Rassf2_9
  gRNA
gaaugguggagucccgacag

SEQ ID NO: 132417 - RNA, 20 nt, Artificial Sequence
  mmSKRIPTE0003196_Hmgb2_1
  gRNA
acuaccacgaguguacaggc

SEQ ID NO: 132418 - RNA, 20 nt, Artificial Sequence
  mmSKRIPTE0003197_Hmgb2_2
  gRNA
aacuugaccagaccagucgc

SEQ ID NO: 132419 - RNA, 20 nt, Artificial Sequence
  mmSKRIPTE0003198_Hmgb2_3
  gRNA
ucuuaacgcguagacguggg

SEQ ID NO: 132420 - RNA, 20 nt, Artificial Sequence
  mmSKRIPTE0003199_Hmgb2_4
  gRNA
aaauuggaaguuacgagaug

SEQ ID NO: 132421 - RNA, 20 nt, Artificial Sequence
  mmSKRIPTE0003200_Hmgb2_5
  gRNA
ccaaucggaagccuucuccg

SEQ ID NO: 132422 - RNA, 20 nt, Artificial Sequence
  mmSKRIPTE0003201_Hmgb2_6
  gRNA
aaaaaacgagucaaucggca

SEQ ID NO: 132423 - RNA, 20 nt, Artificial Sequence
  mmSKRIPTE0003202_Hmgb2_7
  gRNA
agaaagccguguccggaccg

SEQ ID NO: 132424 - RNA, 20 nt, Artificial Sequence
  mmSKRIPTE0003203_Hmgb2_8
  gRNA
accccgacuccaaauuugag

SEQ ID NO: 132425 - RNA, 20 nt, Artificial Sequence
  mmSKRIPTE0003204_Hmgb2_9
  gRNA
gcagguaagguucggccggg

SEQ ID NO: 132426 - RNA, 20 nt, Artificial Sequence
  mmSKRIPTE0003205_Rab27a_1
  gRNA
cugccacagagaauugagcg

SEQ ID NO: 132427 - RNA, 20 nt, Artificial Sequence
  mmSKRIPTE0003206_Rab27a_2
  gRNA
cucacuuagcugauccgcag

SEQ ID NO: 132428 - RNA, 20 nt, Artificial Sequence
  mmSKRIPTE0003207_Rab27a_3
  gRNA
gcguuacagauggaugcccg

SEQ ID NO: 132429 - RNA, 20 nt, Artificial Sequence
  mmSKRIPTE0003208_Rab27a_4
  gRNA
aaaacuggacuucuacgagg

SEQ ID NO: 132430 - RNA, 20 nt, Artificial Sequence
  mmSKRIPTE0003209_Rab27a_5
  gRNA
acuguguuaaggcaggcgac

SEQ ID NO: 132431 - RNA, 20 nt, Artificial Sequence
  mmSKRIPTE0003210_Rab27a_6
  gRNA
caucugaauccuauauaccc

SEQ ID NO: 132432 - RNA, 20 nt, Artificial Sequence
  mmSKRIPTE0003211_Rab27a_7
  gRNA
gcgucaucgcaauugccaga

SEQ ID NO: 132433 - RNA, 20 nt, Artificial Sequence
  mmSKRIPTE0003212_Rab27a_8
  gRNA
ccuaaaugacccgccaccgu

SEQ ID NO: 132434 - RNA, 20 nt, Artificial Sequence
  mmSKRIPTE0003213_Rab27a_9
  gRNA
gacuucaguagugcccagag

SEQ ID NO: 132435 - RNA, 20 nt, Artificial Sequence
  mmSKRIPTE0003214_Nfkbia_1
  gRNA
ccagcguuuauagggcgccg

SEQ ID NO: 132436 - RNA, 20 nt, Artificial Sequence
  mmSKRIPTE0003215_Nfkbia_2
  gRNA
ccacuuauaaugucagacgc

SEQ ID NO: 132437 - RNA, 20 nt, Artificial Sequence
  mmSKRIPTE0003216_Nfkbia_3
  gRNA
ugaauaucauauaggcaucg

SEQ ID NO: 132438 - RNA, 20 nt, Artificial Sequence
  mmSKRIPTE0003217_Nfkbia_4
  gRNA
gccugggucuaggcgcugug

SEQ ID NO: 132439 - RNA, 20 nt, Artificial Sequence
  mmSKRIPTE0003218_Nfkbia_5
  gRNA
gaugacagggaaaccccccg

SEQ ID NO: 132440 - RNA, 20 nt, Artificial Sequence
  mmSKRIPTE0003219_Nfkbia_6
  gRNA
cucagcucauaauaaccucg

SEQ ID NO: 132441 - RNA, 20 nt, Artificial Sequence
  mmSKRIPTE0003220_Nfkbia_7
  gRNA
ggcuuguuccugaagaucgg

SEQ ID NO: 132442 - RNA, 20 nt, Artificial Sequence
  mmSKRIPTE0003221_Nfkbia_8
  gRNA
acagccgucagcgugcugag

SEQ ID NO: 132443 - RNA, 20 nt, Artificial Sequence
  mmSKRIPTE0003222_Nfkbia_9
  gRNA
gguagccguggauagaggcu

SEQ ID NO: 132444 - RNA, 20 nt, Artificial Sequence
  mmSKRIPTE0003223_Ednrb_1
  gRNA
cuagacaagaaugcgcaaag

SEQ ID NO: 132445 - RNA, 20 nt, Artificial Sequence
  mmSKRIPTE0003224_Ednrb_2
  gRNA
cugccguagaccagucggug

SEQ ID NO: 132446 - RNA, 20 nt, Artificial Sequence
  mmSKRIPTE0003225_Ednrb_3
  gRNA
agucccgagaagugacagcg

SEQ ID NO: 132447 - RNA, 20 nt, Artificial Sequence
  mmSKRIPTE0003226_Ednrb_4
  gRNA
ccuuucacaccgacaugacg

SEQ ID NO: 132448 - RNA, 20 nt, Artificial Sequence
  mmSKRIPTE0003227_Ednrb_5
  gRNA
uaguacaaguaccuccacag

SEQ ID NO: 132449 - RNA, 20 nt, Artificial Sequence
  mmSKRIPTE0003228_Ednrb_6
  gRNA
gccggugauuaacggccaga

SEQ ID NO: 132450 - RNA, 20 nt, Artificial Sequence
  mmSKRIPTE0003229_Ednrb_7
  gRNA
auaugauagcgaaaauaccg

SEQ ID NO: 132451 - RNA, 20 nt, Artificial Sequence
  mmSKRIPTE0003230_Ednrb_8
  gRNA
agugaaccuaaggcacgucg

SEQ ID NO: 132452 - RNA, 20 nt, Artificial Sequence
  mmSKRIPTE0003231_Ednrb_9
  gRNA
acacguagaggacuuaacaa

SEQ ID NO: 132453 - RNA, 20 nt, Artificial Sequence
  mmSKRIPTE0003232_Btnl2_1
  gRNA
acgguauagucuaucuggcg

SEQ ID NO: 132454 - RNA, 20 nt, Artificial Sequence
  mmSKRIPTE0003233_Btnl2_2
  gRNA
acagaucgaaccgagaccug

SEQ ID NO: 132455 - RNA, 20 nt, Artificial Sequence
  mmSKRIPTE0003234_Btnl2_3
  gRNA
ugaaaggccucggaaaacga

SEQ ID NO: 132456 - RNA, 20 nt, Artificial Sequence
  mmSKRIPTE0003235_Btnl2_4
  gRNA
ccauucucacgaggaucgug

SEQ ID NO: 132457 - RNA, 20 nt, Artificial Sequence
  mmSKRIPTE0003236_Btnl2_5
  gRNA
gagaagccaaaagauccacc

SEQ ID NO: 132458 - RNA, 20 nt, Artificial Sequence
  mmSKRIPTE0003237_Btnl2_6
  gRNA
gcccaauccaguagcacuag

SEQ ID NO: 132459 - RNA, 20 nt, Artificial Sequence
  mmSKRIPTE0003238_Btnl2_7
  gRNA
gaggagcugacacguuagca

SEQ ID NO: 132460 - RNA, 20 nt, Artificial Sequence
  mmSKRIPTE0003239_Btnl2_8
  gRNA
agaugagcaaaacaucgaga

SEQ ID NO: 132461 - RNA, 20 nt, Artificial Sequence
  mmSKRIPTE0003240_Btnl2_9
  gRNA
augcucagaacuuagaggug

SEQ ID NO: 132462 - RNA, 20 nt, Artificial Sequence
  mmSKRIPTE0003241_Galp_1
  gRNA
auggucaaauuccacgugcg

SEQ ID NO: 132463 - RNA, 20 nt, Artificial Sequence
  mmSKRIPTE0003242_Galp_2
  gRNA
guaggaaguccuacuugcac

SEQ ID NO: 132464 - RNA, 20 nt, Artificial Sequence
  mmSKRIPTE0003243_Galp_3
  gRNA
gaauacuggagguaaacaug

SEQ ID NO: 132465 - RNA, 20 nt, Artificial Sequence
  mmSKRIPTE0003244_Galp_4
  gRNA
ggucagacaaaggugccuug

SEQ ID NO: 132466 - RNA, 20 nt, Artificial Sequence
  mmSKRIPTE0003245_Galp_5
  gRNA
aguaugugcauaucugcaag

SEQ ID NO: 132467 - RNA, 20 nt, Artificial Sequence
  mmSKRIPTE0003246_Galp_6
  gRNA
ggucaacugacauaaccaug

SEQ ID NO: 132468 - RNA, 20 nt, Artificial Sequence
  mmSKRIPTE0003247_Galp_7
  gRNA
auuuauuagcaucguaugug

SEQ ID NO: 132469 - RNA, 20 nt, Artificial Sequence
  mmSKRIPTE0003248_Galp_8
  gRNA
aaaauuaauaugaggccggu

SEQ ID NO: 132470 - RNA, 20 nt, Artificial Sequence
  mmSKRIPTE0003249_Galp_9
  gRNA
guucuucagccggaugagug

SEQ ID NO: 132471 - RNA, 20 nt, Artificial Sequence
  mmSKRIPTE0003250_Nfauc3_1
  gRNA
guuugcaguagucaucggcg

SEQ ID NO: 132472 - RNA, 20 nt, Artificial Sequence
  mmSKRIPTE0003251_Nfauc3_2
  gRNA
ucgcagaggacucacgcgau

SEQ ID NO: 132473 - RNA, 20 nt, Artificial Sequence
  mmSKRIPTE0003252_Nfauc3_3
  gRNA
acugagggaagauucccggu

SEQ ID NO: 132474 - RNA, 20 nt, Artificial Sequence
  mmSKRIPTE0003253_Nfauc3_4
  gRNA
cuucaaacucgucuucggcg

SEQ ID NO: 132475 - RNA, 20 nt, Artificial Sequence
  mmSKRIPTE0003254_Nfauc3_5
  gRNA
cccagcaugaagcggcgcug

SEQ ID NO: 132476 - RNA, 20 nt, Artificial Sequence
  mmSKRIPTE0003255_Nfauc3_6
  gRNA
cugacaucgcacggucaugg

SEQ ID NO: 132477 - RNA, 20 nt, Artificial Sequence
  mmSKRIPTE0003256_Nfauc3_7
  gRNA
gccagcuuucuaggucggaa

SEQ ID NO: 132478 - RNA, 20 nt, Artificial Sequence
  mmSKRIPTE0003257_Nfauc3_8
  gRNA
acugaaauggaaacggugca

SEQ ID NO: 132479 - RNA, 20 nt, Artificial Sequence
  mmSKRIPTE0003258_Nfauc3_9
  gRNA
agccacggucgccucaacca

SEQ ID NO: 132480 - RNA, 20 nt, Artificial Sequence
  mmSKRIPTE0003259_Myo1g_1
  gRNA
aaucuuccccuccgucagug

SEQ ID NO: 132481 - RNA, 20 nt, Artificial Sequence
  mmSKRIPTE0003260_Myo1g_2
  gRNA
uuggccacggcguaaagaug

SEQ ID NO: 132482 - RNA, 20 nt, Artificial Sequence
  mmSKRIPTE0003261_Myo1g_3
  gRNA
caccgagggucucgguuucg

SEQ ID NO: 132483 - RNA, 20 nt, Artificial Sequence
  mmSKRIPTE0003262_Myo1g_4
  gRNA
ucacggacucuucaucacca

SEQ ID NO: 132484 - RNA, 20 nt, Artificial Sequence
  mmSKRIPTE0003263_Myo1g_5
  gRNA
guaugguucugggaccacca

SEQ ID NO: 132485 - RNA, 20 nt, Artificial Sequence
  mmSKRIPTE0003264_Myo1g_6
  gRNA
aucccaccuugcgagccaug

SEQ ID NO: 132486 - RNA, 20 nt, Artificial Sequence
  mmSKRIPTE0003265_Myo1g_7
  gRNA
gguguucccugucaacaggu

SEQ ID NO: 132487 - RNA, 20 nt, Artificial Sequence
  mmSKRIPTE0003266_Myo1g_8
  gRNA
gaucugagcacuacucacag

SEQ ID NO: 132488 - RNA, 20 nt, Artificial Sequence
  mmSKRIPTE0003267_Myo1g_9
  gRNA
accagugaagaucaaaggcg

SEQ ID NO: 132489 - RNA, 20 nt, Artificial Sequence
  mmSKRIPTE0003268_Top2a_1
  gRNA
ucuucucuauucguugccgg

SEQ ID NO: 132490 - RNA, 20 nt, Artificial Sequence
  mmSKRIPTE0003269_Top2a_2
  gRNA
ccucuucaggaccgucacca

SEQ ID NO: 132491 - RNA, 20 nt, Artificial Sequence
  mmSKRIPTE0003270_Top2a_3
  gRNA
uagccacuugcuaagcuccg

SEQ ID NO: 132492 - RNA, 20 nt, Artificial Sequence
  mmSKRIPTE0003271_Top2a_4
  gRNA
ucggcacguaccgucuacca

SEQ ID NO: 132493 - RNA, 20 nt, Artificial Sequence
  mmSKRIPTE0003272_Top2a_5
  gRNA
ugagacagucgggcugcacg

SEQ ID NO: 132494 - RNA, 20 nt, Artificial Sequence
  mmSKRIPTE0003273_Top2a_6
  gRNA
gguagaguuagcaggcgcgu

SEQ ID NO: 132495 - RNA, 20 nt, Artificial Sequence
  mmSKRIPTE0003274_Top2a_7
  gRNA
aucgucgucauaguuacugg

SEQ ID NO: 132496 - RNA, 20 nt, Artificial Sequence
  mmSKRIPTE0003275_Top2a_8
  gRNA
ucucaaguucaagauuggug

SEQ ID NO: 132497 - RNA, 20 nt, Artificial Sequence
  mmSKRIPTE0003276_Top2a_9
  gRNA
uucugugcuagagcgacccg

SEQ ID NO: 132498 - RNA, 20 nt, Artificial Sequence
  mmSKRIPTE0003277_Sox11_1
  gRNA
gcccuucagcguuauccacg

SEQ ID NO: 132499 - RNA, 20 nt, Artificial Sequence
  mmSKRIPTE0003278_Sox11_2
  gRNA
gcggcuuaaagguccccgcg

SEQ ID NO: 132500 - RNA, 20 nt, Artificial Sequence
  mmSKRIPTE0003279_Sox11_3
  gRNA
guaagugucccguagcacua

SEQ ID NO: 132501 - RNA, 20 nt, Artificial Sequence
  mmSKRIPTE0003280_Sox11_4
  gRNA
uauacauggaacguuaugag

SEQ ID NO: 132502 - RNA, 20 nt, Artificial Sequence
  mmSKRIPTE0003281_Sox11_5
  gRNA
uucacguauugagaggcgca

SEQ ID NO: 132503 - RNA, 20 nt, Artificial Sequence
  mmSKRIPTE0003282_Sox11_6
  gRNA
cgcgcucaaugagauacgag

SEQ ID NO: 132504 - RNA, 20 nt, Artificial Sequence
  mmSKRIPTE0003283_Sox11_7
  gRNA
agcgcgaucucauagcgcgu

SEQ ID NO: 132505 - RNA, 20 nt, Artificial Sequence
  mmSKRIPTE0003284_Sox11_8
  gRNA
acaucugugucguaucauga

SEQ ID NO: 132506 - RNA, 20 nt, Artificial Sequence
  mmSKRIPTE0003285_Sox11_9
  gRNA
acacgucaagaaucguuaca

SEQ ID NO: 132507 - RNA, 20 nt, Artificial Sequence
  mmSKRIPTE0003286_Trim27_1
  gRNA
acguucacuuccucacggag

SEQ ID NO: 132508 - RNA, 20 nt, Artificial Sequence
  mmSKRIPTE0003287_Trim27_2
  gRNA
caccgaacuaaacguagcug

SEQ ID NO: 132509 - RNA, 20 nt, Artificial Sequence
  mmSKRIPTE0003288_Trim27_3
  gRNA
uucagccuaagcuacucggg

SEQ ID NO: 132510 - RNA, 20 nt, Artificial Sequence
  mmSKRIPTE0003289_Trim27_4
  gRNA
cuguaggagaugcccaccag

SEQ ID NO: 132511 - RNA, 20 nt, Artificial Sequence
  mmSKRIPTE0003290_Trim27_5
  gRNA
aaaauggcgagccggacgug

SEQ ID NO: 132512 - RNA, 20 nt, Artificial Sequence
  mmSKRIPTE0003291_Trim27_6
  gRNA
aaucaguacccaauugacac

SEQ ID NO: 132513 - RNA, 20 nt, Artificial Sequence
  mmSKRIPTE0003292_Trim27_7
  gRNA
ucugagaagagaguccagcg

SEQ ID NO: 132514 - RNA, 20 nt, Artificial Sequence
  mmSKRIPTE0003293_Trim27_8
  gRNA
caucugcucggccuccaaug

SEQ ID NO: 132515 - RNA, 20 nt, Artificial Sequence
  mmSKRIPTE0003294_Trim27_9
  gRNA
gcuacuuggaaccuauacaa

SEQ ID NO: 132516 - RNA, 20 nt, Artificial Sequence
  mmSKRIPTE0003295_Nfam1_1
  gRNA
cuaaccgggagacugaacgc

SEQ ID NO: 132517 - RNA, 20 nt, Artificial Sequence
  mmSKRIPTE0003296_Nfam1_2
  gRNA
acaagcuucugggcuagccg

SEQ ID NO: 132518 - RNA, 20 nt, Artificial Sequence
  mmSKRIPTE0003297_Nfam1_3
  gRNA
ugaagcuaacggaaccgcaa

SEQ ID NO: 132519 - RNA, 20 nt, Artificial Sequence
  mmSKRIPTE0003298_Nfam1_4
  gRNA
gcuuagggugaggcacggug

SEQ ID NO: 132520 - RNA, 20 nt, Artificial Sequence
  mmSKRIPTE0003299_Nfam1_5
  gRNA
uuagcgcuuagugcgcacug

SEQ ID NO: 132521 - RNA, 20 nt, Artificial Sequence
  mmSKRIPTE0003300_Nfam1_6
  gRNA
ccggcaccugacuagcugug

SEQ ID NO: 132522 - RNA, 20 nt, Artificial Sequence
  mmSKRIPTE0003301_Nfam1_7
  gRNA
agacucgcccacuuacccag

SEQ ID NO: 132523 - RNA, 20 nt, Artificial Sequence
  mmSKRIPTE0003302_Nfam1_8
  gRNA
aagcugcccuaguggccuag

SEQ ID NO: 132524 - RNA, 20 nt, Artificial Sequence
  mmSKRIPTE0003303_Nfam1_9
  gRNA
ccuacagcgucgagagacgg

SEQ ID NO: 132525 - RNA, 20 nt, Artificial Sequence
  mmSKRIPTE0003304_H2-M5_1
  gRNA
ccuuucacaucccuuacgga

SEQ ID NO: 132526 - RNA, 20 nt, Artificial Sequence
  mmSKRIPTE0003305_H2-M5_2
  gRNA
uugugguccaaauacgaccg

SEQ ID NO: 132527 - RNA, 20 nt, Artificial Sequence
  mmSKRIPTE0003306_H2-M5_3
  gRNA
cgugcuucucaugcccacgg

SEQ ID NO: 132528 - RNA, 20 nt, Artificial Sequence
  mmSKRIPTE0003307_H2-M5_4
  gRNA
gcacucaccugcgcgaacca

SEQ ID NO: 132529 - RNA, 20 nt, Artificial Sequence
  mmSKRIPTE0003308_H2-M5_5
  gRNA
cagcaugucaucauucgaca

SEQ ID NO: 132530 - RNA, 20 nt, Artificial Sequence
  mmSKRIPTE0003309_H2-M5_6
  gRNA
aaggaacucaaagguuacgg

SEQ ID NO: 132531 - RNA, 20 nt, Artificial Sequence
  mmSKRIPTE0003310_H2-M5_7
  gRNA
ucuagaccuucuaaacacgg

SEQ ID NO: 132532 - RNA, 20 nt, Artificial Sequence
  mmSKRIPTE0003311_H2-M5_8
  gRNA
ugggaauggugugcuuagaa

SEQ ID NO: 132533 - RNA, 20 nt, Artificial Sequence
  mmSKRIPTE0003312_H2-M5_9
  gRNA
cccccgccccugaaguguag
